US007700838B1

(12) United States Patent
Corbin et al.

(10) Patent No.: US 7,700,838 B1
(45) Date of Patent: Apr. 20, 2010

(54) BACILLUS THURINGIENSIS CHROMOSOMAL GENOME SEQUENCES AND USES THEREOF

(75) Inventors: David R. Corbin, Chesterfield, MO (US); Thomas M. Malvar, Troy, MO (US); Hridayabhiranjan Shukla, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 332 days.

(21) Appl. No.: 11/049,404

(22) Filed: Feb. 2, 2005

Related U.S. Application Data

(62) Division of application No. 09/663,779, filed on Sep. 15, 2000, now abandoned.

(60) Provisional application No. 60/154,678, filed on Sep. 17, 1999.

(51) Int. Cl.
  A01H 1/00 (2006.01)
  C07H 21/04 (2006.01)
  C07K 14/415 (2006.01)
  C12N 15/00 (2006.01)

(52) U.S. Cl. .................... 800/295; 435/6; 435/468; 435/419; 435/320.1; 435/183; 530/370; 536/23.1; 536/23.6; 800/278

(58) Field of Classification Search .............. None
See application file for complete search history.

(56) References Cited

U.S. PATENT DOCUMENTS

| | | | |
|---|---|---|---|
| 5,706,498 | A | 1/1998 | Fujimiya et al. |
| 6,037,123 | A | 3/2000 | Benton et al. |
| 6,118,050 | A * | 9/2000 | Sturner et al. ............. 800/298 |
| 6,242,669 | B1 | 6/2001 | Feitelson et al. |
| 6,562,958 | B1 * | 5/2003 | Breton et al. ............. 536/23.7 |
| 7,297,541 | B2 * | 11/2007 | Moshiri et al. ............. 435/419 |

OTHER PUBLICATIONS

Andrup et al., Complete Nucleotide Sequence of the *Bacillus thuringiensis* subsp. *Israelensis* Plasmid pTX14-3 and Its Correlation with Biological Properties, *Plasmid* 31:72-88 (1994).

Blattner et al., The Complete Genome Sequence of *Escherichia coli* K-12, *Science* 277:1453-1462 (1997).

Kunst et al., The complete genome sequence of the Gram-positive bacterium *Bacillus subtilis*, *Nature* 390:249-256 (1997).

Meijer et al., Characterization of single strand origins of cryptic rolling-circle plasmids from *Bacillus subtilis*, *Nucleic Acids Research* 23:612-619 (1995).

Monod et al., Sequence and Properties of pIM13, a Macrolide-Lincosamide-Streptogramin B Resistance Plasmid from *Bacillus subtisil*, *Journal of Bacteriology* 167:138-147 (1986).

Muller et al., Complete nucleotide sequences of *Bacillus* plasmids pUB110dB, pRBH1 and its copy mutants, *Mol. Gen. Genet.* 202:169-171 (1986).

Nakayama et al., Complete Nucleotide Sequence of pSTK1, a Cryptic Plasmid from *Bacillus stearothermophilus* TK015, *Biotechnology Letters* 15:1013-1016 (1993).

Noguchi et al., Determination of the complete nucleotide sequence of pNS1, a staphylococcal tetracycline-resistance plasmid propagated in *Bacillus subtilis*, *FEMS Microbiology Letters* 37:283-288 (1986).

Okinaka et al., Sequence, assembly and analysis of pX01 and pX02, *Journal of Applied Microbiology* 87:261-262 (1999).

Okinaka et al., Sequence and Organization of pX01, the Large *Bacillus antracis* Plasmid Harboring the Anthrax Toxin Genes, *Journal of Bacteriology* 181:6509-6515 (1999).

Takami et al., Complete genome sequence of the alkaliphilic bacterium *Bacillus halodurans* and genomic sequence comparison with *Bacillus subtilis*, *Nucleic Acids Research* 28:4317-4331 (2000).

* cited by examiner

*Primary Examiner*—Phuong T Bui
(74) *Attorney, Agent, or Firm*—Timothy K. Ball, Esq.; Howrey LLP

(57) ABSTRACT

The present invention relates to nucleic acid sequences from *Bacillus thuringiensis* and, in particular, to genomic DNA sequences. The invention encompasses nucleic acid molecules present in non-coding regions as well as nucleic acid molecules that encode proteins, fragments of proteins, tRNA's, fragments of tRNA's, rRNA's and fragments of rRNA's. In addition, proteins and fragments of proteins so encoded and antibodies capable of binding the proteins are encompassed by the present invention. The invention also relates to methods of using the disclosed nucleic acid molecules, proteins, fragments of proteins, RNA's, and antibodies, for example, for gene identification and analysis, and preparation of constructs.

19 Claims, No Drawings

BACILLUS THURINGIENSIS CHROMOSOMAL GENOME SEQUENCES AND USES THEREOF

CROSS-REFERENCE TO RELATED APPLICATIONS

This application is a divisional application of non-provisional U.S. application Ser. No. 09/663,779, filed Sep. 15, 2000, now abandoned which claims priority under 35 U.S.C. §119(e) to U.S. Provisional Application Ser. No. 60,154,678 filed on Sep. 17, 1999, the entire contents of which are incorporated herein by reference.

FIELD OF THE INVENTION

The present invention relates to nucleic acid sequences from *Bacillus thuringiensis* and, in particular, to chromosomal genomic DNA sequences. The invention encompasses nucleic acid molecules present in non-coding regions as well as nucleic acid molecules that encode proteins and fragments of proteins. Nucleic acid sequences that encode proteins and/or enzymes and homologues and fragments thereof are encompassed by the invention including but not limited to insect inhibitory proteins, proteins capable of conferring antibiotic resistance, microbial inhibitory proteins including bactericidal, bacteriostatic, fungicidal, and fungistatic proteins, polyketide synthases, transposons and mobile genetic elements and their corresponding transposases, excisases and integrases, phage and phage particle proteins, other useful protein homologues, ribosomal RNA (rRNA), and transfer RNA (tRNA). In addition, proteins and fragments thereof so encoded and antibodies capable of binding the proteins are encompassed by the present invention. The invention also relates to methods of using the disclosed nucleic acid molecules, proteins, fragments of proteins, and antibodies, for example, for gene identification and analysis, preparation of constructs, transformation of cells with nucleotide compositions disclosed herein to produce *Bacillus thuringiensis* proteins or fragments thereof, in particular novel insect inhibitory, bactericidal, fungicidal and nematicidal proteins.

BACKGROUND OF THE INVENTION

*Bacillus thuringiensis* is a spore-forming Gram-positive bacterium. During sporulation, *B. thuringiensis* produces proteinaceous inclusions which are composed of proteins known as insecticidal crystal proteins (ICPs), Cry proteins, or delta-endotoxins. These proteins are toxic to a variety of insect species including orders Lepidoptera, Coleoptera, Diptera, Hemoptera, Hymenoptera, Orthoptera, and Mallophaga and to nematodes, mites, and protozoa (Beegle and Yamamoto, *Can. Entomol.* 124:587-616; Feitelson, Advanced Engineered Pesticides (L. Kim, ed.), Marcel Dekker, Inc., New York (1993), pp. 63-71; Feitelson, et al., *Bio/Technology* 10:271-275; U.S. Pat. No. 4,948,734 (1990)). Due to their high specificity for particular insect pests and their safety for man and the environment, ICPs have been used as biopesticides for the last three decades. Using molecular genetic techniques, numerous delta-endotoxin genes have been isolated and their DNA sequences determined. The cloning and sequencing of a number of δ-endotoxin genes from a variety of *B. thuringiensis* strains has been described and are summarized by Schnepf et al. (*Microbiol. Mol. Biol. Rev.* 62:775-806, *Bacillus thuringiensis* And Its Pesticidal Crystal Proteins, 1998). The nomenclature and appearance of newly identified genes is summarized and regularly updated at by Crickmore, N., Zeigler, D. R., Schnepf, E., Van Rie, J., Lereclus, D., Baum, J, Bravo, A. and Dean, D. H. "*Bacillus thuringiensis* toxin nomenclature" at the University of Sussex Department of Biology web site biols.susx.ac.uk/home/neil_crickmore/bt. These genes have been used to develop certain genetically engineered *B. thuringiensis* products that are in commercial use. Recent developments have seen new δ-endotoxin delivery systems developed, including genetically engineered plants that contain and express δ-endotoxin genes. *Bacillus thuringiensis* is a key source of genes, which when modified can be used for transgenic expression to provide pest resistance in plants.

*B. thuringiensis* strains are classified into subspecies or varieties, based on biochemical and serological criteria (de Barjac, *Entomophaga* 7: 5-61 (1962); de Barjac, *Proceedings of the IIIrd International Colloquium on Invertebrate Pathology* (C. C. Payne and H. D. Burges, eds.), Society for Insect Pathology, U.K., 451-453 (1982)) Each subspecies may produce one or several insecticidal protein toxins. To date, approximately 172 δ-endotoxins belonging to 28 classes have been identified. There is also a nonprotein toxin, the β-exotoxin, secreted by some *B. thuringiensis* strains. This toxin, which is assayed on house fly larvae (Sêbesta et al., "Thuringiensin, the β-exotoxin of *Bacillus thuringiensis*," in W.H. Burgess (ed.), *Microbial Control of Pests and Plant Diseases, 1970-1980*, Academic Press, Inc., New York, pp. 249-281 (1981)), is not as selective as the δ-endotoxins.

Extensive studies have been carried out with *B. thuringiensis* subspecies that produce proteinaceous inclusions during sporulation. The inclusions are often bipyramidal, but some are cuboidal or multifaceted, and there is a wide variety of other morphologies. Some strains contain more than one type of inclusion in each cell. These inclusions are present within the mother cell adjacent to the spore, but in a few subspecies, they are localized within the exosporium (Aronson et al., *Bacteriol. Rev.* 40:360-402 (1976)). Inclusions are released, as is the spore, upon cell lysis.

*Bacillus* strains can have a chromosomal genome size of 2.4 to 5.7 Mbp (Carlson, et al., *Appl. Environ. Microbiol.* 60: 1719-1725 (1994)). Physical maps of chromosomes of two *B. thuringiensis* strains, *B. thuringiensis* subsp. *Berliner* 1715 and *B. thuringiensis* subsp. *Thuringiensis* HD2, have been constricted and are estimated to be between 5.4 and 5.7 Mbp (Carlson, et al, *Microbiol.* 142: 1625-1634 (1996); Carlson and Kolstø, J. Bacteriol. 175: 1053-1060 (1993)). The total genomes of each of these two strains consist of one or more chromosomes, and a more variable component comprised of extrachromosomal elements (Carlson and Kolstø, *Mol. Microbiol.* 13:161-169 (1994)).

Most *B. thuringiensis* isolates have several extrachromosomal elements, some of them circular plasmids and others linear (Carlson, et al., *Microbiol.* 60: 1719-1725 (1994)). In general, crystal-protein genes are localized on large plasmids (ca. 40 to 200 Mda) of *B. thuringiensis* (Gonzalez, et al., *Plasmid* 5: 351-365 (1981); Carlton and Gonzalez, Molecular Biology of Microbial Differentiation, American Society for Microbiology, Washington, D.C. 246-252 (1985), Kronstad, et al., J Bacteriol. 154: 419-428 (1983)), and in some cases, more than one gene is present on a given plasmid (Aronson et al., *Bacteriol. Rev.* 40:360-402 (1976); Carlton et al., "The genetics and molecular biology of *Bacillus thuringiensis*," in D. A. Dubnau (ed.), *The Molecular Biology of the Bacilli*, Vol. II, Academic Press, Inc., New York, pp. 211-249 (1985)). However, chromosomal crystal-protein genes have been reported in some *B. thuringiensis* strains (Carlson and Kolstø, J. Bacteriol. 175: 1053-1060 (1993), Klier, et al., EMBO J 1: 791-799 (1982), Kronstad, et al., J Bacteriol. 154: 419-428 (1983)).

Bacillus thuringiensis strains often contain multiple epigenetic elements which are known to harbor genes expressing vegetative insecticidal proteins (VIP's) and Bt crystalline insecticidal and nematocidal proteins. It is believed that many other Bt insecticidal/nematocidal genes are present within these sequences, some of which may only be expressed under conditions which cannot be artificially simulated, some of which may be cryptic, and some of which may be actively expressed but which have not been previously identified due to their limited availability as a result of very low levels of expression. Identification of whole or substantial portions of DNA sequences of individual plasmids would greatly facilitate identification of genes encoding novel insect inhibitory proteins. However, when one tries to isolate and purify plasmid DNA of a B. thuringiensis species for constructing genomic DNA libraries used in sequencing, it would be difficult to eliminate the contamination of chromosomal DNA. Such contamination would complicate greatly the sequencing effort of individual plasmids and subsequently hinder construction of genetic maps of individual plasmids of the B. thuringiensis species. Thus, it would be desirable to generate the complete DNA sequence of the chromosomal genome exclusive of epigenetic sequences of a B. thuringiensis species, because the complete DNA sequence of the chromosome could be used as a background to significantly minimize the interference of chromosomal DNA sequences in identification of whole or a substantial portion of individual plasmids and of novel genes encoding insect inhibitory proteins.

Furthermore, although it is unexpected that the complete DNA sequence of the Bacillus thuringiensis chromosomal genome exclusive of epigenetic sequences would provide a substantial number of Bt crystalline insecticidal/nematocidal and VIP genes for second generation insect/pest control in crop species, comparison of the open reading frames present within the Bacillus thuringiensis chromosomal genome with other bacterial genome sequences, in particular other. Bacillus species genomic sequences would allow the subtraction of common sequences and thus the identification of sequences novel and unique to Bacillus thuringiensis, and which may play a role in the regulation of expression or activity of genes encoding insecticidal proteins, and may also provide a plethora of useful genes for future insect resistance management technologies and applications. Therefore, it is advantageous to generate the complete DNA sequence of the chromosomal genome exclusive of epigenetic sequences of a B. thuringiensis species.

Chromosomal genome sequence information from B. thuringiensis allows comparisons of those sequences with sequences from other B. thuringiensis strains as well as comparisons with DNA sequences from other organisms, including plants, mammals such as humans, bacteria, and fungi such as yeasts. In addition, genome sequencing and mapping provides increased opportunities for identification and isolation of agents of commercial interest, as well as insight into mechanisms of genome interactions.

SUMMARY OF THE INVENTION

The present invention provides an isolated and purified nucleic acid molecule having a first nucleotide sequence, wherein: (1) the first nucleotide sequence hybridizes under stringent conditions to a second nucleotide sequence selected from the group consisting of SEQ ID NO: 1 through SEQ ID NO: 8283 or complement thereof, wherein the hybridizing portion of the second nucleotide sequence is at least 50 nucleotides in length; (2) the first nucleotide sequence is a portion of third nucleotide sequence selected from the group consisting of SEQ ID NO:1 through SEQ ID NO: 8283; or (3) the first nucleotide sequence is the complement of (1) or (2).

In a preferred embodiment, the hybridizing portion of the second nucleotide sequence is at least 100 nucleotides in length. In a more preferred embodiment, the hybridizing portion of the second nucleotide sequence is at least 200 nucleotides in length. In a further more preferred embodiment, the hybridizing portion of the second nucleotide sequence encodes any polypeptide or protein or set forth in Table 1.

The present invention also provides an isolated and purified nucleic acid molecule comprising a nucleotide sequence, wherein: (1) the nucleotide sequence encodes any polypeptide or protein set forth in Table 1; or (2) the nucleotide sequence is the complement of (1).

The present invention, in another aspect, provides a substantially purified polypeptide or protein comprising an amino acid sequence, wherein the amino acid sequence is defined as follows: (1) the amino acid sequence is encoded by a first nucleotide sequence which specifically hybridizes to the complement of a second nucleotide sequence selected from the group consisting of SEQ ID NO: 1 through SEQ ID NO: 8283; or (2) the amino acid sequence is encoded by a third nucleotide sequence that is at least 50% identical to a portion of the complement of a sequence selected from the group consisting of SEQ ID NO: 1 through SEQ ID NO: 8283. In alternative embodiments, the above described third nucleotide sequence is at least 55% identical, at least 60% identical, at least 65% identical, at least 70% identical, at least 75% identical, at least 80% identical, at least 85% identical, at least 90% identical, or at least 95% identical to a portion of a sequence selected from the group consisting of SEQ ID NO: 1 through SEQ ID NO: 8283; and, the above described third nucleotide sequence is identical to a portion of a sequence selected from SEQ ID NO: 1 through SEQ ID NO: 8283.

The present invention also provides a recombinant construct comprising: (A) a promoter region which functions in a host cell to cause the production of an mRNA molecule; which is operably linked to (B) a structural nucleotide sequence, wherein the structural nucleotide sequence encodes a polypeptide or protein set forth in Table 1; which is operably linked to (C) a 3' non-translated sequence that functions in said cell to cause termination of transcription.

The present invention also provides a recombinant construct comprising: (A) a promoter region which functions in a host cell to cause the production of an mRNA molecule wherein the promoter region is selected from the group consisting of promoter sequences located within SEQ ID NO: 1 through SEQ ID NO: 8283 or complements thereof; which is linked to (B) a structural nucleotide sequence encoding a polypeptide; which is linked to (C) a 3' non-translated sequence that functions in said cell to cause termination of transcription.

The present invention also provides a transformed cell having an exogenous nucleic acid molecule which comprises: (A) a promoter region which functions in said cell to cause the production of an mRNA molecule; which is operably linked to (B) a structural nucleic acid molecule, wherein the structural nucleotide encodes any polypeptide or protein set forth in Table 1; which is operably linked to (C) a 3' non-translated sequence that functions in said cell to cause termination of transcription.

The present invention also provides a transformed cell having an exogenous nucleic acid molecule which comprises: (A) a promoter region which functions in said cell to cause the production of an mRNA molecule wherein the promoter region is selected from the group consisting of promoter sequences located within SEQ ID NO: 1 through SEQ ID NO: 8283 or complements thereof; which is operably linked to (B) a structural nucleotide sequence encoding a polypeptide; which is operably linked to (C) a 3' non-translated sequence that functions in said cell to cause termination of transcription.

The present invention also provides a plant cell, a mammalian cell, a bacterial cell, an algal cell, an insect cell and a fungal cell transformed with an isolated nucleic acid molecule of the present invention.

The invention also provides isolated nucleic acid molecules comprising nucleotide sequences encoding polypeptides or proteins exhibiting insect inhibitory activity, wherein said activity is manifested by inhibiting the growth or development of, or contributing substantially to, or causing the death of a Coleopteran, a Dipteran, a Lepidopteran, a Hemipteran, a Hymenopteran, or a sucking and piercing insect or insect larvae thereof. Also provided are nucleotide sequences encoding novel proteins comprising polypeptides which augment the activity of polypeptides exhibiting insect inhibitory activity when fed to Coleopteran, Dipteran, Lepidopteran, Hemipteran, Hymenopteran, or sucking and piercing insects or insect larvae thereof.

The present invention also provides a method for using insect inhibitory proteins for controlling target insect pests, i.e. also known as insect pest control.

The present invention also provides a computer readable medium having recorded thereon one or more nucleotide sequences, wherein each of the nucleotide sequences is selected from the group consisting of SEQ ID NO: 1 through SEQ ID NO: 8283 or complements thereof.

The present invention also provides a computer readable medium having recorded thereon one or more of the nucleotide sequences encoding a protein or fragment thereof set forth in Table 1.

The present invention also provides a method for using the computer media of the present invention in isolating/identifying nucleic acids encoding insect inhibitory proteins, or proteins involved in biosynthesis of antibiotics.

The present invention also provides a method for identifying one or more genes encoding insect inhibitory proteins in the sequences of one or more plasmids of a *Bacillus thuringiensis*, wherein the method of the present invention comprises the steps of a) isolating and purifying plasmid DNA; b) constructing a DNA library from the isolated and purified plasmid DNA; c) sequencing the DNA library to obtain a set of plasmid DNA sequences; d) comparing the set of DNA sequences with a set of chromosomal DNA sequences, wherein the set of chromosomal DNA sequences comprises the group consisting of SEQ ID No: 1 through SEQ ID No: 8283; e) identify common sequences, which are identified both in the set of plasmid DNA sequences and in the set of chromosomal DNA sequences; f) subtracting the common sequences from the set of plasmid DNA sequences to obtain a subtracted set of plasmid DNA sequences; g) assembling the subtracted set of DNA sequences to obtain contigs and sequence assemblies; h) determining open reading frames in the contigs and sequence assemblies; and h) identifying one or more genes encoding insect inhibitory proteins in the sequences of one or more plasmids of said *Bacillus thuringiensis*.

The present invention also provides a method for identifying plasmid DNA sequences of a *Bacillus* species, the method comprising the steps of a) identifying a *Bacillus* species strain which does not contain plasmid DNA; b) generating a library of chromosomal genomic DNA from said *Bacillus* species strain which does not contain plasmid DNA; c) obtaining the nucleotide sequence of said chromosomal genomic DNA; d) identifying a *Bacillus* species strain which contains plasmid DNA; e) generating a library of said *Bacillus* species plasmid DNA; f) obtaining the nucleotide sequence of said plasmid DNA; g) subtracting any common sequences identified in the plasmid DNA which are also identified in the chromosomal genomic DNA; and h) constructing a contig sequence or sequence assemblies of said plasmid DNA, wherein said contig sequence or sequence assemblies comprise the plasmid DNA sequence of said *Bacillus* species.

DETAILED DESCRIPTION OF THE INVENTION

Agents of the Present Invention

Nucleic Acid Molecules

One aspect of the present invention relates to an isolated nucleic acid molecule having a first nucleotide sequence, wherein: (1) the first nucleotide sequence hybridizes under stringent conditions to a second nucleotide sequence selected from the group consisting of SEQ ID NO: 1 through SEQ ID NO: 8283 or complements thereof, wherein the hybridizing portion of the second nucleotide sequence is at least 50 nucleotides in length; (2) the first nucleotide sequence is a portion of any sequence selected from the group consisting of SEQ ID NO:1 through SEQ ID NO: 8283; or (3) the first nucleotide sequence is the complement of (1) or (2).

The term "nucleic acid" means a single or double-stranded polymer of deoxyribonucleotide or ribonucleotide bases read from the 5' to the 3' end. Nucleic acids may also optionally contain synthetic, non-natural or altered nucleotide bases that permit correct read through by a polymerase and do not alter expression of a polypeptide encoded by that nucleic acid.

The term "an isolated nucleic acid" refers to a nucleic acid that is no longer accompanied by some of materials with which it is associated in its natural state or to a nucleic acid the structure of which is not identical to that of any of naturally occurring nucleic acid. Examples of an isolated nucleic acid include but are not limited to: (1) DNAs which have the sequence of part of a naturally occurring genomic DNA molecules but are not flanked by two coding sequences that flank that part of the molecule in the genome of the organism in which it naturally occurs; (2) a nucleic acid incorporated into a vector or into the genomic DNA of a prokaryote or eukaryote in a manner such that the resulting molecule is not identical to any naturally occurring vector or genomic DNA; (3) a separate molecule such as a cDNA, a genomic fragment, a fragment produced by polymerase chain reaction (PCR), or a restriction fragment; (4) recombinant DNAs; and (5) synthetic DNAs. An isolated nucleic acid may also be comprised of one or more segments of cDNA, genomic DNA or synthetic DNA.

It is also contemplated by the inventors that the isolated nucleic acids of the present invention may also include known types of modifications, for example, labels which are known in the art, methylation, "caps", substitution of one or more of the naturally occurring nucleotides with an analog. Other known modifications include inter-nucleotide modifications, for example, those with uncharged linkages (methyl phosphonates, phosphotriesters, phosphoamidates, carbamates, etc.) and with charged linkages (phosphorothioates, phosphorodithioates, etc.), those containing pendant moieties, such as, proteins (including nucleases, toxins, antibodies, signal peptides, poly-L-lysine, etc.), those with intercalators (acridine, psoralen, etc.), those containing chelators (metals, radioactive metals, boron, oxidative metals, etc.), those containing alkylators, and those with modified linkages.

The term "nucleotide sequence" refers to both the sense and antisense strands of a nucleic acid as either individual single strands or in the duplex. It includes, but is not limited to, self-replicating plasmids, chromosomal sequences, and infectious polymers of DNA or RNA.

A nucleotide sequence is said to be the "complement" of another nucleotide sequence if they exhibit complete complementarity. As used herein, molecules are said to exhibit "complete complementarity" when every nucleotide of one of the sequences is complementary to a nucleotide of the other.

A "coding sequence" or "structural nucleotide sequence" is a nucleotide sequence which is translated into a polypeptide, usually via mRNA, when placed under the control of appropriate regulatory sequences. The boundaries of the coding sequence are determined by a translation start codon at the 5'-terminus and a translation stop codon at the 3'-terminus. A coding sequence can include, but is not limited to, genomic DNA, cDNA, and recombinant polynucleotide sequences.

The term "recombinant DNAs" refers to DNAs that contains a genetically engineered modification through manipulation via mutagenesis, restriction enzymes, and the like.

The term "synthetic DNAs" refers to DNAs assembled from oligonucleotide building blocks that are chemically synthesized using procedures known to those skilled in the art. These building blocks are ligated and annealed to form DNA segments which are then enzymatically assembled to construct the entire DNA. "Chemically synthesized", as related to a sequence of DNA, means that the component nucleotides were assembled in vitro. Manual chemical synthesis of DNA may be accomplished using well established procedures, or automated chemical synthesis can be performed using one of a number of commercially available machines.

The term "stringent conditions" or "stringent hybridization conditions" refers to conditions under which a probe will hybridize to its target sequence, to a detectable greater degree than other sequences (e.g., at least 2 fold over background). Stringent conditions are sequence dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of complementary to the probe are detected (heterologous probing).

Typically, stringent conditions will be those in which the salt concentration is less than about 1.5 M monovalent cation (e.g., Na$^+$), typically about 0.01 to 1.0 M monovalent cation concentration at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$, can be approximated from the equation of Meinkoth and Wahl, *Anal. Biochem.*, 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, $T_m$ hybridization and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$ those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. Appropriate stringent conditions are known to those skilled in the art or can be found in *Current Protocols in Molecular Biology*, John Wiley & Sons, N.Y. (1989), 6.3.1-6.3.6.

The hybridization portion of the two hybridizing nucleic acids is usually at least 40 nucleotides in length, more usually at least about 75 nucleotides in length, more particularly at least 100 nucleotides in lengths. The hybridizing portion of the hybridizing nucleic acid is at least 80%, at least 90%, or at least 98% identical to the sequence of a portion of a sequence set forth in SEQ ID NO: 1 to SEQ ID NO: 8283.

Another aspect of the present invention relates to an isolated nucleic acid molecule comprising one or more open reading frames listed in Table 1. An "open reading frame" (ORF) is a region of a nucleotide sequence which encodes a polypeptide. This region may represent a portion of a coding sequence or a total coding sequence. Table 1 sets forth a list of open reading frames identified in the isolated nucleic acid molecules, wherein the open reading frames encode *Bacillus thuringiensis* proteins or polypeptide or fragments thereof which are homologues of known proteins or unknown proteins, or of tRNA's or rRNA's or fragments thereof which are homologues of known tRNA's or rRNA's.

Open reading frames in genomic sequences can be screened for the presence of protein homologues utilizing a number of different search algorithms that have been developed, one example of which is the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology* 12:76-80 (1994); Birren et al., *Genome Analysis* 1:543-559 (1997)). Other examples of suitable programs that can be utilized are well known in the art. In addition, unidentified reading frames may be screened for by gene prediction software such as GenScan, which is located at the Stanford University web site gnomic.Stanford.edu/GEN- SCANW.html. Novel genes, i.e., with no known homologs, can be predicted with the program GeneMark, which calculates the probability of a gene based on the presence of a gene-like 'grammar' in the DNA sequence (i.e., start and stop signals, and a significant open reading frame) and statistical analyses of protein-coding potential through biases in putative codon usage (see the Georgia Tech University web site genemark.biology.gatech.edu/GeneMark for details).

The present invention also provides an isolated nucleic acid molecule comprising a first nucleotide sequence, wherein: (1) the first nucleotide sequence hybridizes under stringent conditions to a second nucleotide sequence, wherein the hybridizing portion of the second nucleotide sequence encodes any polypeptide or protein set forth in Table 1; or (2) the first nucleotide sequence is the complement of (1) or (2).

In one embodiment, an isolated nucleic acid molecule comprises a nucleotide sequence, wherein the nucleotide sequence encodes any polypeptide or protein set forth in Table 1.

The term "polypeptide" or "protein" refers to a linear polymer composed of amino acids connected by peptide bonds.

By "substantial identical" or "substantially identical" as used in reference to two amino acid sequences, it is meant that one amino acid sequence is identical to the other amino acid sequence or has at least 50% sequence identity, at least 70% sequence identity, preferably at least 80%, more preferably at least 90%, and most preferably at least 95% identity when compared to the other amino acid sequence as a reference sequence using the programs described herein; preferably BLAST using standard parameters, as described below.

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

Polypeptides which are "substantially similar" share sequences as noted above except that residue positions which are not identical may differ by conservative amino acid changes. Conservative amino acid substitutions refer to the interchangeability of residues having similar side chains. "Conservative amino acid substitutions" refer to substitutions of one or more amino acids in a native amino acid sequence with another amino acid(s) having similar side chains, resulting in a silent change. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine, valine-isoleucine, phenylalanine-tyrosine, lysine-arginine, alanine-valine, aspartic acid-glutamic acid, and asparagine-glutamine.

Optimal alignment of sequences for comparison can use any means to analyze sequence identity (homology) known in the art, e.g., by the progressive alignment method of termed "PILEUP" (Morrison, Mol. Biol. Evol. 14:428-441 (1997), as an example of the use of PILEUP); by the local homology algorithm of Smith & Waterman (Adv. Appl. Math. 2: 482 (1981)); by the homology alignment algorithm of Needleman & Wunsch (J. Mol. Biol. 48:443 (1970)); by the search for similarity method of Pearson (Proc. Natl. Acad. Sci. USA 85: 2444 (1988)); by computerized implementations of these algorithms (e.g., GAP, BESTFIT, FASTA, and TFASTA in the Wisconsin Genetics Software Package, Genetics Computer Group, 575 Science Dr., Madison, Wis.); ClustalW (CLUSTAL in the PC/Gene program by Intelligenetics, Mountain View, Calif., described by, e.g., Higgins, Gene 73: 237-244 (1988); Corpet, Nucleic Acids Res. 16:10881-10890 (1988); Huang, Computer Applications in the Biosciences 8:155-165 (1992); and Pearson, Methods in Mol. Biol. 24:307-331 (1994); Pfam (Sonnhanuner, Nucleic Acids Res. 26:322-325 (1998); TreeAlign (Hein, Methods Mol. Biol. 25:349-364 (1994); MES-ALIGN, and SAM sequence alignment computer programs; or, by manual visual inspection.

Another example of algorithm that is suitable for determining sequence similarity is the BLAST algorithm, which is described in Altschul et al, J. Mol. Biol. 215: 403-410 (1990). Software for performing BLAST analyses is publicly available through the National Center for Biotechnology Information (NCBI) web site ncbi.nlm.nih.gov; see also Zhang, Genome Res. 7:649-656 (1997) for the "PowerBLAST" variation. This algorithm involves first identifying high scoring sequence pairs (HSPs) by identifying short words of length W in the query sequence that either match or satisfy some positive valued threshold score T when aligned with a word of the same length in a database sequence. T is referred to as the neighborhood word score threshold (Altschul et al, J. Mol. Biol. 215: 403-410 (1990)). These initial neighborhood word hits act as seeds for initiating searches to find longer HSPs containing them. The word hits are extended in both directions along each sequence for as far as the cumulative alignment score can be increased. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLAST program uses as defaults a wordlength (W) of 11, the BLOSUM62 scoring matrix (see Henikoff, Proc. Natl. Acad. Sci. USA 89:10915-10919 (1992)) alignments (B) of 50, expectation (E) of 10, M=5, N=−4, and a comparison of both strands. The term BLAST refers to the BLAST algorithm which performs a statistical analysis of the similarity between two sequences; see, e.g., Karlin, Proc. Natl. Acad. Sci. USA 90:5873-5787 (1993). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

One skilled in the art will recognize that these values of sequence identity can be appropriately adjusted to determine corresponding sequence identity of two nucleotide sequences encoding the proteins of the present invention by taking into account codon degeneracy, conservative amino acid substitutions, reading frame positioning and the like. Substantial identity of nucleotide sequences for these purposes normally means sequence identity of at least 40%, preferably at least 60%, more preferably at least 90%, and most preferably at least 95%.

The term "codon degeneracy" refers to divergence in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for expression in a host cell, it is desirable to design the gene such that its frequency of codon usage approaches the frequency of preferred codon usage of the host cell.

The present invention also includes an isolated nucleic acid comprising a nucleotide sequence encoding a polypeptide set forth in Table 1, wherein the an amino acid sequence of the protein or polypeptide contains one or more conservative amino acid substitutions.

In a preferred embodiment of the present invention, the isolated nucleic acid molecule comprising a nucleotide sequence which encodes an insect inhibitory protein or polypeptide or fragment thereof.

In a preferred embodiment of the present invention, the isolated nucleic acid molecule comprising a nucleotide sequence encoding all or substantial portion of a sigma factor homologue listed in Table 2.

The term "insect inhibitory protein" refers to any polypeptide or protein or a substantial portion thereof that exhibits insect inhibitory activity, wherein said activity is manifested by inhibiting the growth or development of, or contributing substantially to, or causing the death of a Coleopteran, a Dipteran, a Lepidopteran, a Hemipteran, a Hymenopteran, or a sucking and piercing insect or insect larvae thereof.

The term "insect inhibitory protein" also refers to any polypeptide or protein with modified amino acid sequence, such as sequence which has been mutated, truncated, increased and the like and which maintains at least the insect inhibitory activity associated with the native protein. Accordingly, the isolated nucleic acids encoding those polypeptide or protein with such modification are also within the scope of the present invention.

In a preferred embodiment of the present invention, the isolated nucleic acid molecule comprising a nucleotide sequence which encodes whole or a portion of a protein homologue capable of conferring antibiotic resistance or resistance to heavy metals or other chemicals, wherein the nucleotide sequence is any sequence set forth in SEQ ID NOs: 33, 98, 145, 162, 180, 204, 275, 298, 361, 397, 421, 423, 579, 613, 624, 692, 726, 862, 930, 950, 986, 995, 1005, 1023, 1130, 1188; 1190, 1208, 1226, 1227, 1240, 1246, 1246, 1257, 1272, 1302, 1339, 1355, 1374, 1393, 1426, 1460, 1471, 1526, 1854, 1914, 1923, 2151, 2179, 2211, and 2304 (Table 4).

In a preferred embodiment of the present invention, the isolated nucleic acid molecule comprising a nucleotide sequence which encodes whole or a portion of a transposon or transposase homologue, wherein the nucleotide sequence is any sequence set forth in SEQ ID Nos: 2, 64, 226, 379, 383, 387, 410, 416, 546, 555, 603, 642, 644, 660, 691, 691, 781, 799, 980, 1002, 1045, 1072, 1098, 1190, 1207, 1214, 1252, 1273, 1275, 1305, 1317, 1330, 1340, 1353, 1354, 1362, 1378, 1378, 1380, 1383, 1386, 1386, 1388, 1391, 1392, 1549, 1573, 1611, 1698, 1725, 1739, 1804, 1869, 1902, 1965, 2041, 2049, 2130, 2135, 2153, 102, 1340, 1795, 1797, 1989, 2055, 2057, 2248, 14, 296, 722, 834, 834, and 999 (Table 3).

In a preferred embodiment of the present invention, the isolated nucleic acid molecule comprising a nucleotide sequence encodes whole or a portion of a toxin or toxin homologue listed in Table 5.

In a preferred embodiment of the present invention, the isolated nucleic acid molecule encodes a B. thuringiensis protein or fragment thereof that is a homologue of another Bacillus protein. In another preferred embodiment of the present invention, the nucleic acid molecule encodes a B. thuringiensis protein or fragment thereof that is a homologue of a fungal protein. In another preferred embodiment of the present invention, the nucleic acid molecule encodes a B. thuringiensis protein or fragment thereof that is a homologue of a plant protein. In another preferred embodiment of the present invention, the nucleic acid molecule encodes a B. thuringiensis protein or fragment thereof that is a homologue of mammalian protein. In another preferred embodiment of the present invention, a B. thuringiensis protein or fragment thereof of the present invention is a homologue of a non-Bacillus bacterial protein. In another preferred embodiment of the present invention, the nucleic acid molecule encodes a B. thuringiensis protein or fragment thereof that is a homologue of an algal protein.

In a preferred embodiment of the present invention, the nucleic acid molecule of the present invention encodes a B. thuringiensis homologue protein or fragment thereof where the B. thuringiensis homologue protein exhibits a BLASTP probability score of greater than 1E-12, preferably a BLASTP probability score of between about 1E-30 and about 1E-12, even more preferably a BLASTP probability score of greater than 1E-30 with its homologue. In a preferred embodiment of the present invention, the nucleic acid molecule of the present invention encodes a B. thuringiensis homologue protein or fragment thereof exhibits an aat_nap score of less than 200, preferably an aat_nap score of between about 200 to about 400, even more preferably an aat_nap score of greater than 400.

It is understood that certain amino acids may be substituted for other amino acids in a protein structure without appreciable loss of interactive binding capacity with structures such as, for example, antigen-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, J. Mol. Biol. 157, 105-132 (1982)). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, 1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−33), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred.

Another aspect of the present invention relates to a class of isolated nucleic acid molecules comprising promoter sequences or regulatory elements, particularly those found within SEQ ID NO: 1 through SEQ ID NO: 8283 or complements thereof.

The term "promoter sequence" means a nucleotide sequence that is capable of, when located in cis to a structural nucleotide sequence encoding a polypeptide or protein, functioning in a way that directs expression of one or more mRNA molecules that encodes the polypeptide or protein. Such promoter regions are typically found upstream of the trinucleotide ATG sequence at the start site of a protein coding region. Promoter sequences can also include sequences from which transcription of transfer RNA (tRNA) or ribosomal RNA (rRNA) sequences are initiated. Transcription involves the synthesis of an RNA chain representing one strand of a DNA duplex. By "representing" it is meant that the RNA is identical in sequence with one strand of the DNA; it is complementary to the other DNA strand, which provides the template for its synthesis. Transcription takes place by the usual process of complementary base pairing, catalyzed and scrutinized by the enzyme RNA polymerase. The reaction can be divided into three stages described as initiation, elongation and termination. Initiation begins with the binding of RNA polymerase to the double stranded (DS or ds) DNA. The sequence of DNA required for the initiation reaction defines the promoter. The site at which the first nucleotide is incorporated is called the startsite or startpoint of transcription. Elongation describes the phase during which the enzyme moves along the DNA and extends the growing RNA chain. Elongation involves the disruption of the DNA double stranded structure in which a transiently unwound region exists as a hybrid RNA-DNA duplex and a displaced single strand of DNA. Termination involves recognition of the point at which no further bases should be added to the chain. To terminate transcription, the formation of phosphodiester bonds must cease and the transcription complex must come apart. When the last base is added to the RNA chain, the RNA-DNA hybrid is disrupted, the DNA reforms into a duplex state, and the RNA polymerase enzyme and RNA molecule are both released from the DNA. The sequence of DNA required for the termination reaction is called the terminator.

Generally, for bacteria the optimal promoter is a sequence consisting of a −35 hexamer separated by about 17 base pairs from a −10 hexamer and lies from about 7 to about 10 base pairs upstream of the startpoint of transcription, but these sequences can vary among and between sequences which are recognized by the RNA polymerase. The startpoint of transcription generally lies from about 20 to about 50 base pairs upstream of the startpoint of translation of one or more open reading frames which comprise the entire length of an mRNA transcript. Some promoters can be recognized by RNA polymerase alone and in these cases, an accessible promoter will always be transcribed. Promoter availability may be determined by extraneous proteins, which either may act directly at the promoter to block access by RNA polymerase, or may function indirectly by controlling the structure of the genome in the region. Other promoters are not by themselves adequate to support transcription initiation and thus ancillary protein and or RNA factors are required to further initiation. The additional protein or RNA factors usually act by recognizing sequences of DNA that are close to, or overlap with, the sequence bound by RNA polymerase itself. Additionally, some of these ancillary factors must touch and concern the RNA polymerase in order to effect efficient transcription initiation as well as transcription elongation.

Promoters in particular in *Bacillus* species are highly regulated by the appearance and disappearance of accessory factors known as sigma factors which touch and concern both the DNA sequences flanking the promoter site as well as the RNA polymerase in order to effect efficient transcription initiation and elongation. Such factors are required for effecting transcription from various classes of promoters and along with other factors expressed from spaO genes affect both the temporal regulation of expression from promoters as well as the spatial distribution of patterns of expression within the cell during differentiation and development of the *Bacillus* cell from spore activation, vegetative growth and proliferation, and sporulation. Examples of sigma factors which are known to function in this manner are ó$^{A}$, ó$^{B}$, ó$^{C}$, ó$^{D}$, ó$^{E}$, ó$^{F}$, ó$^{G}$, ó$^{H}$, ó$^{I}$, and ó$^{K}$. In addition, the sporulation factors which function for temporal and spatial regulatory gene expression include gene products in the classes of SpoO, SpoOI, and SpoOII.

Thus, in *Bacillus*, in many circumstances a consensus promoter may be sufficient for expression, however additional sequences may act to further regulate expression, for example, in response to biochemical, developmental or environmental signals. In a preferred embodiment of the present invention, the promoter is upstream of a nucleic acid sequence that encodes a *B. thuringiensis* protein or fragment thereof.

Promoters of the present invention can be included within sequences up to 10 kb upstream of the trinucleotide ATG sequence at the start site of a protein coding region, tRNA, or rRNA. Promoters of the present invention can preferably be included within sequences up to 5 kb upstream of the trinucleotide ATG sequence at the start site of a protein coding region, tRNA or rRNA. Promoters of the present invention can more preferably be included within sequences up to 2 kb upstream of the trinucleotide ATG sequence at the start site of a protein coding region, tRNA or rRNA. Promoters of the present invention can most preferably be included within sequences up to 500 by upstream of the trinucleotide ATG sequence at the start site of a protein, tRNA, or rRNA coding region. While in many circumstances a 300 by promoter may be sufficient for expression, additional sequences may act to further regulate expression, for example, in response to biochemical, developmental or environmental signals. In a preferred embodiment of the present invention, the promoter is upstream of an nucleic acid sequence that encodes a *Bacillus thuringiensis* protein or fragment thereof.

The term "regulatory element" is intended to mean a series of nucleotides that determines if, when, and at what level a particular gene is expressed. Regulatory DNA sequences specifically interact with regulatory or other proteins. Many regulatory elements act in cis ("cis elements") and are believed to affect DNA topology, producing local conformations that selectively allow or restrict access of RNA polymerase to the DNA template or that facilitate selective opening of the double helix at the site of transcriptional initiation, i.e., the transcriptional startsite referred to above. Cis elements occur within, near to, adjacent to, or at a distance from a particular promoter, but remain linked to the promoter sequence along the sequence of phosphodiester bonds which comprise the nucleotide sequence within which the promoter resides. Cis elements are not limited to promoters, but may be imparted to RNA sequences derived from transcription from DNA sequences of the present invention, wherein such RNA cis elements are involved in post transcriptional regulation of gene expression. For example, elements which are known as inverted repeat sequences can assist in the formation of hairpin structures which prevent, inhibit, or otherwise modulate the translational efficiency of the RNA sequence, or which regulate the survival of the RNA sequence. Other elements may function to bind ribosomes or components which enhance or suppress translational efficiency. Cis elements can be identified using known cis elements as a target sequence or target motif in the BLAST. Promoters of the present invention include homologues of cis elements known to effect gene regulation that show homology with the nucleic acid molecules of the present invention.

The isolated nucleic acid molecules of the present invention also include nucleic acid sequences that encode ribosomal RNA (rRNA), transfer RNA (tRNA) molecules, or other nucleic acid molecules which function to regulate gene expression, transcription, translation by acting alone or in combination with other cellular components in activating, inhibiting, terminating or anti-terminating gene expression functions, or by acting alone or in combination with other structural molecules to form or assist in the formation of said structural molecules.

It is contemplated by the inventors that the isolated nucleic acid molecules of the present invention also include those comprising a substantial portion of a nucleotide sequence selected from the group consisting of SEQ ID NO: 1 through SEQ ID NO: 8283 or complements thereof.

A "substantial portion" of a nucleotide sequence comprises enough of the sequence to afford specific identification and/or isolation of a nucleic acid fragment comprising the sequence. In general, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

It is also contemplated by the inventors that the isolated nucleic acid molecules of the present invention also include known types of modifications, for example, labels which are known in the art, methylation, "caps", substitution of one or more of the naturally occurring nucleotides with an analog. Other known modifications include internucleotide modifications, for example, those with uncharged linkages (methyl phosphonates, phosphotriesters, phosphoamidates, carbamates, etc.) and with charged linkages (phosphorothioates, phosphorodithioates, etc.), those containing pendant moieties, such as, proteins (including nucleases, metabolic toxins, antibodies, signal peptides, poly-L-lysine, etc.), those with intercalators (acridine, psoralen, etc.), those containing chelators (metals, radioactive metals, boron, oxidative metals, etc.), those containing alkylators, and those with modified linkages.

The nucleic acids of the present invention may be used to isolate nucleic acids encoding homologous proteins from the same or other species. Isolation of homologous genes using sequence-dependent protocols is well known in the art. Examples of sequence-dependent protocols include, but are not limited to, methods of nucleic acid hybridization, and methods of DNA and RNA amplification as exemplified by various uses of nucleic acid amplification technologies (e.g., polymerase chain reaction, ligase chain reaction).

For example, genes encoding homologous proteins, either as cDNAs or genomic DNAs, could be isolated directly by using all or a portion of the nucleic acids of the present invention as DNA hybridization probes to screen cDNA or genomic libraries from any desired organism employing methodology well known to those skilled in the art. Methods for forming such libraries are well known in the art. Specific oligonucleotide probes based upon the nucleic acids of the present invention can be designed and synthesized by methods known in the art. Moreover, the entire sequences of the nucleic acids can be used directly to synthesize DNA probes by methods known to the skilled artisan such as random primer DNA labeling, nick translation, or end-labeling techniques, or RNA probes using available in vitro transcription systems. In addition, specific primers can be designed and used to amplify a part or all of the sequences. The resulting amplification products can be labeled directly during amplification reactions or labeled after amplification reactions, and used as probes to isolate full length cDNA or genomic DNAs under conditions of appropriate stringency.

Alternatively, the nucleic acids of interest can be amplified from nucleic acid samples using amplification techniques. For instance, the disclosed nucleic acids may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194) to amplify and obtain any desired nucleic acid or fragment directly from mRNA, from cDNA, from genomic libraries or cDNA libraries. PCR and other in vitro amplification methods may also be useful, for example, to clone nucleic acid sequences that code for proteins to be expressed, to make nucleic acids to use as probes for detecting the presence of the desired mRNA in samples, for nucleic acid sequencing, or for other purposes.

In addition, two short segments of the nucleic acids of the present invention may be used in polymerase chain reaction protocols, for example, the RACE protocol (Frohman et al., Proc. Natl. Acad. Sci. USA 85:8998 (1988)), to amplify longer nucleic acids encoding homologous genes from DNA or RNA from other sources.

Nucleic acids of interest may also be synthesized, either completely or in part, especially where it is desirable to provide plant-preferred sequences, by well-known techniques as described in the technical literature. See, e.g., Carruthers et al., Cold Spring Harbor Symp. Quant. Biol. 47:411-418 (1982), and Adams et al., J. Am. Chem. Soc. 105:661 (1983). Thus, all or a portion of the nucleic acids of the present invention may be synthesized using codons preferred by a selected plant host. Plant-preferred codons may be determined, for example, from the codons used most frequently in the proteins expressed in a particular plant host species. Other modifications of the gene sequences may result in mutants having slightly altered activity.

Availability of the nucleotide sequences encoding *Bacillus thuringiensis* proteins facilitates immunological screening of DNA expression libraries. Synthetic polypeptides representing portions of the amino acid sequences of *Bacillus thuringiensis* proteins may be synthesized. These polypeptides can be used to immunize animals to produce polyclonal or monoclonal antibodies with specificity for polypeptides or proteins comprising the amino acid sequences. These antibodies can be then be used to screen expression libraries to isolate genes of interest (Lemer, Adv. Immunol. 36: 1 (1984); Sambrook et al., Molecular Cloning: A Laboratory Manual; Cold Spring Harbor Laboratory Press: Cold Spring Harbor, (1989)). It is understood that people skilled in the art are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988)).

Another aspect of the present invention relates to a method for obtaining a nucleic acid comprising a nucleotide sequence encoding a *Bacillus thuringiensis* protein homologue listed in Table 1. In a preferred embodiment, the method of the present invention for obtaining a nucleic acid encoding all or a substantial portion of the amino acid sequence of a *Bacillus thuringiensis* protein homologue comprising: (a) probing an expression library with a hybridization probe comprising a nucleotide sequence encoding a polypeptide listed in Table 1; (b) identifying a DNA clone that hybridizes to the hybridization probe; (c) isolating the DNA clone identified in step (b); and (d) sequencing the DNA fragment that comprises the clone isolated in step (c) wherein the sequenced nucleic acid molecule encodes all or a substantial portion of the amino acid sequence of the *Bacillus thuringiensis* protein homologue.

In another preferred embodiment, the method of the present invention for obtaining a nucleic acid molecule encoding a substantial portion of an amino acid sequence of a *Bacillus thuringiensis* protein homologue comprising: (a) synthesizing a first and a second oligonucleotide primers corresponding to a portion of the coding sequence of a second nucleic acid molecule set forth in SEQ ID NO: 1 through SEQ ID NO: 8283; and (b) amplifying a DNA insert present in a cloning vector using the first and second oligonucleotide primers of step (a) wherein the amplified nucleic acid molecule encodes all or a substantial portion of the amino acid sequence of the *Bacillus thuringiensis* protein homologue.

Protein and Polypeptide Molecules

The present invention, in another aspect, provides a substantially purified protein or polypeptide molecule comprising an amino acid sequence, wherein the amino acid sequence is defined as follows: (1) the amino acid sequence is encoded by a first nucleotide sequence which specifically hybridizes to the complement of a second nucleotide sequence set forth in SEQ ID NO: 1 through SEQ ID NO: 8283; or (2) the amino acid sequence is encoded by a third nucleotide sequence that is at least 50% identical to all or a substantial portion of a coding sequence located within SEQ ID NO: 1 through SEQ ID NO: 8283. In alternative embodiments, the third nucleotide sequence is at least 55% identical, at least 60% identical, at least 65% identical, at least 70% identical, at least 75% identical, at least 80% identical, at least 85% identical, at least 90% identical, at least 95% identical to all or a substantial portion of a coding sequence located within SEQ ID NO: 1 through SEQ ID NO: 8283. In a preferred embodiment, the third nucleotide sequence is 100% identical to all or a substantial portion of a coding sequence located within SEQ ID NO: 1 through SEQ ID NO: 8283.

The term "substantially purified protein or polypeptide molecule" refers to a protein or polypeptide molecule separated from substantially all other molecules normally associated with it in its native state. More preferably a substantially purified protein or polypeptide molecule is the predominant species present in a preparation. A substantially purified molecule may be greater than 60% free, preferably 75% free, more preferably 90% free, and most preferably 95% free from the other molecules (exclusive of solvent) present in the natural mixture.

It is well known in the art that proteins or polypeptides may undergo modification, including post-translational modifications, such as, but not limited to, disulfide bond formation, glycosylation, phosphorylation, or oligomerization. Thus, as used herein, the term "protein molecule" or "polypeptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

The polypeptides or proteins of the present invention may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition, Cold Spring Harbor Press*, Cold Spring Harbor, N.Y. (1989)), or similar texts.

The polypeptides or protein molecule of the present invention may also include fusion protein or polypeptide molecules. A protein or polypeptide molecule that comprises one or more additional polypeptide regions not derived from that protein molecule is a "fusion" protein or polypeptide molecule. Such molecules may be derivatized to contain carbohydrate or other moieties (such as keyhole limpet hemocyanin, etc.). Fusion protein or polypeptide molecules of the present invention are preferably produced via recombinant means.

The protein or polypeptide molecules of the present invention may also include protein or polypeptide molecules encoded by all or a substantial portion of protein-encoding sequences in SEQ ID NO: 1 through SEQ ID NO: 8283 or complements thereof or, fragments or fusions thereof in which conservative, non-essential, or not relevant, amino acid residues have been added, replaced, or deleted. An example of such a homologue is the homologue protein from different strains or species. Such a homologue can be obtained by any of a variety of methods. For example, as indicated above, one or more of the disclosed sequences (all or a substantial portion of the protein-encoding sequences in SEQ ID NO: 1 through SEQ ID NO: 8283 or complements thereof) will be used to define a pair of primers that may be used to isolate the homologue-encoding nucleic acid molecules from any desired species. Such molecules can be expressed to yield homologues by recombinant means.

Antibodies

Another aspect of the present invention concerns antibodies, single-chain antigen binding molecules, or other proteins that specifically bind to one or more of the protein or polypeptide molecules of the present invention and their homologues, fusions or fragments. Such antibodies may be used to quantitatively or qualitatively detect the protein or polypeptide molecules of the present invention. As used herein, an antibody or polypeptide is said to "specifically bind" to a protein or polypeptide molecule of the present invention if such binding is not competitively inhibited by the presence of non-related molecules. In a preferred embodiment the antibodies of the present invention bind to protein or polypeptide molecules of the present invention, in a more preferred embodiment of the antibodies of the present invention bind to protein or polypeptide molecules derived from Bacillus thuringiensis.

Nucleic acid molecules that encode all or part of the protein or polypeptide of the present invention can be expressed, via recombinant means, to yield protein or polypeptides that can in turn be used to elicit antibodies that are capable of binding the expressed protein or polypeptide. Such antibodies may be used in immunoassays for that protein or polypeptide. Such protein or polypeptide-encoding molecules, or their fragments may be "fusion" molecules (i.e., a part of a larger nucleic acid molecule) such that, upon expression, a fusion protein is produced. It may be desirable to derivatize the obtained antibodies, for example with a ligand group (such as biotin) or a detectable marker group (such as a fluorescent group, a radioisotope or an enzyme). Such antibodies may be used in immunoassays for that protein. In a preferred embodiment, such antibodies can be used to screen DNA expression libraries to isolate clones containing full-length insert of genes (Lemer, Adv. Immunol. 36: 1 (1984); Sambrook et al., Molecular Cloning: A Laboratory Manual; Cold Spring Harbor Laboratory Press: Cold Spring Harbor, (1989)).

The antibodies that specifically bind proteins and protein fragments of the present invention may be polyclonal or monoclonal, and may comprise intact immunoglobulins, or antigen binding portions of immunoglobulins (such as (F(ab'), F(ab')$_2$ fragments), or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, *Antibodies: A Laboratory Manual*, Cold Spring Harbor Press: Cold Spring Harbor, N.Y. (1988)).

In a preferred embodiment, the antibodies of the present invention specifically bind to one or more of the insect inhibitory polypeptides or proteins of the present invention. Such antibodies may be used to detect the presence of such insect inhibitory polypeptides or proteins in a sample.

The present invention also provide a method for detecting an insect inhibitory polypeptide or protein in a biological sample, the method generally comprising: (1) obtaining a biological sample; (2) contacting the sample with an antibody that specifically binds to the polypeptide or protein, under conditions effective to allow the formation of complexes; and (3) detecting the complexes so formed.

Microbial Constructs and Transformed Microbial Cells

The nucleotide sequences of the present invention may be introduced into a wide variety of prokaryotic and eukaryotic microorganism hosts to express the *B. thuringiensis* polypeptide or protein of interest, particularly the insect inhibitory polypeptides or proteins of the present invention. The term "microorganism" includes prokaryotic and eukaryotic microbial species such as bacteria and fungi. Fungi include yeast and filamentous fungi. Illustrative prokaryotes, both Gram-negative and Gram-positive, include Enterobacteriaceae, such as *Escherichia, Erwinia, Shigella, Salmonella,* and *Proteus*; Bacillaceae; Rhizobiceae, such as *Rhizobium*; Spirillaceae, such as photobacterium, *Zymomonas, Serratia, Aeromonas, Vibrio, Desulfovibrio, Spirillum*; Lactobacillaceae; Pseudomonadaceae, such as *Pseudomonas* and *Acetobacter*; Azotobacteraceae, Actinomycetales, and Nitrobacteraceae. Among eukaryotes are fungi, such as *Phycomycetes* and *Ascomycetes*, which includes yeast, such as *Saccharomyces* and *Schizosaccharomyces*; and *Basidiomycetes* yeast, such as *Rhodotorula, Aureobasidium, Sporobolomyces,* and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies *B. thuringiensis kurstaki* HD-1, *B. thuringiensis* kurstaki HD-73, *B. thuringiensis sotto, B. thuringiensis berliner, B. thuringiensis thuringiensis, B. thuringiensis tolworthi, B. thuringiensis dendrolimus, B. thuringiensis alesti, B. thuringiensis galleriae, B. thuringiensis aizawai, B. thuringiensis subtoxicus, B. thuringiensis entomocidus, B. thuringiensis tenebrionis* and *B. thuringiensis san diego*); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc,* and *Alcaligenes*; fungi, particularly yeast, e.g., genera *Saccharomyces, Cryptococcus, Kluyveromyces, Sporobolomyces, Rhodotorula,* and *Aureobasidium*. Of particular interest are such phytosphere bacterial species as *Pseudomonas syringae, Pseudomonas fluorescens, Serratia marcescens, Acetobacter xylinum, Agrobacterium tumefaciens, Rhodobacter sphaeroides, Xanthomonas campestris, Rhizobium melioti, Alcaligenes eutrophus,* and *Azotobacter vinlandii*; and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae,* and *Aureobasidium pollulans*.

It is well known that exogenous nucleic acids encoding polypeptides of interest can be introduced into a microbial host cell, such as a bacterial cell or a fungal cell, using a recombinant contruct. The present invention also relates to a fungal or bacterial recombinant construct comprising a structural nucleotide sequence encoding a *B. thuringiensis* protein or polypeptide. In a preferred embodiment, the structural nucleotide sequence encodes an insect inhibitory protein or polypeptide of the present invention. The present invention also relates to a bacterial or fungal cell comprising a bacterial or fungal recombinant vector. The present invention also relates to methods for obtaining a recombinant bacterial or fungal host cell, comprising introducing into a bacterial or fungal host cell an exogenous nucleic acid molecule.

The bacterial recombinant vector may be any vector which can be conveniently subjected to recombinant DNA procedures. The choice of a vector will typically depend on the compatibility of the vector with the bacterial host cell into which the vector is to be introduced. The vector may be a linear or a closed circular plasmid. The bacterial recombinant vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding *B. thuringiensis* proteins or polypeptide can, for example, be suitably inserted into a replicable vector for expression in a bacterium under the control of a suitable promoter for that bacterium. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, and an inducible promoter allowing the expression of exogenous DNA.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, *E. coli* is typically transformed using pBR322, a plasmid derived from an *E. coli* species (see, e.g., Bolivar et al., *Gene* 2:95 (1977)). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding *B. thuringiensis* proteins or polypeptides may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide encoding DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, β-lactamase or heat-stable enterotoxin II leaders and the like.

Both expression and cloning vectors contain a nucleotide sequence that enables the vector to replicate in one or more selected host cells. Generally, in cloning vectors this sequence is one that enables the vector to replicate independently of the host chromosomal DNA, and includes origins of replication or autonomously replicating sequences. Such sequences are well known for a variety of bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a polypeptide can also contains an inducible promoter that is recognized by the host bacterial organism and is operably linked to the nucleic acid encoding, for example, the nucleic acid molecule encoding the *B. thuringiensis* protein or polypeptide of interest. Inducible promoters suitable for use with bacterial hosts include the β-lactamase, *E. coli* λ phage $P_L$ and $P_R$, and *E. coli* galactose, arabinose, alkaline phosphatase, tryptophan (tip), and lactose operon promoter systems and variations thereof (Chang et al., *Nature* 275:615 (1978); Goeddel et al., *Nature* 281:544 (1979); Guzman et al., *J. Bacteriol.* 174:7716-7728 (1992); Goeddel, *Nucleic Acids Res.* 8:4057 (1980); EP 36,776) and hybrid promoters such as the tac promoter (deBoer et al., *Proc. Natl. Acad. Sci.* (*USA*) 80:21-25 (1983)). However, other known bacterial inducible promoters are suitable (Siebenlist et al., *Cell* 20:269 (1980)).

The term "operably linked", as used in reference to a regulatory sequence and a structural nucleotide sequence, means that the regulatory sequence causes regulated expression of the operably linked structural nucleotide sequence. "Expression" refers to the transcription and stable accumulation of sense or antisense RNA derived from the nucleic acid of the present invention. Expression may also refer to translation of mRNA into a polypeptide or protein. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065, incorporated herein by reference). The complementarity of an antisense RNA may be with any part of the specific gene transcript, i.e., at the 5' non-coding sequence, 3' non-translated sequence, introns, or the coding sequence. "RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA.

"Regulatory sequences" or "control elements" refer to nucleotide sequences located upstream (5' non-coding sequences), within, or downstream (3' non-translated sequences) of a structural nucleotide sequence, and which influence the transcription, RNA processing or stability, or translation of the associated structural nucleotide sequence. Regulatory sequences may include promoters, translation leader sequences, introns, and polyadenylation recognition sequences.

The promoter sequence may consist of proximal and more distal upstream elements, the latter elements often referred to as enhancers. Accordingly, an "enhancer" is a DNA sequence which can stimulate promoter activity and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions.

Promoters for use in bacterial systems also generally contain a Shine-Dalgarno (S.D.) sequence or a consensus sequence thereof operably linked to the DNA encoding the polypeptide of interest. The promoter can be removed from the bacterial source DNA by restriction enzyme digestion and inserted into the vector containing the desired DNA coding sequence, or vice versa.

Alternatively, the expression constructs can be integrated into the bacterial genome with an integrating vector. Integrating vectors typically contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (E.P.O. Pub. No. 127,328). Integrating vectors may also be comprised of bacteriophage or transposon sequences.

Construction of suitable vectors containing one or more of the above-listed components employs standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *B. thuringiensis* protein or polypeptide of the present invention, may be ligated into the vector in frame with sequences for the amino-terminal Met and the subsequent 7 residues of β-galactosidase so that a hybrid protein is produced; pIN vectors (Van Heeke and Schuster *J. Biol. Chem.* 264:5503-5509 (1989)); and the like. pGEX vectors (Promega, Madison Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

It is, of course, necessary to select the appropriate bacteria taking into consideration replicability of the replicon in the cells of a bacterium. For example, *E. coli, Serratia*, or *Salmonella* species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Expression vectors for *B. thuringiensis* and related bacilli contain an origin of DNA replication and associated replication factors and a selectable marker gene that will be expressed in *Bacillus* and allow selection of transformed cells. These *Bacillus*-specific plasmid functions may also be present on an *E. coli* or other broad host range cloning vector, forming a plasmid that can replicate and be selected in either *E. coli* or *B. thuringiensis*, and thus comprising a shuttle vector. Such vectors are well known in the art and usually also contain a *B. thuringiensis* $\delta^E$ promoter adjacent to one or more convenient cloning sites to allow cloning and expression of exogenous genes during sporulation. Such a promoter is typically found associated with many δ-endotoxin genes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988)). Yet another method is the use of the technique termed electroporation. In addition, bacterial cells can be readily transformed using various forms of phages (i.e., transducing, temperate, lytic and lysogenic), suicide vectors for inserting DNA directly into the chromosome, and through homologous recombination using either phages, suicide vectors or linear DNA.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763.

A yeast recombinant construct can typically include one or more of the following: a promoter sequence, fusion partner sequence, leader sequence, transcription termination sequence, a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a procaryotic host for cloning and amplification. Examples of such yeast-bacteria shuttle vectors include YEp24 (Botstein et al., Gene, 8:17-24 (1979)), pCl/1 (Brake et al., Proc. Natl. Acad. Sci USA, 81:4642-4646 (1984)), and YRp17 (Stinchcomb et al., J. Mol. Biol., 158:157 (1982)). In addition, a replicon may be either a high or low copy number plasmid. A high copy number plasmid will generally have a copy number ranging from about 5 to about 200, and typically about 10 to about 150. A host containing a high copy number plasmid will preferably have at least about 10, and more preferably at least about 20.

Useful yeast promoter sequences can be derived from genes encoding enzymes in the metabolic pathway. Examples of such genes include alcohol dehydrogenase (ADH) (E.P.O. Pub. No. 284044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (E.P.O. Pub. No. 329203). The yeast PHO5 gene, encoding acid phosphatase, also provides useful promoter sequences (Myanohara et al., Proc. Natl. Acad. Sci. USA, 80:1 (1983)). In addition, synthetic promoters which do not occur in nature also function as yeast promoters. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, or PHO5 genes, combined with the transcriptional activation region of a glycolytic enzyme gene such as GAP or PyK (E.P.O. Pub. No. 164556). Furthermore, a yeast promoter can include naturally occurring promoters of non-yeast origin that have the ability to bind yeast RNA polymerase and initiate transcription. Examples of such promoters include, inter alia, (Cohen et al., Proc. Natl. Acad. Sci. USA, 77:1078 (1980); Henikoff et al., Nature 283:835 (1981); Hollenberg et al., Curr. Topics Microbiol. Immunol., 96:119 (1981); Mercerau-Puigalon et al., Gene, 11:163 (1980); and Panthier et al., Curr. Genet., 2:109 (1980)).

Intracellularly expressed fusion proteins provide an alternative to direct expression of the polypeptides of interest. Typically, a DNA sequence encoding the N-terminal portion of a stable protein, a fusion partner, is fused to the 5' end of heterologous structural nucleotide sequence encoding the desired polypeptide. Upon expression, this construct will provide a fusion of the two amino acid sequences. The DNA sequence at the junction of the two amino acid sequences may or may not encode a cleavable site. See, e.g., E.P.O. Pub. No. 196056. Another example is a ubiquitin fusion protein. Such a ubiquitin fusion protein preferably retains a site for a processing enzyme (e.g. ubiquitin-specific processing protease) to cleave the ubiquitin from the polypeptide of the present invention. Through this method, therefore, a mature polypeptide can be isolated [see, P.C.T. WO 88/024066].

Alternatively, polypeptides or proteins can also be secreted from the cell into the growth media by creating chimeric DNA molecules that encode a fusion protein comprised of a leader sequence fragment that provides for secretion in yeast of the polypeptides. Preferably, there are processing sites encoded between the leader fragment and the polypeptide-encoding sequence fragment that can be cleaved either in vivo or in vitro. The leader sequence fragment typically encodes a signal peptide comprised of hydrophobic amino acids which direct the secretion of the protein from the cell.

DNA encoding suitable signal sequences can be derived from genes for secreted yeast proteins, such as the yeast invertase gene (E.P.O. Pub. No. 12873; J.P.O. Pub. No. 62,096,086) and the A-factor gene (U.S. Pat. No. 4,588,684). Alternatively, leaders of non-yeast origin, such as an interferon leader, exist that also provide for secretion in yeast (E.P.O. Pub. No. 60057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (typically about 25 to about 50 amino acid residues) (U.S. Pat. Nos. 4,546,083 and 4,870,008; and E.P.O. Pub. No. 324274). Additional leaders employing an alpha-factor leader fragment that provides for secretion include hybrid alpha-factor leaders made with a pre-sequence of a first yeast, but a pro-region from a second yeast alpha factor. See, e.g., P.C.T. WO 89/02463.

Examples of transcription terminator sequence and other yeast-recognized termination sequences, such as those coding for glycolytic enzymes, are known to those of skill in the art.

Alternatively, the expression constructs can be integrated into the yeast genome with an integrating vector. Integrating vectors typically contain at least one sequence homologous to a yeast chromosome that allows the vector to integrate, and preferably contain two homologous sequences flanking the expression construct. Integrations appear to result from recombinations between homologous DNA in the vector and the yeast chromosome (Off-Weaver et al., Methods in Enzymol., 101:228-245 (1983)). An integrating vector may be directed to a specific locus in yeast by selecting the appropriate homologous sequence for inclusion in the vector. See Orr-Weaver et al., supra. One or more expression constructs may integrate, possibly affecting levels of recombinant protein produced (Rine et al., Proc. Natl. Acad. Sci. USA, 80:6750 (1983)). The chromosomal sequences included in the vector can occur either as a single segment in the vector, which results in the integration of the entire vector, or as two segments homologous to adjacent segments in the chromosome and flanking the expression construct in the vector, which results in the stable integration of only the expression construct.

Expression and transformation vectors, either extrachromosomal replicons or integrating vectors, have been developed for transformation into many yeasts. For example, expression vectors have been developed for, inter alia, the following yeasts: *Candida albicans* (Kurtz, et al., Mol. Cell. Biol., 6:142 (1986)), *Candida maltosa* (Kunze et al., J. Basic Microbiol., 25:141 (1985)); *Hansenula polymorpha* (Gleeson et al., J. Gen. Microbiol. 132:3459 (1986); Roggenkamp et al., Mol. Gen. Genet. 202:302 (1986)); *Kluyveromyces fragilis* (Das et al., J. Bacteriol. 158:1165 (1984)); *Kluyveromyces lactis* (De Louvencourt et al., J. Bacteriol. 154:737 (1983); Van den Berg et al., Bio/Technology 8:135 (1990)); *Pichia guillerimondii* (Kunze et al., J. Basic Microbiol. 25:141 (1985)); *Pichia pastoris* (Cregg et al., Mol. Cell. Biol. 5:3376 (1985); U.S. Pat. Nos. 4,837,148 and 4,929,555); *Saccharomyces cerevisiae* (Hinnen et al., Proc. Natl. Acad. Sci. USA 75:1929 (1978); Ito et al., J. Bacteriol. 153:163 (1983)); *Schizosaccharomyces pombe* (Beach and Nurse, Nature 300:706 (1981)); and *Yarrowia lipolytica* (Davidow, et al., Curr. Genet. 10:380471 (1985); and Gaillardin et al., Curr. Genet. 10:49 (1985)).

Methods of introducing exogenous nucleic acids into yeast hosts are well-known in the art, and typically include either the transformation of spheroplasts or of intact yeast cells treated with alkali cations. Transformation procedures usually vary with the yeast species to be transformed. See e.g., Kurtz et al., Mol. Cell. Biol. 6:142 (1986); Kunze et al., J. Basic Microbiol. 25:141 (1985) for *Candida*. See, e.g., Gleeson et al., J. Gen. Microbiol. 132:3459 (1986); Roggenkamp et al., Mol. Gen. Genet. 202:302 (1986) for *Hansenula*. See, e.g., Das et al., J. Bacteriol. 158:1165 (1984); De Louvencourt et al., J. Bacteriol. 154:1165 (1983); Van den Berg et al., Bio/Technology 8:135 (1990) for *Kluyveromyces*. See, e.g., Cregg et al., Mol. Cell. Biol. 5:3376 (1985); Kunze et al., J. Basic Microbiol. 25:141 (1985); U.S. Pat. Nos. 4,837,148 and 4,929,555 for *Pichia*. See, e.g., Hinnen et al., Proc. Natl. Acad. Sci. USA 75:1929 (1978); Ito et al., J. Bacteriol. 153: 163 (1983) for *Saccharomyces*. See, e.g., Beach and Nurse, Nature 300:706 (1981) for *Schizosaccharomyces*. See, e.g., Davidow et al., Curr. Genet. 10:39 (1985); Gaillardin et al., Curr. Genet. 10:49 (1985) for *Yarrowia*.

In order to obtain expression polypeptides or proteins of interest, recombinant microbial host cells derived from the transformants are incubated under conditions which allow expression of the recombinant polypeptide-encoding sequence. These conditions will vary, dependent upon the host cell selected. However, the conditions are readily ascertainable to those of ordinary skill and knowledge in the art.

Detection of polypeptides expressed in the transformed host cell may be performed by several methods. For example, a polypeptide or protein may be detected by its immunological reactivity with antibodies.

Polypeptides or proteins of the present invention may be isolated from the cell by lysis, if formed intracellularly, or isolated from the culture medium, if secreted, by conventional methods.

Plant Constructs and Plant Transformants

Nucleic acid molecules of the present invention may be used in plant transformation or transfection. Exogenous genetic material may be transferred into a plant cell and the plant cell regenerated into a whole, fertile or sterile plant. Such genetic material may be transferred into either monocotyledons and dicotyledons including but not limited to the plants, alfalfa, Arabidopsis, barley, Brassica, broccoli, cabbage, citrus, cotton, garlic, oat, oilseed rape, onion, canola, flax, maize, an ornamental plant, pea, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, oil palm, Phaseolus etc. Particularly preferred plants would include, Arabidopsis, barley, cotton, oat, oilseed rape, rice, maize, soybean, canola, ornamentals, sugarcane, sugarbeet, tomato, potato, wheat and turf grasses (See specifically, Chistou, *Particle Bombardment for Genetic Engineering of Plants*, Biotechnology Intelligence Unit, Academic Press, San Diego, Calif. (1996) and generally Chistou, *Particle Bombardment for Genetic Engineering of Plants*, Biotechnology Intelligence Unit, Academic Press, San Diego, Calif. (1996)).

The present invention also relates to a transformed plant cell or plant comprising in its genome an exogenous nucleic acid encoding one or more *B. thuringiensis* proteins or polypeptides of the present invention. The present invention also relates to methods for creating a transgenic plant in which one or more *B. thuringiensis* proteins or polypeptides of the present invention are overexpressed.

As used herein, the term exogenous genetic material means any genetic material, whether naturally occurring or otherwise, from any source that is capable of being inserted into any organism. In a preferred embodiment the exogenous genetic material includes an isolated nucleic acid molecule or fragment thereof of the present invention. In another preferred embodiment of the present invention exogenous genetic material includes a regulatory element, promoter or partial promoter of the present invention. In a more preferred embodiment of the present invention exogenous genetic material includes a regulatory element, promoter or partial promoter of the present invention and a nucleic acid molecule encoding a *B. thuringiensis* protein or fragments thereof. In a further more preferred embodiment of the present invention exogenous genetic material includes a regulatory element, promoter or partial promoter of the present invention and a nucleic acid molecule of the present invention having a sequence encoding a polypeptide or protein or fragment thereof set forth in Table 1.

One skilled in the art understands that an exogenous nucleic acid can be a heterologous nucleic acid derived from a different species than the species into which the nucleic acid is introduced or can be a nucleic acid derived from the same species as the species into which it is introduced.

The term "overexpression" refers to the expression of a polypeptide or protein encoded by an exogenous nucleic acid introduced into a host cell, wherein said polypeptide or protein is either not normally present in the host cell, or wherein said polypeptide or protein is present in said host cell at a higher level than that normally expressed from the endogenous gene encoding said polypeptide or protein. By "endogenous gene" refers to a native gene in its natural location in the genome of an organism.

The term "genome" as it applies to plant cells encompasses not only chromosomal DNA found within the nucleus, but organelle DNA found within subcellular components of the cell. DNAs of the present invention introduced into plant cells can therefore be either chromosomally integrated or organelle-localized. The term "genome" as it applies to bacteria encompasses both the chromosome and plasmids within a bacterial host cell. Encoding DNAs of the present invention introduced into bacterial host cells can therefore be either chromosomally integrated or plasmid-localized.

Transfer of a nucleic acid molecule that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material. In a preferred embodiment of the present invention, one or more of the *B. thuringiensis* proteins or fragments thereof are overexpressed in a transformed cell or transgenic plant.

Exogenous genetic material may be transferred into a plant cell by the use of a DNA vector or construct designed for such a purpose. Vectors have been engineered for transformation of large DNA inserts into plant genomes. Binary bacterial artificial chromosomes have been designed to replicate in both *E. coli* and *A. tumefaciens* and have all of the features required for transferring large inserts of DNA into plant chromosomes as set forth in the protocol by Choi and Wing, available at the Clemson University web site genome.clemson.edu/protocols2-nj.html, July, 1998. ApBACwich system has been developed to achieve site-directed integration of DNA into the genome. A 150 kb cotton BAC DNA is reported to have been transferred into a specific lox site in tobacco by biolistic bombardment and Cre-lox site specific recombination.

A construct or vector may also include a plant promoter to express the protein or protein fragment of choice. A number of promoters which are active in plant cells have been described in the literature. These include the nopaline synthase (NOS) promoter (Ebert et al., *Proc. Natl. Acad. Sci. U.S.A.* 84:5745-5749 (1987)), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987)) and the CaMV 35S promoter (Odell et al., *Nature* 313:810-812 (1985)), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci. U.S.A.* 84:6624-6628 (1987)), the sucrose synthase promoter (Yang et al., *Proc. Natl. Acad. Sci. U.S.A.* 87:4144-4148 (1990)), the R gene complex promoter (Chandler et al., *The Plant Cell* 1:1175-1183 (1989)), and the chlorophyll a/b binding protein gene promoter, etc. These promoters have been used to create DNA constructs which have been expressed in plants; see, e.g., PCT publication WO 84/02913.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci. U.S.A.* 87:3459-3463 (1990)), the chloroplast fructose-1,6-biphosphatase (FBPase) promoter from wheat (Lloyd et al., *Mol. Gen. Genet.* 225:209-216 (1991)), the nuclear photosynthetic ST-LS1 promoter from potato (Stockhaus et al., *EMBO J.* 8:2445-2451 (1989)), the phenylalanine ammonia-lyase (PAL) promoter and the chalcone synthase (CHS) promoter from *B. thuringiensis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994)), the promoter for the Cab-1 gene from wheat (Fejes et al., *Plant Mol. Biol.* 15:921-932 (1990)), the promoter for the CAB-1 gene from spinach (Lubberstedt et al., *Plant Physiol.* 104:97-1006 (1994)), the promoter for the cab1R gene from rice (Luan et al., *Plant Cell.* 4:971-981 (1992)), the pyruvate, orthophosphate dikinase (PPDK) promoter from maize (Matsuoka et al., *Proc. Natl. Acad. Sci. U.S.A.* 90:9586-9590 (1993)), the promoter for the tobacco Lhcb1*2 gene (Cerdan et al., *Plant Mol. Biol.* 33:245-255. (1997)), the *A. nidulans thaliana* SUC2 sucrose-$H^+$ symporter promoter (Truernit et al., *Planta.* 196:564-570 (1995)), and th *spergillus thaliana* SUC2 sucrose-$H^+$ symporter promoter (Truernit et al., *Planta.* 196:564-570 (1995)), and the promoter for the thylakoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (Sinapis alba; Kretsch et al., *Plant Mol. Biol.* 28:219-229 (1995)).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8:1899-1906 (1986); Jefferson et al., *Plant Mol. Biol.* 14:995-1006 (1990)), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989)), the promoter for the major tuber proteins including the 22 kd protein complexes and proteinase inhibitors (Hannapel, *Plant Physiol.* 101:703-704 (1993)), the promoter for the granule bound starch synthase gene (GBSS) (Visser et al., *Plant Mol. Biol.* 17:691-699 (1991)), and other class I and II patatins promoters (Koster-Topfer et al., *Mol. Gen. Genet.* 219:390-396 (1989); Mignery et al., *Gene.* 62:27-44 (1988)).

Other promoters can also be used to express a fructose 1,6 bisphosphate aldolase gene in specific tissues, such as seeds or fruits. The promoter for 3-conglycinin (Chen et al., *Dev. Genet.* 10:112-122 (1989)) or other seed-specific promoters such as the napin and phaseolin promoters, can be used. The zeins are a group of storage proteins found in maize endosperm. Genomic clones for zein genes have been isolated (Pedersen et al., *Cell* 29:1015-1026 (1982)), and the promoters from these clones, including the 15 kD, 16 kD, 19 kD, 22 kD, 27 kD, and gamma genes, could also be used. Other promoters known to function, for example, in maize, include the promoters for the following genes: waxy, Brittle, Shrunken 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell Biol.* 13:5829-5842 (1993)). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant Mol. Biol.* 25:587-596 (1994)). Expression in root tissue could also be accomplished by utilizing the root specific subdomains of the CaMV35S promoter that have been identified (Lam et al., *Proc. Natl. Acad. Sci. (U.S.A.)* 86:7890-7894 (1989)). Other root cell specific promoters include those reported by Conkling et al. (Conkling et al., *Plant Physiol.* 93:1203-1211 (1990)).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435 and 4,633,436, all of which are herein incorporated in their entirety. In addition, a tissue specific enhancer may be used (Fromm et al., *The Plant Cell* 1:977-984 (1989)). It is further understood that one or more of the promoters of the present invention may be used.

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989); Bevan et al., *Nucleic Acids Res.* 11:369-385 (1983)), or the like. It is understood that one or more sequences of the present invention that act, to terminate transcription may be used.

A vector or construct may also include other regulatory elements. Examples of such include the Adh intron 1 (Callis et al., *Genes and Develop.* 1:1183-1200 (1987)), the sucrose synthase intron (Vasil et al., *Plant Physiol.* 91:1575-1579 (1989)) and the TMV omega element (Gallie et al., *The Plant Cell* 1:301-311 (1989)). These and other regulatory elements may be included when appropriate. It is also understood that one or more of the regulatory regions of the present invention may be used.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985)) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988)) which encodes glyphosate resistance; a nitrilase gene which confers resistance to bromoxynil (Stalker et al., *J. Biol. Chem.* 263:6310-6314 (1988)); a mutant acetolactate synthase gene (ALS) which confers imidazolinone or sulphonylurea resistance (European Patent Application 154,204 (Sep. 11, 1985)); and a methotrexate resistant DHFR gene (Thillet et al., *J. Biol. Chem.* 263:12500-12508 (1988)).

A vector or construct may also include a transit peptide. Incorporation of a suitable chloroplast transit peptide may also be employed (European Patent Application Publication Number 0218571). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996).

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987); Jefferson et al., *EMBO J.* 6:3901-3907 (1987)); an R-locus gene, which encodes a product that regulates the production of anthocyanin pigments (red color) in plant tissues (Dellaporta et al., Stadler Symposium 11:263-282 (1988)); a β-lactamase gene (Sutcliffe et al., *Proc. Natl. Acad. Sci.* (*U.S.A.*) 75:3737-3741 (1978)), a gene which encodes an enzyme for which various chromogenic substrates are known (e.g., PADAC, a chromogenic cephalosporin); a luciferase gene (Ow et al., *Science* 234:856-859 (1986)) a xylE gene (Zukowsky et al., *Proc. Natl. Acad. Sci.* (*U.S.A.*) 80:1101-1105 (1983)) which encodes a catechol dioxygenase that can convert chromogenic catechols; an α-amylase gene (Ikatu et al., *Bio/Technol.* 8:241-242 (1990)); a tyrosinase gene (Katz et al., *J. Gen. Microbiol.* 129:2703-2714 (1983)) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Potrykus, *Ann. Rev. Plant Physiol. Plant Mol. Biol.* 42:205-225 (1991); Vasil, *Plant Mol. Biol.* 25:925-937 (1994). For example, electroporation has been used to transform maize protoplasts (Fromm et al., *Nature* 312:791-793 (1986)).

Technology for introduction of DNA into cells is well known to those of skill in the art. Four general methods for delivering a gene into cells have been described: (1) chemical methods (Graham and van der Eb, *Virology* 54:536-539 (1973)); (2) physical methods such as microinjection (Capecchi, *Cell* 22:479-488 (1980), electroporation (Wong and Neumann, *Biochem. Biophys. Res. Commun.* 107:584-587 (1982); Fromm et al., *Proc. Natl. Acad. Sci.* (*U.S.A.*) 82:5824-5828 (1985); U.S. Pat. No. 5,384,253; and the gene gun (Johnston and Tang, *Methods Cell Biol.* 43:353-365 (1994); (3) viral vectors (Clapp, *Clin. Perinatol.* 20:155-168 (1993); Lu et al., *J. Exp. Med.* 178:2089-2096 (1993); Eglitis and Anderson, *Biotechnique* 6:608-614 (1988)); and (4) receptor-mediated mechanisms (Curiel et al., *Hum. Gen. Ther.* 3:147-154 (1992); Wagner et al., *Proc. Natl. Acad. Sci.* (*U.S.A.*) 89:6099-6103 (1992)).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994)). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988)) nor the susceptibility of *Agrobacterium* infection is required. An illustrative embodiment of a method for delivering DNA into maize cells by acceleration is a biolistics alpha-particle delivery system, which can be used to propel particles coated with DNA through a screen, such as a stainless steel or Nytex screen, onto a filter surface covered with corn cells cultured in suspension. Gordon-Kamm et al, describes the basic procedure for coating tungsten particles with DNA (*Plant Cell* 2:603-618 (1990)). The screen disperses the tungsten nucleic acid particles so that they are not delivered to the recipient cells in large aggregates. A particle delivery system suitable for use with the present invention is the helium acceleration PDS-1000/He gun which is available from Bio-Rad Laboratories (Bio-Rad, Hercules, Calif.) Sanford et al., *Technique* 3:3-16 (1991)).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In another alternative embodiment, plastids can be stably transformed. Methods suitable for plastid transformation in higher plants include particle gun delivery of DNA containing a selectable marker and targeting of the DNA to the plastid genome through homologous recombination (Svab et al. *Proc. Natl. Acad. Sci.* (*U.S.A.*) 87:8526-8530 (1990): Svab and Maliga *Proc. Natl. Acad. Sci.* (*U.S.A.*) 90:913-917 (1993); Staub and Maliga, *EMBO J.* 12:601-606 (1993), U.S. Pat. Nos. 5,451,513 and 5,545,818).

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos.

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example, the methods described (Fraley et al., *Biotechnology* 3:629-635 (1985); Rogers et al., *Meth. Enzymol.* 153:253-277 (1987). Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.* 205:34 (1986)).

Modern *Agrobacterium* transformation vectors are capable of replication in *E. coli* as well as *Agrobacterium*, allowing for convenient manipulations as described (Klee et al., *In: Plant DNA Infectious Agents*, Hohn and Schell, eds., Springer-Verlag, New York, pp. 179-203 (1985)). Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multilinker regions flanked by a promoter and a polyadenylation site for direct expression of inserted polypeptide coding genes and are suitable for present purposes (Rogers et al., *Methods Enzymol* 153:253-277 (1987)). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single insert on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes.

The present invention also provides for parts of the plants of the present invention. Plant parts, without limitation, include seed, endosperm, ovule and pollen. In a particularly preferred embodiment of the present invention, the plant part is a seed.

Transformation of plant protoplasts can be achieved using methods based on calcium phosphate precipitation, polyethylene glycol treatment, electroporation, and combinations of these treatments. See for example (Potrykus et al., *Mol. Gen. Genet* 205:193-200 (1986); Lorz et al., *Mol. Gen. Genet.* 199:178, (1985); Fromm et al., *Nature* 319:791, (1986); Uchimiya et al., *Mol. Gen. Genet.* 204:204 (1986); Callis et al., *Genes and Development* 1183 (1987); Marcotte et al., *Nature* 335:454 (1988)).

Application of these systems to different plant strains depends upon the ability to regenerate that particular plant strain from protoplasts. Illustrative methods for the regeneration of cereals from protoplasts are described (Fujimura et al., *Plant Tissue Culture Letters* 2:74 (1985); Toriyama et al., *Theor Appl. Genet.* 205:34 (1986); Yamada et al., *Plant Cell Rep.* 4:85 (1986); Abdullah et al., *Biotechnology* 4:1087 (1986)).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology* 6: 397 (1988)). In addition, "particle gun" or high-velocity microprojectile technology can be utilized (Vasil et al., *Bio/Technology* 10:667, (1992)).

Using the latter technology, DNA is carried through the cell wall and into the cytoplasm on the surface of small metal particles as described (Klein et al., *Nature* 328:70 (1987); Klein et al., *Proc. Natl. Acad. Sci.* (*U.S.A.*) 85:8502-8505 (1988); McCabe et al., *Biotechnology* 6:923 (1988)). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.* 107:367 (1987); Luo et al., *Plant Mol. Biol. Reporter* 6:165 (1988)), by direct injection of DNA into reproductive organs of a plant (Pena et al., *Nature* 325:274 (1987)), or by direct injection of DNA into the cells of immature embryos followed by the rehydration of desiccated embryos (Neuhaus et al., *Theor. Appl. Genet.* 75:30 (1987)).

The regeneration, development, and cultivation of plants from single plant protoplast transformants or from various transformed explants is well known in the art (Weissbach and Weissbach, In: *Methods for Plant Molecular Biology*, (Eds.), Academic Press, Inc. San Diego, Calif., (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. No. 5,004,863; U.S. Pat. No. 5,159,135; U.S. Pat. No. 5,518,908); soybean (U.S. Pat. No. 5,569,834; U.S. Pat. No. 5,416,011; McCabe et al., *Biotechnology* 6:923 (1988), Christou et al., *Plant Physiol.* 87:671-674 (1988)); *Brassica* (U.S. Pat. No. 5,463,174); peanut (Cheng et al., *Plant Cell Rep.* 15:653-657 (1996), McKently et al., *Plant Cell Rep.* 14:699-703 (1995)); papaya (Yang et al., (1996)); pea (Grant et al., *Plant Cell Rep.* 15:254-258, (1995)).

Transformation of monocotyledons using electroporation, particle bombardment, and *Agrobacterium* have also been reported. Transformation and plant regeneration have been achieved in asparagus (Bytebier et al., *Proc. Natl. Acad. Sci.* (*U.S.A.*) 84:5345 (1987)); barley (Wan and Lemaux, *Plant Physiol* 104:37 (1994)); maize (Rhodes et al., *Science* 240:204 (1988), Gordon-Kamm et al., *Plant Cell* 2:603 (1990), Fromm et al., *Bio/Technology* 8:833 (1990), Koziel et al., *Bio/Technology* 11:194 (1993), Armstrong et al., *Crop Science* 35:550-557 (1995)); oat (Somers et al., *Bio/Technology* 10:1589 (1992)); orchardgrass (Horn et al., *Plant Cell Rep.* 7:469 (1988)); rice (Toriyama et al., *Theor Appl. Genet.* 205:34 (1986); Park et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al. *Plant Cell Rep.* 7:379 (1988); Battraw and Hall, *Plant Sci.* 86:191-202 (1992); Christou et al., *Bio/Technology* 9:957 (1991)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152.

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988); Marcotte et al., *Plant Cell* 1:523-532 (1989); McCarty et al., *Cell* 66:895-905 (1991); Hattori et al., *Genes Dev.* 6:609-618 (1992); Goff et al., *EMBO J.* 9:2517-2522 (1990)). Transient expression systems may be used to functionally dissect gene constructs (See generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters, enhancers etc. Further any of the nucleic acid molecules encoding a *B. thuringiensis* protein or fragment thereof of the present invention may be introduced into a plant cell in a manner that allows for over expression of the protein or fragment thereof encoded by the nucleic acid molecule.

Antibodies have been expressed in plants (Hiatt et al., *Nature* 342:76-78 (1989); Conrad and Fielder, *Plant Mol. Biol.* 26:1023-1030 (1994)). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997); Marion-Poll, *Trends in Plant Science* 2:44'-448 (1997)). For example, expressed anti-abscisic antibodies reportedly result in a general perturbation of seed development (Philips et al., *EMBO J.* 16:4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997); Baca et al., *Ann. Rev. Biophys. Biomol. Struct.* 26:461-493 (1997)). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

Exemplary Uses of the Agents of the Present Invention

Nucleic acid molecules and fragments thereof of the present invention may be employed to obtain other nucleic acid molecules from the same species. Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen genomic libraries obtained from *B. thuringiensis*. Methods for forming such libraries are well known in the art.

Nucleic acid molecules and fragments thereof of the present invention may also be employed to obtain other nucleic acid molecules such as nucleic acid homologues. Such homologues include the nucleic acid nucleic acid homologues of non-*B. thuringiensis* species including the nucleic acid molecules that encode, in whole or in part, protein homologues of other species or other organisms, sequences of genetic elements such as promoters and transcriptional regulatory elements. Such molecules can be readily obtained by using the above-described nucleic acid molecules or fragments thereof to screen cDNA or genomic libraries. Methods for forming such libraries are well known in the art. Such homologue molecules may differ in their nucleotide sequences from those found in one or more of SEQ ID NO: 1 through SEQ ID NO: 8283 or complements thereof because complete complementarity is not needed for stable hybridization. The nucleic acid molecules of the present invention therefore also include molecules that, although capable of specifically hybridizing with the nucleic acid molecules may lack "complete complementarity." In a particular embodiment, methods or 3' or 5' RACE may be used (Frohman, M. A. et al., *Proc. Natl. Acad. Sci. (U.S.A.)* 85:8998-9002 (1988); Ohara, O. et al., *Proc. Natl. Acad. Sci. (U.S.A.)* 86:5673-5677 (1989)) to obtain such sequences.

Any of a variety of methods may be used to obtain one or more of the above-described nucleic acid molecules (Zamechik et al., *Proc. Natl. Acad. Sci. (U.S.A.)* 83:4143-4146 (1986); Goodchild et al., *Proc. Natl. Acad. Sci. (U.S.A.)* 85: 5507-5511 (1988); Wickstrom et al., *Proc. Natl. Acad. Sci. (U.S.A.)* 85:1028-1032 (1988); Holt et al., *Molec. Cell. Biol.* 8:963-973 (1988); Gerwirtz et al., *Science* 242: 1303-1306 (1988); Anfossi et al., *Proc. Natl. Acad. Sci. (U.S.A.)* 86:3379-3383 (1989); Becker et al., *EMBO J.* 8:3685-3691 (1989)). Automated nucleic acid synthesizers may be employed for this purpose. In lieu of such synthesis, the disclosed nucleic acid molecules may be used to define a pair of primers that can be used with the polymerase chain reaction (Mullis et al., Cold Spring Harbor Symp. Quant. Biol. 51:263-273 (1986); Erlich et al., European Patent 50,424; European Patent 84,796, European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194) to amplify and obtain any desired nucleic acid molecule or fragment.

The nucleic acid molecules of the present invention may be used for physical mapping. Physical mapping, in conjunction with linkage analysis, can enable the isolation of genes. Physical mapping has been reported to identify the markers closest in terms of genetic recombination to a gene target for cloning. Once a DNA marker is linked to a gene of interest, the chromosome walking technique can be used to find the genes via overlapping clones. For chromosome walking, random molecular markers or established molecular linkage maps are used to conduct a search to localize the gene adjacent to one or more markers. A chromosome walk (Bukanov and Berg, *Mo. Microbiol.* 11:509-523 (1994); Birkenbihl and Vielmetter *Nucleic Acids Res.* 17:5057-5069 (1989); Wenzel and Herrmann, *Nucleic Acids Res.* 16:8323-8336 (1988) is then initiated from the closest linked marker. Starting from the selected clones, labeled probes specific for the ends of the insert DNA are synthesized and used as probes in hybridizations against a representative library. Clones hybridizing with one of the probes are picked and serve as templates for the synthesis of new probes; by subsequent analysis, contigs are produced.

The degree of overlap of the hybridizing clones used to produce a contig can be determined by comparative restriction analysis. Comparative restriction analysis can be carried out in different ways all of which exploit the same principle; two clones of a library are very likely to overlap if they contain a limited number of restriction sites for one or more restriction endonucleases located at the same distance from each other. The most frequently used procedures are, fingerprinting (Coulson et al, *Proc. Natl. Acad. Sci. (U.S.A.)* 83:7821-7821, (1986); Knott et al., *Nucleic Acids Res.* 16:2601-2612 (1988); Eiglmeier et al., *Mol. Microbiol.* 7:197-206 (1993), 1993), restriction fragment mapping (Smith and Birnstiel, *Nucleic Acids Res.* 3:2387-2398 (1976)); or the "landmarking" technique (Charlebois et al. *J. Mol. Biol.* 222:509-524 (1991)).

It is understood that the nucleic acid molecules of the present invention may in one embodiment be used in physical mapping. In a preferred embodiment, nucleic acid molecules of the present invention may in one embodiment be used in the physical mapping of *B. thuringiensis*.

Nucleic acid molecules of the present invention can be used in comparative mapping. Comparative mapping within families provides a method to assess the degree of sequence conservation, gene order, ploidy of species, ancestral relationships and the rates at which individual genomes are evolving. Comparative mapping has been carried out by cross-hybridizing molecular markers across species within a given family. As in genetic mapping, molecular markers are needed but instead of direct hybridization to mapping filters, the markers are used to select large insert clones from a total genomic DNA library of a related species. The selected clones, each a representative of a single marker, can then be used to physically map the region in the target species. The advantage of this method for comparative mapping is that no mapping population or linkage map of the target species is needed and the clones may also be used in other closely related species. By comparing the results obtained by genetic mapping in model organisms, with those from other species, similarities of genomic structure among species can be established. Cross-hybridization of RFLP markers has been reported and conserved gene order has been established in many studies. Such macroscopic synteny is utilized for the estimation of correspondence of loci among these organisms. It is understood that markers of the present invention may in another embodiment be used in comparative mapping. In a preferred embodiment the markers of present invention may be used in the comparative mapping of spore-forming Gram-positive bacteria.

In an aspect of the present invention, one or more of the agents of the present invention may be used to detecting the presence, absence or level of an organism, preferably a *Bacillus*, and more preferably a *B. thuringiensis* in a sample. In another aspect of the present invention, one or more of the nucleic molecules of the present invention are used to determine the level (i.e., the concentration of mRNA in a sample, etc.) or pattern (i.e., the kinetics of expression, rate of decomposition, stability profile, etc.) of the expression encoded in part or whole by one or more of the nucleic acid molecule of the present invention (collectively, the "Expression Response" of a cell or tissue). As used herein, the Expression Response manifested by a cell or tissue, is said to be "altered" if it differs from the Expression Response of cells or tissues of organisms not exhibiting the phenotype. To determine whether a Expression Response is altered, the Expression Response manifested by the cell or tissue of the organism exhibiting the phenotype is compared with that of a similar cell or tissue sample of a organism not exhibiting the phenotype. As will be appreciated, it is not necessary to re-determine the Expression Response of the cell or tissue sample of organisms not exhibiting the phenotype each time such a comparison is made; rather, the Expression Response of a particular organism may be compared with previously obtained values of normal organism. As used herein, the phenotype of the organism is any of one or more characteristics of an organism.

Nucleic acid molecules of the present invention can be used to monitor expression. A microarray-based method for high-throughput monitoring of gene expression may be utilized to measure gene-specific hybridization targets. This 'chip'-based approach involves using microarrays of nucleic acid molecules as gene-specific hybridization targets to quantitatively measure expression of the corresponding genes (Schena et al., *Science* 270:467-470 (1995); Shalon, Ph.D. Thesis, Stanford University (1996)). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides or cDNA molecules representing all possible subsequences (Bains and Smith, *J. Theor. Biol.* 135:303 (1989)). A second method hybridizes the sample to an array of oligonucleotide or cDNA probes. An array consisting of oligonucleotides or cDNA molecules complementary to subsequences of a target sequence can be used to determine the identity of a target sequence, measure its amount, and detect differences between the target and a reference sequence. Nucleic acid molecules microarrays may also be screened with protein molecules or fragments thereof to determine nucleic acid molecules that specifically bind protein molecules or fragments thereof.

The microarray approach may also be used with polypeptide targets (U.S. Pat. No. 5,445,934; U.S. Pat. No. 5,143,854; U.S. Pat. No. 5,079,600; U.S. Pat. No. 4,923,901). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides (Fodor et al., *Science* 251:767-773 (1991)).

It is understood that one or more of the molecules of the present invention, preferably one or more of the nucleic acid molecules or protein molecules or fragments thereof of the present invention may be utilized in a microarray based method. In a preferred embodiment of the present invention, one or more of the *B. thuringiensis* nucleic acid molecules or protein molecules or fragments thereof of the present invention may be utilized in a microarray based method. A particular preferred microarray embodiment of the present invention is a microarray comprising nucleic acid molecules encoding genes or fragments thereof that are homologues of known genes or nucleic acid molecules that comprise genes or fragments thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes.

In a preferred embodiment, the microarray of the present invention comprises at least 10 nucleic acid molecules that specifically hybridize under high stringency to at least 10 nucleic acid molecules encoding *B. thuringiensis* protein or fragments thereof set forth in Table 1. In a more preferred embodiment, the microarray of the present invention comprises at least 100 nucleic acid molecules that specifically hybridize under high stringency to at least 100 nucleic acid molecules that encode a *B. thuringiensis* protein or fragment thereof set forth in Table 1. In an even more preferred embodiment, the microarray of the present invention comprises at least 1,000 nucleic acid molecules that specifically hybridize under high stringency to at least 1,000 nucleic acid molecules that encode a *B. thuringiensis* protein or fragment thereof set forth in Table 1. In a further even more preferred embodiment, the microarray of the present invention comprises at least 2,500 nucleic acid molecules that specifically hybridize under high stringency to at least 2,500 nucleic acid molecules that encode a *B. thuringiensis* protein or fragment thereof set forth in Table 1. While it is understood that a single nucleic acid molecule may encode more than one protein homologue or fragment thereof, in a preferred embodiment, at least 50%, preferably at least 70%, more preferably at least 80%, even more preferably at least 90% of the nucleic acid molecules that comprise the microarray contain one protein or fragment thereof.

In a preferred embodiment, the microarray of the present invention comprises at least 10 nucleic acid molecules that specifically hybridize under high stringency to at least 10 nucleic acid molecules selected from the group consisting of SEQ ID NO: 1 through SEQ ID NO: 8283 or fragment thereof or complement of either. In a more preferred embodiment, the microarray of the present invention comprises at least 100 nucleic acid molecules that specifically hybridize under high stringency to at least 100 nucleic acid molecules that encode a *B. thuringiensis* protein or fragment thereof set forth in Table 1. In an even more preferred embodiment, the microarray of the present invention comprises at least 1,000 nucleic acid molecules that specifically hybridize under high stringency to at least 1,000 nucleic acid molecules that encode a *B. thuringiensis* protein or fragment thereof set forth in Table 1. In a further even more preferred embodiment, the microarray of the present invention comprises at least 2,500 nucleic acid molecules that specifically hybridize under high stringency to at least 2,500 nucleic acid molecules that encode a *B. thuringiensis* protein or fragment thereof set forth in Table 1. While it is understood that a single nucleic acid molecule may encode more than one protein homologue or fragment thereof, in a preferred embodiment, at least 50%, preferably at least 70%, more preferably at least 80%, even more preferably at least 90% of the nucleic acid molecules that comprise the microarray contain one protein homologue or fragment thereof.

Nucleic acid molecules of the present invention may be used in site directed mutagenesis. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34:315-23 (1985)); primer extension (Gilliam et al., *Gene* 12:129-137 (1980)); Zoller and Smith, *Methods Enzymol.* 100:468-500 (1983); and Dalbadie-McFarland et al., *Proc. Natl. Acad. Sci.* (*U.S.A.*) 79:6409-6413 (1982)) and methods based upon PCR (Scharf et al., *Science* 233:1076-1078 (1986); Higuchi et al., *Nucleic Acids Res.* 16:7351-7367 (1988)). Site-directed mutagenesis approaches are also described in European Patent 0 385 962, European Patent 0 359 472, and PCT Patent Application WO 93/07278.

Site-directed mutagenesis strategies have been applied to plants for both in vitro as well as in vivo site-directed mutagenesis (Lanz et al., *J. Biol. Chem.* 266:9971-9976 (1991); Kovgan and Zhdanov, *Biotekhnologiya* 5: 148-154, No. 207160n, Chemical Abstracts 110: 225 (1989); Ge et al., *Proc. Natl. Acad. Sci.* (*U.S.A.*) 86:4037-4041 (1989), Zhu et al., *J. Biol. Chem.* 271:18494-18498 (1996), Chu et al., Biochemistry 33:6150-6157 (1994), Small et al., *EMBO J.* 11:1291-1296 (1992), Cho et al., *Mol. Biotechnol.* 8:13-16 (1997), Kita et al., *J. Biol. Chem.* 271:26529-26535 (1996), Jin et al., *Mol. Microbiol.* 7:555-562 (1993), Hatfield and Vierstra, *J. Biol. Chem.* 267:14799-14803 (1992), Zhao et al., *Biochemistry* 31:5093-5099 (1992)).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)). In a preferred embodiment of the present invention, one or more of the nucleic acid molecules or fragments thereof of the present invention may be modified by site-directed mutagenesis.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995); Birren et al., *Genome Analysis: Analyzing DNA*, 1, Cold Spring Harbor, N.Y.).

(a) Computer Media

The nucleotide sequence provided in SEQ ID NO: 1, through SEQ ID NO: 8283 or fragment thereof, or complement thereof, or a nucleotide sequence at least 90% identical, preferably 95%, identical even more preferably 99% or 100% identical to the sequence provided in SEQ ID NO: 1 through SEQ ID NO: 8283 or fragment thereof, or complement thereof, can be "provided" in a variety of mediums to facilitate use. Such a medium can also provide a subset thereof in a form that allows a skilled artisan to examine the sequences.

In one application of this embodiment, a nucleotide sequence of the present invention can, be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mot Biol.* 215:403-410 (1990)) and BLAZE (Brutlag et al., *Comp. Chem.* 17:203-207 (1993)) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

The present invention also provides, in another aspect, a method for identifying one or more genes encoding insect inhibitory proteins in the sequences of one or more plasmids of a *Bacillus thuringiensis*, wherein the method of the present invention comprises the steps of: a) isolating and purifying plasmid DNA; b) constructing a DNA library from the isolated and purified plasmid DNA; c) sequencing the DNA library to obtain a set of plasmid DNA sequences; d) comparing the set of DNA sequences with a set of chromosomal DNA sequences, wherein the set of chromosomal DNA sequences comprises sequences depicted in SEQ ID No: 1 through SEQ ID No: 8283; e) identify common sequences, which are identified both in the set of plasmid DNA sequences and in the set of chromosomal DNA sequences; f) subtracting the common sequences from the set of plasmid DNA sequences to obtain a subtracted set of plasmid DNA sequences; g) assembling the subtracted set of DNA sequences to obtain contigs and sequences; h) determining open reading frames in the contigs and sequences; and h) identifying one or more genes encoding insect inhibitory proteins in the sequences of one or more plasmids of said *Bacillus thuringiensis*.

Methods for isolating and purifying plasmid DNA are well known in the art. For example, DNA samples comprising endogenous plasmids from *Bacillus thuringiensis* strains can be isolated and purified using the method of Hansen and Olsen (J. Bacteriology, Vol. 135, pp. 227-238 (1978)). Methods for constructing a DNA library are well known in the art.

As used herein, "a contig" refers to a contiguous nucleotide sequence that is assembled from two or more constituent nucleotide sequences that share common or overlapping regions of sequence homology. For example, the nucleotide sequences of two or more nucleic acid fragments can be compared and aligned in order to identify common or overlapping sequences. Where common or overlapping sequences exist between two or more nucleic acid fragments, the sequences (and thus their corresponding nucleic acid fragments) can be assembled into a single contiguous nucleotide sequence.

It is well known to a person skilled in the art that the sequence data from a large scale shotgun sequencing project can be processed and assembled into contigs, which represent a reconstruction of the original chromosomal genome sequence from the cloned fragments. Programs are available in the public domain that can analyze the sequence output and assemble the sequences into larger sequence regions representing contiguous sequences of the target genome. Examples of such programs can be found at, for example, the following web sites: genome.wustl.edu/gsc, sanger.ac.uk, and mbt.washington.edu. An example of a sequence reading program is Phred which can be found at the University of Washington web site mbt.washington.edu. Phred reads DNA sequencer trace data, calls bases, assigns quality values to the bases, and writes the base calls and quality values to output files.

The process of assembling DNA sequence fragments generally involves three phases; the overlap phase, the layout phase and the multi-alignment, or consensus, phase. In the overlap phase, each fragment is compared against every other fragment to determine if they share a common subsequence, an indication that they were potentially sampled from overlapping stretches of the original DNA strand. Pairs of fragments are compared in two ways; 1) with both fragments in the same relative orientation, and 2) with one of the fragments having been reverse complemented. In the layout phase, a series of alternate assemblies or layouts of the fragments based on the pairwise overlaps is generated. A layout specifies the relative locations and orientations of the fragments with respect to each other and is typically visualized as an arrangement of overlapping directed lines, one for each fragment. The general criterion for the layout phase is to produce plausible assemblies of maximum likelihood. In this manner, it can be determined if there is more than one way to put the pieces together and if different solutions appear equally plausible. In such a case, one would return to the lab and obtain additional information to resolve the ambiguity. The multi-alignment, or consensus, phase uses more information than just the pairwise alignments in the layout. The sequences of all the fragments in a layout are simultaneously aligned, giving a final set of contigs representing regions of the target genome. An example of an assembly program is PHRAP, which can be found at the University of Washington web site chimera.biotech.washington.edu/UWG/tools/phrap.htm.

A characteristic feature of a DNA sequence is that it can be compared with other known DNA sequences. Sequence comparisons can be undertaken by determining the similarity of the test or query sequence with sequences in publicly available or propriety databases ("similarity analysis") or by searching for certain motifs ("intrinsic sequence analysis") (e.g. cis elements) (Coulson, *Trends in Biotechnology* 12:76-80 (1994); Birren, et al., *Genome Analysis* 1:543-559 (1997)).

Similarity analysis includes database search and alignment. Examples of public databases include the DNA Database of Japan (DDBJ) website ddbj.nig.ac.jp; Genebank website ncbi.nlm.nih.gov/web/genbank/index.html; and the European Molecular Biology Laboratory Nucleic Acid Sequence Database (EMBL) website ebi.ac.uk/ebi_docs/embl_db.html. A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology* 12:76-80 (1994); Birren et al., *Genome Analysis* 1:543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics* 3:266-272 (1993)). BLASTN and BLASTX may be used in concert for analyzing sequence data (Coulson, *Trends in Biotechnology* 12:76-80 (1994); Birren et al., *Genome Analysis* 1:543-559 (1997).

Given a nucleotide coding sequence and the predicted protein which may be produced from that sequence, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one with which it aligns. Various scoring matrices are used to supply the substitution scores of all possible amino acid alignments. A general purpose scoring system is the BLOSUM62 matrix (Henikoff and Henikoff, *Proteins* 17:49-61 (1993)), which is currently the default choice for BLAST programs. BLOSUM62 is tailored for alignments of moderately diverged sequences and thus may not yield the best results under all conditions. Altschul, *J. Mol. Biol.* 36:290-300 (1993), uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package that performs progressive multiple sequence alignments based on the method of Feng and Doolittle, *J. Mol. Evol.* 25:351-360 (1987). Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available at: ftp.ebi.ac.uk. Another program is MACAW (Schuler et al., *Proteins, Struct. Func. Genet.* 9:180-190 (1991), for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research* 22:3583-3589 (1994)). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.* 18:267-268 (1993); Henikoff and Henikoff, *Nucleic Acid Research* 19:6565-6572 (1991); Henikoff and Henikoff, *Proteins* 17:49-61 (1993). BLOCKS searches a protein or protein encoding nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs) (Krough et al., *J. Mol. Biol.* 235:1501-1531 (1994); Eddy, *Current Opinion in Structural Biology* 6:361-365 (199)). In both cases, a large number of common protein domains have been converted into profiles, as present in the PROSITE library, or HHM models, as in the Pfam protein domain library (Sonnhammer et al., *Proteins* 28:405-420 (1997)). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al., *Proc. Natl. Acad. Sci.* 91:12091-12095 (1994).) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

The present invention also further provides, in another aspect, a method for identifying plasmid DNA sequences of a *Bacillus* species, the method comprising the steps of a) identifying a *Bacillus* species strain which does not contain plasmid DNA; b) generating a library of chromosomal genomic DNA from said *Bacillus* species strain which does not contain plasmid DNA; c) obtaining the nucleotide sequence of said chromosomal genomic DNA; d) identifying a *Bacillus* species strain which contains plasmid DNA; e) generating a library of said *Bacillus* species plasmid DNA; f) obtaining the nucleotide sequence of said plasmid DNA; g) subtracting any common sequences identified in the plasmid DNA which are also identified in the chromosomal genomic DNA; and h) constructing contigs and sequences of said plasmid DNA, wherein said contigs and sequences comprise the plasmid DNA sequence of said *Bacillus* species.

Insect inhibitory protein-encoding nucleic acids of the present invention will find particular uses in the plant protection against insects. For instance, insect-resistant trangenic plants can be generated by introducing the exogenous nucleic acids encoding an insect inhibitory polypeptide or protein or insect inhibitory fragment thereof listed in Table 1. Another example is to engineer transgenic microorganism (bacteria or fungi) to express insect inhibitory polypeptides or proteins of the present invention and then to apply them to the insect food source or allow them to reside in soil surrounding plant roots or on the surface of plant leaves.

The transgenic microorganisms of the present invention may be used to produce *B. thuringiensis* polypeptides or proteins of interest., particularly insect inhibitory polypeptides or proteins. Insect inhibitory polypeptides or proteins or insect inhibitory fragments thereof may be secreted, for example as in bacterial systems, meaning targeted to either the periplasm as for gram negative bacteria or localized to the extracellular space for gram negative or any other type of bacterium, or localized to the intracellular spaces within the cytoplasm. Such compositions may be administered to insects according to methods well known in the art. For example, insect inhibitory polypeptides or proteins of the present invention may be formulated as sprayable compositions or as a bait matrix.

Having now generally described the invention, the same will be more readily understood through reference to the following examples which are provided by way of illustration, and are not intended to be limiting of the present invention, unless specified.

Example 1

The DNA library designated LIB3237 (Monsanto Company, St. Louis, Mo., United States of America) was prepared from purified chromosomal DNA of *Bacillus thuringiensis* strain EG10650. *B. thuringiensis* EG10650 is a derivative of strain EG10368 (U.S. Pat. No. 5,759,538; Jun. 2, 1998) that is deficient in neutral protease and alkaline protease activities and contains only one known extrachromosomal plasmid element of 7.5 kb. Deletion mutations in both the alkaline protease and neutral protease genes which were constructed first in strain EG10368 to produce strains EG10654 and EG10624 were combined to produce strain EG10650. Strain EG10650 provides the value described in U.S. Pat. No. 5,759,538 in which microorganisms containing these modifications exhibit markedly lower proteolytic activity with respect to counterpart microorganisms containing non-disabled protease genes. The result of the reduced proteolytic activity is that the microorganisms expressing insecticidal crystal protein genes and which contain such disabled protease genes produce higher levels of insecticidal crystal proteins and produce crystal proteins having increased stability during storage.

To assure the availability of materials to those interested members of the public upon issuance of a patent on the present application, deposits of the microorganisms listed above were made prior to filing the present application with the ARS Patent Collection, Agricultural Research Service Culture Collection (NRRL), 1815 North University Street, Peoria, Ill. 61604. These microorganism deposits were made under the provisions of the "Budapest Treaty on the International Recognition of the Deposit of Microorganisms for the Purpose of Patent Procedure". EG10654 (NRRL Accession Number NRRL B-21344) and EG10624 (NRRL Accession Number NRRL B-21347) are currently available without restriction. All restrictions on the availability to the public of EG10650 (NRRL Accession Number NRRL B-30217) will be irrevocably removed upon issuance of a United States Patent based on this application. The DNA preparation, chromosomal DNA purification and library construction are described below.

DNA Preparation:

*Bacillus thuringiensis* EG10650 was grown under standard conditions in Brain Heart Infusion medium (Difco). Bacterial DNA was prepared in Agarose Plugs, according to the following procedure:

1. Single colony or loop full of bacteria was inoculated in 5 ml of plain Brain Heart Infusion medium and allowed to grow for overnight at 37° C.;
2. One ml of above culture was inoculated in 20 ml of plain Brain Heart Infusion medium and allowed to grow till 0.6 $OD_{600}$;
3. 180 µg/µl Chloramphenicol was added into the culture and the culture is allowed to grow for one more hour;
4. Cells were harvested by centrifuging at 5,000 g for 10 minutes at 4° C. and the harvested cells were washed with 10 ml Solution A and then re-suspended in 1 ml of cold Solution A;
5. The re-suspended cells were brought to room temperature and quickly mixed with equal volume of 2% Seaplaque (FMC Corp.) agarose which was prepared in Solution A and kept at 50° C. The mixture of the cells and agarose was casted as 100 ul plugs in a mold placed on ice;
6. After 1 hour or solidification, the plugs were carefully removed from mold and placed in a tube containing 2 ml of Solution B. The plugs were incubated in a bath at 50° C. for 12-16 hours with occasional shaking;
7. Proteinase K (0.5 mg/ml) was added in the tube and incubation was carried out for 16-24 hours; and 8. Finally the above solution was carefully replaced with 2 ml Solution C with 75 ug/ml Rnase. Incubation with Rnase was carried out for 16-24 hours. The plugs were stored at 4° C. in the same solution until they were needed.

Solution A: 1M NaCl, 50 mMTris HCl (pH 17.5)

Solution B: 50 mMTris HCl (pH7.5), 100 mM EDTA, 100 mM NaCl and 2% lysozyme.

Solution C: 50 mMTris HCl (pH7.5), 100 mM EDTA, 100 mM NaCl and 1% SDS.

Separation of Chromosomal DNA from Plasmid DNA:

High molecular weight plasmid DNA was removed from chromosomal DNA for obtaining desired DNA in plugs. Plasmids were removed By CHEF electrophoresis gel. Plugs were subjected to a electrical field of 6 V/cm at an angle of 120 degree in 0.5×TBE buffer and 1% agarose gel. Initial switch time of 0.47 seconds and final switch time 44.69 seconds with linear ramping was used for 15 hours. After 15 hours plugs were retrieved form gel and were used for isolation of chromosomal DNA by standard methods.

Library Construction:

Purified chromosomal DNA of *Bacillus thringiensis* strain EG 10650 was sheared to a desired size before size selecting by regular agarose gel electrophoresis. Ends of sheared and size selected DNA were repaired by PFU Polymerase (Stratagene). Repaired DNA was ligated to pSTBlue-1 vector at EcoR V site (Novagen) by using standard reagents and conditions recommended by manufacturer of DNA ligase enzyme (Life Technology). After ligation DNA was introduced by electroporation into commercially available *E. coli* DH10B cells (Life Technology). Transformants were plated on LB agar plate with amplicillin for selection of plasmids. Plasmid DNA was prepared by standard procedure for sequencing by T7 and SP6 primers.

Example 2

Two basic methods can be used for DNA sequencing, the chain termination method of Sanger et al., *Proc. Natl. Acad. Sci*. (*U.S.A.*) 74:5463-5467 (1977) and the chemical degradation method of Maxam and Gilbert, *Proc. Natl. Acad. Sci*. (*U.S.A.*) 74:560:564 (1977). Automation and advances in technology such as the replacement of radioisotopes with fluorescence-based sequencing have reduced the effort required to sequence DNA (Craxton, *Method,* 2:20-26 (1991); Ju et al., *Proc. Natl. Acad. Sci*. (*U.S.A.*) 92:4347-4351 (1995); Tabor and Richardson, *Proc. Natl. Acad. Sci*. (*U.S.A.*) 92:6339-6343 (1995)). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997)).

A number of sequencing techniques are known in the art, including fluorescence-based sequencing methodologies. These methods have the detection, automation and instrumentation capability necessary for the analysis of large volumes of sequence data Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., *Genome Analysis: Analyzing DNA,* 1, Cold Spring Harbor, N.Y.).

Example 3

Generation and Assembly of *Bacillus thuringiensis* Chromosomal Sequence

This example serves to illustrate the generation of the contigs and singletons listed in the Sequence Listing.

PHRED (phragment editor), which is developed by Phil Green at the University of Washington, was used to call the bases from the sequence trace files and to assign quality scores to the bases. PHRED uses Fourier methods to examine the four base traces in the region surrounding each point in the data set in order to predict a series of evenly spaced predicted locations. That is, it determines where the peaks would be centered if there were no compressions, dropouts, or other factors shifting the peaks from their "true" locations. Next, PHRED examines each trace to find the centers of the actual, or observed peaks and the areas of these peaks relative to their neighbors. The peaks are detected independently along each of the four traces so many peaks overlap. A dynamic programming algorithm is used to match the observed peaks detected in the second step with the predicted peak locations found in the first step. Default parameters were used in the base calling.

After the base calling is completed, sequence preprocessing is performed. Quality assessment and trimming is performed by determining the maximum scoring segment of PHRED quality score >10. Cloning sequences are removed by utilizing cross_match (http://www.mbt.washington.edu) and searching a database of relevant cloning sequences. Contaminating sequences (*E. coli*, yeast, vector, linker) are then removed from the dataset by utilizing cross_match to search a database of contamination sequences.

The preprocessed sequences are then assembled into contigs, or groups of overlapping sequences. Contigs are assembled using PHRAP (phragment assembly program), also developed by Green and available at the University of Washington, website mbt.washington.edu, using default assembly parameters. This program takes a file of shotgun sequences and compiles consensus contig sequences. Alignments are influenced by quality scores, based on Green's algorithm. Singletons are the remaining sequences without sufficient overlaps with others after the assembly.

A total of 8283 contigs and singletons were obtained. Contig sequences are recognized as those sequences whose designations begin with. Singleton sequences are recognized as those having designations which begin with. All contig and singleton sequences were run through the annotation and gene selection processes as described in Example 4.

Example 4

Identification of *Bacillus thuringiensis* Genes

This example illustrates the identification of genes within the contig and singleton sequences assembled as described in Example 3. The genes and partial genes embedded in such contigs and singletons were identified through a series of informatic analyses.

Contigs and singletons are interrogated using AAT-NAP and BLASTP. AAT NAP is a program used for constructing a global alignment of a DNA sequence and a protein sequence (Huang, X. et al. Genomics 46:37-45 (1997), the entirety of which is herein incorporated by reference). The alignment model of NAP accommodates introns and frameshifts within codons. The scheme for scoring an alignment has several features that allow NAP to identify the exact locations of introns. A nucleotide insertion gap of length ≦k is given a linear penalty, and a nucleotide insertion gap of length >k is penalized as a gap of length k, where the value for k is the default value. The NAP program reports the starting and ending coordinates of predicted genes. The input to the NAP program includes the query sequence, the protein database and a coordinate file produced by AAT_EXT (an adapter between a database search program and a sequence alignment program) from the output of AAT_DPS (a program computing high-scoring chains of segment pairs between a query DNA sequence and the public non-redundant protein database from NCBI) The NAP program scans the protein database and finds the protein sequence for each coordinate record. Then for each coordinate record, NAP locates the query region, extends the region in both directions by a certain number of bases, and computes an alignment of the extended region and the protein sequence. NAP corrects frameshifts in the query sequence.

BLASTP is used to validate the amino acid sequences and hits reported by the AAT NAP program and to assign BLAST scores and p values to each sequence/hit pair. The AAT NAP generated amino acid sequences are compared with the public non-redundant protein database (nr.aa from NCBI) using the default BLASTP parameters except that the V parameter is set to 1000000 (to report up to 1000000 hits that exceed the BLASTP default report cutoff) If the hit reported by AAT NAP for a particular amino acid sequence is not reported by BLASTP, that particular amino acid sequence is removed. Protein encoding regions in the *Bacillus thuringiensis* nucleic acid molecules of the present invention are listed in Table 1.

Coding sequences identified in Table 1 encode many useful *B. thuringiensis* polypeptides or proteins or fragments thereof, including but not limited to insect inhibitory polypeptides or proteins, polypeptides or proteins capable of conferring antibiotic resistance, cytotoxin proteins which may be used as microbial inhibitory proteins including bactericidal, bacteriostatic, fungicidal, and fungistatic polypeptides or proteins, polyketide synthases, polypeptides or proteins capable of conferring resistance to heavy metals or other chemicals, transposons and mobile genetic elements and their corresponding transposases, excisases, integrases, and invertases, phage and phage particle proteins, transcription regulatory proteins, translation regulatory proteins, and other useful proteins homologous to proteins.

Lengthy table referenced here

US07700838-20100420-T00001

Please refer to the end of the specification for access instructions.

The following tables, Table 2 through Table 5, are offered by way of illustration and not by way of limitation. It is to be understood that the present invention is not limited to the particular proteins or polypeptides or particular coding nucleotide sequences listed in Table 2 through 5.

TABLE 2

Sigma Factor Homologs

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 184 | Bt1G227 | g548832 | 114 | 113 | 1.80E−13 | 29 | 76 | RNA POLYMERASE SIGMA-H FACTOR (SIGMA-30) [*Pseudomonas aeruginosa*] |
| 337 | Bt1G411 | g141373 | 173 | 177 | 1.30E−13 | 44 | 99 | SIGMA-K FACTOR PROCESSING REGULATORY PROTEIN BOFA (BYPASS-OF-FORESPORE PROTEIN) [*Bacillus subtilis*] |
| 499 | Bt1G627 | g133475 | 1164 | 1175 | 2.30E−119 | 89 | 100 | RNA POLYMERASE SIGMA-G FACTOR (STAGE III SPORULATION PROTEIN G) [*Bacillus subtilis*] |
| 499 | Bt1G628 | g133289 | 755 | 719 | 4.90E−71 | 96 | 68 | RNA POLYMERASE SIGMA-35 FACTOR PRECURSOR [*Bacillus thuringiensis*] |
| 1076 | Bt1G1739 | g133282 | 1169 | 1169 | 1.00E−118 | 100 | 100 | RNA POLYMERASE SIGMA-28 FACTOR PRECURSOR [*Bacillus thuringiensis*] |
| 1108 | Bt1G1857 | g282367 | 639 | 672 | 4.70E−66 | 76 | 77 | transcription initiation factor sigma H-Bacillus megaterium [*Bacillus megaterium*] |
| 1179 | Bt1G2157 | g133466 | 1246 | 1273 | 9.60E−130 | 84 | 79 | RNA POLYMERASE SIGMA FACTOR RPOD (SIGMA-A) (SIGMA-43) [*Bacillus subtilis*] |

TABLE 2-continued

Sigma Factor Homologs

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 1189 | Bt1G2201 | g134763 | 167 | 119 | 8.20E−07 | 58 | 17 | SPORULATION SIGMA-E FACTOR PROCESSING PEPTIDASE (STAGE II SPORULATION PROTEIN GA) [*Bacillus subtilis*] |
| 1205 | Bt1G2294 | g3287912 | 431 | 431 | 1.60E−40 | 72 | 99 | ANTI-SIGMA F FACTOR ANTAGONIST (STAGE II SPORULATION PROTEIN AA) [*Bacillus coagulans*] |
| 1205 | Bt1G2295 | g134757 | 591 | 591 | 1.80E−57 | 79 | 99 | ANTI-SIGMA F FACTOR (STAGE II SPORULATION PROTEIN AB) [*Bacillus licheniformis*] |
| 1205 | Bt1G2296 | g464690 | 1071 | 1023 | 3.00E−103 | 83 | 100 | RNA POLYMERASE SIGMA-F FACTOR (STAGE II SPORULATION PROTEIN AC) (SPORULATION SIGMA FACTOR) [*Bacillus megateriuml*] |
| 1227 | Bt1G2414 | g2633716 | 565 | 587 | 4.80E−57 | 49 | 100 | (Z99111) similar to RNA polymerase sigma factor [*Bacillus subtiuis*] |
| 1248 | Bt1G2533 | g1731060 | 2059 | 2038 | 8.30E−211 | 61 | 97 | PUTATIVE SIGMA L-DEPENDENT TRANSCRIPTIONAL REGULATOR IN MMGE-BFMBAA INTERGENIC REGION [*Bacillus subtilis*] |
| 1262 | Bt1G2627 | g133292 | 835 | 855 | 1.90E−85 | 42 | 100 | RNA POLYMERASE SIGMA-54 FACTOR [*Bacillus subtilis*] |
| 1274 | Bt1G2697 | g1941918 | 240 | 283 | 7.80E−25 | 35 | 99 | (X93081) sigma F/sigma G transcribed gene [*Bacillus subtilis*] |
| 1328 | Bt1G3067 | g3386359 | 711 | 721 | 3.00E−71 | 53 | 100 | (AF074855) RNA polymerase sigma B [*Listeria monocytogenes*] |
| 1357 | Bt1G3331 | g3024615 | 156 | 208 | 6.90E−17 | 25 | 99 | RNA POLYMERASE SIGMA FACTOR SIGV [*Bacillus subtilis*] |
| 1357 | Bt1G3332 | g548832 | 157 | 172 | 4.50E−13 | 26 | 99 | RNA POLYMIERASE SIGMA-H FACTOR (SIGMA-30) [*Pseudomonas aeruginosa*] |
| 1364 | Bt1G3404 | g3688548 | 86 | 185 | 1.90E−14 | 28 | 81 | (AJ010320) RNA polymerase sigma factor [*Streptomyces coelicolor*] |
| 1721 | Bt1G4125 | g133466 | 99 | 114 | 4.10E−06 | 33 | 23 | RNA POLYMERASE SIGMA FACTOR RPOD (SIGMA-A) (SIGMA-43) [*Bacillus subtilis*] |
| 1764 | Bt1G4l71 | g133481 | 172 | 203 | 2.30E−16 | 50 | 71 | POSSIBLE RNA POLYMERASE SIGMA-G FACTOR (ORF3) [*Bacillus thuringiensis*] |
| 2212 | Bt1G4696 | g133475 | 272 | 298 | 2.00E−26 | 63 | 36 | RNA POLYMERASE SIGMA-G FACTOR (STAGE III SPORULATION PROTEIN G) [*Bacillus subtilis*] |

SEQ ID NO: A sequential SEQ ID NO: is assigned to each contig or singleton and the SEQ ID NO: corresponds to that set forth in the sequence listing.
Gene ID: Refers to an arbitrarily assigned Gene ID number.
NCBI gi: Each sequence in the GenBank public database is arbitrarily assigned a unique NCBI gi (National Center for Biotechnology Information GenBank Identifier) number. In this table, the NCBI gi number which is associated (in the same row) with a given contig or singleton refers to the particular GenBank sequence which is the best match for that sequence.
aat_nap score: The aat_nap score is reported by the nap program in the aat package. It is an alignment score in which each match and mismatch is scored based on the BLOSUM62 scoring matrix.
Blastp-Prob: The entries in the "Blastp-Prob" column refer to the probability that such matches occur by chance.
BlastP Score: Each entry in the "BlastP Score" column of the table refers to the BLASTP score that is generated by sequence comparison of the designated clone with the designated GenBank sequence.
% Iden: The entries in the "% Iden" column of the table refer to the percentage of identically matched nucleotides (or residues) that exist along the length of that portion of the sequences which is aligned by the BLAST comparison to generate the statistical scores presented
% cvrg: The % coverage is the percent of hit sequence length that matches to the query sequence (% coverage = (match length/hit total length) × 100).
NCBI gi description: The "NCBIgidesc" column provides a description of the NCBIgi referenced in the "NCBIgi" column.

TABLE 3

Transposases, Integrases, and Transposons

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 2 | Bt1G2 | g2497382 | 150 | 145 | 2.30E−09 | 34 | 33 | TRANSPOSASE FOR INSERTION SEQUENCE ELEMENT IS232 [Insertion sequence IS232] |

TABLE 3-continued

Transposases, Integrases, and Transposons

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 64 | Bt1G88 | g3005554 | 93 | 140 | 4.30E−09 | 22 | 36 | (AF047044) putative transposase [Anabaena PCC7120] |
| 226 | Bt1G276 | g549114 | 374 | 410 | 2.70E−38 | 80 | 19 | TRANSPOSASE FOR INSERTION SEQUENCE ELEMENT 1523 IF [Bacillus thuringiensis] |
| 379 | Bt1G464 | g2497400 | 184 | 229 | 4.10E−19 | 38 | 60 | HYPOTHETICAL TRANSPOSASE-LIKE PROTEIN HI1721 [Haemophilus influenzae Rd] |
| 383 | Bt1G468 | g2497400 | 171 | 211 | 3.30E−17 | 36 | 57 | HYPOTHETICAL TRANSPOSASE-LIKE PROTEIN HI1721 [Haemophilus influenzae Rd] |
| 387 | Bt1G475 | g549113 | 337 | 296 | 7.50E−26 | 72 | 21 | TRANSPOSASE FOR INSERTION SEQUENCE ELEMENT IS231E [Bacillus thuringiensis] |
| 410 | Bt1G502 | g2127290 | 57 | 123 | 1.80E−07 | 34 | 32 | transposase (insertion sequence IS231)-Bacillus thuringiensis [Bacillus thuringiensis] |
| 416 | Bt1G512 | g2497382 | 537 | 570 | 4.40E−57 | 85 | 29 | TRANSPOSASE FOR INSERTION SEQUENCE ELEMENT IS232 [Insertion sequence IS232] |
| 546 | Bt1G691 | g2497382 | 606 | 641 | 9.00E−63 | 94 | 31 | TRANSPOSASE FOR INSERTION SEQUENCE ELEMENT IS232 [Insertion sequence IS232] |
| 555 | Bt1G707 | g3005554 | 86 | 113 | 4.00E−06 | 29 | 22 | (AF047044) putative transposase [Anabaena PCC7120] |
| 603 | Bt1G782 | g3005554 | 79 | 142 | 2.60E−09 | 29 | 28 | (AF047044) putative transposase [Anabaena PCC7 120] |
| 642 | Bt1G840 | g3426013 | 288 | 362 | 3.30E−33 | 28 | 85 | (AB016803) transposase [Deinococcus radiodurans] |
| 644 | Bt1G843 | g1789981 | 110 | 135 | 1.10E−08 | 44 | 20 | (AE000433) IS150 putative transposase [Escherichia coli] |
| 660 | Bt1G864 | g2497382 | 109 | 125 | 3.40E−07 | 96 | 6 | TRANSPOSASE FOR INSERTION SEQUENCE ELEMENT 15232 [Insertion sequence IS232] |
| 691 | Bt1G912 | g1694898 | 597 | 635 | 1.70E−61 | 36 | 37 | (Y09450) transposase [Pseudomonas putida] |
| 691 | Bt1G913 | g79972 | 194 | 299 | 2.70E−25 | 26 | 34 | transposase tnpA-Enterococcus faecalis plasmid pAD2 transposon Tn917 [Transposon Tn917] |
| 781 | Bt1G1068 | g1789981 | 276 | 299 | 1.60E−26 | 54 | 35 | (AE000433) IS150 putative transposase [Escherichia coli] |
| 799 | Bt1G1102 | g1694898 | 358 | 411 | 2.80E−37 | 30 | 29 | (Y09450) transposase [Pseudomonas putida] |
| 980 | Bt1G1481 | g1749770 | 308 | 351 | 4.90E−32 | 46 | 52 | (Y09946) transposase [Bacillus thuringiensis] |
| 1002 | Bt1G1538 | g2497400 | 183 | 231 | 2.50E−19 | 40 | 57 | HYPOTHETICAL TRANSPOSASE-LIKE PROTEIN HI1721 [Haemophilus influenzae Rd] |
| 1045 | Bt1G1654 | g2497382 | 912 | 882 | 2.60E−88 | 91 | 45 | TRANSPOSASE FOR INSERTION SEQUENCE ELEMENT IS232 [Insertion sequence IS232] |
| 1072 | Bt1G1724 | g3005554 | 105 | 162 | 1.60E−11 | 24 | 41 | (AF047044) putative transposase [Anabaena PCC7120] |
| 1098 | Bt1G1819 | g2497382 | 424 | 470 | 1.20E−44 | 94 | 23 | TRANSPOSASE FOR INSERTION SEQUENCE ELEMENT IS232 [Insertion sequence IS232] |
| 1190 | Bt1G2215 | g2497382 | 286 | 292 | 9.10E−26 | 76 | 18 | TRANSPOSASE FOR INSERTION SEQUENCE ELEMENT IS232 [Insertion sequence IS232] |
| 1207 | Bt1G2302 | g2497382 | 532 | 548 | 6.50E−53 | 99 | 25 | TRANSPOSASE FOR INSERTION SEQUENCE ELEMENT IS232 [Insertion sequence IS232] |
| 1214 | Bt1G2345 | g2497382 | 528 | 544 | 1.70E−52 | 99 | 24 | TRANSPOSASE FOR INSERTION SEQUENCE ELEMENT IS232 [Insertion sequence IS232] |
| 1252 | Bt1G2554 | g136144 | 2449 | 2407 | 6.60E−250 | 99 | 100 | TRANSPOSASE FOR INSERTION SEQUENCE ELEMENT IS231C [Bacillus thuringiensis] |
| 1273 | Bt1G2694 | g3005554 | 100 | 138 | 7.20E−09 | 24 | 37 | (AF047044) putative transposase [Anabaena PCC7120] |
| 1275 | Bt1G2705 | g135956 | 459 | 718 | 6.30E−71 | 29 | 100 | TRANSPOSASE B (TRANSPOSON TN554) [Staphylococcus aureus] |

TABLE 3-continued

Transposases, Integrases, and Transposons

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 1305 | Bt1G2905 | g2098612 | 342 | 433 | 9.90E−41 | 38 | 100 | (U66614) putative transposase [*Marinococcus halophilus*] |
| 1317 | Bt1G2979 | g1789981 | 387 | 406 | 7.20E−38 | 52 | 50 | (AE000433) IS150 putative transposase [*Escherichia coil*] |
| 1330 | Bt1G3082 | g3005554 | 93 | 139 | 5.60E−09 | 25 | 32 | (AF047044) putative transposase [*Anabaena* PCC7120] |
| 1340 | Bt1G3161 | g2497382 | 2231 | 2231 | 2.90E−231 | 100 | 100 | TRANSPOSASE FOR INSERTION SEQUENCE ELEMENT IS232 [Insertion sequence IS232] |
| 1353 | Bt1G3278 | g136144 | 316 | 340 | 7.10E−31 | 94 | 15 | TRANSPOSASE FOR INSERTION SEQUENCE ELEMENT 1S231C [*Bacillus thuringiensis*] |
| 1354 | Bt1G3289 | g3426013 | 330 | 510 | 6.90E−49 | 30 | 94 | (AB016803) transposase [Deinococcus radiodurans] |
| 1362 | Bt1G3378 | g2497382 | 616 | 622 | 9.30E−61 | 95 | 29 | TRANSPOSASE FOR INSERTION SEQUENCE ELEMENT IS232 [Insertion sequence IS232] |
| 1378 | Bt1G3590 | g1749770 | 280 | 308 | 1.70E−27 | 52 | 41 | (Y09946) transposase [*Bacillus thuringiensis*] |
| 1378 | Bt1G3595 | g2497400 | 187 | 229 | 4.10E−19 | 38 | 57 | HYPOTHETICAL TRANSPOSASE-LIKE PROTEIN HI1721 [Haemophilusa influeazae Rd] |
| 1380 | Bt1G3625 | g1789981 | 796 | 806 | 3.00E−80 | 52 | 100 | (AE000433) IS150 putative transposase [*Escherichia coil*] |
| 1383 | Bt1G3662 | g1789981 | 852 | 809 | 1.40E−80 | 54 | 100 | (AE000433) IS150 putative transposase [*Escherichia coil*] |
| 1386 | Bt1G3684 | g3005554 | 117 | 208 | 7.90E−17 | 20 | 72 | (AF047044) putative transposase [*Anabaena* PCC7120] |
| 1386 | Bt1G3687 | g3218350 | 169 | 240 | 2.80E−20 | 26 | 100 | (AL023861)putative IS element transposase [Streptomyces coelicolor] |
| 1388 | Bt1G3704 | g3005554 | 97 | 135 | 1.50E−08 | 24 | 36 | (AF047044) putative transposase [*Anabaena* PCC7120] |
| 1391 | Bt1G3745 | g1749770 | 735 | 735 | 9.90E−73 | 51 | 100 | (Y09946)transposase [*Bacillus thuringiensis*] |
| 1392 | Bt1G3762 | g136144 | 2443 | 2424 | 1.00E−251 | 100 | 100 | TRANSPOSASE FOR INSERTION SEQUENCE ELEMENT IS231C [*Bacillus thuringiensis*] |
| 1549 | Bt1G3942 | g2497400 | 92 | 120 | 2.30E−07 | 28 | 46 | HYPOTHETICAL TRANSPOSASE-LIKE PROTEIN HI1721 [*Haemophilus influenzae* Rd] |
| 1573 | Bt1G3970 | g2497382 | 153 | 179 | 4.60E−13 | 43 | 21 | TRANSPOSASE FOR INSERTION SEQUENCE ELEMENT IS232 [Insertion sequence IS232] |
| 1611 | Bt1G4009 | g2497382 | 129 | 139 | 1.00E−08 | 49 | 17 | TRANSPOSASE FOR INSERTION SEQUENCE ELEMENT IS232 [Insertion sequence IS232] |
| 1698 | Bt1G4102 | g2497382 | 177 | 220 | 1.50E−17 | 44 | 24 | TRANSPOSASE FOR INSERTION SEQUENCE ELEMENT 15232 [Insertion sequence IS232] |
| 1725 | Bt1G4130 | g2497382 | 115 | 159 | 6.90E−11 | 52 | 14 | TRANSPOSASE FOR INSERTION SEQUENCE ELEMENT IS232 [Insertion sequence IS232] |
| 1739 | Bt1G4145 | g2497382 | 270 | 276 | 7.20E−24 | 49 | 29 | TRANSPOSASE FOR iNSERTION SEQUENCE ELEMENT 15232 [Insertion sequence IS232] |
| 1804 | Bt1G4211 | g2497382 | 213 | 248 | 1.10E−20 | 56 | 22 | TRANSPOSASE FOR INSERTION SEQUENCE ELEMENT 1S232 [Insertion sequence IS232] |
| 1869 | Bt1G4277 | g549114 | 93 | 161 | 5.10E−11 | 28 | 26 | TRANSPOSASE FOR INSERTION SEQUENCE ELEMENT IS21F [*Bacillus thuringiensis*] |
| 1902 | Bt1G4312 | g1789981 | 258 | 286 | 3.80E−25 | 35 | 58 | (AE000433)IS150 putaivetransposase *Escherichia coil*] |
| 1965 | Bt1G4386 | g2497382 | 218 | 203 | 1.10E−15 | 36 | 40 | TRANSPOSASE FOR INSERTION SEQUENCE ELEMENT 1S232 [Insertion sequence IS232] |
| 2041 | Bt1G4473 | g136144 | 266 | 307 | 4.10E−27 | 66 | 20 | TRANSPOSASE FOR INSERTION SEQUENCE ELEMENT IS231C [*Bacillus thuringiensis*] |
| 2049 | Bt1G4484 | g2497382 | 119 | 154 | 2.40E−10 | 35 | 22 | TRANSPOSASE FOR INSERTION SEQUENCE ELEMENT IS232 [Insertion sequence IS232] |

TABLE 3-continued

Transposases, Integrases, and Transposons

| SEQ ID NO | Gene Id | NCBI gi | aat nap Score | BlastP Score | BlastP- Prob | % Ident | % Cvrg | NCBI gi description |
|---|---|---|---|---|---|---|---|---|
| 213 | 0 Bt1G4607 | g2497382 | 130 | 155 | 1.90E−10 | 56 | 13 | TRANSPOSASE FOR INSERTION SEQUENCE ELEMENT 15232 [Insertion sequence 15232] |
| 2135 | Bt1G4612 | g2497382 | 174 | 229 | 1.50E−18 | 49 | 27 | TRANSPOSASE FOR INSERTION SEQUENCE ELEMENT 15232 [Insertion sequence 15232] |
| 2153 | Bt1C4631 | g2497382 | 130 | 187 | 6.20E−14 | 61 | 13 | TRANSPOSASE FOR INSERTION SEQUENCE ELEMENT IS232 [Insertion sequence IS232] |
| 102 | Bt1G134 | g586206 | 178 | 178 | 1.90E−13 | 67 | 16 | D-ALANYL-D-ALANINE-CARBOXYPEPTIDASE (DD-PEPTIDASE) (DD-CARBOXYPEPTIDASE) [Transposon Tn1546] |
| 1340 | Bt1G3160 | g141450 | 74 | 136 | 1.40E−08 | 32 | 29 | HYPOTHETICAL 37.1 KD PROTEIN IN TRANSPOSON TN4556 [Transposon Tn4556] |
| 1795 | Bt1G4202 | g1196998 | 220 | 208 | 2.50E−16 | 55 | 24 | (J01829) unknown protein [Transposon Tn10] |
| 1797 | Bt1G4204 | g1196998 | 160 | 180 | 3.00E−13 | 51 | 18 | (J01829) unknown protein [Transposon Tn10] |
| 1989 | Bt1G4413 | g4309763 | 475 | 494 | 6.20E−46 | 75 | 10 | (AC006217) putative retrotransposon polyprotein [*Arabidopsis thaliana*] |
| 2055 | Bt1G4494 | g479357 | 235 | 251 | 1.60E−20 | 65 | 14 | hypothetical protein 612-maize transposon MuA2 [*Zea mays*] |
| 2057 | Bt1G4496 | g2130141 | 254 | 184 | 4.20E−13 | 51 | 14 | mudrA protein-maize transposon MuDR [*Zea mays*] |
| 2248 | Bt1G4735 | g196998 | 108 | 118 | 1.70E−06 | 61 | 11 | (J01829) unknown protein [Transposon Tn10] |
| 14 | Bt1G21 | g1710383 | 584 | 606 | 4.60E−59 | 72 | 53 | PROBABLE INTEGRASE/RECOMB1NASE RIPX [*Bacillus subtilis*] |
| 296 | Bt1G3S7 | g4098413 | 95 | 173 | 1.20E−12 | 32 | 32 | (U77495) putative integrase [*Leuconostoc oenos* bacteriophage 10MC] |
| 722 | Bt1G961 | g4490997 | 364 | 442 | 1.10E−41 | 29 | 100 | (AL035707) putative integrase [*Streptomyces coelicolor*] |
| 834 | Bt1G1164 | g1881291 | 294 | 381 | 3.20E−35 | 29 | 95 | (AB001488) PROBABLE INTEGRASE. [*Bacillus subtilis*] |
| 834 | Bt1G1165 | g166159 | 321 | 335 | 2.40E−30 | 30 | 95 | (M34832)integrase(int) [Bacteriophage phi-11] |
| 999 | Bt1G1529 | g1926326 | 693 | 724 | 1.40E−71 | 39 | 100 | (X98106) integrase [Bacteriophage phigle] |

SEQ ID NO: A sequential SEQ ID NO: is assigned to each contig or singleton and the SEQ ID NO: corresponds to that set forth in the sequence listing.
Gene ID: Refers to an arbitrarily assigned Gene ID number.
NCBI gi: Each sequence in the GenBank public database is arbitrarily assigned a unique NCBI gi (national Center for Biotechnology Information GenBank Identifier) number. In this table, the NCBI gi number which is associated (in the same row) with a given contig or singleton refers to the particular GenBank sequence which is the best match for that sequence.
aat_nap score: The aat_nap score is reported by the nap program in the nat package. It is an alignment score in which each match and mismatch is scored based on the BLOSUM62 scoring matrix.
Blastp-Prob: The entries in the "Blastp-Prob" column refer to the probability that such matches occur by chance.
BlastP Score: Each entry in the "BlastP Score" column of the table refers to the BLASTP score that is generated by sequence comparison of the designated clone with the designated GenBank sequence.
% Iden: The entries in the "% Iden" column of the table refer to the percentage of identically matched nucleotides (or residues) that exist along the length of that portion of the sequences which is aligned by the BLAST comparison to generate the statistical scores presented
% evrg: The % coverage is the percent of hit sequence length that matches to the query sequence (% coverage = (match length/hit total length) × 100).
NCBI gi description: The "NCBIgidesc" column provides a description of the NCBIgi referenced in the "NCBIgi" column.

TABLE 4

Antibiotic, Chemical, and Heavy Metal Resistance

| SEQ ID NO | Gene Id | NCBI gi | aat nap Score | BlastP Score | BlastP- Prob | % Ident | % Cvrg | NCBI gi description |
|---|---|---|---|---|---|---|---|---|
| 33 | Bt1G51 | g266515 | 250 | 273 | 2.10E−22 | 29 | 19 | MULTIDRUG RESISTANCE-LIKE ATP-BINDING PROTEIN MDL [*Escherichia coli*] |

TABLE 4-continued

Antibiotic, Chemical, and Heavy Metal Resistance

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 98 | Bt1G130 | g3861147 | 104 | 114 | 4.80E−06 | 33 | 17 | (AJ235272)BICYCLOMYCIN RESISTANCE PROTEIN (bcrl) [*Rickettsia prowazekii*] |
| 145 | Bt1G181 | g1174516 | 499 | 526 | 1.30E−49 | 55 | 17 | ISOLEUCYL-TRNA SYNTHETASE, MUPIROCIN RESISTANT (ISOLEUCINETRNA LIGASE) (ILERS) (MUPIROCIN RESISTANCE PROTEIN) [*Staphylococcus aureus*] |
| 162 | Bt1G201 | g1684651 | 432 | 314 | 4.00E−28 | 37 | 56 | (Z82987) unknown similar to quinolon resistance protein NorA [*Bacillus subtilis*] |
| 180 | Bt1G222 | g1945096 | 183 | 192 | 1.70E−14 | 54 | 19 | (D88802) S. lividans chloramphenicol resistance protein; P31141(492) transmembrane [*Bacillus subtilis*] |
| 204 | Bt1G249 | g136472 | 237 | 284 | 6.10E−25 | 33 | 99 | ACETYLTRANSFERASE (TABTOXIN RESISTANCE PROTEIN) [*Pseudomonas syringae*] |
| 275 | Bt1G332 | g2108269 | 116 | 133 | 6.10E−09 | 41 | 41 | (X92868) mercuric resistance operon regulatory protein [*Bacillus subtilis*] |
| 298 | Bt1G359 | g1684651 | 383 | 298 | 2.00E−26 | 38 | 48 | (Z82987) unknown similar to quinolon resistance protein NorA [*Bacillus subtilis*] |
| 361 | Bt1G441 | g3861147 | 199 | 215 | 4.30E−17 | 27 | 60 | (AJ235272) BICYCLOMYCIN RESISTANCE PROTEIN (bcrl) [*Rickettsia prowazekii*] |
| 397 | Bt1G486 | g1705428 | 604 | 605 | 5.90E−59 | 59 | 84 | BACITRACIN RESISTANCE PROTEIN (PUTATIVE UNDECAPRENOL KINASE) [*Escherichia coli*] |
| 421 | Bt1G519 | g1174634 | 93 | 168 | 2.10E−12 | 26 | 60 | TELLURITE RESISTANCE PROTEIN TEHB HOMOLOG [*Haemophilus influenzae* Rd] |
| 423 | Bt1G522 | g2633162 | 329 | 245 | 7.60E−26 | 25 | 83 | (Z99108) similar to multidrug resistance protein [*Bacillus subtilis*] |
| 579 | Bt1G744 | g1684651 | 638 | 349 | 9.00E−55 | 33 | 100 | (Z82987) unknown similar to quinolon resistance protein NorA [*Bacillus subtills*] |
| 613 | Bt1G795 | g2632985 | 1127 | 958 | 2.30E−96 | 37 | 66 | (Z99107) similar to acriflavin resistance protein [*Bacillus subtilis*] |
| 624 | Bt1G809 | g2688027 | 183 | 189 | 1.70E−13 | 22 | 27 | (AE001125) acriflavine resistance protein (acrB) [*Borrelia burgdorferi*] |
| 692 | Bt1G915 | g2145816 | 117 | 144 | 4.20E−10 | 28 | 99 | bacitracin resistance protein homolog bacA-Mycobacterium leprae [*Mycobacterium leprae*] |
| 726 | Bt1G970 | g2500765 | 396 | 404 | 1.20E−37 | 28 | 100 | SENSOR PROTEIN VANSB (VANCOMYCIN B-TYPE RESISTANCE PROTEIN VANSB) (VANCOMYCIN HISTIDINE PROTEIN KINASE) [*Enterococcus faecalis*] |
| 862 | Bt1G1220 | g2827439 | 1774 | 1774 | 7.80E−183 | 78 | 100 | (AF043609) aluminum resistance protein [*Arthrobacter viscosus*] |
| 930 | Bt1G1354 | g2499116 | 335 | 371 | 3.70E−34 | 29 | 100 | VANCOMYCIN B-TYPE RESISTANCE PROTEiN VANW [*Enterococcus faecalis*] |
| 950 | Bt1G1408 | g1277135 | 374 | 374 | 1.80E−34 | 41 | 42 | (U50978) kanamycin/gentamycin-resistance protein [Cloning vector pFW13] |
| 986 | Bt1G1495 | g399406 | 246 | 212 | 2.60E−17 | 25 | 85 | DAUNORUBICIN RESISTANCE TRANSMEMBRANE PROTEiN [*Streptomyces peucetius*] |
| 995 | Bt1G1520 | g1174516 | 1843 | 1846 | 1.80E−190 | 58 | 53 | ISOLEUCYL-TRNA SYNTHETASE, MUPIROCIN RESISTANT (ISOLEUCINETRNA LIGASE) (ILERS) (MUPIROCIN RESISTANCE PROTEIN) [*Staphylococcus aureus*] |
| 1005 | Bt1G1550 | g2879772 | 110 | 145 | 3.30E−10 | 37 | 45 | (Y07640) putative mercury resistance operon regulatory protein (MerR) [*Listeria monocytogenes*] |
| 1023 | BtlG1597 | g1945096 | 952 | 778 | 2.70E−77 | 46 | 100 | (D88802) S. lividans chloramphenicol resistance protein; P31141 (492) transmembrane [*Bacillus subtilis*] |
| 1130 | Bt1G1938 | g1652918 | 412 | 300 | 1.20E−26 | 28 | 100 | (D90909) quinolene resistance protein NorA [*Synechocystis sp.*] |

TABLE 4-continued

Antibiotic, Chemical, and Heavy Metal Resistance

| SEQ ID NO | Gene Id | NCBI gi | aat nap Score | BlastP Score | BlastP- Prob | % Ident | % Cvrg | NCBI gi description |
|---|---|---|---|---|---|---|---|---|
| 1188 | Bt1G2199 | g585375 | 1044 | 1054 | 1.60E−106 | 70 | 100 | DIMETHYLADENOSINE TRANSFERASE (S-ADENOSYLMETHIONINE-6-N', N'-ADENOSYL(RRNA) DIMETHYLTRANSFERASE) (16S RRNA DIMETHYLASE) (HIGH LEVEL KASUGAMYCiN RESISTANCE PROTEIN KSGA) (KASUGAMYCIN DIMETHYLTRANSFERASE) [*Bacillus subtilis*] |
| 1190 | Bt1G2211 | g2633434 | 931 | 787 | 3.10E−78 | 42 | 100 | (Z99109)similar to multidrug resistance protein [*Bacillus subtilis*] |
| 1208 | Bt1G2308 | g2634168 | 444 | 462 | 8.40E−44 | 59 | 99 | (Z99113) similar to fosfomycin resistance protein [*Bacillus subtilis*] |
| 1226 | Bt1G2406 | g1705428 | 713 | 561 | 2.70E−54 | 55 | 100 | BACITRACIN RESISTANCE PROTEIN (PUTATWE UNDECAPRENOL KINASE) [*Escherichia coil*] |
| 1227 | Bt1G2407 | g1881228 | 159 | 173 | 2.40E−12 | 36 | 20 | (AB001488)SIMILAR TO ENZYMES WHICH ACT VIA AN ATP-DEPENDENT COVALENT BINDING OF AMP TO THEIR SUBSTRATE. [*Bacillus subtilis*] |
| 1240 | Bt1G2497 | g1881342 | 392 | 441 | 1.40E−41 | 34 | 100 | (AB001488) SIMILAR TO BACILLUS CEREUS ZWITIERMIC1N A-RESISTANCE GENE. [*Bacillus subtilis*] |
| 1246 | Bt1G2519 | g461637 | 168 | 276 | 4.30E−24 | 23 | 100 | MULTIDRUG RESISTANCE PROTEIN 1 (MULTIDRUG-EFFLUX TRANSPORTER 1) [*Bacillus subtills*] |
| 1246 | Bt1G25020 | g728970 | 180 | 293 | 6.80E−26 | 21 | 100 | MULTIDRUG RESISTANCE PROTEIN 2 (MULTIDRUG-EFFLUX TRANSPORTER 2) [*Bacillus subtilis*] |
| 1257 | Bt1G2596 | g728970 | 1488 | 1194 | 2.30E−121 | 72 | 100 | MULTIDRUG RESISTANCE PROTEIN 2 (MULTIDRUG–EFFLUX TRANSPORTER 2) [*Bacillus subtilis*] |
| 1272 | Bt1G2692 | g1881374 | 892 | 804 | 4.80E−80 | 46 | 100 | (AB001488)SIMLLAR TO BICYCLOMYCIN RESISTANCE PROTEIN. [*Bacillus subtilis*] |
| 1302 | Bt1G2884 | g115950 | 1180 | 1191 | 4.70E−121 | 75 | 92 | GLUCOSE-RESISTANCE AMYLASE REGULATOR (CATABOLITE CONTROL PROTEIN) [*Bacillus subtilis*] |
| 1339 | Bt1G3158 | g2632985 | 3348 | 2412 | 3.20E−256 | 63 | 100 | (Z99107) similar to acriflavin resistance protein [*Bacillus subtilis* |
| 1355 | Bt1G3297 | g2500765 | 301 | 395 | 1.10E−36 | 29 | 67 | SENSOR PROTEIN VANSB (VANCOMYCIN B-TYPE RESISTANCE PROTEIN VANSB) (VANCOMYCIN HISTIDINE PROTEIN KINASE) [*Enterococcus faecalis*] |
| 1374 | Bt1G3544 | g4914624 | 1071 | 920 | 2.50E−92 | 57 | 92 | (AJ009627) multidrug resistance transporter [*Listeria monocytogenes*] |
| 1393 | Bt1G3769 | g2769708 | 955 | 852 | 3.90E−85 | 37 | 100 | (U82085) pristiriamycin resistance protein VgaB [*Staphylococcus aureus*] |
| 1426 | Bt1G3813 | g2827439 | 122 | 143 | 3.70E−09 | 49 | 17 | (AF043609) aluminum resistance protein [*Arthrobacter viscosus*] |
| 1460 | Bt1G3849 | g994737 | 104 | 125 | 1.30E−07 | 52 | 20 | (M18327) kanainycin resistance protein [cloning vectors] |
| 1471 | Bt1G3861 | g2633162 | 161 | 156 | 1.40E−10 | 25 | 44 | (Z99108)siinilar to multidrug resistaflce protein [*Bacillus subtilis*] |
| 1526 | Bt1G3918 | g585375 | 126 | 176 | 2.70E−13 | 35 | 45 | DIMETHYLADENOSINE TRANSFERASE (S-ADENOSYLMETHIONINE-6-N',N'-ADENOSYL(RRNA) DIMETHYLTRANSFERASE) (16S RENA DIMETHYLASE) (HIGH LEVEL KASUGAMYCIN RESISTANCE PROTEIN KSGA) (KASUGAMYCIN DIMETHYLTRANSFERASE) [*Bacillus subtilis*] |

TABLE 4-continued

Antibiotic, Chemical, and Heavy Metal Resistance

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 1854 | Bt1G4261 | g1945096 | 446 | 406 | 7.20E−38 | 59 | 35 | (D88802) S. lividans chloramphenicol resistance protein; P31141(492) transmeinbrane [*Bacillus subtilis*] |
| 1914 | Bt1G4327 | g2668553 | 130 | 68 | 0.85 | 37 | 6 | (U62929) multidrug resistance protein 1 [*Fiobasidiella neoforinans*] |
| 1923 | BtIG4339 | g115950 | 133 | 153 | 1.80E−10 | 55 | 18 | GLUCOSE-RESISTANCE AMYLASE REGULATOR (CATABOLITE CONTROL PROTEIN) [*Bacillus subtilis*] |
| 2151 | Bt1G4629 | g3925779 | 238 | 181 | 5.00E−13 | 29 | 31 | (AL034353) putative major facilitator family multi-drug resistance protein [*Schizosaccharomyces pombe*] |
| 2179 | Bt1G4659 | g2632985 | 98 | 107 | 9.60E−05 | 30 | 11 | (Z99107) similar to acriflavin resistance protein [*Bacillus subtilis*] |
| 2211 | Bt1G4695 | g4416482 | 101 | 115 | 2.40E−06 | 38 | 24 | (AF125999) daunorubicin resistance protein A [*Mycobacterium avium*] |
| 2304 | Bt1G4796 | g115950 | 204 | 269 | 2.40E−23 | 51 | 32 | GLUCOSE-RESISTANCE AMYLASE REGULATOR (CATABOLITE CONTROL PROTEIN) [*Bacillus subtilis*] |

SEQ ID NO: A sequential SEQ ID NO: is assigijed to each contig or singleton and the SEQ ID NO: corresponds to that set forth in the sequence listing.
Gene ID: Refers to an arbitrarily assigned Gene ID number.
NCBI gi: Each sequence in the GenBank public database is arbitrarily assigned a unique NCBI gi (National Center for Biotechnology Information GenBank Identifier) number. In this table, the NCBI gi number which is associated (in the same row) with a given contig or singleton refers to the particular a GenBank sequence which is the best match for that sequence.
aat_nap score: The aat_nap score is reported by the nap program in the ant package. It is an alignment score in which each match and mismatch is scored based on the BLOSUM62 scoring matrix.
Blastp-Prob: The entries in the "Blastp-Prob" column refer to the probability that such matches occur by chance.
BlastP Score: Each entry in the "BlastP Score" column of the table refers to the BLASTP score that is generated by sequence comparison of the designated clone with the designated GenBank sequence.
% Iden: The entries in the "% Iden" column of the table refer to the percentage of identically matched nucleotides (or residues) that exist along the length of that portion of the sequences which is aligned by the BLAST comparison to generate the statistical scores presented
% cvry The % coverage is the percent of hit sequence length that matches to the query sequence (% coverage = (match length/hit total length) × 100).
NCBI gi description: The "NCBIgidesc" column provides a description of the NCBIgi referenced in the "NCBIgi" column.

TABLE 5

Toxins and Toxin Homologs

| SEQ ID NO | Gene Id | NCBI gi | aat nap Score | BlastP Score | BlastP-Prob | % Ident | % Cvrg | NCBI gi description |
|---|---|---|---|---|---|---|---|---|
| 73 | Bt1G100 | g419952 | 125 | 135 | 1.30E−09 | 29 | 13 | alpha-latromsectotoxin precursor-black widow spider (fragment) [*Latrodectus tredecimguttatus*] |
| 212 | Bt1G260 | g2507017 | 330 | 263 | 1.00E−22 | 68 | 29 | HEMOLYSIN BL BINDING COMPONENT PRECURSOR (ENTEROTOXIN 40 KD SUBUNIT) [*Bacillus cereusi*] |
| 316 | Bt1G386 | g2507017 | 990 | 1027 | 1.10E−103 | 68 | 78 | HEMOLYSIN BL BINDING COMPONENT PRECURSOR (ENTEROTOXIN 401W SUBUNIT) [*Bacillus cereus*] |
| 410 | Bt1G503 | g2507017 | 126 | 156 | 1.10E−10 | 60 | 13 | HEMOLYSIN BL BINDING COMPONENT PRECURSOR (ENTEROTOXIN 401W SUBUNIT) (Bacillus cereus) |
| 479 | Bt1G597 | g2507017 | 1829 | 1732 | 2.20E−178 | 98 | 98 | HEMOLYSIN BL BINDING COMPONENT PRECURSOR (ENTEROTOXIN 40 KD SUBUNIT) [*Bacillus cereusi*] |
| 694 | Bt1G917 | g1665720 | 1623 | 1644 | 4.70E−169 | 95 | 93 | (D17312)diarrhealtoxifl [*Bacillus cereus*] |

TABLE 5-continued

Toxins and Toxin Homologs

| SEQ ID NO | Gene Id | NCBI gi | aat nap Score | BlastP Score | BlastP- Prob | % Ident | % Cvrg | NCBI gi description |
|---|---|---|---|---|---|---|---|---|
| 1552 | Bt1G3945 | g2507017 | 210 | 200 | 1.50E−15 | 51 | 25 | HEMOLYSIN BL BINDING COMPONENT PRECURSOR (ENTEROTOXIN 40 KD SUBUNIT) [*Bacillus cereus*] |
| 2056 | Bt1G449 5 | g97193 | 96 | 105 | 9.60E−05 | 51 | 6 | leukotoxin B-Pasteurella haemolytica [ ] |

SEQ ID NO: A sequential SEQ ID NO: is assigned to each contig or singleton and the SEQ ID NO: corresponds to that set forth in the sequence listing.
Gene ID: Refers to an arbitrarily assigned Gene 11) number.
NCBI gi: Each sequence in the GenBank public database is arbitrarily assigned a unique NCBI gi (National Center for Biotechnology Information GenBank Identifier) number. In this table, the NCBI gi number which is associated (in the same row) with a given contig or singleton refers to the particular GenBank sequence which is the best match for that sequence.
aat_nap score: The aat_nap score is reported by the nap program in the sat package. It is an alignment score in which each match and mismatch is scored based on the BLOSUM62 scoring matrix.
Blastp-Prob: The entries in the "Blastp-Prob" column refer to the probability that such matches occur by chance.
BlastP Score: Each entry in the "BlastP Score" column of the table refers to the BLASTP score that is generated by sequence comparison of the designated clone with the designated GenBank sequence.
% Iden: The entries in the "% Iden" column of the table refer to the percentage of identically matched nucleotides (or residues) that exist along the length of that portion of the sequences which is aligned by the BLAST comparison to generate the statistical scores presented
% cvrg: The % coverage is the percent of hit sequence length that matches to the query sequence (% coverage = (match length/hit total length) × 100).
NCBI gi description: The "NCBIgidesc" column provides a description of the NCBIgi referenced in the "NCBIgi" column.

LENGTHY TABLES

The patent contains a lengthy table section. A copy of the table is available in electronic form from the USPTO web site (http://seqdata.uspto.gov/?pageRequest=docDetail&DocID=US07700838B1). An electronic copy of the table will also be available from the USPTO upon request and payment of the fee set forth in 37 CFR 1.19(b)(3).

SEQUENCE LISTING (8283 sequences)

SEQ ID NO: 1 - DNA, 371 bp, Bacillus thuringiensis
aaaacctttaatgttcaatcttcttcaattcactcaacactatccaatgcaacatccctttctactggaaatttcatcataccttcaataataccccttaaattatcaaactccattacctcttgactctattcgtaaataactacacttttttgacaaaatacattatcatatcccatcaactacctacctgcatcatacttatttccttcaacacatttttaatacatatactaccccaccagaaaccattttactttcaatcgacttaaaatcatccacaccaacgcactccatcatctctcacatattatctaaaccaaactcccccattaattcatcttccatccataaaacatacctgcctaaca

SEQ ID NO: 2 - DNA, 422 bp, Bacillus thuringiensis
gaaagccttgcccccaattccaaatttcttcccccctttctttgggttggggcggtttttaccaccgatggggtttttaaaatgtcccgggcgtcattcccgccttaattttaaaaaacccttcttttgagcccatttttggtggggggaagccgttttttttagggtcttccagggggggcccttttggaaacccctccgggaccccagcttaatttatttggaaaaaaagccttccttttgaaccccaaagggggcaaatccttttttggaatggagcctgcctttttttggccctcctcaagattaaaggttttcctttggatttttcaaaaaccccaaggggtttaagggccttttatcccagggcctttgaaaatgttggggggggccccaagggtattggcccgggatattttaaa

SEQ ID NO: 3 - DNA, 388 bp, Bacillus thuringiensis
atgcgagattattaatagtctacgcaatggatcgagtttttttaatcagacctaccagcgcaagcagcgggattagttgactatcgagtgtatgcttatacgtttgtatgacaacaacatcccaggactagcgagtaggaacgtatgcaactcaagacccataagaactagggatgtccgatgcatgagctttgaaacactggaaacggatgcatgtcttgtcaagggtgggcttgaacccttagcagcctgtgttctccattcacttggaaatatgaacttgaccagacacacatgtgcaccgcgttaataacagggtatgttagaaccgaaaattgtagtaagatatgaagtaaagccttcagaacagaggcattttaccaaagac

SEQ ID NO: 4 - DNA, 387 bp, Bacillus thuringiensis
  unsure (1)...(387): unsure at all n locations
gacgcgtatgnatgggaacacagggggcgagattttcacttcggcatatagaccagtaactgttgtttttatagcttagccaattggctgaatttttgctggtttttattttaacacagcgacatgatccattatttaatcgtatgccaacttaccaattactgcttgaatacgacgaggtgatggaccgataccagactcagtgacgagttccgaaaataccgatagaagctgaattttaaacgcgactgccaccacagagctctcagctgctatcgccaactagtacaccgcgcacaacaacgtgcgtcttttcaccgaataaagccatatgagcccatttattacgcttatgcgcatgctttgtgagaacactcaacatcaata

SEQ ID NO: 5 - DNA, 509 bp, Bacillus thuringiensis
ttcaactaaagcaattgttgcaccatttgcagagtttattgccattgcctcatataactcttttaccgtataagagccaccattttctaatggaacatttgatagtgaacgatcttgcgaaatcttatgtgcatattcagagattttaactctttgatcccatttaagttttcctttatccaccgattcatgaactaagtattcgctcatcatttttgtcatactagcaattgccaatgattcatctgcatttttttcatagtaaatttttccggaatttgcttgtattaaaattgctgatcctgcttcaacgtctatagcaggaactgtctgcgctgctgcttttccaattggtacgaccatgctacaaaatagtgtaagcactgttactattgcaataactctcttgcaaaacataccttacacttctgttacctacaatttctttgcactaaaaaaagcgttattctaacatagtctcgcagaagatagacagtgttctcaaatat

SEQ ID NO: 6 - DNA, 453 bp, Bacillus thuringiensis
tttatcatgctgccaacgctttctgtacacattttcccattcgcgatcttcatatgtttcttgtgtatgattatcgttataacgatctattggtgaaaaatattttaaacgtctcattagtgctgaagtttttttcttcatactgttcactcctcgtatagtatgtttaaacttaatttttttactttcatgagagacctgtaaaataactcttggacgtctcaagatatttctagataatggtcttaggatcatttgggacaattcttaccgctcctgtggacttaccacataattaagagtgtttctcagtgaacgtgcgggactccctactcgcaggctgagcagcctgaccctcgaacctaagatggttagtagctctagggcggctttcgattcaggactaagctctcatacacgaggttgttggtcggcgtgcacactagagatatc

SEQ ID NO: 7 - DNA, 496 bp, Bacillus thuringiensis
cagataaagggattattattatagaagctggcgcaaatggttcaaacgacttagataattttaaagatcgtaatggaaaaaagattttaaatcgaaatagtccagacttcaaggattcaggtgctattatggttggggcgggatcatcaactgttccacatcaacgtttatggttttcaaattatggaagtcgattagatgtatatggatggggagaaaatgttgatacaacatcagcaaatccaagtcaaaatactacaaatttatatacatcaacatttagtggaacatcaagtgcttcaccaattattgctggagcagcaacttcgattcaaggtattgctaaagaacatcgaggttctccttatacaccagccgaattaagaaatatcttaagtaatccgaatacaggaacaaaatctcaagatccgtggaatgatagaataggtgttttacctgatctaaaatctatattagataacttaggttttaattc

SEQ ID NO: 8 - DNA, 524 bp, Bacillus thuringiensis
acaaagcgcttgtaatgcgttcacataatcccctaattttttagacttatccattccgaatatagtttgaactaacatatacattctcccctttatatgtactgttaacacctcaatgataacgcttacattatttatcgtcaataaaaacattcaattgttttaacaccaaatctatattgtatcgagccaataatcagcgaggaattccccgccaattaaagtttcactttatcccgcattaactgcccgtaaaagcccgattggtgagggctgataatcagtgggagaggaacaacctcccactgattaaagtttcactttatcacttcgttaattgatgcctaaatgcataaataaccgcctgagtacggtcacttacattcaatttatttaatatattactcacatgtgtctttaccgttttcagtgcaataaataactcgtccgcaatctcttgattactttttccctctgcaattaataacaaaatctcaaactctctttccgttaaatcatcatgc

SEQ ID NO: 9 - DNA, 296 bp, Bacillus thuringiensis
gcaaagacgtatgaacaatgtatgggtttcttacgtatactagaaggagcgaatccattagatcgaacaggtattcatccagagcaatataagaatgttgaattgttattgaagagtctagggttatcgatagattcaccttcttttatcccagccgttaagagaaggatagtagctattgttgcaatgattattgctgcggtttgccatagcttgtcgacagttgctttccaatctattacgaataataaaattattactccttcacttttaggtttcgaatcactttattcagc

SEQ ID NO: 10 - DNA, 615 bp, Bacillus thuringiensis
ttccattggatatattacgtcattagtactatcaaaatgtaatctctttaatgcttcgatgtaaataggctctcttaagccgatacgtggcaatatattcgacgctaagatttcttttggtgttcctatcgcaatgactttaccttcatcaattaatataactttgtctaaatccaggtttaaaatttcttctattctatgttcgataataacaatcgttttattatatcgttcatgtatatctttcataagctttatcgcatgtaaggcgcttagtggatctaaattagctaacggttcatcgaacaataatatatccgcatttgttgttaataaacccgctagagaaactgtttgcttttgacctcctgataattcatatggactttgtttatgaaacgaaggcatcttcacctttgttaatgagtccgaaacaatctttttcatgtcatcttgccttacacattcattttctaaataaaaagctacatcttcctcaactgtcaggccaataaattgagcatcttgatctagcaaaagtgttccaacctgtttactcgcttcaagaatacaacctcccctcggatctttaccggcaattaaaaagaaacctgt

SEQ ID NO: 11 - DNA, 545 bp, Bacillus thuringiensis
tatcctacttagaagtggaaacgtccttgcattgctactactgttacaccttgaagtgtaccaaatactagttgacctgcatggccttctacagttgatactgggaattcagggatttcactgtaaggtactgttactgcgttctcaatttcgtctgctaatacacctagtcctgatccaaggattagtcctacttgtggtgtctcttgaaatttctcttttaagtatgaagctgattttgtaataagttcacgattcatttgtttatccccctatttctttagctcgtttaagaagcttgatccgtattctggcattttcacaccgaagttttctgctactgttgcaccaatatcagcaaatgtttgacgaagtggtaattcttgtccgccttctttcatgcttgggctatatgccaataatggtacatattcacgtgtatggtcagtaccagggtgaattggatcatctaccgggtctgctgtaattaataatagatcatttttctttagttttgcgaatacttctggaagacgtgcatcata

SEQ ID NO: 12 - DNA, 682 bp, Bacillus thuringiensis
tgataataccaaataaagccgatgcactcgttgttattgtatttggtatatcttttaagtattcaatcgcatttttttcaattgtttcaatggaaacgtagttttgtgtagataaccattcaaacaacctatgatgtgataattcttgtatgtatacttttccctcttttatgtagcctggcatattttttactaagtccattagctgttgtgaaatcgtaggaacaactactccaacgccaaccgcagttaatgttatgataaaaagatataacagcaatatcgctaaatttctaggtacttttttattctccaaaaagattaatacaggattaaatatgaagtataaaaaaagcgcgattaagattgggaaaaataatgttgatatgaagataccaatcggttgaaataaaaatgatatttttgtgcaaataaatatgattcctacaaccattagcacttctaatgtccaaaagtgcacttttgatttcaaaaaaatggcctcctttaaactagcacttgttttcattgtaccaaaataaggattgaatttcacataatattttcctttacaatattccaaaataccaataaatacactacaatgagattatatacaaatttgcaggttaaggtgataaaaatgacacaatgcatcatttgcagaaaagattcgaaagaa

SEQ ID NO: 13 - DNA, 501 bp, Bacillus thuringiensis
aaaatgaagcgttacattttcacagagcgtaacggtatctacatcatcgacttacaaaaaactgtgaaaaaagttgaggaagcttacagaacgatgcgcgacatcgctgctgaaggcggagacatcttattcgtaggtactaaaaaacaagcacaagaagctattaaagaagaagcaactcgtgctggtatgtacttcgttaaccaacgttggttaggcggaactttaacaaacttccaaacaatccaaaagcgtatcaagcgtcttaaagacatcgaaagaatgcaagaagatggtactttcgaagtacttcctaagaaagaagttgttcaacttaaaaaagagttagagcgtcttgagaaattcttaggcggtattaaagatatgaaaggtcttccaagtgcattattcgtagtagaccctcgtaaagagcgtattgcagttgctgaagcacgcaaattacacattccaatcatcggtatcgttgatacaaactgtgat

SEQ ID NO: 14 - DNA, 528 bp, Bacillus thuringiensis
cgtgatatgcgacaggacttcgtgtttcaaaattgattgcactcatttagaagatgtacatttaacgatgggatttgttcgttgcatagggaaagggaataaagaaagaattattccactaggaagtttagcaacggaagcgattcaaaagtatattgaaaaaggaagaagagaattaatggggaaaaaagtagtagatgcactctttttaaaccatcatggtaatcgtttatcaagacacggattttggaaaatattaaaacgattagcgaaagaagcaaatattgaaaaagagcttacacctcatacgttgcgtcactcgtttgctacgcacttattagaaaatggagcaattttacgtgctgtacaagaaatgcttggacatgcagatatttcaacgactcaaatctatacgcacgtttcaaaaactagattaaaagatgtatataaacagtttcatccgagagcatagttactatgctctttttttcatagattaaaagggggagaccgctttacagaaacttt

SEQ ID NO: 15 - DNA, 508 bp, Bacillus thuringiensis
cttgtctgggttttgattctaaaaaagaacaggtatcatatgcagcgggtcttttatataaactaaataaaacgatacctcagcatttaacaaataaaataaaaaggcctgcttagaaagcagaaccttttaccattgttgcatttttacaggacgacgctttgtttctttcaacaaaaagaaatatttcgcctctgctattttcaaagaacaaatgacatcttgagacggttctacactatggtcgaccattctcttgtgacgtaaccactcattcttcactttttccaaaagtacaattaacttatcgtcatactctttacgcaatttaccctttttttgaaagaacattttcgtttctcctcttatacttctctgcgaccttctaacgctttggataatgtcacttaatctgcatattctaaatctccaccaactggcagaccatgtgcattacgagtcactttaatgcctgtaggttttaagaggcgggagatatacatcgctg

SEQ ID NO: 16 - DNA, 589 bp, Bacillus thuringiensis
  unsure (1)...(589): unsure at all n locations
attatccctaatatagtagcatcaaaggaaattaacaaagttctttttagtattttaggaagtgttttgtgatccacagggggattatataaaccgattaaaatgcccaaagatagatatgccagtaatagccctacccaattccagatccaatcttgatcccccattaaattaaacaaaagcgcaatgatccctcctactgcaagaatcgaagagatcataatactatttaaagctgatttcatactattttcacttccttaaaaattttacaatacagcattgaagtctactcttaagttgtcctttacttattagattccttttcattaaaaatcttttatggaaatcccatcatataatccggtcatcatacctaatagcatatacggagaatgggtaggcccagcaaaaattacatgtacatgatcacataccataatttttaaactgaatgaaactccaccaaatcctattcacatggtagatatacaaatgaggatgccattaccaacttgatttgtatataaatattagacgagtatagctactgcataacctanataaatgcttgattttcatcgtcatc

SEQ ID NO: 17 - DNA, 524 bp, Bacillus thuringiensis
ctaagtgactaactgctttacgacgaatgtaaggttctgcaacttgacgcatctcaattgaagtttgtacacgagtttgaattccgatattctccaagctatcttgaagagctaatgaattcataactgtcgctaacatgcccatgtaatctgcccctgcacgatccatgcccatttcacttccaattttcccacgccaaatgttaccgccaccaacaacaacagcaacctctacatcaagttctgcaatttcttttacttgttccgcaactgacttaataacagttgggttaattccaaatccttgctctccagctaaagcttctccacttagctttaaaacgacacgattatatttcggtttactcataatgaacctccaattgcttacatctttattttaaaaaagggaacacaatgtgttccctaatctgtattagttgctaccttttacttggttcattacttcttcagcaaagttgtcttcgcgtttttcgataccttaaccaacagcgtagcgaacg

SEQ ID NO: 18 - DNA, 732 bp, Bacillus thuringiensis
attgaaccaagtatagaaccatttgaagtggtgcaaatgctcaatacgctaaacgaatcaagaaaagaattgatgcgtttcctgagtacaatagaagatgagtctatattagcgaaaaaagcagtgatgcatccagctcttggagaattatcccttgatcagtggatagaactgatttatttacatgaacagcgtcatatttcacaaataaaagagataaaattactttgtgaaattgaaaagtaaaaatcattccctatttattgatgcgtattataaacagggaaaacggttgattcatattgattcagaagaaaacaaaaatagaatgaaattagttgaaagtaaccaataagcttaagaaaatatgaaactatccgattttctgtataagtgtaaccccgtcttaaatgaagagcggggttatttttttggaagtattttcattgagaaggaaatacttcgacaatgaaattcaaaaaaataatcatcataacatattttatatgcgaattttagtaaattgaaataatgattttatgatgatgaatgatatgtccttattttgaaagtactcttcacacgcttaaggaaggggtattctgtcaggaaacgataaaatacaattctgttaggggatgtatgcaatttattctctttattttgcaacagaaccaccttcaaaattatcttttgtagttgaagtttcctgaataataagttacattttta

SEQ ID NO: 19 - DNA, 657 bp, Bacillus thuringiensis
tgatcaagaattagattggaaccgtattaatccagcgactggacctgtatatgttaaaggagcagaacctggcgatatattagccgtaacgattgaaaagattaaaattgcagagcagggcgttttaactacaggtgcaaaccttggtgtaatagggaatgagttaaatgaaaatacagtgaaaattgtcccaatacataatgaacatgttttgttttcaagtgaactacaaatcccgattaatccaatgattggggtaattggtattgcaccgaaagaagagagcatttcatgtggcacaccgcatgatcacggcgggaatatggactgtaaagaaattaaagaaggaacaacattactactaccagttaatgtcccaggagcactattagcgttaggtgatttacacgcagcaatgggggatggtgaaattggggttagtggagtagaggttgctggtgaggtaactgtaacagttcaaattataaaagggaaaaaatggccactaccaatggctattcaaaaagaaaaagtaatgacgattgcttcagaaaaattgctagatgatgcagcaaatcgtgctgtacgtaatatggtgacatttttacatgaagaattagcaatgtctaaagctgatgcaacgcttttattatcggc

SEQ ID NO: 20 - DNA, 516 bp, Bacillus thuringiensis
actcgagttgattccattccattccaatccattgcattccattccatgccattccactcgggttgattccattcctttgcattccattccattccattccattccattccattccattccgttgcattccattccattacattcggattgattctattcaactcccttactctccattacattccattccattcgggttgttccattccattccattccattccactccattccattgcactcgggttgattccattccattccattccattccattccattccggatgattccattccattgcattccgttccattacattcccctgcactcacgttgattccattccattccattccattccattcaattccattccattacaattcgttccattccattctattccgtaccattccattccattccataccattccattccattccattccattccattccattccattccgttccattccattccattccattctatacgggttaatcccat

SEQ ID NO: 21 - DNA, 346 bp, Bacillus thuringiensis
ggaaaaataagtacttttttcattgaaagcatttagggggacgattactatgacacaaaacataaatcaattagcagtgaatacacttcgtacgttatcgattgatgctattaatgcggcaaactcaggtcatccaggtcttccgatgggagcagcaccaatggcttatgcattatgggcgaatcatttaaattacaatcctaatcacccagaatggtttaaccgtgatttatccgaatggcacgatgctcgatatgaaaggatataataaaatattagaatttgatccagagaagaagcggattacagttcaaagtggtgtcacctggaatgatattcagaagaa

SEQ ID NO: 22 - DNA, 551 bp, Bacillus thuringiensis
ggaaaaaagaggaaagtaaatgtttaaaaagactatgatcttcttgtttgggaagatgataaaaaaggtgttggtttagaaccagcagtgaaaagctttgaggaaaaatataaagtaaaagtaaaagttgttgaaatgcaaatgacagatcaagtgaagaagttacgccttgatgggccagcggggactggaccagatgttgtaacattgccacacgatcaaatcggaaatgcagtaacagaaggtttactttctgaagtgaaagcagatgatgctgtaaagagtaaatttactaattcatcaatagaagcacagacatataacggaaaattatatggtttaccaaaagcaattgagacaccagtctttatttacaataaaaaactaatgccaaaagcgccagaaacgatggacgagctgtttaacttctcaaaagaatttacgaaagatggcaagtacggatttttagcattaggagataacttctactttgctaatgcattcatggcatgtatgggcggttatgtatttggagaataatatggtatatc

SEQ ID NO: 23 - DNA, 392 bp, Bacillus thuringiensis
agggattttcacatgtacgctatgggcttgtttttcatgccctgttccgtgacatgttgtacatggatctttgatttcttttccacgaccgtgacagacatcacaggttacttgacgacgcatcataccaagcggagtctgcgtatcgacgttaatgacaccagcaccatgacagcgtccacaagtaactggacttgttcctggtttagcacctgagccattacatgtactacagcttgcttcacggttgtatttaacttctttttcagctccaaaaatagcttcttcaaaggtcaagttcacacgatactggaggtcatccccctgacgaggagcatttggattgcgtgaagcaccgcctccgccgaagaaacttgagaagatatcttcaa

SEQ ID NO: 24 - DNA, 401 bp, Bacillus thuringiensis
cttcattattagaaattaagaaatgcgtcgtatatggtaatgttatgttttcatcttgtaatcttttaattaattttaataaaattgcaacacttactttgtcatctaaatgacgtgattttatgtatccactctctgtaatttgaacgcgcggatcaaatgaaacgaagtctcctacttcaattcctaattcgcgtacttcatcagctgaaaatacgcgctcatcaatacgaacttcaatatttttctcatcgcgttttgcttcacctgcatctttatatacatgtacagatgtttgatgcattaaaattgttcctgtatacgtcttgccacttgatgtttcaatttcgcaatattccccttctacggagttccagcgaaatccaccaatcatagaaaga

SEQ ID NO: 25 - DNA, 787 bp, Bacillus thuringiensis
ctaaataaatacgtgccccgcgtagctcaaatgctctaaaatagatggcaccttgttcattcgtaacatgtgcacctagcgcttcaaaccctttaatatgctgatcaatcggcctcgggcctaaatgacatccacccggaagcccaataacagcttttttaaaacggccaagcattgcacccattaaataataagaagcgcgcaattttttcacttttccatttggcaaaggcattgcaaccatgttagaaggatcgactaccatttcttcctcctgtccataagttactttccctccaatttcctctagtaagtctcctaacattttcacgtccgaaatattagggacaccaccaatagttactggagtatctgctaaaattgtcgctggaattaatgcaacggcactgttctttgcaccacttactcgaattgacccatttatagctcttccgcctgccatcagcaatttatccatattgagctcccttctcgcgaatgtatacactttctatcccgcaatagaaagctccccttaagaatctcaattactctctccatcccagaactccataaataacacaccattatcttaatctatcctgtaccacaaatagatgaagaccaaccattcatcgaattcactttatcaatttagatactgtatcacatccattaataggactatgcacattattgtctatataacaaccaaaaatgacataaatctttagacttgttcacgctctcattatacatcgaagggaatccgcctaaaagactagac

SEQ ID NO: 26 - DNA, 129 bp, Bacillus thuringiensis
gcgagcgcgtggacacgcgtgaacgcgttgtctctttcccgccccaagctgtgattacgcaggataacttgacggtggccatcgatacggtggtgaccttccagatcaacgatcctgcccgcgcgatct

SEQ ID NO: 27 - DNA, 502 bp, Bacillus thuringiensis
gaagtttatgcttttccggcgcatttgcatggtttacattatggtgaattaggtgaaacattttggaaaagattatcattaattattcaaaccatatcaaatttacaacagaataatacgaagtttatcccaattcagcaagatacagaaataatgatgtgggtgaaacgttttctaacaggaataccatataagagaagtgagttggcgagaaaactatggacggaagtacataatcttttagaaaagagcaatacgatagaagcgacgattgtaacatatcgactaacgggttatgaaccgtattggttgtacattgcaacaattagcagaaattacgaaacaagatatattcaggttgtattttttatttttggggtacaatgcatttctttatacaagaagttcgtgataaagaaaatgaatttccactattagctgaaattatatcttatccaaatgagagagctgaatatttagtttatccacgaaaaaaacatat

SEQ ID NO: 28 - DNA, 511 bp, Bacillus thuringiensis
ttcttctgaaccttctttacttggcatagatgcgattaaacaatgtcttgtttatcttgacggaagttatacttcacatctaaagcatgtgcaacaattagttcttgctcagctttgtgagcgaatggatcgccgccagatggactagagcgatcaggacgtccaatgtagcctgttttcactgtatctccagcatgttcgaacagaattggagccatgtaatgccatgcgcccatattacgaggttcttcttatttagaatggaaagaagactgcgtacgacatttaaacggaattttcgcttttgccttatgggatgatcagaagcaacaattgtttttagcacgagatcatttaggtgtaaaaccactcttttttacagaaagaaatggcagtattattttcggctctgaaattaaagcattattagcgcatccatctgtccctgctgaaattgatgcgaatggaataaatgaaatatttggattaggcttattttgcactcaagatg

SEQ ID NO: 29 - DNA, 340 bp, Bacillus thuringiensis
cagaaactgctgttgttcataccaatacggattatattgtgaggagaactacagcacattgaagtgctaaaatgacgctagatcataactgcgctgacgaacgactagctatatgaagatcgagatgaattgacatcataccatatggggaccgacgttctaacacatactacgtgtgatggcagcggtacagacaggaacggcgtgcaactctacattcataccactgccagctccatcgaaggagatgaacattgtcgcaagagaacttacaggcgcagcactggaatgctgatgaacaaatatcatcgatccgatagtaccatttgctactgtaatc

SEQ ID NO: 30 - DNA, 513 bp, Bacillus thuringiensis
aatacagcattttcttcaaaaatagagataaaggagaaaaacaaatgataaaagatatgcaaccatttttacaacaagcttgggagaaggctggttttaaagagttaactgaaattcaaaaacaagcgattccaactattttagaaggacaagacgttatagctgaatctccaactggaacaggaaaaacattagcgtacttattaccacttttacataaaattaatcctgaagtaaaacagccacaagttgttgttttagcgccaacacgtgaacttgtaatgcaaattcatgaagaggttcaaaagtttacagcaggaactgaaatttcaggtgcatctttaattggtggtgcagatattaagcgccaagttgaaaaattaaagaaacacccaagagtaattgtcggttcaccaggccgtattttagaattaattcgtatgaaaaagctaaaaatgcatgaagtaaaaacaattgtatttgatgagtttgatcaaattgtaaagcaaaaaa

SEQ ID NO: 31 - DNA, 655 bp, Bacillus thuringiensis
  unsure (1)...(655): unsure at all n locations
agaaatatatttactactattttacatatggagatacataatcatatgcaaaaaagaaaaatattgtcaaactcacccataaagcaattatattcatataccatatttaaaggaggcttcattatctatgattcttaagttaaattccacttcttttgaagtagcaacatccattttacaggttcaaattccagcttataaagttgaagcaggctacttaaatagtactgccatacctcgtttatatgatactgtaaacgatattcaaaattgcgttgaaacattctatggatatttttctgaaaataaacttgtcggttttatttcttttgtacaagaagaaaaactaatcgatatccacaggctagttgtatcgcccgatttttttcaaaaaggaatcgcaacgaaactcctaatttatatatttaacatgtttccctcttcaatgacatacattgtacaaacaggtaaagcgaatacccctgctattactttatataaaaaacacggattcattacagtatcagatacaatacttcctgacggtatgattcttacgcaattaaaaaagacagaatacacanaataatttgacttgttcgctcctttatgttattttttactttataaaaccttttgctgagtccaaattttg

SEQ ID NO: 32 - DNA, 712 bp, Bacillus thuringiensis
actggaagagcactcagatgcaaagggcttacttgttattaacccaacgtactttgggtttgctgcagacttagaacagattgtacaattagcacattcttataacatccctgtactagtcgacgaggctcatggtgttcatattcattttcacgatgaattacctatgtcagcgatgcaagctggtgcggatatggcagcaacaagtgttcacaaattaggaggctctttaactcaaagttctattcttaatgtgaaagaaggcttagtgaatgtaaagcatgtccaatctattattagcatgcttacaactacatcaacttcttacatcttgttagcatcccttgatgttgcgagaaaacgtcttgctacagaaggaacagcactcatagaacaaacaatacaattagctgagcatgttcgtgatgctataaattctattgagcatctttactgtcctggaaaagaaatgttaggtacagatgctacctttaactatgatcctacaaagataattgcatctgtaaaagatttaggtattaccggccaccaagctgaagtatggcttagagagcaatataacattgaagtagaactctcagatctatacaacatactatggcttatcactttgggagatacacaaagtgatacaaatacacttattgcaactttacacgatttaacaacaacatttaaaaattaggcaaaa

SEQ ID NO: 33 - DNA, 618 bp, Bacillus thuringiensis
aatgaaggaaaacgtttggtataaggaaatgtatgaaagccagcggtgagaatctttagtcgagaacggaggcgtatgatggtagagaagaagcgaagtgatttaagtagattgctttcctatatgaagccatataaagggttgctatctttagcatttatctttttagttggtgcgacagtaacggaaatgatgggtccttttttaattaaacaattcctcgatgaacacctagtaccgcgggattttgaacgatcagcgctcgttactttatttgtaatttacatagttgctcatttattaaaagtattatttacgtatttaaatctattgtactttcagaacattgcttttaagattgttcaagatatgcgagttgaagtatatgaacatgttcaaaagctgtcattaagtttctttgatcgtacgccgattggtacacttgtatcgcgtataacaaatgatacggaagcgattaaagatttttatgttagtgtattatcaacatttgtgaaaaatgtagtctttttagtaggtattttagagccgatgtttttattagatgtaaaattagcgctattttctctcggattaattccgattatgtttgcgattatg

SEQ ID NO: 34 - DNA, 458 bp, Bacillus thuringiensis
ttacagcaatgtgaatcgcacccgcatccgttcttccgcccgctactgaatcatattgatacgggatttgtaattcatcagcaacatcaactacgaaatcacgtaaacctgtatgtccaataacagaagcatcatataaaatgatttgtggtccatcgcccattttactttgcgcttcttttgacgttacacccggtgtatctccagcgataccaacatctactgcgaacgcgatatctggtttaatataattcgcagatgtttttgcgccacgaagaccaacttcttcttgtacagttccaacgccgtatacaacgtttggatgcttttcatcttttaattgttttaatacgtcaattgcaattgcacaaccgattcggttatcccatgcttttgcaagtaacattttttcattcttcatcacttggaattcaaagtaaggtacaacttgatctcct

SEQ ID NO: 35 - DNA, 529 bp, Bacillus thuringiensis
gttaatacttataagatttttttttttaaatgtattaaactgctcatttaactcattagactgtaataaagtttgtgctatatcatgcggagctgctaaaacaacataatcagctagtattgcttcatgattgacaaaagaaatctcatatcgatcttctagtatacttacagccgtcgttatagcacctttttttacgacagtttcagtgagcacttcttctaagcgattaattatcgcagatagtccaccttttaaatgatacgaattttttatttcctgctgattgaaattgttttttattctcttcaaaacctttaataatacttccatacttatttttataatccagtaaatacggtaatgtagatgccattgtaagctcattcaatttaccagaatatacgcctgaaagtacaggagcaatttgtctttccactaactctttccctaagaaactttctaaaaatagagcaagtgatgtatctttcgtaaactctttatttttcgttatgagatcttttaaaga

SEQ ID NO: 36 - DNA, 358 bp, Bacillus thuringiensis
acttattgcgtctgggagcgatcgtcgtacaggagcaggggcgtacccacttctaggtcacatgaacgtgcactgtgcttgcgatgtgggtactataccaggatggcttgcaggacttgctctcgtggctatccaaatggatcgtgcgaaagttgtaactgctgacggcgtgatgctcggtaggatgccatggcttaacatgcttgaactgcttcgcgccatggacgctgggtaactgacagcggtgcgtgttgtcggagagcatgtggcgcttgtagattctaatgcgcatcatgtacatgatgtgttgtctagccttgatttgttagttgtgcaagatgttatcctttctaaaact

SEQ ID NO: 37 - DNA, 333 bp, Bacillus thuringiensis
attcctttttcaacatcgaaggccagtttagggtagagaactataaatcctactttgcgtcacaaaatctgacctatctcaaaatgagcttcaactctgtgctctatgcggggattgtgaccatggtgacgctgcttatcagctatccaacggccctctttttgacccgtctcaagcaccgtcagctctggcttatgctgattatcctaccgacatggattaacctgctcctcaaggcctatgcctttatcgggatttttggtcaaaatggctctattaaccaattcttggaatttatcggaatcggttcgcagcagttgctctttaccgatt

SEQ ID NO: 38 - DNA, 520 bp, Bacillus thuringiensis
tcttgcataaaatcaatgactttagcaccgataaaaacagcaactagcgtatacatgccctcgcggtatgataaataggtaagaatagagactacgataacgacagcatcaaacataaacattgttttccccatactccagccaacatatttgtgagctagtcgtgcgataatatctacaccgccagtagtcccgccatatttaaatattattccaaggccgataccgataaatgccccggcgaataaagctgcgagtgtcatatcattttgcaagtttaaatgtaagttgagtacttcgtaacgctggaaaatccatagaaataaagatacgctaaaggtgccaattaatgtatataaaaatgtcgttctgccaagtaacctccaaccaataaaaaatatagggatatttaaaattaagtttgagtaggaaggatcaaacttcaataaaaaatacaataatagtgtaataccagtaaacccaccctctgcaaggtggttttcaatattgatattgacaa

SEQ ID NO: 39 - DNA, 530 bp, Bacillus thuringiensis
ataatggaatgtaacgtttctaacggatcatttgtttggaaacgattcatcatctccttttctgcttctcttgtaggatagccttggcgtatagtaagtaaaaatcgatctaactgagcatcaggtaaaggaaatgtaccggcggattcaagaggattttgcgttgcaattactaaaaagggttctggtaatgaatgtgtctgtttcgcaatcgtaacagtacgttcttccatcacttccagtaacgaagattgcgttctcggtacagcacgatttatttcgtctactactactatatttgcaaaaataggacccaacctcgttttaaattcggattccttcacatcaaaatattcaagaccaataacatctcccggcaaagtatccgctgtaaattgtattctttgaaatttagcgtccacacttttagccaagcttttcgctaacgttgtttttcctgttccaggtacatcttctaataaaatatgcccccttgctttagagcaaggctgctagttctatcgattcgt

SEQ ID NO: 40 - DNA, 463 bp, Bacillus thuringiensis
ttagctcaagcagtttaacaggacatatttctgttattggaatccttctcgcgttaggatgcgctattggctgggcacttggcacagtattcattaagaagactggtcaccgtgttaatgccatttggatggtaacacttcagcttattattggtggtctttgcttaattggatttggttcagagtttgaaagctggtctagtatcgcttggagtatgccatttgttagcgtacttctctttatttcattctttgatattgcaatggggtggcttgcatacttcacacttgttggagctggtgaagcatgtcaagttggggcttatacattcctcattccactaatagctattattgtaagttcaattttcttacatgaggctattaccattagcttattcatcggactattatttattgttgtgagtatttgctttgttaatattaaacccgaaacacttgc

SEQ ID NO: 41 - DNA, 417 bp, Bacillus thuringiensis
cggcatctacaaaaccatttgggtttactccatattggccagggccagggatagggggacactgtattccagtagaccctttatattttcaatggcctcataaaaatcaatgcctaaactttcacatagtgtgtttagttcatttactaaagaaatgttaactaagcgctgaatattttcaaatagcttgcacatctctgctactttcggagagctaacaggtacaacttcgtcaaaaatggtactatataaatcctgtaccttttgtctacacttttctgtttgtccactaataacttttggaatagcttgaactgaatattgactatttgctggatcaattctctcaggggaatatccgatatagaaatcttcccctaccttgttactattttgagaaattataggtatgatgac

SEQ ID NO: 42 - DNA, 505 bp, Bacillus thuringiensis
cggaagtttattttgtagcgccctttctcgtaattgaggatgttttccaaagaaaatagtgaaaaacagggcgatgaatacatttacaaaatgacaaaactgtaagaatacacgaatgtttgtaagaaagttcgatgttttctttttcctttttttattatagtgaaaaagaagaacaaaatattctcttatgtaggaaaggaagataataatgattgatctattaaataaatggatgttagaaagtacagccaattttaatatcgttgtaggacttacagcacttctatttttgggttcagtaattgcacttattattatttacaaaaaaattggtaaatcggttgaaagaacaaatactatttatttaaaaattacttctcgtatgtttactactcaaattctaatgaatgctatatttatttctttagttggtaaagatattgagaatttccgtcaaatctttatattattttgaagcttttgtattcttttattggagcta

SEQ ID NO: 43 - DNA, 446 bp, Bacillus thuringiensis
gacaacttctttagttacatttgcacaaaaacatcatcatcatacgtaacccttgaaacctagcggaaaaattacgcgtaggtacaagggttattcccgttgtacctacgctttggcaaaagagccatgtaggtatttttttatctacatggctctttttttattgtcaaaaagctagtaaaaaatgatgtttaagcaaaacttactacaaaggagttaacaaaaatggaaacgaaaaagtggggattatgggttttaacagcatttgttatcgggaatatggttggcggtggcgtatttatgcttccagcaaatttagcacaagtatcaggtccaatgggttctacactcgcatggagtattacaggccttggcgtatttatgattgcacttgtatttggatatttagcggattgggaaccagaattaaagctggaccacaaagc

SEQ ID NO: 44 - DNA, 494 bp, Bacillus thuringiensis
tgcaggttaatttttcaaatacgcgagttgtatgtatcgagaaaccaattggcgtaggcaattctgttgaagtaatgggtgaaaaagagaatccattttacgcaacaatcggattcaaagttgaacgtggtgaacttaattgcggtataacatataaattaggtgttgagctcggctcactacctttagcatttcataaagcgattgaagatacggtatttcaaacgttaaaacaaggattatatgggtgggaagttacagatattatcgtcacgttaacacatactggttatgctagtcctgttacaacagcgagtgactttagaaacttaacaccgctcgttttaatggatgctttaaaacaagctgcaacatatgtatatgaaccagttaatgcgtttgaattaactgtaccggagcaagcaattagtaccgcaatgtataagctcgctgccgttccagcaacttttgcagagcctatattcaataacaat

SEQ ID NO: 45 - DNA, 299 bp, Bacillus thuringiensis
ggagttattgtaatatagagagaagaagaaggtactataattacaaaagttacgattgatgaagctgcctctgaagcgatggggaaaaaacctggaaattatttaacacttgaagtacaagggatacgtcagcaagatacagaacttcaacaaaaagtggagcgtatttttgcaaaagaattttcttgtttcttagaagaggttggagttacaaaagaagcaagctggttaattgtaggtcttgggaattggaatgtaacaccagatgctcttggaccgatagttgtagaaaatgtatt

SEQ ID NO: 46 - DNA, 541 bp, Bacillus thuringiensis
gtaatgccgcatatttattgcaaatggcaggacgggaagatatacctgttattaatggtgcgaaaattcctttatccggagatattacgacgtattatccagaaattcatgggacagacggtttagggccaattaaacctccaaaaactttttcaccaaatataaagcctttttgtacattttttgatcttcttgaaaaatataaaggagaattaataatagtcgatgctggtagatcaacaacattagcgacagcatttattttagaaaagccgatgatgaagtatgtgaaagaatattatataatgggcggtgctttcttaatgcctggcaatgtaacaccagtcgcagaggcgaattttcatggtgatcccattgcgtcacaattagttatgcaaaatgccaaaaatgtaacattagtgccacttaacgttacatctgaagcaattattacaccggaaatggtaaaatatattacgaaacactctaaaacgagttttaataagttaatcgagccgatatttacgtactattataaagc

SEQ ID NO: 47 - DNA, 290 bp, Bacillus thuringiensis
ttacatgaataccttcgaatttccaaaagtttcaatacaccaaacgacggtttctttcttcgcgctgaatcattttataacgttgcttcttatattgatgaaatagatgctataaaatcttacggcggcgtttcactacacgaacaatctcacggcgaatcattcttttccttatttatgaaccgtttttcaggacaaggtttatacattttagatgagcctgaggcagctttatcaccaatgagacaactttccatgcttattattaatgctatgagctagcggaacaa

SEQ ID NO: 48 - DNA, 377 bp, Bacillus thuringiensis
tggctcgctgtatttcagtcattttagaacaaggcaaattacttgatactatcgttaaccagctcgcacagtctcttgaaggacaaagccctgtatttggtgttatcggtatgtacgtaagtagtgccgcattacatttccttatttcatccggaacaggagaatcggttatttttattccgatattagctccattagctgatttcatgcacattacacgccaagttacagtacaggctgttatgctcggcgagggtgtagtaaactgccttaatccaacttccggtgttttaatgggcgttctcgcagcgagcggcatttcttatggaaaatggattcgtttcatggctccacttgcactcatttggtttatcatt

SEQ ID NO: 49 - DNA, 441 bp, Bacillus thuringiensis
tgcagtctttactacagccattactagaagctggttcaccaatgcaagtgactatcgaagaaataccatgggcagaagcagcagcgaaaatagctgaaaagcaacctgcaacacctttaccatttaaaagtgttggtccatatgtatatgaactattaccagaagaaggattatccattatcgatcactttattaataatgcacctgccttttccaccacctccgtatttttccacggattaggcggtgctgttgctgaggtgccaaatgaggcaactgcttacttttaccgaaaagcactatcaaacatgtcaatattcgctacttgggagcaaccagaaggtgccgctggaagtattcgatgggttgaagacttccgcttagcgatgcttgcattacaaaggtgtctacgttaatacgcctgacctatccattaaaaat

SEQ ID NO: 50 - DNA, 987 bp, Bacillus thuringiensis
caagccattctcaaaaatggtctttactctatccagtgaaaagtgatttcagctgatggacatccaattcaaggagttatcccgttcccgggttggattagcgaaagcggaaacaggcgatatacaagtggaagagatgggctacgtcccacaaatcgatatgattatggaacgtggaattttatatacaagtttctcactatttataggagtgctattctttaatcttattatgtataaaggcaatgcaacctcggttcgatcaaggagtaagaacataatatggatctctttatttgggatattgattagcttgttattcaatctaccactgcaagcgaaaataaatgctgatgtttcatggctagaagcattcaatcctttactattaaaagaaacattacagctttctgtttttggttatgtatggattactcaaatggttctcattagtacgcttataattgttacgtattttgcggtgcagcatgaaagggtttcgtcgtttaaagtatggagtattccaatactattgtttatagggctacttgttatgaaggcctttaatagtcacgcatacggtttaaagtttaaagacattgctgccgttatggattttctacatttattagcagcttcattatgggttggtggtttatcatctattattcttcttttatgtaaagaggataataagtggcatatgtattgggatatgattaagcgtttttcaccgtgggcaacaggtgctgacattgtgattttaataacaggcctttttaatagtacattttttattccaacaatccactcgttatttgatacgaaggatggattggctttattagcaaagatactattatttattttcatggggatatgggaattattcattatgtgaaagggagaattagagcgcacaaggattaggagctaccgtgaaaggagagttttgtattggaattatctttttcgaaatctagtttt

SEQ ID NO: 51 - DNA, 611 bp, Bacillus thuringiensis
aaagtagatttgaggaagatttataatgaaacaatcttgattcgtacgtgtacgcgatgcaattttagctgattttcataacgtgttagatgagaaggaaagaaaaaatccaattgcgatgttaaaccaatatttacgtgatagtgagcgtgaaataacaaaaattgagaagttaattgagcgtcataaaacattaaaatctaactttgctcgtgagcttgagcaagcacgttatttcgttaataaaagatcaaagcaagctatcattgctcaagaagcaggtgaattacaattgcacgaacgtgcgttagaagaggtagcttattatgaagggcaagtaactcgattagaagaaatgtatgcaggtgttgtagagcaaattgatgagttagagcgtcgtctttctgaaatgaaaaataaattaaaagaaatgcacgcaaagcgtatggaactaatggcacgtgaaaatatggcacatgcaaatcgtcgtatgaatactgcgatgcataaaatggatgaaaataatccattcttacgatttgaagagattgaagatcatattcgtgacttagaaactcgtatgaatgaagagcatgagcgtgacacatttg

SEQ ID NO: 52 - DNA, 527 bp, Bacillus thuringiensis
gtatgataattaagcgagtacatataaagaacctctagatgtcgcaaatccatgggccagttattatgccagtccggcgatgatggagcttattccccaggaactagaaggaaattagatactagatgctggatgtgcagctggatggtatacttctcaattcataggaagaggagcaaatgttacagcaattgatgtaagtcctgaaatggtaaaagcagcaaaagaaaatataggagaagaagcgacgttcctttgtcatgatctgcaagaaacattgccatttgaagataatacgtatgatgtgattgtaagttcattaactcttcattatatagaaaattggaatcaagtatttcaagaatttcgtcgtgtattgaagccaggtggagaacttatttattctattcatcatccttttatggatttcacaaagtttccatgtgaaaattattttgaaaaacagttattaatagatacttgggttaaaccgaatattactattgaagtcaagttttttagaagat

SEQ ID NO: 53 - DNA, 572 bp, Bacillus thuringiensis
agcaatgactgggtgtaactctcttcgaaaattagaatcgaacagattcctcattcttacttttaggattcaaaactgtgctatttttatttctattaaaaataaaataagaaagtatgataagaacagtaacaaacattgttaaaagtgcttgtgaacgtaaagtatcaattgcgaacatcgcaactaaaactgctataatagcaacaattgtaacatacgttacatacggaaaaagccacattttcactttcaaattttgttgttccactttccccatttttttacgcatctttaaatgcgaaactgcaataacgagataaactagtaacgcaatcccgccagatgcattcactaaaaacaaaaagactttatctggagaaatgtaactaaacacaacgccaatataagcgaagaaagttccaaataaaacggcccgaactggaacaccactactgttcaatttcaaaaacgcctttggagcatctcctctttctgccatcgaaaaaagcattcttgaagtttgtatataaacccgaatttaaacaagagagtcaggctgtaaaaacgat

SEQ ID NO: 54 - DNA, 304 bp, Bacillus thuringiensis
gagatggctcagttggaattgctgcacccgaggttcgccatccttgacgagaccgactccggtctggacatcgacgctctcaaagtcgtcgccaacacggtcaaccgctacatgactgatccggagcatggtctgatgctcatcacccactacacccgcatcctgcgttacgtaaaacccacacaggttcacgtctacgtcgacggtcgggttgccgctactggcggtccggagctgggcgaagagctcgaggctgaaggctacgagaagcacctgtccgctgccaaggccaacgcctcattat

SEQ ID NO: 55 - DNA, 566 bp, Bacillus thuringiensis
tactagtggggacaagttatggaattataaggggataaaaaagaagcctgtttagcaggcttcttttttattatttagtaaacacgttttcgattttccgcataactagagatgagtagtaatgcagtttcttctcctatattacgaacaatatgaggaacgcatgcattccatgagaaagaatcaccttcttctacaattgcaatatcttcaccgtgctgaacttctagttttccgcgtaatacaaggtgacattcttccccttcatgggcatttggtgagttttctttcgggaatccagtagggatttctactaaagataggcgaaggcccccttgctccgcaacatgttcaattctttgctcatctttgccgtatacactgtatttccgttcttcttttttgacaatttttaatcgatctttttgctctaacaataaatagggaaggggaacgtttaaaaaattggagatcgtttctaaagttgagatagatggtgatgttttattattttcaacctgactcataaatcctttagaaagacctgttccctcacaaatttgtgc

SEQ ID NO: 56 - DNA, 558 bp, Bacillus thuringiensis
cgtgatccctgcgcttgtgcttttcttggatcaaatcatttccattggcgtatagcatgatgtttgccgtttatttacaacaccatttgctgcagcacttccgcaagcgtatgcctttccatctgtttttctaacaatccttgcatcagcttcattattataagtaacttttgcccacgctgttttacacgtcgtgctaaattttaattccacataagaatttgaatcaatccacttcttttctttcgttactgctgattgatcacaactattgtaatacggacttttcccatcatacgaatggtcttctgcaaatgctttatcattattggtcgtactaaacacactagttacgacgagcaatgccagacaaagacatgcgcttacctttttaataagtttcacaggattccactcctttattaataacgtccagttttcccgtaaccattattaatcgtcactgcttcggcatcagctgtataaccaaaatcagcagtcaaatcaaacaccattcctgtataagtgctcgtttgccccgttttaattgctccatta

SEQ ID NO: 57 - DNA, 524 bp, Bacillus thuringiensis
gagcacctggtactttacgctcaattacacgcttcaccttctctaactctttcattaagttcactttattttgcaagcgtcctgctgtgtcacatagtaatacatctaccttacgtgctttcgctgcttgtacagcgtcatacataaccgccgctggatcagatccagatccttgtttaatcacttctacaccaacgcgatcgccccatacttctaattgttcaatcgctccagcacggaatgtgtctcctgccgccaataggactgacttaccttctgatttaaacttatgcgccagtttaccaattgtcgtcgtttttcctacaccattaacaccaacaaataaaacgaccgttaattggtcctcttgcatattaatttcgttactaaaatcgctgtcacctttgtaaattcctactagtttttcttgaaataacagcttgtacttcttttggatctttgaatgttacgactttgtacttcttctttcatttggcaaataaatccattaccgtcgtacgtca

SEQ ID NO: 58 - DNA, 553 bp, Bacillus thuringiensis
caagacattatggatgcacacgtcacaaagctttcgaaaaggttcgaagtatctaaatgagaatattatcaattatggtataatattattgtcacaatactaagggggattttatgttatcaaaaaaattgcacgacgcattaaatgaacaaatgaactttgaattttactctgcccatgcttatatggcaatggctgcttactgtacagctgagagctatgatggattcgctaactttttccttgtacaagctgaagaagaacgtttccacgcaatgaagctttacaactatattaatgaccgcggagaacgcgctattattactggatttgataatccgaataacgaatacaaatctgtattaaacgcttttgaagtcgcacttgagcacgagcgtgaagtaacgaaacgtatttacaacttatctgatatcgcttgggacgagcgtgaacatgcaacaattacattcttaaaatggttcgttgacgaacaagttgaagaagaagcttcattcgatagcatcattcaaaaattaaaacgtattacaagcga

SEQ ID NO: 59 - DNA, 555 bp, Bacillus thuringiensis
  unsure (1)...(555): unsure at all n locations
tgtattagttgaagaaactcctcaaaaagttgatgagggatgaaacaattgtatggccgatctaaggaaaaatcttaccaattacagaagtacctgaccaagtattctcaggaaaaatgatgggagacggatttgcaattgagccaactgaaggaacagtagtttctccagttaacggggagattgtcaatgtattccctacaaaacatgcgattggtattcaatctgacggcggaaaaggcattttaatccacttcggtattgatactgtaaaattaaatggtgatggttcagaagcgcttgtagcacagggcgactaggtgaaacatggccaaccattattaaaagcagatcttgcatttgtctgagaaaatgcaccatctatcattacaccaattgactgtactaacttacaacatgggcaacaagtcgaattgaaaaaagatggaaatgctaacaagggcgaagccgttattattgacattcagcaagaacttgacgcanaatgtcaataattataataggcgatgcggctgaccgaacatcgcctattat

SEQ ID NO: 60 - DNA, 234 bp, Bacillus thuringiensis
actggtaaaatcgttgtctgcttctttggagatggcgcgaccaacgaaggtgttttccatgaagcagtgaatatggcttctatttggaaacttcctgttattttctactgcattaacaacggttatgggatttctgcggatatcaagaaaatgaccaatgtggagcatatccatcaacgtagcgctgcttatggaattcctggaatgtttatcgaagatggaaacaatgtcatc

SEQ ID NO: 61 - DNA, 820 bp, Bacillus thuringiensis
gggttatacctttgtttattcggggtttcgacgttttgaaggagggtttagttaatgattgaaatcgaaaagccgaaaatcgaaacggttgaacttaacgaagatgctaaatatggtaaattcgtaattgaaccgcttgagcgtggatatggtactactttgggtaactccttacgtcgtattcttttatcctcactccctggtgccgctgttactgctatccaaatcgatggcgtattacatgaattttcaacagttgagggcgtagtagaagacgttacgacgatcatcttaaacttgaaaaagttagctcttaaaatctactctgaagaagagaagacgttggaaattgatgtacagggcgaaggtattgtcacagctgctgatattactcacgatagtgatgtagaaatcttaaatccagatttacacattgcaacgttagcaaaagatgcgcatttccgcgtgcgtttaactgcaaagcgtggccgtgggtatacgccagctgatgcaaataaaagcgaagatcaaccaataggagtaattcctattgattctatttatactccagtatcacgtgtgacttaccaagtggaaaagacacgtgtcggacaagtggctaattatgataagcttacgcttgatgtatggacggatggaagcatcgggccaaaagaagctatctctttaggtgccaaaatcttaactgagcatttaaatatctttggttggtttaactgatgaagcacacaatgctgggattatggtcgagaaggaggaagatcaaaagagaaagttcttgagatgactttcgagaact

SEQ ID NO: 62 - DNA, 425 bp, Bacillus thuringiensis
tcggagacgtcccggaaaaagtgaatccagtcgtctggggtcacgacgccaaaggtcttagtgtgcgggcccaggagttcagggttgtggacaacggcctgatcacgttaacacgagcctccgcgaagagtacagggtaagtggtaggtaccggcggcacgtaggcaaaatccccgggccccataatccgacacttgtccccattccacagtttaagatagccctttgtaacgaggaacacatcatgcgcgtggttatggtaatgaaaccctggtgcgtcggagagagtcgcgccgctttggaatacggccatcaagccattggtctgctttgaggacgcaaggatccgaaatgtgcccttgctgccgggaatcgtaagacgttctccttctagctggggtattgcgtagggcgttcggctgggg

SEQ ID NO: 63 - DNA, 523 bp, Bacillus thuringiensis
tttccattattttttcttgtatattttaagtgaggtgattgcattgaacggctttgaaagagtaaaagaaaagaaaaagcgtgccattaaagaagcagcattcttattattttcagaacgtggatttaatgaagtgaaaatagaacatatcgcaaaagaagcaaacgtttctcaagttacaatttataatcatttcggaagtaaagatgcgttatttagggagcttatacaagaatttatcatatctgaatttcaatattataaagagcttgcagaagaaaaattaccttttcatgatatgatgcaaaaaatgattgtaagaaaaatgaatactggcggattatttcaacctgatatgttactacaaatgatgcaaagggacgaagaactccgtaagtttatttatagttatcaaaatgaaaaaatcctaccctggtatttagaaatattagaacgagctcagcgcaaaaacgaaattaatccacaccttactaaagaaatgatgttactttacattcaaatg

SEQ ID NO: 64 - DNA, 663 bp, Bacillus thuringiensis
tatctttaaacgacaaaaagactcgcactttgcaagaatggataccggtttatatattccactttgtgcatttttatctttatctttcctattagcgataattttgtgagtgaataatagtagtttcttttctcaacatatatgtaaacgtgagaaatctaagagtaaataaaaaggatgtaagcgccttcttgtcgaaatgtaaattattatgaaagaccaactatgagaagtcaaggggagttttttatataaatagggggtgtttttctaaaaaagggcgtgccaaataaacctaaggattttcaaaaaaaatgaaaaggtcatgtttctgttgtgtgaggtggtacttcataaggcttattgcttttaagaatggcatagataatgtaacacagctttctagctaccgcccctatacaaacatagtagtgctttccttgctttcgtttcttttcataaaaagcttttaatacagggtcatgtttatgcgctgtaatagccgcttggaataaggctctacgcaaatgagaagaaccacgtttggatatagacgtacctgaggcttcaaattgtccagattgggacacagaggcatcaatgcctgcgtaagcgacaagtttagatggtttgtcaaagcggggaatatccccaaattcactt

SEQ ID NO: 65 - DNA, 675 bp, Bacillus thuringiensis
cttttgagatgatgctacaagtgttaccatcgctaatccaaatagaccaattccagatggatctgctgttgtcattttcacatgatgtgtagtagtttgattgctcatataaacctcctgattataaacatactcgaatacaatacttaaatcagaagcctatgtcaatggtttttttgtatgttgtcagacgttatattttataatgattaaatatatttccgaccacttcataaggttttatattcactttttccaactcatttatcggtagccataacggaatataacttcctctaccttcccactgaaattcctcagctgttccacttccgaacactccgcctgtaatataggcagcataataatattcattccctttatattttacctgtgcaataaggtgctccacttttatatgtacccctaattcttcgtatacctctcttttcgttgcctcttcaggcgtttcaccttcctcaatccctccgcccggaaacacataatatgtttcctcttctcgaatacgttttataagagcgatttttccttcctgtacaatgatagccgctccgcgatttcttatcattttattacctcaatacaaatcgcaactgttccccactctttttcttgttctttcgtatatattttgaatgtactttctaacatttc

SEQ ID NO: 66 - DNA, 553 bp, Bacillus thuringiensis
cgaagttcgtgaaagagctgctcgtacaggccgtaacccacaaactggtgaagaaatgcaaatcgcagcttctaaagtacctgctttcaaagctggtaaagaactaaaagaagctgtaaaataatgaaaaatatccttctcatttatgagaaggatatttttttcataacataattaataaaaatctgaccattatgttgtttcttttgttcttttatgcaaataaaacctttactttcaaaaaaaggttttgcggtaatgctcgcctctgtatatatctccctatgccctaggttcactgcttctttttctaacttctgtagtatgtatgaagcgactcttttcccttgataatctttatgcgtaaataaacgatctacgtaacgatcatcgttataatccccaaaccccacaatcacacctttatgatccgctacatagctaatattcttttctaaagactgtaaccaattttctctatctagttgctccggtgcccacgcctgtagctgtaactcattataatcttttgcattaaccgtatgaactgttt

SEQ ID NO: 67 - DNA, 245 bp, Bacillus thuringiensis
accacgggccagcacagacgtcgcagcgtccgcaaggagtcgtggaggggtcgtccagctgcccggtgagcaaggtcatgcgacaggttcttgagcgctcgtagccgagcatggcctgctgttcctcgcgacgtgcctgggagatgcgttcgtaccgttcggtgtcgtgcacccacggcttgccggtggcttgccacccatctcggaccttcacgaccgagccatcaacggccatcactttaagc

SEQ ID NO: 68 - DNA, 628 bp, Bacillus thuringiensis
taaaaaccctccaattatacaaatacatgcaatgctatttaccgcataggccatattatattttattgtaagaaacgggatcaatactcccgctaatgtaccaccaatcggtataccggcttgtctaatccccatcgctaacccgcgattttcttttgagaaccacttcattatcaccttacttcctcctggctgcgaaacactataaaacgttcctactaataaaagtacaaagagtaacccattaaatccattgaccatattagtcagtaaaaacgaacttcctagtaaaaatgaacttatcgaaattaacaacttttcattgtattgatcaagtagccgcccgacaaaaagcatacaaaatagcggtcctatatttacaacacttactaacaatccaatctccgtattcgtaagtgcatattcttctttccaaaataaagcaaacgctccaacaccatacgttataagtgtcgctgttgtttgagcaaccgtcgcaaaaattaacataacccacttataagtactattcaccctttcttccattaacacaataatccctccttcccttccattgtatgaaagttctgtttcatataaataaagattatcatggattcataaaaaa

SEQ ID NO: 69 - DNA, 666 bp, Bacillus thuringiensis
  unsure (1)...(666): unsure at all n locations
tgctatactgtttttgccttggggtctatacaccccccgcttcctcatgttataggtgatggtatagcttagcctataggtgtgggttattgaccattattgaccacctcccctttggtgacgatactttccattactaatccataacatggctctttgccacaactcctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtggccgacaggccgggcggagggtatgtgtctgaaaatgagctcgggnagcgggcttgcaccgctgacgcatttggaagacttaaggcagcggcagaagaagatgcaggcagctgaagttgttgtgttctgataagagtcagaggtaattcccgttgcggtgctgtaacg

SEQ ID NO: 70 - DNA, 843 bp, Bacillus thuringiensis
agaatcccagcggttcgatgaccgacagctcggtctcgagacgctctaggacctctttgggcgggttcggaccgaatttctcgtcgagtccttcctggagtttcttacgcagccaggactcctgagtctccccctcaggaacatcgaactgcggcatccggtcgacgtacttaaacacctcgtcgtaggagccaatcatctcggtcagcagcaaggtgttgtcacaggcctccggatggtcggggaacagcgcccgcatctgctccgaggatttgatgtagtagccggaaccgttgaaccggaaccggttcggatcgtctttgtttcggcccacaccgacacacagcaaagagtcgtgggcgtcggcctgatcctcagtgacgtagtgggagtcgttggtgaccagcaacggaatgtctagttttttggccagcttcagcaggtcggacctcacctgcttttcgatcgggacgccgtggtccatcaactcacaaaaatagttttcacggccaaagatgtcccgataatcggatgcagcttggcaagcttcctcaaactggccgaggcgcagccgggtctgcacctcacccgatgggcaaccggtcgaggcgatgatgccaccggagtactggcccatgagctcgcgatccatacgcggtttcatgtagtagccctcataggacgccaaggacgagagtcggaaaaggttgtgcaggccttcggaatccttcgcccacatcgtcatatgggtgtaccgaccgccgccagagacgtctttgccgccctcggcatccggatctcctgcatcacgagaggtcccccagaaatcatgtactcgtgact

SEQ ID NO: 71 - DNA, 687 bp, Bacillus thuringiensis
ttacatattatatttggaacgataaaataggtgctgaaagggggcatgttttaaggtgaagggggaacttggacagcagaactaaaggggaaccaaaaagggctcttttatacgtataaggtcaaaattggtgataagtgggctgaagcggttgatccatatgtgcgtgctgcttctgtaaatggcgataaaggtgcagtcgttaatttagaagaaacaaatccgaaaaaatggaaagcaaacaaaaagccaaaatttaaaaatccggaagatgctattatttatgagttacatgtacgcgatctttccattcaacctgaaagtggtattaaacagaaagggaagtatttaggtgtaacagaaaaaggaacaaaagggccaggaggtgtaaaaacaggacttgatcatataaaggaccttggtgttactcacgttcagtttttaccgatatttgattatgcttcagtaaatgaagagactttaaatgaaccgcaatataactggggatatgatcctaaaaatttcaacgttccagaaggctcctattctacaaatccttatgagccaactgttcgaataactgaattaaagcaaatggttcaaacactacatgataataatcttcgagtagtgatggatgtagtatataaccatatgtataatgctgctgaatctaattttcataag

SEQ ID NO: 72 - DNA, 591 bp, Bacillus thuringiensis
attttatcaacaagtaaaaatggatagcggtgaggaatgatttctttaatttgttctatatttagcatgtaacaatcgccccttttgtaatattggtcttaccacttggacatattgctattatcccattttgtttattggttgtcattacaaagtaacattttatatttagtacaacttcctaaaaaaaatgcacacactctattccattaaaatagttgcacatttttgcaactgacacggaggtggaaaagagtgtatgcccaaattagggaaaggcaatatgtattgaaacattatttgccttaatgtcgtattcgactcattatattataaacgttttcaattaaggaaatattaaatttaaccatatatatgaatattttacctgtttccttcatatttctctattttccttccattttcgcaaaaaaacaaaataaaaaaatataaaaacaaaaaagaactaaggcattagccttagttctttcaaattatctcaaagcacgctttggtaatctgtcgatattctctaacataatacctgtaccaaccgcatcgcagtgcattggttttcagcaattaatactg

SEQ ID NO: 73 - DNA, 731 bp, Bacillus thuringiensis
  unsure (1)...(731): unsure at all n locations
agcacaagctgttataagtggtaataaggaaaaagtagtgaagtttataaaggcgagtccaagcattgttaacgaatgtagtgaagatggctggacaccacttcatttagcagcttattttggacagaaagaaatagcgagttttcttttagaaagcggtgcagatatacatagtagagcgaaaaatgaaaatgaaaatacacctttgcaagcggcaattgcgaacaagcaaagtgaacttgtcgctttcttaattgaaaaaggatcagatgtaaatattatgcaaagtggtggctggacaggactccacgaagcagcattattaggaaatgaagaaataattatgttgctccttaaaaatggagctaataagatgattaagaaaaatgatgggaaaacagcgtatgatattgcattagaaaaaggatataatcaccttttacatcatttgaaacaggaagtgaacttatgatgaataaatggagtgttggtatatttttatttaatgaagtagaagtgttagactttgcagggccatttgaagttttttctgtaactgaggtgaatgaagaaaaaacatttactgtttatacagttagcgagaatggggaaatgattacagcaaggaatggattgaaggtacagcccgattataggattgaaaatttaccaccagtggatattntaataattccgggtgggctaggtgctaggaaatatgaaataaaaaa

SEQ ID NO: 74 - DNA, 290 bp, Bacillus thuringiensis
aaatcccttgatgctgaaacgacggtactcagacttgcggggcataccgtcttcgaagaccaccatcgacccgacgacattggtgccctggatatgggaaatgtcgtaggactctatccgtagcggggcgcggtccaagccgagtgactcctgaatttcttccagagcgcgagtacgggtagcaaggtcagaggcccgcttgagcttgtgctgggcaagagtttcctgggccctgcgagtgacaatgtccaccagagtcgctttgtcaccacggcgcggaactcagaatc

SEQ ID NO: 75 - DNA, 501 bp, Bacillus thuringiensis
ttcatggttaagtgaagctgaagattccagcaggaacacaaactggaacagaattccgcttaaaaggaaaaggtgctccgaacgtacgtggatacggccaaggagatcaatatgtagtcgttcgtgttgttgtaccgacgaaattgacttcgcagcaaaaagatttattacgtgaatttgcaggacaagaagagcaggatgatagtttattcggaaagcttaaacgtgctttcaaaggggaataatggaaataaaaaatggagttggtaaattgtgaaatggtcagaaattagtattcttacaacagaagaagcagtagaagctgtctctcatattttacatgaagctggtgctagtggagttgcgattgaggatccagcggagttaacgaaagagcgcgagcaacaatatggtgaaatttatgcattgaacccagatgaatatccggcggaaggtgtattaataaaagcgtatttcccgcaaacggattctttacatgaa

SEQ ID NO: 76 - DNA, 525 bp, Bacillus thuringiensis
tactaaagacctattgtttattaactaataggtctttcaacttaggaagctcacactaatgagggatgttaaagggaatatatctaacctatactaattactataaagctttggaaaatgaaaaggaggagatttgcatgaagaattgggttcaatttagaattgcaagaccaacagataaattggaagaagtgattagtttttatgaaacaggattaggattaaaacgtataggggaatttcacaatcatgaaggatatgacggggttatgtttggattaccagatgaagagtatcatttggagtttacttcacatgttaatggaagtccatgtccggcaccgacaaaagataatttactagttttttatatgcctaataaagatgaaattgaaaatatagtaaatcaattaagtaatatgggctaccatgaggtggaaccagaaacccgtattggatagagaaaggaaccacaatagaggatccagatggttggagaattgtgcttatgaatgcatctgaata

SEQ ID NO: 77 - DNA, 635 bp, Bacillus thuringiensis
tcacaatgtttttcttcatcttaacaatctttgttcttgttgctttaattccttgagaagaagcatgactcacaaagagcccattcgttgctgtttttgataatatcgatattccatatgcagctgatattatgaactttgttattcttactgctgttctttctgttgcaaactcaggactatacgctgctactcgaatgctttggtctttatcaaaaaacgaaatggctccagcatttttaaagaaattatcatcacgtgggattcctctcaacgctttaatcatgacaatagctatttctgctttttctcttttaacaagcgtcgtagctgctgaaacggtttacttatggttaatttccatttctggagtcataacaattattgtttggatgtcaatttgtgtttctcaattctttttccgcaaacactatttagctgaaggtgggaaattagacgacttgaagttcagaactccactctatccccttgtaccaattcttggttttggattgtatggcattatattagtaagtcttatctttatcccagatcaaagactaggcatttattgcactgtaccatttatcatcttttgctatacttactatcactttaaagtaagaaaagaattg

SEQ ID NO: 78 - DNA, 808 bp, Bacillus thuringiensis
ttggtacagttggcgtaattatcggtctggcggtttttgttgttttaagttacatcgcaccgaaagacttattcgtatatgtatatagtgcgagtgtacttcctggtatggtaccatggttcgtcattttaattagtcaaattcgttttaggaaagaaaagggagcagagatgaaagatcatccgttcaaaatgccatttgctcctgtaacaaactatttaacaattgcctttttaattatggtattaatcggaatgtggtttaacgatgatacacgcatttcattagttgtaggtattattttcttagctatcgttacaattagtttctatgctttcggaataggaaagcgagctccgttagacgttcaaaataataaagagatttcaagtaaataaagaagaggctgttcatctggaacagccttttcttattgttgttatttgtcgataaatcgatataacttgtcgaatcgttgatataatttgatttgtgatagatatattcgaaaaatcgttaatataatttcacatactacctatcactatcatgattaaaatttctctaatacgattttcccaatggtgtgcccgctttcaagtagtgcatgtgctttttttaagttttcagcgttaatcggtgttaatgtttcatttaaagtaagaattctttacttctatattatagatggtgaaatactgctatgtaaaaaaatacccttttttttatgcaagctgtactgatagtctagaaggagtttatttctaaaaagatgaattttttactgtattactttatccaaaactaa

SEQ ID NO: 79 - DNA, 595 bp, Bacillus thuringiensis
atattttaggagaagagggttatggagacgagataacgtcttctgacggggttgtttggttaattgatccaattgacggcacgatgaactttgttcatcaaaaaagaaattttgcgatttcaattgggatttatgagaacggtatcggaaagattggacttatatatgatccagtgcatgatgaactatatcatgcagtcaagggatatggagctttttgtaatgatatatcaattcctacactgaaaaaaggaactgtagagcaaggtattgtagctttaaatgcgatatggcttacagataatccattgcttaatatggaaagtatgatggcacttgttaagaaagcaagaggcacaagatcatatggctgtgcagcgttagagatggtatacgttgcaacaggaagaatagatgcatatgtaacgccgagattatcaccatgggattttggcggaggaaagataattgtagaagaagatggaggtaaggtgacgacattctctggagcgccactttctatcatagagaagagcagtgtgttagttgcaaaaccaggagtgtatgacgaagtgttatcgtttatatgagagca

SEQ ID NO: 80 - DNA, 732 bp, Bacillus thuringiensis
gctgttctttattcttctctactacatatgctaagccactggatgtttatctaaatatgggggatcaatttgctgaggatctcccatcagtacaatctgactgtcttccactaccctaggtaatatcgattgcacttcatgctttgttaaattttgtgcttcggcaatgataatgaactgatctggaatacttctcccgcgtatatatgtaagggcttctacttcaatcgaacccattccagctaaaatagcatctaactctcctggctttttcgtattaaataaatactctaggttatcaaaaattggctgcatccatggtcttaacttttcttctttttctcctggtaaataaccgatatcttttccgactggaacaattggtcttgccacaagtaattttttatataaccctaagtcttctgtttgcataagtcccgaagctaacgcaagtaacgtttttcctgtgccggctttccccgttaacgttacaagcggaatatcttcacgaagcaacaattctaatcccataatttgctgcacatttcgtggtcgtatcccccacacttgttcattgtgaaaaataagtttctttaccttcttacctaagtgatccacaatgccaagagcagaactagagccccctaatgcatctttcatcactacaaactgatttgggtaaaaaggatgattcgcaatttcagatagaggcaattcacccttctcataaaa

SEQ ID NO: 81 - DNA, 186 bp, Bacillus thuringiensis
gtaatgagactggtagtcgtcgcaacaacaaagtcctgttcgtgagccagcaggtaggtgtatgagaagaaagccaaggacccgatggccaccacaccggatgccaggccgtcaagtccatcaatgaaattcaccgcattggcgcacaacacaatgaagaacaccgtcaccaagatcgaagtaggc

SEQ ID NO: 82 - DNA, 210 bp, Bacillus thuringiensis
tgtatgagttcttcgacaaattagtatcagtttctttaccacgtgtacgtgatttccgtggtgtttctaagaaatcattcgatggtcgtggaaactatacattaggtgttaaagagcaacttattttccctgagattgattatgataaagtaagcaaagtccgcggtatggacatcgtaatcgttactacagcgaaaactgatgaagaag

SEQ ID NO: 83 - DNA, 631 bp, Bacillus thuringiensis
ttgttttcttctgctcccaaatatttagcaatacttcttgtaaatgacttcgagtaaaagcatccagcgctccaaaaggttcatcaagtaataatacatttggatctcttaataacgctctcgctatcgcaacacgttgtgacatcccgcctgaaatttctttcggatacgatttttcaaagccatctaaccgaacgatttcaacccattctcttaccttatctttcacatacttatcttttaacgataaatctgccgctatattttcttcaactgttaaccatggaaaaagcctatgttcttgaaaaataaaaccttgtttcttgctcgtttttaagataggctccccgtcaataacaacttccccttcaaaatcattatctagaccggcaacaatttttagtaatgtactttttccgcacccactcggaccaattactgtaacaaaatcccctttctctaattgaaaattaatattctctaatacttgaacagtaccagtttgtttcaaaaaatattttgataccccatcaattgaaacagtcatttcttctcctgcttagatgattcatataaatgaacagattcagtatttgtgcaataaaaaaccaaaggcattttatcaacagat

SEQ ID NO: 84 - DNA, 418 bp, Bacillus thuringiensis
atcttcattgtcataacgtttattaagtttatatttatgtttacattgaggttctggtaatttatcaaactatatttcctaacataaaggaatccctttcctctcgaaaatattctttttattcccatccccttaagcacaccttagaaaagattcacaatcaatgaaacgtggtagcttgtttttctataaacaaaaggattattttattaagcttttcacaagctatatctttgaattttcaaacttaaatgaacctctagacacatacaccatatactaatataaatactccctaagaaagaaggtgaaagctatgccatctattgtcggaaatatggctgtacaaaatagtgacggttctttcaacttaggagatttttgtaaccggttctccaaaggaaaatacatacgctta

SEQ ID NO: 85 - DNA, 524 bp, Bacillus thuringiensis
agaaacgagttttatcattgaagaagagggtgaaacgttttgtttcttatgcggatttttttcacaaacatataaagatgaagcatacgttcattttatcggtgtaaatccgaagtatagaagaagaggaatcgcatcgacattgtattcttatttctttgatgtcgctcgtgcaaataatcgtaaagttgtaaaagcaattacgtcaccaactaataaaaagtcgatacagtttcatcaagaaatcggttttcgaattgaggctggggatgatgaggtagagggtgtattggtacatacaaattatgatgggaatggcgggagtagagttttatttttgaaacatgtgtagataaaaggggaatgattgcatggatatgcagcaacggaaaatgttagttgcatgaatcgttttagcaagagtgttaggggtaggctatttttctacaaacgtattacaaactttctcaatcgtatgtttagcaataccgattgtatttaggggtttagggagcatacaaaag

SEQ ID NO: 86 - DNA, 636 bp, Bacillus thuringiensis
tatatatatctacaatttaaaaaagaaagggtatgatgtgtccgaaaatgaaaatacaaatagtattgtttgatggtttcggagaacttgtctctttcgcaccgtttgaggtactgaaaagagcgatagaagaaggggctccatttacaattgaattcgtttcgagtgaacaaaaacaagaagttacgacttcatttggagttacggttaaactacatgattttttacgaatggataataggccagatttgttaattgtacctggtggtggctggaatcataaagcagagcatggggcacgaaagcaagcagagcttggtactttgaccgaaatgattagcgagatgcacaatgcaggaacaattgttgctggtgtgtgtacagtaggtatgctattagctgcctctggtatattgaacggtcgaaaggcaacgatgcactatgtggcacaggatcaaatgagtgtatacggggcagagcttcttcattacagaattgcggatctaggggatattatctctgcaagaggagttacttcaggagttgatttgggactttggctcacggaaagattcgcaagccctgaaatttagtctaaagttgtttacagaatggaatatgagaggcgaggtgttg

SEQ ID NO: 87 - DNA, 518 bp, Bacillus thuringiensis
acatttttactatttttatttactttttctgtacttgtgtacgtattaattggtggatttcgtgcagttgctctatcagatacattattaggaatcattatgttagttggaacaacaatcattttaattgctactgtcattgctggtggtggaattgaaaagattatgcaggaacttgttcaaattaatccaaagttaattacaccattcggagcagatggcagtttaacgaaatcatatgttacatcattttggattttaattggaattggcgttgtcggtttaccgcaaattagcgtgcgtgccatgtcttataaaaattcaaaagcgatgcaccaagctttaataattggaaccgttgtcgttggcacaattatgatcggtatgcatttaacaggtgtatttgcaagagtagtacttccaggtataacggtaccagataaagtaatgccgctacttgcgatggaagtgttgccaccttggttagctggagttttcttagctacaccgatggcagc

SEQ ID NO: 88 - DNA, 595 bp, Bacillus thuringiensis
  unsure (1)...(595): unsure at all n locations
tatcgcaaatattttattattaagcctcatacatgttgcactccatccatctggagaatcttctgtcgcttttcttttcgataaacagtacgctcttgttgcattcattttaattggcacctcttattctttccctgtttgattacgatgcatcacaatttgcttcgttgcttgaaattgctgctcaccgtaaaactttattagcttctctccgcaaaatagactaacaatatcaatatgagatatttctcgaagtaacattgtaagcattttctctccaatacctttatttcttacattctcatgtacgacaacatcttcaatgtatgctcgaaaaacaccatcagaaacgactctagcaaatccaactaattcattttcttcccatactccaatggctatactattctttaacattttttcaatatcgacttcttttctttctgggcaccaaccgacagaatcataaagcttcttaattttttctgcacagattggttgttcttgttgcaatttatacgtgtacatatgctttctcccattcatcagtatncataatattattataatctcttttcaaaaagtgctgactatg

SEQ ID NO: 89 - DNA, 290 bp, Bacillus thuringiensis
aggtgcatttgtacttgagaaaacgatgcgctctaaatttatggggcatttacttaagatgacgccgactttttatcaaaaaaatcgtactggcgacttaatggcgagggcaacgaatgatttaaaagcaatcgctatgacagctggttttggtatattaacgcttgtggattctagtttatacatgcttacaatcgtttttatgatgggatttacaattagttgggagcttacatttgcggcacttataccgcttccgattatggcgtatgcgatgaatatatatggaa

SEQ ID NO: 90 - DNA, 737 bp, Bacillus thuringiensis
ggggttgtttggaaaagtcttgacgccggtgttattatgtatgattgcactcatttttataaagagtatgtttacaacggtaggagatatgaaagaaccaatagggaactatggacaagctcctatgtttcaagggtttttagatggatatttaacaatggatgcgttagctgctttaatctttggaattgttattgcaaatgcattacgtgcaaagggtattgaagatgataaaggtttagcgaaatatatgagtattgctggcattggggcaggattattattatcgattatttatgtcatccttggatatgtgggggcaattagtggctcattaggaacatttgataacggtgcgaaagtgttagcacaagttatgattacattatttggacagggcggagtcgttttattaggtcttatttttactatcgcgtgtttatggtgttacaattggacttgttacgtcttgtagtcaattttttgcgagtgcatttccgaaagtatcttataaattgtgggcatttatagtaagcgttgttagtatgattttagctaatttagggttaacgcaaattttaaaagtatcagcaccaattctgggatttatttatccaattgcgataacgcttattattctagggttattccatcagtatattgaaaagtatgcatacgtatatgcagtaactgttttggttgtagcgatatttagtgcaattgattttttaaataaa

SEQ ID NO: 91 - DNA, 509 bp, Bacillus thuringiensis
ggagatagcacttcataaatcagggttgttttttctgcttcttccaacgtaccaacagcacctaaaaacatatttctgctcttttcatccggcatatcttcttctgttaattttttcttttctccaaatgaaaatcccgctggtaacaaagatcgtgaaggtttatttccttctttcatctctcgaccaaaatgtttcaaaataaaatcaatcgtatcacttgtaatcgaaacagcatcgaccacagtcggaacaccaattgcgataacagggatacctaatgtgtctttacttagttctttacgtttattcccaacccctgatccaggatggattccagtatcagaaatttgtatcgtgctatttactcgttcaataaaacgagcagctaatgcatcaattgcaattacaaagtccgggttcgtcttctcaaaattccataaataacatcgctcgtttcgattcctgtaatccccattacccccggccgaattgcactaacaggccta

SEQ ID NO: 92 - DNA, 438 bp, Bacillus thuringiensis
tgcaggtttagttatggctacaatggatatcattaaacattaccacggtgacccagctaacttcttagatgttggtggcggtgcaactgcagaaaaagttacagaagcattcaaaattatcctttctgacaaaaatgtaaaaggtatctttgttaacatttttggtggcattatgaagtgtgatgttattgcagaaggtgttattgaagcaacgaaacaagtaggtcttgagttacctttagttgtacgtcttgaaggtacaaacgtagaactaggtaagaaaattttaaatgagtctggcttaaatattgttgcagcagaatctatggcagacggtgcacaaaaaattgtttcactagtgggctaatagaaagcgtggggagaaaaatgagcgtattagttaataaagattcaaaagttattgctcaaggtattaca

SEQ ID NO: 93 - DNA, 468 bp, Bacillus thuringiensis
aaattcgctgaattagtatgttttaactcacttcgtgcaaacactttaacaaatgcagttggagttattaaagaggaaatgcgcttaatggattctgtaattattcgtgcggcggatgagtgctctgtaccagctggaggcgctttagctgtagaccgtcatgagttcgcagctaaagtaacagaatacgtaaagaaccatccaaatgtaactgtaatgaatgaagaaattacagatattccagagggaccgacaattattgctacaggtccattaacatctcctgatctttctgcaaaattgaaagaattaacaggagaagattatttctacttctatgatgctgcagccccaatcgtagaaaaagacagcattgacatgaataaagtatatttaaaatcgcgttatgacaaaagtgaagctgcatatttaaatttgccaatgacagaagaagagttgatcggtttt

SEQ ID NO: 94 - DNA, 891 bp, Bacillus thuringiensis
  unsure (1)...(891): unsure at all n locations
ctaagaggcattcttgcgtttctggggctccgttattgtaagaaaaggaagaaccaggcggtgcagtttcttcggcttctcgtaacatatcataaattttcatcggaccgtagtaatttttgccgcggggtaaaatattgctagctaaatataattgtgcatcttgattttctagcccaggctgctcatatccatgagtaggatattcagctgacacttgcatgtccattaattgctgaagtgtggcattaccgaacggtgtgttttttaattcttttatgtcagcgtcagctgatttttctaagtcaatacgtttttcttcagcgagagattgtataatcgccccggtaaagacttttgctaatgatgccataccatgaggttcattctgtttatacccattgaaatatcgttcataaacaagttgtccattatgtacaacgacaaaagcatctgttttgttatcgtctaaaagtttttttagaggagttgtatttccgaatctacgctccacagcaaaatcgtctaagttttgcaatgcggaagggaagtgagcaatttggtcaggattgttttttacgttattaactaaagtgaattctttcatatgggtatatgaccaacgtaagtaagggtcatttaaccagttttcttttgtcacattatgttttgatggggtcgttttattttgtttgaagtaagtaaacccaagccctgtaattacaaatatgaatgttagtataagtaagagtaggggagatttttttagtttcatatatggcccttcttttatttctactataagtatacgctcgtcttgaaagaaatacataataaggaaagtaaacggngaagtttactttccttattaacgttaaagcggaaattttt

SEQ ID NO: 95 - DNA, 919 bp, Bacillus thuringiensis
  unsure (1)...(919): unsure at all n locations
aggttattttatctttagactagaaagtgatatttacgtcccactttctaagcttacataagtagttatacttgaacaatcgataaaaatcaattattcacctttattttttttgataatttcttcagaaacagactttggtacttcttcatagtggtcaaacaccatagagaatgttccgcgtccttgagtgttagaacgtaatgacgttgcataaccgaacatttcagaaagtggaaccatagcgcgaacaacttgtgcgttaccgcgagcttccataccttctacacgtccacgacgagatgttacgtcacccataatgtcacccatgtactctataggaattacaacttcaactttcatcattggctcaagaattactgggctacatttagaaaccgcagctttaagtgccatagatgcagcgattttgaacgccatctcagatgaatcgacatcatggtaagatccgtcaactaatgcatctttaatgtcaactagtggataaccagctagtacaccatttttaagcgcatgttcaagacctgctccaacagctgggatgtattcacgaggaactacaccaccgccaatcttgttgttgaatctaaatcctttaccttattcattaggatgatactcaatccaaacgggtccacatggcgcacgaccaccagattgacgagcgaacttaccttcaactttcgcagtagcgctggatagactgacggactgctacctgaggagcacccacgactgctaacactttgaactcacgacgcatactgataacgatgatatcaaggtgaagctgacccataccaacgatgatagtcagtacaggctattggtcagagtgagcacggaatgccggaccttgttgagacagctnatataccgctgtgcccattttatactg

SEQ ID NO: 96 - DNA, 367 bp, Bacillus thuringiensis
acaaaacgaatagtagattagacggtctagatatgactggtatacttgcagtaattagtgttcagtggagtaaaacgaaatgcacgcacggataaaatgattgttccagtaatggcaaattattaatgaagcagtggcattattcgttgtagtaacaaacattacggcaattccgtatgtatttaaagagattttcttacatgctttcggaattaaagaagtagtaggtgggggactaggagccgcgattttactaggggtaaaacgcggattattctcaaatgaagcaggtatggggagtgcgccgaacgcagcagcgactgcgaacgtaacgcacccagttaaacaaggttttattcaaacttta

SEQ ID NO: 97 - DNA, 505 bp, Bacillus thuringiensis
ttctacagtgaaaccttctgtatcgtacattttttcaaataaacgatttttttctactaaattgcgctcaagcttctctttaaatgcttcacggtctaaaagatcagccatacgaataccaatacgagcagctttatccatatatgcaggaccgataccttttttcgttgtaccgattttgttatcacctttacttgcttcttctaactcatcttgctttaagtggtaaggtaaaataacatgtgcacggttacttacacgtaaattatcagtacttacaccacgatcgtgtaagtattttaactcttcaagtaatgcttttggatctactactaatccgtttccgattacacaaattttctctttatagaaaataccagatggaattaagtgtaatttatatttaactccgccgaaaacaattgtttgtcccgcgttatttccaccttgatatcttgcaactacttccgcatgctcagaaagaaaattagggaatttacctttt

SEQ ID NO: 98 - DNA, 549 bp, Bacillus thuringiensis
cgacggccaattatatttgatagccatccaataaaaaatacacctaaagcaaatccagcaaaatacacactaagcgttaactgcacctcattattacttacatgtaacgcctttgaaatgtccggtaaagacggtgtgtaaatcgtttcactaatttgcggaaatgcgacaagaataatcattaacaaaagtgatggtactgagacttttttcatttttcataccctcctataactttggaaaaatctcagaaataaaaagactttccttagctacggaacaggaggggccattatagaaatccggtcataaaacaacaaagaaaacacctcaattacgtatgttaatacttataggagggtaatattaacatcgatttttaaatatactttttcaattatattacatattaattttatttttctagtattatcatttcgaatgctctttttatattagtgaacaaataataaacgccataaaagataacaacttgatatgaacgccttattatggaataattaggaatagtttgaattaataaacctg

SEQ ID NO: 99 - DNA, 619 bp, Bacillus thuringiensis
agaagttcttgatattcacggttatactgttggctataatattacatcagcccttgttactggtagaattgccggaacgacagctggagaaaacgcgaaaatgcagtattaaaaaaagaaacagggattcctgtttctttttttataggtacatgaaattatatgagcaattccacaaatatatcagcgattccgcaacttatatcggcgattccccaaatttatcagcgattctgcaacttatatcggcgattttccaaatttatcgacttaccgagaagaaacgacaaatatctgctccatgtaactttccattgcttttttgttgctttatttaccttagtacctttatattttatattgttgaatatttaaaaaagggtaaggggaaaacaaatgagaaaaaaagtcatgatgtctttaatgttaatgacgtttctttctgcggtagaaggaacgattgttagtacagcaatccctcgtataacgagtgatttgtcaggcgtcgaacttgttagttgggtatatgcaatttatatgcttgcaacagctgtttcgactccaatatacggaaagctcgctgatttatttggccgtaaaaaagttttacaaatcggag

SEQ ID NO: 100 - DNA, 393 bp, Bacillus thuringiensis
tgagtattttttatggaatccttgatacgtatgctcagtttttcgacttggacatgtggattaaagtgttgcaagatccagtatcttggggattaattggtacacttgttgtacttgaagggttgttatctgctgataacgcacttgtgttagcggtaatggtaaaacaccttcctgaagagaaacgtaaaaaagcattattctatggacttattggagcttatatattccgctttattgcaattggaatcggaatgttcttaattaaattatggtgggtaaaacttcttggtgcactttaccttgcttggttatcagtaaaatactttattgataagcgtaaaggtgcaagtgaagaagaggaagctcatggtatgaaccaaaacagtattt

SEQ ID NO: 101 - DNA, 543 bp, Bacillus thuringiensis
agcaatggtatttggaggccccattttaactgcaatcctcttacgaatgcgcagcaaacaagcattattgtttttaatgttcatatttttaattggtcaatcgctcggagctattgcttggaactatgatattatgatgatttcacgtattataactggtattgcttcagcttcagcttttggagttgcgatttccttttctgcgacattggttcactctgattcaaggggaaaagctgcatcaattgtacttgcaggtttaatgttcgcaactgtattaggtttacctataacaaccgttatttcgcaatattttggctggcgtattagttttggggctgtttctgttcttgtgctagtatcagcaattatgattcaacggttgttaccatcctcttcaaataaagagcaattaaattggaaagatgaacttctgcgatttaagaatattcatctttgggcagcgtacgtaacaagtatgttcattattggtggtacgtttgccgcattagttatttcactctatctttacaaatgtacagg

SEQ ID NO: 102 - DNA, 147 bp, Bacillus thuringiensis
aagtttttgaacgttgtcgatgcggctggaaaagatggcgtacagcatttcttaatgagtagtgggtatcgagattttaaagaacaaagtaaattatataaagaaatgggatctgattacgcgcttccagcaggatatagtgaacat

SEQ ID NO: 103 - DNA, 468 bp, Bacillus thuringiensis
gtgaaattacttctaatgatcgttatgccacttattttagtgtctattatttcagcctttacaaaattacagttaacgaaaaaccttggtaaaatcagtggtcttattatcggaattttaattcttactacaggaatcgctgcagctgtcggtatcgctgcaagtgcaggatttgatgtatctgcagcaggcttgcaacaaggtgatgcagaatctgctcgtctgaaactagttgaagaaagatttacttctattgaaaagacaacaattccagataaattattagagctattgcctacaaatccgtttcttgatttaacaggcgctcgttcaacatcaacaatttctgtcgtaatatttgcagcctttatcggcattgcctttataggtgtaaaacgaaaatattcagaacaagccgaactatttaagaaaatgcttgatgctgtatatgcaatcgtaatgcgtatg

SEQ ID NO: 104 - DNA, 247 bp, Bacillus thuringiensis
tactcataatcgctgctagaatggctgctaataaaaatccagtaataagtggatggaataaaattttcccaagttcaaggaaaattgtctctggattagataatgtcaactcttgttgtgaatagtaagcaataccaataagaccagtaaacatagctccaacaacagagaaaatcatccagctcataccaattcttcgtgcacttttaagttcttttacagaagaaattgccataaagcgtacgat

SEQ ID NO: 105 - DNA, 795 bp, Bacillus thuringiensis
gattatcgtattcgtaaagaaatgaccgaaaagggtttctacattttagagatgcggaaaaacaatgagttcttggatcaatcttctgctgatgattggacgttaggctatgcattatatatagaagaagtggatgaagaaaaagcaaatacagcacagaaaattatcgttgaacatgaaggatcaccctttaataaagtacctcttattgcaaaactaactgaagatgggcatgcctctttaacgaaagatagccttacagtagcaaaaaatggtaaaaaaacgaaagaaaccgttacagacatgcaatatacaaaccttttacattcaaaattcgaaattacactataagtaagtaagccttgttatttcagcagggcttttcaattttcagcagggattttttgcaatttgttgtatttcatagttatatagaaatataactacatgtttagaaaggaaatgattatgacagaacttaaagatcgattacaagtagctgatatagaaaaatgggatttaacagacatttaccatacaattgaagattgggaaagtgattttcataaaattgaagtattaacgaaggaattacacgagtttaatggaaatattcacgatggcaatagtttattagcttatttaacgaagagtgaagaagtttctagcataatatctttaatgttcgcttatgcacgattacaatctgaccttgatacacgcgatactgacgcgcaatctcttgtcgataaagtatcacaattacacgttgaaagtaagtgcagcgaaattctt

SEQ ID NO: 106 - DNA, 477 bp, Bacillus thuringiensis
caactgcatcttaattagcgcaagctatgattcgtgaaggtgttaaaaacgtaacagctggtgcgaacccaatgggtcttcgtaaaggtatcgaaaaagctgttactgctgcaattgaagaattaaaaacgatttctaaaccaatcgaaggtaaatcttctatcgcacaagtagctgctatttctgctgctgacgaagaagtaggtcaattaatcgctgaagcaatggagcgcgttggtaacgacggcgttattactttagaagaatctaaaggcttcacaacagaattagacgtagtagaaggtatgcaatttgatcgtggatatgcatctccttacatgattactgattctgacaaaatggaagcagttcttgataacccatacatcttaatcactgacaaaaagatttctaacattcaagaaaatcttacccagtcttagagcaagtggtacaacaaggtaaaccatcttctta

SEQ ID NO: 107 - DNA, 684 bp, Bacillus thuringiensis
ttaaattattgaattctacaaatgaaaaagagtattgggctatttctgatatagctgatggaacacatctcccagttagtacagtacatagattacttaactctctaatggagcatgggttagttacacaaataccagagacaaaacagtacaaaattggaccaatgtggatggaaatagggttacgtcaattggagaaggtagactacagatcagttgcaagagaagtgatgaagcggttggcctttgaagtcgaagaaagtgtctatttaaatattccaaacggaacacattctattatcattgaaagaattgatagtcctttaaaaattcgagttatcgataatctaggggaacaaattccactttcaattggtgccgcaaataaaacgatgcttgccaatatgaaaacgaatgaaatggaacatattgtagaacatttactttcttcattaccagaacaaaagcaaattcttcttaatcaaataaagcaaataaaaaatgaaggatatgctgtcagttatggtgaaaaaacagaagggacagcttcagtagctgcacctattatcggatttaatcataaagtagtaggagcattaagtgttgggttaattagtcatcgtattatgatgatcgactatcttttcttattagcaggtaaaacaagcagctcatgaaatattc

SEQ ID NO: 108 - DNA, 219 bp, Bacillus thuringiensis
ctcggtcatccgtacggtgcatctggggctatgcttgtaacacgtttgttttatcaggctcaaagagagtttatgaaatatggaattgctacattaggaatacttcgtcgagtttttaaacgctgcaatattagatgatgaaactggtaaacccgcagaagaaactgaaggtttttggtttatacccattttagaacatcaattaatcggaagttggta

SEQ ID NO: 109 - DNA, 491 bp, Bacillus thuringiensis
catccaagccatacgctcttacaagcgcacctaatcttccttggaatccacttgctactgcattaaacttacactgtccattatgacggtataattcacaaaagacaactgctgtttcgatagagaagtcttcccctaaatcaaaacgaagaacttcttcgttcgtctcttcattcgctaaacgaacgaatgcgtttcctacttgtccaaagttttgattacggccttccgcatcataaattgtaactgtaatagcaattttatgaacggtctgctggaacctttttcaaatctacaacaagttgctcatcgtcgccttcgccttcacctgttctgttatcgccagtatgtaaaactgatccacacggagactttaaattattatagaagataaaatcagtttccttcgtacatttcccgttcgcatctaatataaaagcagatgcatctaaatcgaaatcgtctccgccatcataagatttaatatccca

SEQ ID NO: 110 - DNA, 173 bp, Bacillus thuringiensis
cggtgcgtaacccatcccgaactgcacggcagcatcgggagaaaaacctcgtccagcgacaaattcccgagcgatacgaccctcatcggtcgacatctgggactggaagaactccgctgctgcctcattggcggcgaggatctgcatccgcaggcctggctcaaggccaggac

SEQ ID NO: 111 - DNA, 252 bp, Bacillus thuringiensis
tcaccattccaagcattttgcttaagtgcagcagcacgtatcggtatcggaaacttagctggtgtagcattagcaatttcaatgggtggacctggcgcaatattttggatgtggtttatcgcaattatcggagcagctactagttttgtagaatgtacacttgcgcaaatttataaagtaaaagatggaagtaggttccgtggtggaccagcatattacatggaaaaagggttaaacaaacgctggatgggc

SEQ ID NO: 112 - DNA, 665 bp, Bacillus thuringiensis
tacattcttgctcctaaatctttagaagtaggtatggaaggtatgtctggcccagaagctgacattaaaatcggtaacgcattaccattaatcaacattccagtaggtactgttgttcataacatcgagcttaagcctggtcgtggcggacaattagttcgttctgctggtacatctgctcaagtacttggtaaagaaggtaaatacgtacttgtacgtttaacttctggtgaagtacgtcttgtattatctgcttgtcgcgcttcaatcggtcaagtaggtaacgaacaacacgaacttatcaaaatcggtaaagcaggtcgctctcgctggttaggtaaacgcccaacagttcgtggttctgtaatgaacccggttgatcacccacacggtggtggtgaaggacgttctccaatcggacgtaagtctccaatgtctccatggggtaaaccaactcttggattcaagactcgtaagaaaaacaaagcgtctgacaaattcatcgttcgtcgtcgtaaaaaataatgggattgtagtacggttcatttctagaaccgtacgccaatcacgaagggaggcaccaaaatggctcgtagctctaaaaaaaggaccatttgtcgatgatcacttaatgagcaaaatggaaaaattagttgcatctgagc

SEQ ID NO: 113 - DNA, 484 bp, Bacillus thuringiensis
cagctagtatgcaaagtgtcgcagcttcatcagaaggtcaggtttattccatggagggaattagttcagcttcgcaatccttagctgagatggcagaagaactacaagcgatgactagtaaatttaaagtataataacagcagataagtaaggtgaaaataatatcaccttacttatttttctattcagcaattaggggagtcattaacaggatgaaaaaaagaaaaagactatggaatttatggaaaacgattacattgttagtttgtacaggtgtaattttttctttacttgtgacagatatattaattagtcataatgtagaacggacgacggaggatagccaagcagagaaagcaaaaacaattgcacacattgtggcgaatgattcgattgtaatcgatggtttggttgggaaagcaaatacctctgcaatccaaacctgtaccaatagaatcttacataacacaggtgttcaattatg

SEQ ID NO: 114 - DNA, 404 bp, Bacillus thuringiensis
catgcgcaagtagttgcattatctgctcatttgctcggtattaagagtaaaactgttatgccgatctctgctccgcagtcgagagttgaagcaacagaaggatatggatctgaagtgattttacatggtgaggcctttgatcatgcaaaggtagaatgtgaagaaatgatatggcccgcaggtgaaacatcctttcatccatatgatgatgtagaggtaatgtctggtcaaggtgcaataagattagacattcttgatcatatgtgggatgtaaatactgtcattgtaccaattggtggagtcgaaattatttctggcattgctgtagcattgaaatcttttaatccatccattaatataattggtgtccaagcagataatgttcatggaatgaaggcatctta

SEQ ID NO: 115 - DNA, 138 bp, Bacillus thuringiensis
tggtgcaccacggttatttctggaagggcgaaaacccctgcatcaccggcatgaagcaacgccgcctcaaaaccctgctcaagcatgacatcagcctgctggcctaccacttgcccctggacctgcacgccgatgtgg

SEQ ID NO: 116 - DNA, 491 bp, Bacillus thuringiensis
ccatcggttttaaatcgaatcgttttgtacgtacaagttctaattcatcttcttctacctcatccaaaacagctactgcttctggaaggataaagttcgttttcatagaacctttctcacgtaacttacgatttacttttgttttatgtttacgaatttgtcgctcaattttatcaactactaaatcgatagcagcgtacatatcgctattagtttcttctgcacgaagtaataaatcagtaaatggtattgttacctcgacacgttgcttgtcagagtatacttttaaattaactttaatctctgggaatgtatcaaaataacgctctaacttacttagttttttctctacatattcctttaatgctggagttacttcaatattttcaccacgaatgttgaatttcatagatgaattcctcctttcaagcctatgtattataaatattctcttccattccccatccggggataaaaataatctttagctc

SEQ ID NO: 117 - DNA, 500 bp, Bacillus thuringiensis
tgctgaaggtaactcttttttatttaaccaagattctggatcccatatcttcgaacgaataaacgcttttgcacaatgaatgtaacactcttctatttcaacaacaattccaagcaacggattacgtccattcgcctgcatttctttcaaaatttcttcatagtttgtaatatacgctcggccatttattctaagtgtctccccaagacctggaataaaaaagagtagtcctacacgtggatttgaaataatattcaaaatggagtctatacgacgatttcctggcctttctggaatgataattttattattattgagtacgtatacaaatccaggtgcgtctcctctcggcgaggcgtcacactcccccaacttatttgcagtagataatactagaaaaggagatttagaaaggaaatctaccaatgggggtctaatgatgaaataacttttttcaatgctcgctcacttggtttccccaatattttccgtaactcttc

SEQ ID NO: 118 - DNA, 473 bp, Bacillus thuringiensis
tatataatcattatatattgagaaaatctgagtggataaaaatataacgtttggtagtaaaagaccgatagcaatcggtcttttctcatttatataataaagatttattatacattatatttcctactactatacaattattataagatagttatgcgttaattttagtttgaaataattatgttgtcattttttttagaaatcttacaagcgtgtaaggtaaatgaaagatgaatcaatatgagctgtaagacaattcatttacactttatagtgagcagtggaaatgaagggagaatatacatggaaattttacatgcaaaaagtattagtaaagtatataaagggaaagtaccttataaagcattagtagatattgatttatccattcaagaaggtgaatttgtaggaattataagtccatcaggtagcggaaaaacaacgttattaaatccgacttatgatcgcataca

SEQ ID NO: 119 - DNA, 386 bp, Bacillus thuringiensis
tctttcttttagaacatacttaaggggaagagtataacacagaaattttctaaatatttttactggtacgtgcataagtatagaatttattgactataacagtaataacccaaaaaaatagcccctatgtcaaaagacatagagactatttcaattaagcgtgaagatcagaaacttcttgttctttcacttcttctactttttcgtttacacgttcaatagttgcacctaatgcagctaatttcttatggaagtttacatagccacggtcaagatgttttaactcagttacacgagtatacccttctgatactaaaccagctaagattaacccagctgcagcacgtcagcccgttgctgctacttcagcaccttataaaaagttt

SEQ ID NO: 120 - DNA, 562 bp, Bacillus thuringiensis
  unsure (1)...(562): unsure at all n locations
aatgcgttttgtgttaattcgataccttctaaattttatcctttgtaaagtccagaacataatacgataaatgctgttgatgtacatactaagaatgtatctacgaaaacgcctaacgcttgaacaagcccttgttttacagggtgagatacatcagatgttgcggctgcattaggagaactacccattcccgcttctgtagcgaataaaccgcgctgaattccgaacttgattgctgctccaataccaccagcgatggcttggtctaaaccgaatgcaccgttaaagatttccatgaaaatgcttggtaacatactgaagttgttaataacgacaaaaatagccacgccgatataaacgattgccattggcggaacaatcatttctgtaatacgtgaaatgctcttaatgccaccaaaaataataactgcaactaataaggctaatagagctcctacgattgttcgctctagtccaaaagcattttcaaacgctattgttactgtatttgcttgcactgaattgaaaattaatccatacgcaactgntataagaagtgaaa

SEQ ID NO: 121 - DNA, 381 bp, Bacillus thuringiensis
ggatacaccctgtttgtctcgcataattagagaggggccatataggactcgttcatcatggccatgacattggcccatcacctgactacatgtgacaagtccagctgataagcctggatacacacagagaggcatttcaacatcatgcatactagcgcccgggggaatgcctcaggtggatgccacggggcgttctggaggcgcacgggggttagcgaccccattcatctgcaaaagagctcttaagacgtgtataatcgggttcatatgacgttcagttaagccttctaagaaccgggcgaagcattcattacctgagtgattcataaatgcttggtgacttgcagtggcaccctgcgcagcatgaagatagctccaaat

SEQ ID NO: 122 - DNA, 683 bp, Bacillus thuringiensis
acaatatgtagttcaacaagttgagtctcgtcataataatcgtcttcttgatgttgctactggtggcgggcatgtggcaaatatgttagcacctatgtttgaagaagtagttgcacttgatttaacagaacagatgttagaaaaagctaaagtttttatcacgctgaatggtcatgaaaatgtatctgttgtagcaggacatgcagagaatttaccatttgcagaccatttttttgatacaattacatgccggattgcagcccatcattttacgagtccggctcaatttatttatgaagtaaatcgtacgttggagaataatggattattcatcttaatagataatgtttcgccagaaaataatgaatatgatacattttataattttatagaaaaaaagcgtgacccaagtcatgaacgagctctaaaaaagacagaatggcttactttattagaaaaaaacggtttgcaaatgcagtcatgtcttacttttgataagaagtttgattttgactggtggtgtaatatgatggatgtccctttacaaaagcgtgaaaaattaacagaatgtatgatgaaagcaccaaacgaaatgaagggatattttaatattcaatttaaaaataataaagtagaatcgttctatactgaaatggctatgtttatatgtaaaaaaagtacaa

SEQ ID NO: 123 - DNA, 746 bp, Bacillus thuringiensis
aatacgaagatttctactctgaacgaaagaacagtctaaaaatattatggataaagcagggaagattgttcgcacagaaaaagtgactgaaggaaaaagtggaaataacttgatgttaacagtcgatatggatttacagaaaagagtagagggaagtcttgaaaagaatttacgagcctttcatgctgcagagccgatgatggatcgtgcgttcgtagtaatgatgaatccgaaaaacggtcaaattttatcaatggcaggaaagaaaattgtaaataaagatggcggtatgcaaatagaagattatgcattaggaacgatgacaagttcttatgagttagggtcaactgtaaaaggtgctactttattaactggatatcaaacagaagcgattaagccgtatacacatttctttgatgcaccaatgtattttaaaggaagttctaagccgaagaaatcgtggaaagaatttggggatattgatgatttaagagctttgcaagtgtcatcgaacgtttatatgtttaatacggctttaaaaatggcaggcattaattatgtcccaaacaatccattagatattaaacaagaaacatttaataaaatgcgctactattttagacaatttggcctaggtgtgtcgactggcattgacctgccaaatgaatcaattggtcaagtaggtagaactgataacatacccggatttttacttgattccgccgatggacagtatgatacatata

SEQ ID NO: 124 - DNA, 564 bp, Bacillus thuringiensis
gatgatgatttggccgatgtttgggggtgtttaaggaattaacgctgtgcaaagaggaaacgcttcgttagaccgtgtaaatgaaacgttagctgatgaaccagatgtaaaggatccgaaacatccaaagcttgtgcaagagccggattatattcagtttgatgatgttaccttttcatatccttcatcaactgaaacaaatttaaaaaaggtttcgtttacattaaaacaaggggaaacgcttggggttgtcgggaaaacaggaagcggaaagacgacgcttgtccgtcagcttcttcgtcaatatccgcttggagatggggatattgcagtctctgatgggacgcttgattaaatgacgaaatgaaaatgtactccggctggattggttattgaccgcaagagcatattttgttctcaaaaacagcgcgagaaaatattttatttcggaatagggaagcgactgaagaagaactagagaaagccgattgaaattgctgcgtttaaaaaggattagaagttttaccagaagggttagaaacgctagttggagagaaaggtgtt

SEQ ID NO: 125 - DNA, 453 bp, Bacillus thuringiensis
acctatcacaaatacttctgcgtcttgtttaaacatgcaacctaacccgcctaaaatttcaattgctccttctgttatttcagtcatcggtgttcatatggaaaaacataaattaaaaataaaaacgggacaaaacattgtgttatcagcttccattttaccaatacaagcaacgaataaagagcttatttggtcaaatatgaattctgatatcatcaccatatatccaaaaggtgacaccgtgacgattactggaaaaagtgcaggtaaagcagtcgtaattggcacaactgctgaaggccaaatttcgtgacctatgtgtcattcatgtacaaccttatatgacaaatccaagtaaaagagtggcttcggagcccctcttttacttgatttcaatatttgagttttcacttttccagggtaataaaaaattggatataacctccatttttt

SEQ ID NO: 126 - DNA, 740 bp, Bacillus thuringiensis
atgcgtgatcttgcaacacaagcatcaaggggtgctaacaacgataaagatagtcgcatctatggacaaagagtatcaagcattagcacaagaaattaatcatattgctgataaaacaaatttcaatggtaacgcatttttaaataaaggtactaatcctgatgagggtaaagatatcacgattcaactttctgatgcttcaagtgatacaatgataatcgcagctatcgaaacaaagaaattaacaactgctaatttagcagtttcaactgatggaacaaagaaattagatgctacaactgcagcaactgaaatcacggctctggacactgctattcagaatatcgctgacgctagagcaactttcggttctcaattaaaccgtttagaccataacttaaacaacgtaacgagccaagctactaatatggcagcttctgcttctcaaattgaagatgctgatatggcaaaagaaatgtctaacatgacaaagttcaaaattttaaacgaagcatgcatcagcatgctttctcaagctaaccaaactccacaaatggtttctaaattattacaataatccatttgaacatatactctctgtagtatataaagagttttcttttaaataattaaaaattaatgggggttcttaacatgagaattaatacaaacattaacagcatgcgtactcaagagtacatgcgacaaaaccaagacaaaatgaatacatctatgaaccg

SEQ ID NO: 127 - DNA, 754 bp, Bacillus thuringiensis
aattcgtgatttccgctaaatcatcagctgactgtttatgatttataaacgattgtaaaagaagcgaaattaaaagtgttagttattgatgaagaatttaatgaagtgttattaaaggttgatgctgttaaagaaattccttatgtaattcaaacaacaaaagaaggctttggttcatttgaattagagttgcaaaaacagccaacgacagaaccgaacgtagaagttcatgaagaagacgatgccatttacttgtttacatcaggaacgactggacaggcaaaagcatgtgtaattggacataaaaacttacatcattattttgctgaaattgcgggacaaagagaaatcccagcaggtgaacgctttttatctgtgcatccattgtttcatatgagtggcgtgctttctattttaaattgtatttatcatggcgttacgatgatcttcttagctgattcgaatcctgctcttatttgggataagattgaagaagagaaaattactacgatgcttgctttcccagctgtttatagttacatgcttgatgaactaaataaaaaagaacgtaacatttcaacctttaaagtagcacaaagcggtggtacaaaagtgccagaaacactcattcaaaaatatatggaaaaaggcatatatatggtgcaaggctatggtagtacagaaggttgggttgtaacctcatggcatccaatgatgggaaaagaaaagatgtcttctgtaggaaagaccttga

SEQ ID NO: 128 - DNA, 669 bp, Bacillus thuringiensis
gaaagacgaagttatgaaagttaagacttaagggcaatcgaataaactgtacgatcaaggaaaggtaaaagcgagtttttttgctaaatatattgcgaaagatgatacgataattttaattgggacttccattgcgaattcaaatgaaattataaatacgttaaatacattttacttatatatcctatgtttctcgctccttcttattattttacttgtgtggatactttcaaaaataataacgacaccactgaaagagttaagtgatgtggctcaggatatttcacatttgcagtttaaaagaacgaaagtgaaaacgaatgatgaaataggagagttggccaatagtattaatatcatgagtgaaaaactacatgaagcacatcaagacttaactgatcgtaatgaacatttaaaacgatttatgggtgatgtaacgcatgaattaaagacaccgatcgcattagtaaaagcatactctatggggattaaagatggattagatgatgggacttatgtagatacaattattaaacaaacagatcatatatcaaacttaattgaagaactattacgattttctaaactagaaagagatattttacaaaaagaagaattccccattgaaccactggtccagagtatattagataagcatcagattgacct

SEQ ID NO: 129 - DNA, 381 bp, Bacillus thuringiensis
ctaccatcgttacaatttttccatcttttaatatttcaaatgatggagaagaaggtgggtacccttcgaaatattcacgcgctcttgctgtcgcttctttatcttgacctgcaaacaccgttacaaggtggttaggacgtttatcataatgtacggaatgcgcagcagcaggacgagcaataccacctgcacaaccacatacagagtttaccattacaagtgttgttccatttcttttaaacgcttcttctaccgcttccggcgtcgtcaattctgtatatccagcagagacaatttcttcacgcgcttggcggacaacatcattcataaaaaaagttaaaattaatcacttcttttcccttctttaaaactacctatttt

SEQ ID NO: 130 - DNA, 468 bp, Bacillus thuringiensis
acattgcgcctgtatcaatataaacataagaaagttccttcgcaacaacttttgccactgtacttttccctgcagctgctggaccatctatagcaattgaaattcgtttatccattgtaacacctcattttttcacttataaaacaaaacgaaaagcaggtgttcaccctgcttcttctcatttgcttcgcgtcattaaatcctcaattattgtagcataatccttcatagaagaaaatgaaaactaccgattcacctgcaagatttccactttgttttttaccataacaccctcataataaacgattttagataaatatttcactgatgacttatgtataaataacaattgtacaacagaaagacaaatgaattgtattattaatatacgaataaaaattcttttcatctttatcaccgaaatttctccttctatactatatttggacatttcggtttcgtatttta

SEQ ID NO: 131 - DNA, 507 bp, Bacillus thuringiensis
gcatgataacaacacatcggaattgttctgattggacatgaaggagtatctccagtagctgctttagatcaagcacggaatggaattgttcgtaacaatatcgtccatcacaattcatctttcaataatactagttataacgaatattcagctgatggtatttacgtggatggtgggaaggaaattattattgagcaaaatcagagctatgaaaacgacctcggtattgaagtagctagcgaacatgcggggaaaagtgcaagtcaaattacagttagagataatacaatatctaacaatactatgggtggcattgcaattggtggatatgacagtcagcaaggatacgctgaaaataacacgattaccaacaatttgatttataaaaatgacacaaaagatcaagagagtggtcaaattgaattaaattacgatcttcgtaacaatgtgattaccaataacgaaatctatgcaagtaatagtcgtatttttattagcaataatttt

SEQ ID NO: 132 - DNA, 564 bp, Bacillus thuringiensis
aagttgggacgattcgaattgggagttttccgagcgcttctgcacatttcttacccaaaatgataaacctttttaaggaaaagtatccgaacttagaagtagttctttgtgaagggacgattaaagaagttgaagattggttagtatcgagggttattgatatagggattgttattttgcctaataaagatatggagattgttccattaacgaaggggaaaatggttgctatcttaagagaggatcatcctctctgtaagaaggacgctcttacaatttgtgatttagagaatgaaccgatcatattatgtaagggtggatacgaaccacccattattgatatgtttaaacaagcaaacgtaccacttcgggctgaatatgtaatttcgacagttactacagctttaaatatgattcaagaaggattgggcattgcaatattagctgaattatctttaacgaatttaccaaaaaatgtgcaaacgagagaattggaaccacaagtatggagagaaattgctttagctgttccttcattaaaggattcttcaatcgctgtgcagc

SEQ ID NO: 133 - DNA, 609 bp, Bacillus thuringiensis
atctgaatgaaacttcacctatatcctattccacattgttgatatacaaatagaggatgccattgaccaacttttatttgtatatcaattattcagacgagtatcagctactgcataaccttaaaataaatgctttgatttttcatcgtcaatcaaatagcacatttgattcttattaacttgtattcttccttcttctactgctttattatagcccgctgtatatttaaaaatagtaacccctttgtttctaattaaatctttttcccattttttcgcagctgctgccatatgtacatatgatgttttaaaattaataataatttattataattaagtatatattaacaatatattaagtataagtaaataaaattaataataatttaattttatttgcttatttaaaggggattacatatatgaacgatattaatgttggtcacaaaattagggcatttagaaaaggggccggattaaccagtaaaacgttagcagagttagctgatataacaccttccatgttaagtcagattgaaaaaggaatcacaaatccttcattacaacactaaaattaatttctgtagcactaaatattccattgtttaa

SEQ ID NO: 134 - DNA, 948 bp, Bacillus thuringiensis
ttaataaagtcgagaatgtcttgctggcgtttcgttaacttttccattttttctaacacctcgttttctttcatttttcttattaataagtataacatgtgaaaaaacattctacaaacataagttcgaacaaatggcggatttatgttacactatagggaaataatagggagaaagaggggttcaaaatgaatgcaattatttatgcacgtgtgagtacaacgaaagaagcacaagaaacatcattattacgtcaaaaagatgaattattgcatttagctgagcgctatcaaatgaatgttactaaggtgattgaagagcaggctagtggatatacaattgaacgtgacggtatattagaggtgttggatacaattcgagacgaacaaattgatgtgttacttatacaagatgaaacgcgtcttggtagaggaaatgcgaagatcgcgttaatgcattgtttacataaagaaggcataaaagtatatacgcatacacataacggtgaattacaattgtcggattctgattcgatggtattagatattattggtattgttgaagaatatcaaagaacgattcataatatgaaaattaaacgaggtatgcaacgtgcagtagaaaaaggttatcgtccagaaaaaaatttaaaaaatcgtcatttaagtgtaggaagagagagaaaagaagtgccaattgaggaaattgtacgtttgcgaaaaagtgaactcacgtttgaagaaattgcagcatcattacgtggatacggtcataatgttacaaaggcgactgtacatcgtagatatgtagagtatacgaggcagtggcttgataaagaagagtaactattgtatgatcataatcagttttgattagaaaggggattggagatgaataatcacgaactccatgaacgcattaactttttagcgaaaaaaagcaaagctg

SEQ ID NO: 135 - DNA, 574 bp, Bacillus thuringiensis
atggtttactccgtttctatctgttcttgaacttgaaacaaaaaatcgtattttaaacttgtatgagggtgtacaggacatagagaattcaattccatcaacaattgaaattggagaaaatattatatttgtaggtactgtgaattttgatgaaacaacaaaagagctctctgatcgattattagatcgaacgaacctaataacgttacagaaaattccgttttgtgagatggacatggaacaggggaaagtcgtattacatccacctttgaaagtaacagcgggagaatttcggataaattggatgagaaataaagcgatgattgaagggttttctgaagaagaattagagctattagataagttgcatgtcgtattgtcatcacatgacgcgtctaggggaatttcttttcgatgtgcaaatgcaattgcgacttatttgcaaaacataccgttccaaaataaccatacctatttgatcagtaatgtagaggggtctgatttacaaataagtcacgtgtattgacgaaaatcagagggaccgaaatgatggttgggcctttacttttctgag

SEQ ID NO: 136 - DNA, 583 bp, Bacillus thuringiensis
  unsure (1)...(583): unsure at all n locations
gcattatgatgttgttgttgtcactagcggtccttctgggctaatggctgcaattggtgctgcagaagaaggcgcaaatgtcttacttcttgataaaggaaataaacttgggcgtaaacttgcaatttctggtggcggacgctgtaacgtaacgaaccgtctaccacttgatgaaattgttaaacatataccaggaaacggtcgcttcttatacagcgctttttctatttttaataatgaagatattattacattcttcgaaaatcttggtgttaaattgaaagaagaagaccacggtcgcatgttccctgtgtcaaacaaagcacaatctgttgtagacgcacttttaacacgattaaaagacttaggtgtaaaaattcgtacaaatacgcctgttgaaacgattgaatatgaaaatggtcaaacgaaagcagttatactgcaaacaggtgaagtgttagaaacaatcacgtcgttatcgctgttggcggaanatcagttcctcaactggatctactggagacngatatgctngngctgaaaaagcgggtcatacaatcacagaattattcccaacagaagt

SEQ ID NO: 137 - DNA, 536 bp, Bacillus thuringiensis
aaacgaagtaaatgtatatgcaattgttttcggagatccagcggtattaatggctgttcgtgaagtagcaccaaatatgcagttgcactggaatacagaaacgacagcaacaaactggttcacttgtaattactggggacaaagaggatcaaagcgtgctgtattagctcgtgagcttagcttagatgaaattgttgatttaaaagaaaatgctgaagtggaactggaagtacaaattcacggtatgacttgtatgttccaatcgaagcgttcattagtaggaaactactttgagtatcaaggacgtaatcttgacattgaaaagaaaaaatatgaagagaatatgttcttatatgacccagagcgtaacaataaatatccaatttatgaagatgaaaatggtactcacattatgagtccgaacgacatttgtttcatcgatgaattagaggaactaatcgatgctgaagttgatagcttaaaaatcgacggtgtactaaaaagctctgaatacattattgaagtaacgaagaaat

SEQ ID NO: 138 - DNA, 602 bp, Bacillus thuringiensis
ggctctatttttcatttcgtgtgaaatttgtccaagttcgttacttcggtgaaatgattcgattacttggggatggagcaagctcgaaaacgagaaaagcgcaaaaagagaagagtggcgtatcatcattccaagcattttgtatgagtacagcttctcgtgtaggtactggtaacttagctggtgtagctatcgcaatttcagcggggggtccaggagcagtattttggatgtggttaatcgcggtaattgggggtgcttctgcatttgtagagagcacattagcgcaaatttataaagtgaaagatgggaatgcattccgtgggggcccagcgtattatatggaaaagggtttaaataaacgctggttaggtgttgtgttctctgttctaataacagtaagtttcggattgatttttaatgctgtacagtctaatactgtagcggcagcttttgatggggcattcaaaacagatagtagattagtcggtcttgttatggctggtttacttgcagttattattttcggtggagtaaaacgaattgcacgcgcggttgaaatgattgttccagtaatggcaattatctatgtagcagtggca

SEQ ID NO: 139 - DNA, 342 bp, Bacillus thuringiensis
gttcctactaaatcaccagcaacaacataacgcttagaattatcctttacagatacacatgtaataagcgttatctcatctttcccatgatcctctacaacttcccacttatcaggagtcacttcagatacaccagtaaccgcatactcatattcattttcattgtcatacaaataaattttatcgccttttttcaaagaagctatatcactaaataaaacaccttttttagacatattatgtcctgctaatgcgtaatttccttttcccataacttgattctcttttactgtcgctgcacctgataataagtttttttcagtaaaagcatttaaaacaggc

SEQ ID NO: 140 - DNA, 821 bp, Bacillus thuringiensis
aatcagtatcttttttctaatatgcaccaactatcataccttcggaagagtcccttaatcataccaaattgcttagaattaagattgagaactgtgttaataatgtatggcaacggaacggttacagcaaagcctaaaaagaaattaagagaaattaaaatactaaaagtattttttaagcttttccgctccaataagtaagagtatccctcctttatatcttcaataaaattaatttctctaattgaacattcctcatttatgttttgctcaaacaatttaaagttaataaacaatatggaaatagccgaaaggataaatgaaataccatttataattataaaaattttaatatcaaagactgcaaaaacaatcccccctaacataggccctaaaattaaagatatagaatcgataattttacttatagaattaatactcattaaccgttctttagtaaccatattcggttttacggcccctaatcctattccaaaaaacgttgtaaatactgtcataagaaaggtagtagtataaataatgaataagtttaatccataatagttgcttaatatataaacagttattaataagcacccgcttagtacatccatacaaacgacgagtttctttttatcaaccttatcagcaatgacaccagcaaatggattcataacaatcattggaatcgttcctaatatgagcgtaatcgcaaaatgtaacgcagatccggttattttgaaaacatacaatcctaatgcacaactataaattgagctaccgaatagtgatactgtttttgcaattgatataaacaaata

SEQ ID NO: 141 - DNA, 693 bp, Bacillus thuringiensis
gatttgaatacttctttcgcttctgtccatttttcttgtttcatgtaaatgtcccctaagatgttataaggaaagtatgaagaaggattcaacttaacaacttctcttattaattcaagagctttatcatcattctcttcctcatagaagtacatccaagcaagattattgagagattgtacgtctctagattcatgtactgcttgttgaaacagttccattgcttcctcatatttattttgttcaaacatttcaattgccttctcgttaatgttcaaataactacctccgaagtgaataaattcatctacgctttatcattattttaagatgtaaaaattgaaatttctataaaaaatttctttatcctgtctacatttcgattgaaatagaagctaaaacacacgaatttacaacaatgagtaaatttttcaatctcccttaaattggatatacatcctgttttattttacatattatggtacaatcaaaagggtactaactaaacatttacgctccacactagtaatctagcaataccaaaatcaaaattcacatggaattgagggatgttatgaaacagaaattagctgttcttctattcactggaatcatattatcaggatgttcaactatagcagagaattctttacaaagcgggaaaggcagtatggaattattaacaccaacgat

SEQ ID NO: 142 - DNA, 518 bp, Bacillus thuringiensis
gaaaagtgtgtaaagctatatttgccatccgttctgttcatcgccatgttaactgctgtatgtgctaaagctagaccgattaccattactactggaccaactacgattggtggtagtaatttcataatccactctgatcctgatttcttaattccgagtgagattaagatgtacacaagtcctgctagcaaaccaccaagcattgctgctcccggtccacctgccgttttcgctgttataatcggtgcgataaaggcgaatgatgatcctagataggcaggtacttgacctttcgttataaagaaggaacgctaacgttcctaatccacttgataataatgctactgatggattcaatcctgttaaaaacggaacaagcactgttgatccaaacatcgcgaacaaatgttgtatacttaaaaataaccattttcccggtttcggtactttattaacgtctaacactggcttttgtccattgtacatcctcctcagtttaaatctttgcaataaaaaac

SEQ ID NO: 143 - DNA, 562 bp, Bacillus thuringiensis
aaagaggcattttgtaaagagggagcaagcgcttctgcgatggcgattggcggaacagtaggcaaaacgttcattatgcttatcttgctacttgcaacgtctgtctattcatacatacagatgatgcaggggacgatgaagatgccagtattaattggtgctttaatcgttgcggcaatcatcgcattcgcgtctatgttcttcccgcgcatttcaccttttggtgcaccaatctatgcagcggtagaaggggttgtgttaggaagtatttcagcagtttatacaatgaaatttggcgattctatcgttttaaatgctgtattactaacaatctcaattctatttgcaatgttagtgttatatgcaacacgcgtagtaaaagtaacggataaattccgtacaggcgttatggcagcaacacttggaattatggttatgtatttagtcgtattcctactaaatatgtttggtgtaactgttccatacattcaccaaggtggtacaatcggaattattattagtgcagttgttattggagttgctgcattaaacttatactaga

SEQ ID NO: 144 - DNA, 785 bp, Bacillus thuringiensis
  unsure (1)...(785): unsure at all n locations
acaaaaagattttgcaacgtttttttctatgtaatttgcttaaaccttttcccaccttacatcattcgtataacttacttccaaatacagctttttctaagttagataagcgttttaaaatatccgtattcgtgttgttataaactggttgtgcaactggtgtttgtacaggttgttgtggaacttgcgttactgctagtttttgttcctctaattcacgctttaaacgagcattttgttgctttaattgctcaaactctttgtggaaagcttcatagtctttaatgatcatatcaagaaacttgtctacttcttcttgctgataacctctcatacctgttttaaattctttttctaaaatatctttcgctgttaatttaattttatccgaaatcatttttcttcacctcaaattttttaccaaaaactttcattaactaaattttttcagaaacaatgcttttttngncaatcatatatacgagtactatattacatattttactctgcattattcccactgttcctcttctattatatcttggaaatcagaaaaaagaatgaaattactgggataattttctatttctccttttttctttgctgcttttacatattatttgggaacttctggtttttcttaatcgattccgtttaaagggcatcatttttttattaaaattgattttttaattaaattgctttgactttatcctttgttttggatctattaaatggtctgtttaaaaggttaaatataattttaccttttttctttcattttt

SEQ ID NO: 145 - DNA, 513 bp, Bacillus thuringiensis
ttcatctacaagtgcttgcaatttcacgagctgcattcgtaaattgataatcatcaagtgcagttctcacttttttcgttgtactatgcaatcttgataatacccattcgtctaatttcgtaagctttacatcatacgtttctttcggattatactcatctaaatttgcatataaaacgtagaagctatacacattgactaatgtatctacaaatttagatttcgcttccagtactgttctttcagaaaaacgcttcgcattccacggggcactatcaacaagtaaagcccatcttagcgcatctgcaccaaatttatctactaaatcaactggatctagtgcatttcctttgcttttagacattttctgcccttcttcatctaaaacatgccctagtgataacactcgtttatacggtacttttcctgtatatagagctgatactgctaataaactataaaaccagccgcgtgtttgatcaattccttctgcaataacatccgctggaaact

SEQ ID NO: 146 - DNA, 453 bp, Bacillus thuringiensis
aaaaggctctacgtaacttacatgcgttggtttcatttcttttggcggccctggtaataaaatataaacttttccgttcttatttacccccataccaggcgccataccgtggtcatttgcaaatactgttgctccatttaaaacgagcgcttgctttttattattctccgtaaattcacggcctgtacgcttaaagtaattacttattaaggctaatgccttttcatcatacacaagctcttcatctaaactagcagctatcgtttctttcgttaaatcatcttttgttggtcctaatccacctgtaaaaataagtatatcagcacgttcttccgcagcttcaatcgccttttgcaatcgcttattattatcaccaacaacagtatgatagtacacgttaattccgattgaagctaacttttcagataaaaactgggcatttgtatttgcaat

SEQ ID NO: 147 - DNA, 703 bp, Bacillus thuringiensis
  unsure (1)...(703): unsure at all n locations
ttggggcgttgatcggatcttgttgttatgttgtggatgatcgtgtattaacagcagcacaggaagtagttaggggtgctgttcctcatcaaaaaatttctgacgggcagtacgcaattaatttaaaagaaattaatcgtatattatgtgtacaagcaggcataaaagaagagcatattgtaatgtcatctctttgtacaagctgtgaagagcaactatttttctctcatcgtcgtgatcaaggtaagacaggaagaatgttgagtttcataggttttaaggaggaagaaagcaagtgacagtacaagaaaatttagaaattgtaaacgaagctattaaagaatcttgcgctcgagctggacgttcgttgcaagatattaaacttgttgcagttacaaaaactgtagggattgaaaaaacaaatgaagtaattgaagctggagttatcgatttaggtgaaaatagaaatgaaggtttcttacagaaatacgagcattttcggttcaaaagttaattggcactttattggctcattacaaacgagaaaagtaaaagaaatcattaatgaaattgattatttacattcgttaggatcgtctttcactggcgaaagaaattcanaaacgtgctgatagaaagtgaaatgcttattcaagtgaaaacctcatctgaagaatcgaagcaaggattggcaataaagagg

SEQ ID NO: 148 - DNA, 517 bp, Bacillus thuringiensis
tcttagctgcaccgatggcaggggtggtttttacagtaaactctctattattacttgtaagctcgtcaattattaaagatatatacgtaaattacataaataaagatgcagcagacagtacgataaaaaaaggaagtttgtggattacgggtattgtaggactactcgtttatgcagcggcaattaaaccaccagattttttaatatggctaaatttattttctttcggtggattagaagcagcattcatttggccaatcgtattagggttatattggaggaaaggaaatgctacaggagcgcttgcgtctattttagttggggtaggctcatatatgtgtattcatcttttctatccaaatccgttcggtatacatacagttgtcttcccgatttgttttgcgtttatcgcttacatcattggaagtatgagtgctgtaaaaaaaacagtataggttagctgaagaaacgtagtccttataagactgcgtttttttgtgtgaatttgttcattttt

SEQ ID NO: 149 - DNA, 838 bp, Bacillus thuringiensis
  unsure (1)...(838): unsure at all n locations
ctccatcatatcaaaaacatttgttcatcgaaaaaaagtcatcgaagcgatgactgttattgtgctggttgctctatcccttggtttttaatcaccaatctttggtgatattctttttgtggatctaacgggaaagcaagcacttggccattcagtttaatttcaacattcggtgcacttccaatattaagtcgtacttcttttaatgttgatacatcgcgtttctctgtttgaccgctttgtactgtagtgtttagaatttcgttacccgcatcatccttaacatctacataacttgtacccttagctgaaatttccagttctaatgttttattattatgaatttccaaagtagatacctttccagttgttccaactactttcacttcttgctgtccagttggttgtgctggttgctcctctttctttggttcttctttctttggttcctcttttttttggctcttccgctttcacttcatctttcttcgtatctaacggagaatctttcgctttttgaacttcaattttctcactttgagcgcttggaactttttcatcatcttttccagttaacgcttgaaacacaaaccagattaccactccaactgcgatgactaacagcgcaactaagattttcggcatgtgatctgcaattggccatgatgaagatttttgcattgtttcttgtgttttttgtcccgttgatacttgtggaacttcacgcttttcagattgtggtatcgtactctgatgttctacaagcagttcctctccatttaatccaaccgcatctgcgtattgtttaatgaatgcacgcgcataannagctcctggc

SEQ ID NO: 150 - DNA, 683 bp, Bacillus thuringiensis
tccccttatatttttcaaaatgattcacactttcatattttttaggattacagttaatagacaatctcaataatacatttgttccacgtttgctaaaaataatgagttttcaccatatcttgcatgtagtttttctaactgatttatttatttttcacttcatttttataaaaagcaaataatggttcgatggatggactagataacagcggaattgccttctcaatcaatttcctatcccaatcaaaccaacacatttccattaacatgtttatttctgtatcagtgaatcgtttctttatttccttagcaggatttccaccaactattgtatacggcggaacatctttacttacgactgatcctgcagcaacaattgcaccttcaccaatagtaacgccaggcattattatagcattcattccaatccaagcatcacttttaatgactgtatctcccttaggttcatatgattgtttaatttgctcagcgaatggatatactgtaatccattctgagtgatgattatgattaccacccattaaaatgactaccccgcttgcaatgcaaacataattcccaataatgagtttgtcaaggtgccatcccatctgttcaattggattgaacagtgcttgggacttagcatctccccacaaataccttacacagccatcttcaaa

SEQ ID NO: 151 - DNA, 809 bp, Bacillus thuringiensis
cacgtgatttaatacgtaaagcggttgaattgtcaaaagagatgaagctagagcaattgaatttaggggttgtgtcaacgaacgaaccaaccaaacgattatatgaatcaatgggatgtaaaacatacggaattgaaaaaagggctattaaaatgaatggtgtgtatagtgatgatgaacatatggtgttgttcttttaagagaggaagttttgtatgaaaaaggcgaaactgcgacaataagatggtgaatatggcatatagcagatcataattggtatcatcaagctcatatcagtcgtttgaggaaattatacagagaatataaactacatattctttaatttttgaatgaacgaacgcccctaaataataattaaaggaggcgtttgtttttattcgttcgcttttcttcccaagctatcattaaatttttatgataatcttttggtttctcaatagaaaaccagtaaattgaatgtgcaatagttggtagccatcttttatagcggatgtgtatattttcatggtgagtatagtgggtcgagattaaagtagattttgacccttgaaaattttgatatgtaatggcctcgatttcataccaatgcactttattcccatgtaaatttactacaattccttcatcattccaaagtgaaatgtaagtttggatgtagatttttcatcgcgtatacttaaaatatgttatagagataaaaaattaaatacaggggttttacatgaagcaattgtttagggatattggaatattttctttgctttaccttgtttaaacggcatggctta

SEQ ID NO: 152 - DNA, 632 bp, Bacillus thuringiensis
tgttctatacggggcaacaacgtttatgatttatacagtgcgcaccgcacaatacacgaagaaaaccaagggaagaattgaacatagaagcagaagaaaacatatggagctgaacggaattgaggaaattatcgtccatgcgccgtatattattaatgttgggaatacgacgaagccacgaaacattccaattaggcgtagactttcttcgcatggaaattgaaagaacatcgggcttaggtgtagcgaaacaaattgttcttcacccaggagcgcacgttggtgctggagcagatgctggtattcaacaaattattaaagggcttaatgaagtattaacgccagaacagacggttaacattgcgttagagacgatggcaggaaaaggaacagaatgcggtcgtagctttgaagaaattgcaaaaattattgatggtgtaaaatataatgaaaagctatctgtatgctttgatacgtgtcatacgcacgatgcaggatatgatattgtaaatgactttgacggcgtattaaacgaatttgataagatcgttggtatagatcgtttacaagtacttcatattaatgatagtaaaaatgtacgcgaagcaggaaaagaccgtcatgaaaacatt

SEQ ID NO: 153 - DNA, 673 bp, Bacillus thuringiensis
  unsure (1)...(673): unsure at all n locations
gcaatatttttaggtagtagtttattgaacctctctgttaaataaccgttctattctaaaataaaaaggggtatctcataagcaagtgaaacccgccacttataagatagccctttaattttaacgctctattaatcatgtaatttacttaagaactctgtgaatgtattagcaacaaaaaatacattttctcttgcgattttctctgcttcttctgccgtaatcccttcactttccatcagcgcttccttttcccatgcatcttcatgttcccaaaaaacaacaattggattttcttcatgatttttataatcaaagcaaattaaatttcctgctggatcaattccaaaaggaattacatctctaggtaaggtagcacggtagttattataatctcttacaatataatcactactctcctcatcaaaagaaagtaatgcaccaaaaactctttctattccttcaacatcaaaacaatatggtattacattagccccatgatttacctttgcacactcgatataatcttttggaaactcaactcccagtgattgacctattttcttcacaaattctttcgtaaccggatcattcgcatacttncattctaaattcttcatctaatttcgcctccccataatctattttcacctaaatgattcacactatgaac

SEQ ID NO: 154 - DNA, 755 bp, Bacillus thuringiensis
cagcttttcataagcgatatgtaattttaaccccatttcattaattggacaaggtttatatgacatacataccctttatatacattacattgtacaagttatattctattcaaaatctgagatttcatagcaaaaaagctgctctagcgtagttatatagctatgctagagcagcttttcttatcgttaaaagtaacgtttcttccaaaaaacaaaagctaacgtgaaagatagtgttacacatatgatgagtacaattacaaaaccgtgggcttctccttcaaacggaacctttacgttcattccaaagaaactagaaaccatcgtcggtaaagataaaatgatcgtaattgacgttaacagtttcataacactatttaaattatttgatataacggagctaaaagtattcatcattccacttaaaatatgactatatatttccgccatttcaatagcctgtttattttcaattaatacatcttctaataaatcttgatcgtcttcatacatttttaaaaatgtactattacgcattaacttttgaattacaattttattagcctttaatgacgttgtaaagtatactaagcttttctcaaggcctaataatgtgaaaatctctttatttttcattgactgatttaattgatgctctaaatcaattgtttttcgatttatttgctttaagtatcttaaataataagtagaaatcgtatataaaagcttgagtgcaaagcgcgtcttcttaaacg

SEQ ID NO: 155 - DNA, 595 bp, Bacillus thuringiensis
acggagttataaacatacagatgggtgttattacgtctgacgatttaagatgcaaattcgaaatggttgtggagaaaaatacagggattatgttgaaatttcttagttttcaagaaggcttgattcaatattcagttacgactgaatggatacaaatagataagggattgaaagaaagtatgtttcaaaaggatagcgctaaatatgaaaaaatgagaaacatattggatcaatagaaacaggaggagagtaaatggggaatcattcatctttaagagaagagaaaaataagcaaaaatataaaaagaaaaagataacaagtttactactggcggtattactatttggtggaattggctatggagcctatgtatatatgaaaacttctagtcttgtacaaaaatctaatttgaatttagcacgaggtgaaaaatccaatttacgtgagaaatctgtaaagccaattgcaaatcatgtttcacttttaattatgggaattgatgaaaatcaagaacgacaaaaggaatataatggtgcatttcatacagatgcattattgttagcgacttttaataaagacgataaaacagtgaaa

SEQ ID NO: 156 - DNA, 910 bp, Bacillus thuringiensis
ttgcaaggaaagaccatcaaaatatgttggatggtttctagagaattcaaaggtgttttttgcatcccaattaatagaccaagacattaggccgcggaatgcaggatagccactctggttagaaagtttatactttcctccgaatggaactcctttaatgatataatttaaagcttttttcatttcagttggcgaaatgtatccaccacttggagctgccgctggtgctgctggaagcccaatcatgacttgatctgaacgaagagctgggaaaatgttatttgcattaccacctacaggaaaaccatgtaagagcatatctgccatagcgacctcgtagtctgcagtaccttgattgtagttattaccgtccattccaatcccgctaccagcgttgtagtgttgaacgtgaatgtatgttagtttatctttcactccataaataattggtaaatatgcaccccatatgcttccatatgcgctatatccgccttgaacataagctgtttcaggggccatgcttaatagaaaatctggaccataatgatctgagattgttcgaatagctgaaataagatttacgatttgaggggtagttgggtttttgaagttagtgtcatttccgtttaagtaaatacctgattcaaggtcaatatctattccgtcaaaaccgtatttatcgatcagagattgtatggaattaataaaacgatccttagcggcattgtcaggaagtaaaacgaccccattttgtccacctattgaaagaactattttctttcctttactttttaaataagaaatatctgatttgaattctgcatctgtaccatacacaggagaaaatccaacagtggtacaatcccccacagtttcaccaaaagatacattgataaaaacccattttggt

SEQ ID NO: 157 - DNA, 957 bp, Bacillus thuringiensis
cgtaatccaaagcttatttaacgttactttctttttcgtattgttgcatgcgtaacgcgtcgttcatagcatcttctgactgattaattggcgtatacgcaattgtaacattattttcactttcaattgtatgaataatatcttctaaatcattgactggcgcattttgtatttgagttgtaaattcatttaagttttcacgtgttttataaatattatatttcggcaagagaaagttaattaataataaagaaattgtaaatataagaataacggttaaagaaatgctgagaaatagctttttcccaagtttattcactttgttcctccaaactataacccagcccacgatgcgtcttaataatattttctccaatttttttacgcagccttcttacatgtgtatcaaccgtttcttctcttcttcaaaatagtcaaatccccatacaatgtctaacaatttttttacgagttaaaatagttcctttatgatttaaaaagcattttattaattcgagctctgtttttgtcatttctaactctatatcatttttatatcctttagttttggcgaaatttagctttacgtcttgtacttgaataagatcatcatgctgaataagttttttcgctcgtgtaattagtactcctggatgaaatggtttttttacgtactcatctgccccactttgaagcgctgctaattcatcttcactttcacttttcgccgtaagcattaatacttttacgcttgaattcttttttatttcctgacagacagtaataccactatgtttcggcatcatccaatccaaaatagcttaatcaattatttgatcataaaatatttgaagtggtacctctccgtctttcgctaataatacttcaaaggcttctttttcaaaataagctgttaaaacccttaacatatcttgttcgtgatctgcaactaaaact

SEQ ID NO: 158 - DNA, 427 bp, Bacillus thuringiensis
caaacttgattaggcggttcatttcaactgcgtatgccattggaagctcgcgagtgaatgggccagtgaagcccattgcgatcatttctgttgcttcttgctcagaaataccacgggtcattaggcagactaatagtgcttctgatactttagatactgtcgcttcgtgctcaagagaaacgtaatcgttgttgatttcgttgtaaggaatcgtgtcatatgtagattggttatccatgattaacgagtcacactcgatgttagagcgagagtttttcgcttttggaccgcagtgtacgatcccacggtatgtcactttaccaccatgcttcgtattcgatgcagaaacgattgttgaacacatgtttggtgccaaatgaatcagctacgcacgagcgttttggagttggccttcaccagctttcgc

SEQ ID NO: 159 - DNA, 890 bp, Bacillus thuringiensis
taatgatactacaagtttctagttttttaaaccctttttataaagtattaacaaaatcaaaatggaaaaaagcaaatatatttatatttcagttgctttgttacaatttaattccagtaatcattaatggttaatcttttatagaatgaagtgaaagtgggagtagttcaaacactttagctaaacatattgataaaaattatatataataatcatatgtctatacattaaaattaactatatatttttacacctctacgattttagataaaattagttgtataatatgactgaattaaacaattggtcatgttgttttgacggaaaattcacttaatttatgtaggtaatacaatttgattaacttcttttaaactgtattgtttgaggttaggataagatagggattgataagatatttctgatccaaacttatttatacttacaaaaaaattaagaaaatagagggtaaacattacctagaatattaggatggttttcattaggaggattacaaagcatgactaaagttgataaggttaaagaaaaaattattgaaacatctttatatttatttaatactaatgggataactcgcacatccatccagtatataatgacagctactgaactacctaaaggatctatttatcgtagattcaaaagtaaagaagaaattgtccttgctgcctacgacaaaagtggtgagattatgtggagtcattttcataaagcaatggaaaataaaaagacagcaattgataaaatccttgcaattttccttgtatatcaagatgcagctaataatcctcctattgctggaggctgtccattacttaatagtgccattgaaagtactggagtatttccagaattacaaaaagcagcag

SEQ ID NO: 160 - DNA, 552 bp, Bacillus thuringiensis
taaggaggaaatgttctgatagagaatcaagtgaaaaagaagcgtagacgtatctttttattttcgattattgcactgcttttagtttgtggttcagtctatgcgtatatttcatccgcattaggaccagttgatagcgggaataaaaaagagattgaagtagaaattccgaaaggatcatctacaagtaaaattggagaaattttagaagaaaaaggcgctgtaaaaaacggtacagtttttagtttttatacaaaggctaaatcgaaaagtttacaagcaggtacatatttattaaatccttcaatgaatgctgaagatgtgattgaacaaatgtcatctggcaacgtgcatcgtccagctctttataaagtgacgattaaagaaggggcgcaagtaactgaaattgcagaaacgattgcgacagaactaaagtggaataaagatgatgttacgcgtcaattaaacgataaagcatttattcaaaaaatgcagcaaaagtatccgaagttattaacggattaaatctttgatagcaatattaaataccca

SEQ ID NO: 161 - DNA, 553 bp, Bacillus thuringiensis
ttctaaagaatgaatttcagcttcagtttcaaattcttcttgtgaagtttggaacacctcagttgttttaatgtcaaatggtaatgtcacatctactaaagagcgagaacatggtaaaaccatgcttccagttatatgtagatgaaacgtaaacttaccggagccaaaatcaactcttcccgttacatgaacaggattaatttcacgaatatctttctcgacctcttttagctcacttacatctaccatctcatccaatgtcaatcttaatttctcaatttattcaattgatggatggaccatttcatatcatatcacctcaaggcaacaaacaaaattatagctagccattttatatttgtcaatgttttttctttacactataatgaagtcatcatagtaaataatatatagagtatcacgtttttcaaaaagatgctacatcgaaaggagagattaccataaaagctggtggtatagttgttgaatataacccttttcataacggtcatctttatcatgtgcaacagacaaaaaagttaacacaatccga

SEQ ID NO: 162 - DNA, 659 bp, Bacillus thuringiensis
tacttgcatttttattaggactacttgtagatattccacacgaagcacctgttagcaaacaaaaacgtgaaaaaatgaaatggaaagacttaatcgaaccatcttctattccaattgcacttacaggatttgttttagccttttcttatagtggtattttatcctttattcctatttatgcgaaagaactcggtttaagtgaaattgcaagttacttctttattttatacgcacttgttgttgtcatttctcgtccatttacaggaaagatttttgatcgcttcggtgaaaatgtactcgtttaccctgctatcattattttcacaatcggaatgttcatattaagccaagcacaaacttcattttggttccttggcgcaggtatgctaatcggtttaggttacggaacattaattccgagtttccaaacgattgcgatttctgccgctccaaaccatagacgtggttctgcgacagctacgtatttctcattctttgatagtggtattggctttggttctttcattttaggtattgtcgcagcgaaatccagttatcataatatgtattttatcgcagctattatcgttgcgttcactttacttttatattatggattacacggacgaaaacaaaaattcaagaaacaacctacagac

SEQ ID NO: 163 - DNA, 704 bp, Bacillus thuringiensis
  unsure (1)...(704): unsure at all n locations
gaatagattggctactaccataatcaacattttgtttcactaatataacacccgtatcatgaaaaagcgcttcaagttctttcctaatagacactttcgcaatatgagctgntttaattgcagataaaattgcaatttcattaaactttaattttatttcatttggacaaaatgcgtcttcaactaatataacttcattactataaattagtgcaacaagattacttgatttggcatctgttaaatcaacttttttcataatatctttcattacattttgcctcctttattttcatatatatcaattatacaaatttttttaaaaaattactcaactttattatattaattttaacacacttttattgaaatccacgctccaaacgttttactattccacaatttttattgtatgaaccatctgaactataactccatatagtaatgttaacaacttattataaagcaggtgaaaattatgccatcagttgtaggaaatttagttgtacaaaatagcaatggatcatttaacttaggtgatttctacaacgtatctccgaaagaaaatacgaaagcttataatggttccggcgcatcaaacgttggttttgttgttaatacttttagcggtgttagcgcgaccacacccatttgattctgacactctccccatcaaaaccaagtgggtacagcctaaaaatatg

SEQ ID NO: 164 - DNA, 638 bp, Bacillus thuringiensis
gtagtggaccacctgtatataaatagccaactgccatcccaattaaaccaataaccactaaccaccaactactattcatacaaatataaatgccaataaaagctgctacgacatacaataaaagcgcaactgttaaaacattttttggcttcaatccatgacggacaattccgccaccgatgccaacggattcagcagtgtctaatccacgtttaaaatcatagtactcattaaataagttcgttgctatttgcaatgctaaacatgcaaccatcatcgcaataaataacagccaatcaattttggcaacataaagtgatgccactgttcctaaaattacaggagaaaacgtcgccgttaatgtatgcgggcgcgtcatcttccatattaatttagcggaactaatttctttttctgtccccataactctgttcaatctccctacattttaagtataaattactagcagtatctttctatctatttcctgccacgcatccattcattatatcaataaatgattatcctttctaacaatcaacttttaataggtgaaaaattataaaatgaaactttaatcagtaggaattttgtcacccccactgattattagtacatatccattgttttttacggca

SEQ ID NO: 165 - DNA, 670 bp, Bacillus thuringiensis
gtacacaaaattattctcaaccgacatacaaacatgttggtttacatcgttgcgctttttaaactggaaaatagccagtgaaagcgtttcagaatatggttcaagagaggaagaggtgaacggaatgggtactaaaacaaaaaagaccctatttaatgttgatgagcaaatgaaagctatcgcagctcaatttgaaacattacaaattttaaatgaaaacggtgaagttgtgaatgaagcagctatgcctgaattatctgatgatcaattaaaagaattaatgcgtcgtatggtgtatactcgcgtattagatcaacgttctatttctttaaaccgtcaaggacgtttaggtttctacgcacctacagctggacaagaagcttctcaattagcaagtcatttcgcacttgaagcagaagactttatcttaccaggataccgcgatgtaccacaatttgtatggcacggattaccattataccaagcattcttattctgtgacaggacactgaatgggaaaccaaatgcctgataatgtatattgctttaacttcacagattattttctttgcgctaattttttcaaactgcatggggttgcgcttgggattgaaaacttcttggtaaacaattctgttgcaatttcttacactggtgactggggtgcttt

SEQ ID NO: 166 - DNA, 655 bp, Bacillus thuringiensis
  unsure (1)...(655): unsure at all n locations
tgtgggtaattatatgattatgagatagaatatcatgaatgagatgcgttattattagaaaataacgtaaaagttttagataatacaagagtggtatttgagtctgaattaggagagaaaatttgtttgctcggtatagatgatgttggattgcaccgtgatcgtctagatttggcattggcggattgtaaagaagatggttttcgtatcctagttagtcacaaccctgatataataaaaaaaatgtctggaaatgaacagatttcacttgtgttaagtggacatacgcatggagggcaaatccgattattcccatctaaaaaatatttaaaaggtggcgtatataaccatttaaatacgattctctttgttagtaatgggtatggaacaacattgataccacttcgtttccgagcacctgctcaaacacacatcattacattgtgcggagggaaatgatgccaactcttagtgggaaatataatataaaagccgtttcgaatataattggagttcagccgagtacgcttcgtgcatgggaaagacgatatcaaattattgccccaagcgtaatcaagctgggcatcgtttatatacangagagcatattcaaattttaaaatggttaatggaaaaagtttcttccgtatgatga

SEQ ID NO: 167 - DNA, 1128 bp, Bacillus thuringiensis
gtgatttcaggtgagaagcgtatcgcggcaacgtcattcgattcttttgtggcacttagtaaggaaaataatccaggtccagtaccgcgtgttatccctgaaaccgaagaagagaaagaattacatcgtattgctgtgttacgtgcagagcagcgtcatatacgtaaggcagagagtaagaaagtagccacattgttaaccttttgagatgaatatttagccatttaagttactatagcagtcggaaatggttttaaaatgaaaagcggacacctaaaataggtgtccgcttttatagttttttcatccacatatcatatgacagtagctacttagcagaagcaagcagcaccgacgatgattaagaggataaataatacgactaatagcgcaaatccattaccatgtgcgaagcccattgttatttcctccttttattttaagatacaacatacaatatgcaaatgagctattgtttgatatggacatatatcatgcaatgacatattttcttgaatgataatgtaataaaaaagggaagatagaaataacagtagtggagaaggaatttatccatgaagcactttttcgctataatcctttgtttaataggtgtattcatttgatgaacatcgatgtggaaatggggaaggaaatggctagtgaatataattaggacaagttcgattaggtgaatttcaactatatacgagcggtgaagagttatatagaaaattatttgacgatataatcgatgcagaaaggtatatatatatccctttttatattgtaggaaaagatgaaataagccaagagtttttgcagttattagagaaaaaagcatctagcggagtagaagtgaaattgtcagtcgatcgggtaggcggatataagctgaagaaaaaggtaattagccgattaaaagaaagcggtgtgaagtttacatttagtaaaaaaccgaaactgaaaaatatgttctattctttgcatcaacgagatcatagacgtattgtccgatagatgagaggtatctatacgcggggccttaatatcggtgagaaccttgcacaaaatccaaagtttgggccatggaaaaattatcacgtgcgcatccatggtgagggtgca

SEQ ID NO: 168 - DNA, 726 bp, Bacillus thuringiensis
ctgttcttattgtacttggcatgaaaaatccgtgggggtgtctttataaagcacaagtgccaataagagaacgtgaaggcggacttgtagctggtttctatcgccaaggaacgcatgacatcattaatatggaatcatgcttaattcaggcagaagaaaacgatacattaatccaagaagtaaaacgtatttgtgaaaagcacggtatcactgcatacaacgaagagcgtaataaaggaacacttcgtcacgtaatggctcgttacggacaagtaacaggggaaattatgcttgtcttcattacacgtacagcagaattaccgaacaaaaaagcaatcattgaagaaattgcagcgaaattcccagaagtaaaatcaatcgttcaaaacgtaaatacgaagcgtacaaacgtaattttcggagacaaaacgacagtactatacggatcagaatatatttatgactttatcggggacattaaatttgcgatttcagcacgttcattctatcaagtaaacccagaacaaacgaaagtgctatacgataaaacgttagaatacgcaaaattaagcggtaacgaaacagtaattgatgcctattgcggaatcggatcaatctcgttattcctagcgcaaaaagcgaaaaaagtgtacggtgttgaaatcgtcccataagcaattgaagacgcaaaccgtaatgcaggactaaacagcatgacaaacgctg

SEQ ID NO: 169 - DNA, 525 bp, Bacillus thuringiensis
aacgctacttcgcaaaagaatgaagatggtattatttgtattcgctctgttgaaatacacaaacataatcatactgttaaagtaaatggagagtatattaaactaacctctattgaattcgatattttatatttgcttgcaagtaatacaggaagagtatttagttcagaagaaatttttgaacgcgtttggaatgaagatggttacggttcaaataagactgtaatggtccatattagcaacttacgggataaacttgaaacagtaataaatggagaaaaatttattcacactgtttggggagttggctcatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaaatttt

SEQ ID NO: 170 - DNA, 809 bp, Bacillus thuringiensis
ttaatgcagtattttgagtggtattctccgaatgatgggaatcattggaatcgtttgcgtactgatgctgaaaatttagcgaaaaaaggaattacatctgtttggataccacctgcatataaaggaactacgcaaaatgacgtaggatatggagcatatgatttatatgatctgggggaattcaatcaaaagggaacagtgcggacgaagtatgggacgaaagcacaattgaaatctgcaattgacgctttacataagaaaaacatcgatgtatacggtgatgtagttatgaatcataaaggtggggctgattatacagaaactgtcacagcagttgaggtagacccgagcaatcggaatattgaagtatcaggtgattatgaaattagtgcgtggacgggatttaactttccagggcgtggagattcttattctaatttcaaatggaaatggtatcattttgacggaacggattgggatgaaggaaggaaattaaaccgaatttataaatttaggggcataggtaaagcatgggactgggaagtgtctagcgagaatgggaattatgattatttgatgtatgcggatcttgattttgatcatccagatgttgcgaatgaaatgaaaaaatggggaacgtggtatgcgaatgaattaaattcagatggttttcgtttagatgctgccaacatattgaccatgaatatttgcgcgaatgggtaaatcacgttagacagcaaacagggaacgaaatgttaacagtagctgaatattggcaaaatgatatccagactttacataattattta

SEQ ID NO: 171 - DNA, 1344 bp, Bacillus thuringiensis
tttccaaactttaatgagcggatcttcttcatagagttccataagaacagcgtataaattatgaatttgctctttaggtaccgcatcaatggcagcttccatttgtggttcggcaaagtgaatatcttttatataatccgtacgttcaccgataatatcaccaattttaatatcattcagcccccacactttacaaaactcaccgttaggaacggtagaagtttgaacggtatctccattatgaaataggcacattttttttatcttttctttatggaatagagacttactgcgctgtatattaacatattttctaacatgtaagctacctgaaaaaactcttatataagcaaccttttctccagaaggttcacgttcaattttaaaaacaacaccggataatggttactcttgtgccgatgtaagagttggaatgagagcccggaagtttttcaagaagttctgttacgctcataccagtcattgctgaacctgaaaagattggatacacattcgcttgctgtattggctgttctagtttttctcttaatagtgcgtccggtattatttcgttatttacatatgattcaagtaacgattcattaaatggtgctaacagttccatacaatcgtcatatgatttgtattcaatgatccgggcttctttcgttccttcgtttagaacagagtagaaggggaatgcttcatttgaaagaacctcttttatttgtttcataactttttcagtgtttgcgccactacgatcaattttattaacgaataaaatagtcggtatgtttagtttctgtaatgttcgcattaaaatttttgtttgtgcttgcacaccttcaacggcagagataactaaaatcgcaccgtctagaacgcggaatgatcgctccacttcagcgataaaatcagcgtgtccaggtgtatcaatgacatttacttttacagcatcaataaagaaagaaacgacagatgctttaatcgtaattccgcgttgtctttctaattccattgagtcagtttgtgtattaccactatctactcggccaatttctttaatcacattcgtttcataaagaatacgctcagtcaaactcgtcttgccagcgtctacgtgcgcgacaatccctatatttattgttgtcatttgtgaatatcctcatttcattttccattttcaattcctcatttctatttgtatattgccgcattatcaatcactctccagttctttaaattagtattattatagtgcaattaacattatttgtaacgctacaaagcgccttaattgaaaaaataaaatgaaaacaaaatgcttgcattctaaatcga

SEQ ID NO: 172 - DNA, 721 bp, Bacillus thuringiensis
aaatgattgctctacaaaattgaatatatcacatacatactaacggctggtgtacacttcaagcttttgcataattttctttttgtgcaagtatagataactcctcaattacatcagcacttaaaggaccctctttacatttttcataaaatgttttttcaaactgatacgatgctcgtattgccattacataattaaaactatttcttattctccagctaagtaatgactttttcatatctttactatccgctgtttcaattagataatacaagagtaccgtttcaaagaaaatagatgctgattcattcttactcattggcaaataatcatctaaaaaagatgtaagattgttcaaaactcatattataaaaatgccaagcatgtcctaattcatgagcgagcactcttacactatctatactcccatcataacgaatggaaattcgcgattctttctcactgaaaaatggagcacaaaacccacctggtggtttattctctctcggttcagcatctacccaaccactttctatcgcattacgtgcaaattctgctaattcttcatcaatattcttacatgcatcataaacgttttgtattgctactgaaaaaggaatcatgatctcattactttcctttaccgtcataagttcatgccatgtaattgaagcttttcctttcttatacacgtataaagcacttactaattttatcaagg

SEQ ID NO: 173 - DNA, 715 bp, Bacillus thuringiensis
actgctaaaaagtcggctacatgatatacacctttaatgctttcaattttcaaaatttcttgcacttgcattggggcttgttctttattttcatttgtataattattacgtgctcctgatggtaatacttcattcaaaataactttcattgtgtttggacttggcgtcggttcaattgctttaatcttcacgtaaaaaactctcctttattgcatgttcttagctgtattgtaacatgttatcactctatactcctactcggatgcttaattttactactttcttcccactaccatactatttcattctttttacattttaaattaggaacgggattttaaaagctttcgtttccgataatttttattttttatccatttcttgaggcatcgccattatttttgaaaaaaacacgctaaacaaaaaaatataataagctatccatatggatagcttatttacataattttcgttattggaagacaactatttttataaatacaaaaggcagaaaagtatatagattctacaaaatattttgattgtgatacatttacagaatctcttattttataattaatgtcttattattttttggagggaatttcgagaaaaagtttgttttgatatttgggccacaaggcagttgggaaaatgaccagtggacaagaactagcaaagatgactgatttaaaattatttcataaccatatga

SEQ ID NO: 174 - DNA, 506 bp, Bacillus thuringiensis
catatgttttatgagcttaacaattatatgtttaattggatctatatttttggccgtcgcatttggtgcaaaggatattcatttgcaaacggtgtggacagcggtttttgattacaatccgaaattaacgcagcatcaaatcatttacgaattaaggctcccaagggtaattggcgcagcagttgtaggagcggcttttgcggtcgctggggctgttatgcaaggagtaacacgaaatcctttagctgatgcaggtgtacttggcataaatgcaggtgcgatgtttgtagtagcacttagttttgccttttttccgcatatgccgtattcctatttaatgattgtctcctttattggagcggtcttaagtacagtactcatttttattatcggatcggccacatcaggcggattaacaccgatgagattaacgatcgctggggcagttatggctgcgcttttacattcgttaagttcaggtgtcgcgatttatttatgacttaagt

SEQ ID NO: 175 - DNA, 787 bp, Bacillus thuringiensis
atgaaaatatgtactatgcaccttcctccctcctattactgtctaaataaagctccataaatttttctggacatgcaatcccactaaatttaacaagcttggttaaagaactctctcttaagttggctctttgtaacgtttcttgatcgcctaatacatcaaacactgtattatccgcaataattttcccttcatgtagaactactgcacggtctgtatattctagcgcgagattcatatcgtgagtgataaaaacaaatgaaattccctttttagctaggtttttaataaaagacataaattgtttatagtgataataatcttgtcccgctgtcggttcatctaatatgataagtttaggatttgttgttaatacagatgcgattgttaatctctttttttgcccatagcttagtgcttgaattggccaattacgaaatggatataaaccacaaatttttaaagttccttctactctattcttaatttcttccttagaaaaattatgtaatgttaatgtaaatgaaacttcttaaaaacagtaggctgtgtaatcatatgatttggattttgcatcacgtaagatatgatttcccacgtttacgaatagaccaagaactaatatcttcaccttttaacatgattttcccattttcattttgttatgcctatagactatgagctatgttgatttcctgctcatatgtctaacaggcccaattctcttattatgaggttactttctatactttgtattgagatgaatgataatctcacttagatcctg

SEQ ID NO: 176 - DNA, 664 bp, Bacillus thuringiensis
ttctacaagaagtaacattttcaggatatgtaattgctccaattctaaacaaacctaaatctttaaatccataattaataatttctccagctgcttctgaagcataaccatttccccaatagcgaggatgcagatcatatccaatctcagatcgtttactccataattgtaaattgtttagtccaattgttcctattaaaacgttcgtttcttttaacacaattccccatcgtattgcctttttctcaaagtaattttttgaaaaagattcgatcatacgtgaagcttgtccaaactccgtaaaagaattcataccgtagtaacacgtcacttcatccaatgaaaagatttcatatattttttgacaataagattgttctatttcaactaaacgtaagcgttctgtttctagtataggaaatgccataggatcactcctttctctctactcattcattatatcagaaaaaatatgtataattagtaaagtccttattgttccataaatcaaacatttctaatggcacattctctcttaattctatatacacgaattagataccttctgattgcacctcaaacatgacgctataatttccataaatcgaattttaaattatcaagaactgtaaagaaattgtttcttcattttctccttctaaac

SEQ ID NO: 177 - DNA, 762 bp, Bacillus thuringiensis
acatgaatagcgcaacaaatcaatctacctctaaaacgcaaactacacaaggacaaggtgaattaaaacgcggattaaaatcgcgtcaccttacgatgatttctctcggcggtacaattggtaccggactatttcttgccagcggtggtgtcatccattcagctggtcctggcggcgcattaattgcatacgccgcaattggaattatggtttacttcttaatgacaagcttagctgaactcgcagcttacatgcctgttactggatcttttagtacgtatgcaacaaaatttgttgatccatcacttggctttgcacttggatggaactattggtataactgggcgattacgatcgctgctgaacttgcagccgtaacattaattatgaaattttggttcccagataccccttctcttatttggagcggattatgtttagctattattttccttttaaactatttatctgttaaaggatttggtgaatctgaatattggttcgcacttattaaagtagttacaattattatctttttaattgtcggctttatgatgattttcggaattatggggggcgaaactgttggattcaaaaacttcactgttgcagatgcaccatttaacggcggtatcatggcaattatcggtgtatttatggcagctggtttctccttccaaggaactgcattattaggagtagctgctggtgaaacatctgatccagaaacgtatatcccaaaagcaattcgctcaatctttt

SEQ ID NO: 178 - DNA, 729 bp, Bacillus thuringiensis
caatctgtatttggtactgctggtagtatgattctcggcatcgcaattattttatttgcctactctactattttaggctggtcgtattatggagaaaaatgtgtagcttatttattcggagaaagtgcagttaaatattataaagcaatctttattgttatgattgcaattggtgctaatttaaagctaggaatcgtatggacatttgctgatattgcaaatggacttatggcaattccaaacttgattggtctaattggattaagtagtattgttgttgctgaaacgaatcgctttttacaagcagagaaattgaaagaaaataataagcaaacaggcaagttaatctatgaaaaaaggaatgactcatacatgatgagcgttccttttttcatcccctcttttacttaattactatcattaaaaatatatttatatcaatatttactcctttttattccttcaaaagtttttcacataaatgtcataaatcgtatggtttaactatatagttgaaaaggaatgcgacattaaggtgtcactgaaaaactcatccaagaaaagggaggaaaaatcttttgaaaaacaaaatcatcgttttcctatctgttttgtcattcattattgactggtttattctttaacacatatactttgatctaccacgaatgcagtatttaatagtacgccggacttttattattaaagcctttattttttacaacctat

SEQ ID NO: 179 - DNA, 744 bp, Bacillus thuringiensis
agatacacctgataatataaatacaaagaaaaatgtaaagaaaccaattaatacaggaccaagcccatcaaacatcgtaaagtctttagagccatgtaaataatttacttcaggtttcataatcgatacatcattcttctctgtgcttttttgcaatacttgaagtacagcacgattttttgacgaatcactaccttccaacagaagtttcatttttccattctctattcgaaatactgcatctaccttttgtttttccaactcagaaatcgccttttccttactgtattcataaattgacgcttcttgatttttcatcacttttactatttgagcgggcatatcaacaacagcaatttgcggtatatagtctttctgtgtaaacactagtgacaaaagccaaagtaataacatcggcgctccaaacatcattgctaacgaacgcttatctcgaaaaaattgacgaataatacgtataattacaccagtaactctcatgatggcaccacctcttctagcaaaaagacatattcaatccgaccagatgaaacgcgtgtgttcaattattcagttgtgccaaccgcaactagtttaccttctgtaattaaccctagacgctcacaaaattcatcttgatccataatgtgcgttgttacaataatcgacgcgcctttgtttttaagaacataaaatttttcccaaattgtttttctaagaagcggatctatccccactgtaggctca

SEQ ID NO: 180 - DNA, 806 bp, Bacillus thuringiensis
accacctcaacaaagttatttaatccaaactgccccgttacgtcagatatacagcaaagttttaataattcagccctacaaataggaatttcactcggctctgcagttggaggtatagctttaaaacaagtacataatgtcgccaatatggcctgggttggtggatctttagttttattatctttaggtttggctatcttttctcttactagacatacaccgacaagagactgtccagtgagtgctaaacatttagattaacattctctttttcttttcatcgtaaaaagtatagataggaatcgtcataaatagtcccgttataaaaacggactttttatgacgggattaaccccatctttttccgaaaaatgaatatgtataaatttcttctccttgaacaaagaaatcctcgtactttccccctcgtatcaaataatttgaagtactttcatcaatcgattgaaactgtagattttggatttctttcgttacttttacagatgtaaaattctctctgagtctaggtgcaatttggctatttatactaaatttattaaataaaataaacgaacttaataaataactattgtgtttaaaaagagaatttaattcgcacaataagaactcctcatgttcaaaactataattacttgtacctgattgatcaattacaatatcaatagaataattctgaataggtatgtttagaaaatcggcacagataaatacaatatttcttttcacatttcttctctcaataacatcttttaaaagtaaaagtttattcaaatctcgatcaacag

SEQ ID NO: 181 - DNA, 548 bp, Bacillus thuringiensis
atttccggttttatctgtacaaagaatgttcatagcttcttagttttgaatagaatttagctgttttacagttactttttgtttagacatgttaacggcacccttagctaaattagcagttacaatcattggtaacatttcaggtgtaaggccaacagcgacggcaatagcgaagaagaaagcttcttgccaatctccttttgtgaatccattaatgagaaggacaataggtgccataataagcatgaatgtaattaagagccagcttactttgtttacacctttatcaaagcttgtttctacacgctttccgattaccttatttgctaaagagccgaaatacgtatcggtacttgttgagatgacaacagctttcgcgctgctcacttacaatatttgttcccatgaaacaaagggtttccatatcgagtggattgtaattttttttcatgattgtcggtaagatatgcttatttcctgtatgatagcagagctcggatttttctacaaggagagctaccctgttaaagaagattgattaacaaata

SEQ ID NO: 182 - DNA, 430 bp, Bacillus thuringiensis
tgcctgctcctggtggtgaaggcggagtgtgtgcaatgcgtcaagctttagctgatgcaggcctacagccagaagatattgattacattaatgcgcatggtacaagtacggatgcgaatgaaaaatatgaaacgatggcaattaaagaaactttcggtgagcacgcgtataaagtagcgattagctcaacgaaatcaatgacaggtcacttattaggagcagctggtgctgttgaagcgattttctctattaaatcaattacagacggagtaattccgccaacaattaactatgagacaccagatccagaatgtgacttagattacgtaccgaatcaagcgagacaccaagaagtaaatgcagtattaagtaactcattaggatttggtggtcataacgcagtgttagtatttaaatcgtataaataata

SEQ ID NO: 183 - DNA, 922 bp, Bacillus thuringiensis
tcaattggaatgacgttctgattggtaacttctttcagcagcttttccgattgaaattagcagtactggtacgtaacgggggttatctagtccaaatgcttctgcgatttggtctttttcaaatccaccaattggacaagtatcgtaaccgtgagcacgagctgctagcataaattgcattgctacaagaccaccgtcaattagcactgtatctttcatgacttctggtgtaaccattgagaagtaagctgaaaggtttttcatttgatcttcttttacttctgctggcattaaaccgcgttctactgctgtaccgtaaatttcttctgcgttatcaaagttatttaaatcaccaaataaagcgatcatcgctgaagatgtttctacttgtgattggttgaatttcgcaagtggcgcaagtgttgctttcgcttcgtcactttcaattactaaaaatctccatggttgcatgtttactgaagatggtgcaagtgttgcttctgtaagaatttctgtcatttcttctttgctaattttcactgaagggtcgtacttacgaattgaacgacgtcctgttaaaatttcgttaaaatcatttgtttttactgagttagtcatagttgtattctcccttttttataattcttttatattttcttgaatgtgatttaacatatttaaaagattatcgcgttcttcctcacttaatcctttaaatgcagatgctgcaaaacgttctttttcctcttgaaatgcttgaattttatttcgtccctcttcagtaagagaaactaacgtaattctgttatcatctggatttttacgtcttacaatcatttcattggcctcaagctgctttaaatgccttgttatcgcagcattatcaatattcacttcttgtgaagtgctttttgactaattt

SEQ ID NO: 184 - DNA, 381 bp, Bacillus thuringiensis
tgagacaaatatagaggatgcgatacagacaacaattttaaaagcctatgaaaatataaaaaaattaaaaaaagaagaattttttcacacttggttaattcgaatactaataaatgagtgtaacaatattattagagcgtataaaaatgtaattgtgacagaagagaatgattacaatatgagtgcgtgtgatcagtatgaagatatagatttgtgtaatgcgattcaatcgttacatgaagaattaagagctgttacggtgctttattattatgaagatatgaatcaagagagtatagcaaagctgttagaaataccgaaaggaacagtgaaatcaagattattacgcgcgagggaacaactacaaaaacgattaaagcc

SEQ ID NO: 185 - DNA, 549 bp, Bacillus thuringiensis
gcttctttaaaactttatttaattatcggtaataaaatgcgccacgaaaaagtgtacgaacaactaaaagcaattgcacctactgtgttctcagatacattacgtggtgaatggaaagataacttcaaattttatgcaaaagcattaaataaagaaaaagaaggtcaaaaagttgtagctgattacgaatcacgtataaaagatttaaaaggcaaacttggtgataaagtaaaccaagaaatctctatggttcgtttcatgcctggtgatgttcgtatttatcatggcgatacattctctggtgttattttaaaagaacttggatttaaacgccctggagatcaaaataaagatgattttgcagagcgtaacgtatctaaagagcgtatttctgctatggatggtgacgtattattctacttcacattcgataaaggaaatgagaaaaaaggatctgaactagaaaaagagtatataaacgatcctctatttaaaaatttaatgcagtaaaaatgggtaagccttcaaagttgatgacgtttttggaat

SEQ ID NO: 186 - DNA, 1033 bp, Bacillus thuringiensis
  unsure (1)...(1033): unsure at all n locations
aaatatccttttaataattatttatgctaactttatataggtgtataatcaaacgttattattcatttttaattgctctaaaagataatcacagacattcacaaaaatacattgtttttttaaacttaataataagtatttcaattcaaattcttgataaaaaatcttagtgatatatagtttaaactcatctaaattaggcttttctgggctatatagcatatctaaaggaagtttaaatttagaaaacaaatgatcgttttgtgcaaaaatcgaaacttcttctctagttaatcgatcatgaaatgcaattgaaatgtttcttaaggcatttacttgttcttcttcaaattcatgatctataacaaatctataaaatgggaattcatctgactgaatcatactttgcataagtctaaattgatatcttaataaagtcacttctttgattaaatccatatttcccctcctttatttccctaaattaaccagtttatcataacaatttataacttgaaatacaaatacttatgatatatcacccatgcaatttttattaacataacctatcattatcaatagttaacgatgctaaaaatttcgttatggggtaattanaactattagcttgatagggatggggtactaacacatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttaaaaacgcttagttctcttttgtgcttttgcaacagaagttg

SEQ ID NO: 187 - DNA, 849 bp, Bacillus thuringiensis
attatttacttgcatgttttttgagcgcatcaataaacttcaagtcgttattatgctttctgatgctgttggcttaggtgtttttacagctattggtgcaaatgcggcaatgtcacatcatgttgacgcctcatttctagttgtttcaatgggagtcattacaggtattggaggcggtattttgcgtgacatttgtgctcaagatatcccttacgtattccgaaaagagatttacgcaatcgcttctatcttaggagcaattagcttcctaatcacacacgctatgggggcgcacgtgttagctttctatgtttgtttattagtaacattcattattcgtgtcgacactgtaatatataatgttcatttccctgttttctttaaaacacatgctaaaattaataaaggccattaagagaattctagatagaattctcttaatttatatactattcaacgaactaatatagagtaattatatataagcatatataattactctatattagttataaaactgaaaacgttctatatacagggggaagaacgatgcttggggttctcaaaaaagatgttactttaacaaatgccagagtaagggaatcaagcaaggaccaacagatgagctgtaatgtccctactaattctgaattaaacaatcacatggatttgctacacatttcaaaagaagatatacaaggtgtgaaagttctacactacagactttttatttttgcagacaatgattgggataccgataaaagctttgccaactttgccaaacaacccaatttaactacccttatatgaacgttccggccctattccaagcctaaaccacctttaaaa

SEQ ID NO: 188 - DNA, 824 bp, Bacillus thuringiensis
taaagattttcttccagaccatgtacgtgaagatataggggatggagattggctgtttgggagaggaacaatggacatgaaatgcggcctcgcattacaaatggcaatgattgaacaagcatgtgaaggaagattcgatgggaatgttcttttattggctgtaccagatgaagaagtgaattctgtagggatgagggccgctgttccgagactattagatttagcaagagagcataatttagattataaaacggtcttaaactcagagcctatgttttcaagacatcctggtgaccaaaataagtatatttacactggctctattggtaaagtgttacctggttttctttgctacggaaaagagacacatgtaggtgaaccttttgcagggttaaatgggagttatatggcttcattaataacagcagaactagagttaaacacagacctttgtgatattgtagaaggggaagcgagtcctccaccaactaacttacttcaaagggacttaaaagaggattattctgtacaaattccgcatcgtgcagtcacattatttaatttgtttttattagaaaaatcaatgacagatgtagtttcattgttacgtcaaaaagtaacgaaagtagcagagaaaatagaagagtcgtatgaaaaacatgcatatcgtttttctaaatataatccatttataccacctaatctcaaagtaaatgtattaaacttatgaagagcttatcacatatgcaattgagcaacatggacgagaaaaaatagatcatattcaatctaattttataaaaatagaggagataaagatgatc

SEQ ID NO: 189 - DNA, 965 bp, Bacillus thuringiensis
tacgctgtcattatcttagacatactagccggtgcaaaagcttcattttcattatattgataaataatatctccatcactcgcatcgataatcatagctgcttttgcgttaatttctggtgggatgtactttggcgggactacttttttagtaaatcctgctttaggtagttctgccacttgcaaaggttgtccctctacattcgctatgctcttttgatttccttggaataagaaccaacatatccctaaaataataactaataggactgtcatccttccccattttaaccgattcatttcaaaactcctttagcaaaccttttatacactcacatttaaccttaacaacaattcctttatatagtcaaggtaaaaggtatatttattcatatacagcaatgattattttaatttatttatgttaaacttacaatattgaaacgtaagaatattcaataataaaatctcgtaaataaagcgaaactttaatcagccccaccaattgggctacccgtcaaatagcgagataaactatttaatagaagggattcatacaaatgctacttccaaaatcattaaaatacggagacacagttgggatctactccccttcttcaccagtaacctacacttctccaaaaagatttgaacgagcaaaatcttacttacaacagaaagggtttcatatattagaaggttcattaacaggtcgatatgatttttatcgttctggtagtatacaagagcgtgctgaggaactaaatgtcttgataagaaatcctaatgtttcttgtattatgtcaacaattggtgggatgaattcaaattcaatattaccttatattgattatgatgcttttctaaagaaccctaaaataatgattgggtattcagatgcaactgctttattactaggaatttacgacaaaacaggaatccctacattttatggaccagctctcg

SEQ ID NO: 190 - DNA, 313 bp, Bacillus thuringiensis
ggcaaaacttttttttacagaaaaaggccacaacgcagggggggttttataagctaaagggccgttacaagccaaacaccaataaacgcccaagttacaggcgctaaaccatacgggactatcatcagaccagcatttcaccaatggaagctccctcgagaggtcgcaaaacccgacaggaccatatagagaccacatgtccgcctctgtaagctcctaaccgcactcgcctgttcctaccctacggtttacgaaatacctgtccatctttgtacctatagaaaagctggggtattttcacagaccactcgga

SEQ ID NO: 191 - DNA, 813 bp, Bacillus thuringiensis
ttacaatagtcaaactgtgtaattttgaacacatcttaaacagcgtaatactgcaataaaaacatgaaaacactctaacttcgatacaaataatatattgattacatttagtttatattttgtaaaaaaattttaattgccataacaaagcaaacaataaccactattggtcgtattaatgacgtcccttttgtaagcaccatcttcgctccaatatatgatcctataatttgaccaagcatcataatcaacccaattgtccaatcgatttggccaaaaataataaaatataacaaagcagcgaaattacttgtaaagttcaaaatcttagcatttgcagtcgcccgtgtagcactatatccacataagagaatgaacgctaaagcaatcaagctacctgttcctgggccgaagaaaccatcataaaatcccagtaacggagccactgttaacgcaaacaacaacatacttattttcctcggtcgatcttcgtttgctatatttggagataatagaaaataaatgccaataaaaacaagtaaaaaaggtaatatcataattagatattctgcccgtatctgtaaaacaagccatccaccgaaaactgatccaaaaaaggtcattaagatggacaaacgcatttctttaagattaatttctttcttcttaataaaaaacactgttgccatgagagttccgctactcccttgcagtttattagttgctatcgctacagaaggagacatacctactaataacattatcgggatagttatcataccaccgcctccagcaatagaaaatatccatcct

SEQ ID NO: 192 - DNA, 410 bp, Bacillus thuringiensis
ttctattttaaaggatataaatgcagaagtatttgaattgacaggtgttgaaccgaatccacgtgtatcaactgtaaagaaagggattcaaatttgtaaagaaaatggtgttgaatttattttagcagttggtggaggaagtgtgatcgactgtacgaaggcaattgcagctggtagtaagtacgatggagatgtatgggatattgtaacgaaaaaaacatttgctaatgaggcattaccatttggttctgtacttacttttgcagcaacaggatctgaaatgaatgcaggctcggtaattacaaactgggaaacgaatgaatagcatggatggggttgcccggttactttcccgctgcttacattttagaatccgttaatacttactctgttcccgaagatccctcatt

SEQ ID NO: 193 - DNA, 706 bp, Bacillus thuringiensis
aatgtaaaatgcaattgggaatagctctacgttcgtattcttattagcagctctatactctattattaagaagaatgtgataatgccccgtggtttcatcctggcagcttttacaacgacgttgctatatagtgtttcagatggagcatatcattacttagcgccagcaacacattttggcggagaaggattcattaaatatgtgtatttcatcattttaattacacatattatcctggcggcaattattgtaccgcttgcattgtttgcacttgtatttggttttacaaatcaattaacacgtcatcgtaaaattgtacgttggacgatgccgatttggttatatgtaagtttatctggtgttattgtttacttaatgatctcaccttattaccaataaaaaatctcagcctgtaggctgggatttttttattaagcaaatatttttgtgaaatgaaaaaaatatggtatacaaaagtatagttgcttttcatatagaagggatggtaaaggaatatgcaaaattttgtatttcgtaatccaacgaaacttattttcggtaaaggtcaattagagcagttaaaaactgaaattccacagttcggtaaaaaagttcttctcgtatacgggggaggcagcattaaaagaaacggtatttatgataatgtaatttctattttaaaggatataaatgcagaagtatttg

SEQ ID NO: 194 - DNA, 684 bp, Bacillus thuringiensis
tagacttttttctttttttccaaatatcattgatagtttattgtaatcccacatctgtatgtcattataaagttggttttgtccgtgaatggcacgttcaacagtgtatccgttgttattgattaaaaatataatcggttttaaattttgacgtagtatagttgataactcttgggcagttacttggaaagaaccatcaccaataattaaaatgttgcgccgtgataaattggcgagctgtgtaccaagtagagcgggcagtgtatatccgatagatccccataatggttgtcctacatatgcagtgttattaggtagagggatagcagcactaccaaagaaaggtgttccttgctctacaattaagacgtcgttttcttgtaagaaatggtacatttgctgccaaaaacgtttttgtgtgaccatttgtgcttttggattgaactcttcagtaaaaggtgatgtttctaaaataaatggcttaacgtcaagggtatctttattacgatgctcaattgaatcacttaaatgttgtaaaacatcctgcattacaactggaccgtattttttatctataattttcacagtgtagggatggatttctataacttgttcttttgtaaaaccttgtgtgaagccgcctgtaatagtatcagttaacttcacgccaatactaataataca

SEQ ID NO: 195 - DNA, 431 bp, Bacillus thuringiensis
gtgttccaatttcaagaccactaccgagtataccacgctttttatctggagaagattctgcgatataaaccattgctcctgaatattcgccgcctgtagagaagccttgaatcattcgggcaactaaaagtagtattggtgcccatacaccaatttgttcataggttggtagtaatgcgatgaataatgtagaaagtgccattaaaataatagtagtacttaacacgatttttcggccgtacttatctcctattctaccaaagaatacacctccgattggtcgaacgagaaaggctgctgcaaatgtaccgaatgtaagtacaagtttgaatccacttattatcaccacctgggaaagaataattgactttaaattacccgttaaataccgcgtataacccgaagtcaaaccacttccattttgcgttccc

SEQ ID NO: 196 - DNA, 674 bp, Bacillus thuringiensis
  unsure (1)...(674): unsure at all n locations
cagattgcgagatgttcgcgtttacttaacagaaggtactttactcgctatttatgcataaaagggtgttcatttactatcgaggattatcaattcattttcatttgcggttttcattacattttttaaattcataagtttattaccatacaactacattgtaacgaattttttctcagaagggaacgatgaaacaaaaggaattaaaataaagtagcattttgtaagaaaaaaggtatatttttcatgtctcacgaacaatatacctttcaaaacacgaattataacttttctttatataactctaatttttctaacaattgttcttttacgcctggccattcactcgagataatactgtacaccaccgcatctctcacataaccattcggtaattttctttcatttctaagcacaccttcttttactgcgcctaatctttcaattgctcgttgtgctttttcatttcttgcatccgtcttaatttgcactctcagcatatgcaatttttcaaaagcatactggagaagcatatacttacactctgtatttatactcgtacgttgtacactcggatgataccacgtttgccctaactcaactgtcttatcttctactgaaatattatataaacgtgtacttnctacaatcttattcgactgttgatctacgac

SEQ ID NO: 197 - DNA, 961 bp, Bacillus thuringiensis
tgacaaatacgatttttggcttcttattatcagctttgtttattaattagttatttgttttaaatagaaaatatggttaaataacttaaccccagtttctcaattttaatatagagaaattggggtttttattttgactttgtttaatgttaaaaacagtttcatttgaaatgcaaataccaataaattgcaacttcatcattttcaatatccaaacctttataaacaagaaaatcacacccaccaattacaaatccgcatttttcatagaacttacatgctgcgacattattattttgcgttttcaagcatgatacctggcatattgcctttttttgcccactgctttgcttgatcaactaatcttttaccaactccgagtgtacgatattttttatctaccgttatatcttctatgtaagcataggggttccaattctttttcaataccattaatccaatgatttggttatgtaacagtgctatgtaaatgacttgattaggtttatttatatattcattgtaagccagttcttcattatcatcttgattttgtaaataacttttttcataactcggaacgtcttctactgtatattctatacgtttatttcctttggaaagagaaagaattaaccgagcattcactataaagctgtcatcaatctccgggagattatctaaatcatttgtttctaactctctaattccaaggttcatcggggcacctccacataataatatttcttctagttcttcatttggttcaaatgaattccaattccaaaattataatagaatttcaatagtgcggctatctttgtattttatctttatcccagcatgttgttatcttgatatgaaaatattgtttagaaagagtagtatcttttattttggatgtatatccagtaaaaaaatttaactgtagtagagaaacaaatatttttttaatatcacg

SEQ ID NO: 198 - DNA, 645 bp, Bacillus thuringiensis
ctctcgcccacgcttctgtttttcctaatattgcaagaacatctttctgtatcctcccatcctttactaatacaaaagaaactggagatttttttcccgccactttaagatcaagccgcgaaactgcttcatattctggataccgaaatatagaaacgacaccgttcgcttcccataatgctaatttaatcgtttgaatatcgctcacatttcgcatacgaagttccgaaaacaaatattccacgttaattctcgcctttttcaaattgctaaaatcaatggaaccattatgtataagaataataggtgctggctctaaaaaacgtctccatctatcccatttcagcattaaaactgagcttataatatgaagtacaacaagtatgaacgttgtaatcatcgatcccagtaaccctactttttcatcagacaatgagttagaaatatgcccaccaagcattaacactaatacaacatctaaaagacgaacttgtgcgatagacctttgccccatcgctttcgcaactaatattaaaaatatgtatgctataatagcccgaataacccattcactattagaaagatgccgtgctccttcaaaaatatgcatatgcatcactttgcactccttacccgtctcaaact

SEQ ID NO: 199 - DNA, 584 bp, Bacillus thuringiensis
atattctcaattgattttaactatatgaatcttattccatggtgggttgtattagattaatgtttttatccagaactcattcacgttcactttccctagactataattcttttacgtcttcatcacttgataatcattttcactgataatgattatcgttactaagtatatatttaatatgaaattatttcaagaatgatttgaaaaattttaacaaactgaattaaaaaaagaagtatctccctaatattagggagatacttctttttttagaaatttatatgtaattcaactggacaatggtctgatcccatcacttcactattaattttcgcttctgtcatctggtctttcattctttccgaaacaacaaaataatctaaacgccatccgatattttcacctttgtaatcttgctcttacatttatgaatacatacatacgcactttattcaggttatactaatttcagaggtgatgttctttgcacaatgaaggagttacattaacaaatgagtattggcaagcaattattcataacgattcttcctatgatagcaaattcttttatgctgtcccctcaa

SEQ ID NO: 200 - DNA, 554 bp, Bacillus thuringiensis
ggtggttgcgggaaaacaacgacaatgaagatgattaatcgtttaatcgaaacgactgaaggatcgattttaatcgatggaaaagatattcaacaatataatataaacgaattacgttgggatataggatacgtgttgcaacagattgctttgtttcctcatatgacaattgctgaaaatattgcagttgttcctgaaatgaggcaatggagcaaaaaagaaattaaagcacgcgtcgatgacttgttacatatggttggattagatccggatatttatcgaaatcgtatgcctgatgaattgtcagcaggacaaaaacaacgtgtcggtgtcgtgcgagcattagctgcaaacccgaaaatcattcttatggatgaaccatttagtgcgttagatccattaagtagggaacagcttcagaaggatattgtacagttgcaaaaaaagattcataaaacaatcgtattcgtatcacatgatatgcaataagcattatcacttggtgatcgcatttgtattatgaaagaaggaaaagttgttcaactagattcacc

SEQ ID NO: 201 - DNA, 566 bp, Bacillus thuringiensis
ggctgggacttgttcttctcccattttcgtttttttttttcttaaaagacgatttacaaggaagaagacgattatacaaaatagtgcatatcctgcaattacaattgaggacatctcatctcccccttacttatgaatacgaactgtcacattcatgccaggaacaatatttactgatttgctatgatctaaagaaattttaactggtactacttgtgttactttcgtatagttcgctgttgcgttgcttgatggcaacatagagaatgtattcgctgttgttaagccaacttgttctacttttcctgttaacgttgtatctgggtatgcatctacatacacatctacattttgacctttttgaacatcatcaacatctgtttcttcaatgtttgctgttacccataaattgttcatatcaaatgcataagcaatcgggctacctgctccaacgaaagcatttgttgtcgcgtttgattgtacaactgttgcattttgtggaattgttacatctactgtttgttctccattagctgccgctacagtaacagtacctaatttatcgt

SEQ ID NO: 202 - DNA, 472 bp, Bacillus thuringiensis
cgatgtaaaagcagttgctttcttaaacgtgcttgtccgattagatgaaaatactgagaaattgaaattacgtaaaatgaaagcggcggctcttcatgcagaagcaagtaaacaagagcgtgaagcgacaatgcgtgctttccgcggagggaaattagaacatctacttgctactgatattgcagcgcgctggcatcgacattgccgattcaacacatgtaatcctacttagaattaccagacacagtagaccaatacattcaccgctcaggacgtactggacgtatgggtaaagaaggaactggcgtatcctcttgtaactccacaagacgagcgcaaattactgcaattcgagaaaaaactaggcatagcttcaactcagcaagaaatgttcaaaggatcattcttagaaacttaacccgaaagcaccaaagaaaacgacactagcatttactgggaagaaaaagcccta

SEQ ID NO: 203 - DNA, 697 bp, Bacillus thuringiensis
ttttcttactagagagtatacataacgggaaagttcgctgggaagatccagtgaaaatgagtgcgaaggcggcacaaacagaatgagcgagaatcccagtacaagttaatgacacattaactgttaaagatttatatcatgcattaatgattgagtcagctaataattcggctgtggctttagcagaacatatggcaaaatcggagaaagatttcgttcagcttatggatgcaaaagcgaaacagttaaaaatgtcggaacatgctaaatttgcaaatgcttctggattacaagagccagatggaagtgaaacaaaaatgacggctggtgatgtagcacaattggcgtatcatcttataaaagattatccggaaatattagaagtgactcacttacgccaaagtcagctagcatttaataatattaatgttataagcacaaacgacatgttaaacaaaaataataaaagtttatatatagaaggaatggacggactaaagactggatttacagatagtgcaggatactgttttactgggactgcaaagcaaggtgatgaacgaattattacagtggtcatggggacatccaggtaaacaaaacgttttacagagacaaataagttgatggcctatgcatttggattagttaattaaggtagtaaaatacgaatctagatcgctacataagtaagact

SEQ ID NO: 204 - DNA, 1018 bp, Bacillus thuringiensis
ctttgtggttcatattgaattggtccacaatttacatttacaccttgcttacataaataagatcggctcgctggtgattctacatatccatgagctgaagccttttctgaaaacccaaatgttaataatcccgtaagtaatacgccaccacttaaaataactttcttcatcttttgtaaactattctttttcattctttcatccccttcccataataaagcgaaaataactatagtcggctagtcatcttctctacatttattataagacgagaatcattactaaaagaaccctctaaaaactttctcaaattcatttagtgcgttaattagattataattaactattttaacaccgccagaaaaatatagacggtgttaaaaatagtcgtttattattcacttactaataattaagcactctccccgtttgattataacttaaatgtttttataataaagaaccgtagcatctaactttccattcgaagaaattgcataccctggtattgttccaacttcttggtagtctagtgatttgtacaatttattggaaggatctccttctctagtatctaatactaaaagagacctgctttcttgctttgctcgttcctctgctttttgcataagcgatcgtccaataccgcttcgtctaaagtttggatgagtcattaatttgcaaatctcagctctatgaattccgttaggcttagtaactaattgtaattgaatactccctgctacttcgttgtttattttagccacatacaatatcacttgtggcgctaatactgtttgccaatactttgtcgcatctttttgttccagtggaggcaaaaaaccaattgatgccccatcatttacaaccattttcaaaagtttcgaaagctcttctatatcattttctaggttcttaatttcttcaattactaaatttcgcattacttttcccccttttgtttcattgtgaccacttttaaagaaggaataatgaaataataagagggatttatagt

SEQ ID NO: 205 - DNA, 413 bp, Bacillus thuringiensis
tataatgatggttctctcgttccaacaacttctaatttatttactttattcaggaaatctttctctccttttccatataaaacgaagggagggtcttgtatttcacgtaataattgcggataattttcatcccatatcgttatataaaaaatacgatttttctctaaataagatatatattgcggaagatttgaactttgaagaaattttactagttctgaagattttttcgaggatattccagtgtagtgttccatttgtttttcgttaaaattatatatgttctctaattctggatcgacatatagtagcctctccatcgctttccaataatctgctagcaagtaatgaagatgtaataatctctctcttttcatcttgattctccttacccataatttttattatgtaaa

SEQ ID NO: 206 - DNA, 576 bp, Bacillus thuringiensis
caggtgaggccttaggggctattatctcgttttatatttatcgcatgggccttcaaaagttcactcacgataaagtcaataagtacccaaaggtagagcgtcttctttatgtagaaggtagagaggcctttctactcgttctatcgtttcgattgatacctttcatcccatcaagtatcgttactttatttgcagctctagggaaaatgtcattactctccttcagtattgccagtacaataggtaaaataccggccttattgattgaagtatattcggcataccaagtcatgaacggaacaaatgaagcgaagtgggttgtaacaatcgcaggcgttattggattgttttatttgtggaaaaaatggagaaaaaaataaagaaggagcataggctccttctttatttttgaggtattttattaatagctatccgttaagtccttagttaataccaacagcactaaatgattgcttaactgctgctacttcagcagaatttgcaccatataagtctgctgcagcttgtactgcaccagcacgagcttgactaaatgaagtagattgcgtgaatact

SEQ ID NO: 207 - DNA, 756 bp, Bacillus thuringiensis
gaaataattatggcagttacaggacaagtaaaatggtttaacaacgaaaaaggtttcggtttcatcgaagttccaggcgaaaacgacgtattcgtacacttctcagcaatcgaaactgacggtttcaaatctttagaagaaggtcaaaaagttagcttcgaaatcgaagacggtaaccgtggacctcaagctaaaaacgtaatcaaactataattttatagttgatgatggaaaaaaggatggctaatgccatcctttttttgttgtggagaaagtttttttagagcctgtttttatatctaaatctctttttcgatgttacaactggtaaaaaattatctggaatgcgtattagtttctgtagaagaattagttcagcatgagcatttgctgcgtatgatagtaaataactataaatttgtattctctgttgaaatggagaaatcttttccagatagaccttgagtaacatcttttttgttagcgttgttgatggaattttgtacgttttgagatgatgtttctaacagttgttcttgttccttactaggggtattcagagcatctgagggaatgctattaacctgctgatttaatggattttctttatccatagtacacaactgcttgtccgaattcgatccaaagcaatgtacttataaatagctactcatatatatttgatgacattgaaaacgctaggatatacatttatattggcaagttaactgatttacagaattgtgatatttggct

SEQ ID NO: 208 - DNA, 605 bp, Bacillus thuringiensis
cggcttcaagtccttctaacacttgaatcgctctccattatattggaactgatgcttcgccagactccttgcccctttcctaatccaaaatcagaacatatgtttctattatagaataacgcctcgactatagttttggcaagttatcttatctcttttatataccattttcaatagaaaaatccttgttttctcacaaggattcctctaggctactatttcagaaaaataatcgtttgtcaacgagaaatggatatgtattccaagattacacattccaaacctttattatgatccaaatgatcaagatccaaaatgggattacaaataacaacccccaaaaacagcctttaaaaaatctcatgatgaacacctcgttcatcggccctacttatctataatgagggctgaatcaatctttctacctttaaatctatactattttgtcatcgcatgtgtctactttaatacaacgatccattattacagtatagtctttttcttttaaaaatctgtatgtatcctcatcttgtactcctaattgtgcccaaaaacatctgcatcatctctacaaatctttgcacatccataaaactctgagcgac

SEQ ID NO: 209 - DNA, 576 bp, Bacillus thuringiensis
ctcgaaacgcgagattctcacgcaggcgatcggcacgtatgtgctcgacagcatctccggcttcggcggagccaacggcatgtgggattcatggcgcgacaacttccatctcaaacttgattaggcggttcatttcaactgcgtattccattggaagttcgcgagtgaatggttcaatgaagcccattacgatcatttctgtagcttcttgctcagaaataccacggctcattaggtagaataattgttcttctgatactttagatactttcgcttcgtgctcaagtgaaacgtaatcgtttttgatttcgttgtaaggaattgtatcagatgtagattggttatccatgattaacgtgtcacactcgatgttagagcgagagtttttcgcttttggtccgaagtgtacgataccacggtaagttactttaccaccatgcttcgcaatcgatttagaaacgattgttgaagacgtgtttggtgctaagtgaatcattttcgcaccagcatcttggtgttggcctttacccagcatcgcgatagataatgttaaaccacgagcgccttcgcctttta

SEQ ID NO: 210 - DNA, 549 bp, Bacillus thuringiensis
tattaatgttttgtgccccggttatattgacacccctggacttggtagtgttaatcctgaacagaaagaatatttagcttcacttcatccacaaggcagacttggaacaccagaagaagtcgctaaagctgtcttatttttagcaagtgatgatgctagttttgttaacggtacaacacttcttgttgatggaggctatactgcacgttaatttaaaaattttgaagcaccctaagaaatatatagtcttcaacaagaaaaagcgccatcacaagtgacggcgctttttctatgtaagagcaactagaaggtatccttctagcctactcccatttataagtccaaaactgttcaagttgcagccattttaatgttgctgcatctttgttttttatttttgcatgcgtgtcttcaagcattgcttctgtttgtgaacggtgcgcacctaatgcagctaatttatgatcaaatacttcactaatgttatttacaacatccggttcttctatactgcttcacgattcttcgtattcgcaacagcatggatac

SEQ ID NO: 211 - DNA, 633 bp, Bacillus thuringiensis
cgggcaatgctttaatcgcagaaatgaacatggctggtactgtagcgattcaccttgagcatggtgcaagcttcgataaatgtgatcaagcaatgcgtgcatgcttgacatctgtaatgatcgtcgcttctcaccacccattgcgaagaatacgtagaaactactaaacgactagtacaatacgcacacgctccgtaacgtatctgcagaagctgagcttggaacatgtgggggacaataagacgacgtaatcgctgatggcgcaacttacgctgacccagcagagtgtagagcgccttgttgaagcaacaggtatcgattgcctagctccagctttaggttctgtacacggtccttacaaaggtgagcctaacttaggattcgctgaaatggaacaagttcgtgacttcactggcgtacctttagtattacatggtggtactggtatcccaactgctgatatcgaaaaagctatctctttaggtacttcaaaaatcaacgtaaacactgagaaccaaatcgagtttacaaaacctgctcgtgaagtatttaacaaaggaccagaagttgacgatcctcgtatatctatcggacctggccgcgacgctatcaaagcaactgttattggtaaaa

SEQ ID NO: 212 - DNA, 567 bp, Bacillus thuringiensis
atgtctctaacaagtattcagcatcaatggtataaaatgggggctaattataaagatttatatgataatatcgatcaaatgcaagaacataaactttcgttaatacctgacgatttaaaagctgctaaacaaagttggaatgatattcataaggatgcagaattcatttcaaaagacattgcttttaaacaagaaaaaacaaactagaaattaatatatattcataggaggaattaaagtgaataataattttccttataaactacttgctgtatcgacgtttttaaccctgacaacaactactgtagtttcaccagtagctgcttttgcaagtgaaagtaaaatagaacaaaccagtacggaagatatatctctttctgtaaacagtgaaaagatgaaaaaagctttgcaagatgctggggtatttgcaaaatccatgaatgattactcttatttgttaattaataatccagatgttaactttgaaggaattgatattaaaggatatacaaatctacctagtcaaattgcacaagatcaaaagaatgcaagagagcatgctacaaa

SEQ ID NO: 213 - DNA, 822 bp, Bacillus thuringiensis
gtatgaatccacaaggccgcatcattcgaaagtacgaataaggtttagttatgcctgacggtcaaaattttcgggaacaaggaactggcacttctaacttaaatttcactttatttattcctcgctattttccaactctcaaagaagcaaatgcatacgcaagttcaattattgaaggcattaaccaaggacgagatcggattgttatacagcgcttagaggacttactaaagaaacaacctacggtggaaaacagcatggagcataatcgtatacagcctacactacagggggattatggagatttgaatcaagaaattcctcaatcatatattgaagggctaaaagaatttttattacgcttagaacaatttatacaggagcctatcgatcaacatactttactatatggaattgatggaaagttctatgctcctacgataaaaattaataatcattttgaaactagtatacatgggctatttttaattggagattgttcaagcgttacgcattcattatctcaagcagctgcaagtggtctggatgtgggaaagtactatctgacatttaatttctatcattaaaatatcagtcaaatattttcaatctcaaaacactctacttatatatagtaaaaggatattaataagacccctatccatccctgctaatgatcaaccgacaaaaaaacgggattttacaaaatacatatgtaatataactgtaaatataaaacgattggcaatcaaaattaacaaatagaatgtcaacagttctaaaagtctctatccatttacaattttatttgcgagatatttt

SEQ ID NO: 214 - DNA, 463 bp, Bacillus thuringiensis
cctgagcaagaacaagtgcttagaaaccatgctggtgctgcaagatttgcttataactattgtaaaagaatgagtgatagatactataagctatttggaaaatctgtgaaagtgttacgcgcacgtgtttatgataagtttagacaagaagcgcaagctgagtatgatcaaaaccgtataccaactgctggacccaggcagcgtgggaagaagttaccgtaacctgcatctgcgataacagaacgagcagcgttgtcgattgcgccaagtgtaacacctggtttacatgcttcaactgcttgtagttgtccagcaagtacagtgtttgaaatgcgagtttgctcttcagaaatttcaccgaatgctactgtacgtgttatatcagagcaataaccatcaatgattacgcctaaatcaaatagtacgaaatcgccgcgtttcattttgtttgcgccaggaatac

SEQ ID NO: 215 - DNA, 589 bp, Bacillus thuringiensis
gtcgaattcgtgagttcggtgtatatagtgatcttcatccacatacaattactgcagaagaaattaaagcaatgaatccaaaagggattattttctctggtggaccaaatagcgtatacggtgaaggtgcattacattgtgatgaaaaaatctttgaactaggtttaccaatcttcggtatttgttacggtatgcagcttatgacgcaacacttcggtggtaaagtagagcgtgcaaatcaccgtgagtacggaaaggctgttcttaaagtagagaacgaatcaaaattatatgcgaaccttccagaagagcaagttgtatggatgagccatggtgacttagtaactggtttacctgaaggattcgtagtagacgcaacaagtgagtcttgcccaattgctggtatgagcaatgaagcgaaaaacttatacggtgtacaattccacccagaagtacgtcactctgagcacggtaacgatttaattaaaaactttgtattcggcgtatgtgggtgttctgaaggatggaacatggagactttatcgaagttgaatagaaaaaattctgaaactgtggagacaaaaaagta

SEQ ID NO: 216 - DNA, 721 bp, Bacillus thuringiensis
gctgcaacgcatccagaattggagacccagattcgcgattgtgccttagtctgattccattctgaccatcttttgggtcatatcatactgcttataccttgtccagtggctgacgcaaaagtctgatcaacttgtaagtgagattcaaacatctcttgctccgaaagaagctccaaaacattataacgggcaagttagaaaagtcgcttatttaacatttgatgacggtcctggaaaatacacagctgagcttttagatatgttaaagaaagaaaatgcaaaagcaacatttttcctaattggttcaaacgtaaaagctttccctgatcttgtaaaacgcgaagatgctgaaggccactacgttgggatgcacagtgtgactcataactacaagaaactttatactgaaggctattacgtagatgaaatgaaggaagaccaaggcttaatcgctggtgttttaggtaaatcaccagtattaactcgtccagcttacggctctatgccaggattaaacgaagctcttcgcaacaaagttgtagacaatggcttaaaagtgtgggattggacaattgattctttagactggaaatataacaaaatgcaagttgatgctgcatcagctaaaattgtagaaaacgttctagctcattctacaaacccaacagaagttatccttatgcatgatattcatccacaatcagtaaaagcagtacctgga

SEQ ID NO: 217 - DNA, 1117 bp, Bacillus thuringiensis
taaaacatatacatttgatgatggatctattgtttttaagacaggcgataaagtaccagaagaaaaaattaaaaggttatattgggcagccaaagaagtaaaggcacaatatcaccgtgtaattggaaatgataaagcactagaaccaggtaacgcagatgatgtgctgacaattgtaatttataataatccagatgattatcaattaaatagacaattatatggatatgaaacgaacaacggcggtatttatattgaagagaagggtactttctttacatatgagcgtacaccaaaacagagtatttatagtctagaagagttattccgtcacgaattcactcattatttacaaggaagatacgaggttcctggtttatttgggagtggagaactatatcaaaatgaacgcttaacttggttccaagaagggaatgcagaattctttgcaggatctacacgtacaaataatgttgttccacgtaaaagtattataagtggcttatcatctgatccggcaagccgttatactgcaaagcaaactttgttcgcaaaatatggatcatgggatttttataattattcctttgcactacagtcttatctatataatcaccactttgaaacctttgataagattcaggatttaatccgtgcaaacgatgtgaaaaattatgacgcgtatcgtgaagcattaagtaaagatgcacagctgaatacagaatatcaaacgtatatgcagcagttgattgataatcaagataaatacaatgtaccacaagtaacaaatgattacttaatacaacatgcacctaagccgttagctgaagtgaagaaagaaattgtcgatgtaactaatataaaagatgcaaaaatcacaaaacatgagtctcaattttttaacacatttactgtagaaggcaagtacataggtagtacatcaaaaggtgagtctgaagactggaaaacaatgagtaaacaagtcaatcaaaccttggagcagttgtctcaaacaggatggagcggctataaaacagttacagcctattttgttaactatcgtgtgaatgcagccaatcaatttgaatatgatattgttttccatggtgttgcaaca

SEQ ID NO: 218 - DNA, 791 bp, Bacillus thuringiensis
tttcaataggaaatcatgcttttctctcattattgacgctttataaatttcgctaaatctttaaatttcactttatctgagtaattcattacgccgtttacgtaaatgcggcttgtaacagcatttaataccgcaattgtcgccaataagactgctaatgttatcgtaatttctagcatacctgcttcaccagctacaatacgtgagaaggtaaccatcggtgtaaaaaagggaacgtaagaatttacaacgacgatagtactattcggatcacttaatgatttaatactaataaagaatgcagccataattaaaatcattaccgggaaagatacagcttgtaaatcctccgtcttagacacgacagctccagcagcagcatacatcatcgcataaagtaaatatcccgtaatgaaataaacaagaaacatgctgataacctatgcatctaatttcgtaaagtcaattggaataccaagtagtgaggcactttctaaatcgacccaacctaacaaatatggaataagataaccacacgccaatatgtcaaggtgcaataacgccgttgaaacaaccgctaaaattttcgcatacatcatcgtaagaggcttcactttcggaagcattacttccattacacgtgacgccttttcacatgcaatattcatagcgattgtatttccgaacgctacaataaacatatataaagcaaatgtaaagaaataggcaattccgaaagcagctgtacgatcttacaacgccccccgctaaacttgaatttctgttagtaa

SEQ ID NO: 219 - DNA, 642 bp, Bacillus thuringiensis
tttaattctatcttcacaataattccaatcactagtggtagcaccgtcttctgctgttgattgattccttgtagcatagcagccgttactgtaaaaagagaaaatagtatgcaagcaggagcataatactgtaaaatgattctccccatctctggatcatttccagcaccaaataaaagggtatatacaggcttggctaacaccatcattccaattgccgccggtaccgtaatcgctactactaatacatttgttctcgtaaaatgtttgtacaatagcttcgtatttcctgctgtataagctttcgtcatctctggtacgagagacatactaaaagctgtcgcaacggataccgggataagcacaaccatttgaacaaggccaattatcgcattaattttttccgcttcgccttgcatataccctatctgtataagtagtttattaattgtaaatgtatcaatcgtctgatacaacggaattgctaagcctactacaacaaaaggaatagaatatgtaaagagctccttataaagtgagaaaaaagatttcgttgtttgtggtatacttgccatttcttttttctttaagtgccttctccttctcatataatacgcacttaaaacagttaatccacctaca

SEQ ID NO: 220 - DNA, 671 bp, Bacillus thuringiensis
tacttcggatctcctgcatgtggatagccaatatatttcatatgaacacgaatttggtgcgtacgtcccgtttctaagcgacattctacaagcgtaaagtctttaaagcgttctaacacttggaagtgcgtaacagcgttcttaccattttcatcaactgtcatactttgacgctctttcttatcacgagcaatcggagcatcaatcgttcccttatcatgcggaatcacaccgtgtacaatcgctttgtaacgtctcgttactgtttttgctacaagctgatttacaagcgattcatgtgccatatcatttttagcaaccattaatagtccagatgtatctttatcaatacgatgcacgatacctggacgcattacaccgttaatgcctgataagtctgtacaatggtgcataaggccgtttacaagtgtaccacttgtatgccctggtgctggatgtacaaccataccacgtggcttatttacaacaagcacatctgcatcttcataataaatttctaaatttaaatcctctggttgaatatctaactcttctggttcaggaattgttactgtaatttcatcttcttcttttactttataattccctcttaccgcttttccgtttactgacacaacgtcatctctaatcctttgctacactcgcttaca

SEQ ID NO: 221 - DNA, 510 bp, Bacillus thuringiensis
actgctttcatgtgcatctttcgggctaattatattcgttactttctttcattctattaatgagaatgcatcgatattaataccgttatttacatttggcggaggagtattagctgcatttcttattattttacttgcgagtgatcgatcaaaaggtttacttcccattagacttattctcgttggtattgcggtttcagctggctttagtgcaatttcgttatttttctctctcaagttaaatgatgagacatatacattcgcttctagatggttagttggtaacgtgtggggaagggattggattcatgtccttgcattattaccttggattttcatactaactccgtatgcatggctaaaatctgaaacgttaaatgcattgtcactcggtgatagtgtggcagcgggacttggtgtttctgttcaaaaagaacggttactcctttagctacagcggttggattattttgcgcgagtgtttcgatggcaggagggattggtttattg

SEQ ID NO: 222 - DNA, 808 bp, Bacillus thuringiensis
attgcgggctctcaggatgtttttcatattttataaaacatttaataaaggtatgaacgctccaaagtataaaggtacagaatgaccaaactttgcaagtaagcccccaagagttggtccaataatagttcccgcacctacaactgcactcacccatccaaagtatttcgttctctgctctttcggaatgatatctgcaaaatatgcgaagatagtacttatgctcccacctgttataccttctattatccgtccagcaaataatacccataaagctcctcctatgccaaaaactaagtacccaattgcagaaccaaataagcatattaaaagtaatggacgacggccatacttatcgcttaaagccccgagtgctggagcagctaaaaacacgcaggccgcatatacggaagttagtagtgtaacaaccaatgcttgttcttccggattgcttgtatatggctgtactaagaatgggactacaggcataatgatactgaaacctataccacaaagaaatacagaaataagtccgaatagtaaagcatgtttatctatgcttttttcagtttccctttcattttgtgatctaaatatagacatttaacttctctccttaaaatgttttgttgctttgtcaacaaaatgataactctgttttgttgattagtcaacaaagataaaataataaaaaagcagcctattctcatattagagtaaggctgccattttattattaaaatgtattacgatttaatatgtataccttgtttctttatttctgcattcaaatgtctactatactttt

SEQ ID NO: 223 - DNA, 578 bp, Bacillus thuringiensis
aagtcacatccaaatccctcaaaaaatagggcatcattttatggggggagatgaagggcctgcattgaaaggaaaagaacatgtatcgttagcagaaggaactttaggtatttccatgcgagtgtttgtaccaatattttctgaaacaggtgaacaacttggagcagtggctgttggtatttcagcagataatgtaaaagagagagttaaggaaagtagacatattatttatattggtgtcggagtgggtgtattagtcggaattataggagcaatattgctagctagacatataaagaaaagtttattcggtcttgagccgcacaggatagcaaaaattcttgaagaaagaaatacgatgctacaatctgtaaaggaaggtattattgctgtagataaagaggctagagtaacgttaattaataatgaagcgaaacgtctatttaaaaaaagcggacttgaagaagattttatcggtaaagatgttgagttgtatatgccaaattcacgtataaaagaagtattgcaaacgggagaagtacaattaaacgaagaacaaaatatttatggaattacga

SEQ ID NO: 224 - DNA, 679 bp, Bacillus thuringiensis
tttgactttcaccccgtggtatgccaattctcgcaaattgttttaaaagtgcaccgtaagctttttgataaacagcatcatcttttcggtatttatagaaatgaataataagaaatgtcctccatatcattctagtggtgaagagaatgtatcccataatactaattagtatcgtagagaggaatacgtaccaccaagaaaaactagtttgagaatttgtgacctttttagtagaagcttcttctgtattttctattaaacttttaagttttgcttcattatttcgtttttgtatttgcgtgttattagaattatttgcttcgctattttgtgaaataggagcaggcgtattatttataaaattatagggattagtaaatccttttgttggttcgaatggaatccatccgtatcctgggaaatatacttcggcccaagagtgtgcgttatcgttcgtgattgtataaacattctcaccttctgcagaggcaagtgtattgtcaagagttccttctgtatagccttttacccagcgagcaggaatcccggcagaacgaagtagtacaatcatagacgtcgaaaaattattacagtagccgctttttgtatcgaaaaggaattgatctacataatcttggcttttggcagggaataagacattccttgaatcgtatgtaaa

SEQ ID NO: 225 - DNA, 917 bp, Bacillus thuringiensis
  unsure (1)...(917): unsure at all n locations
ataaaatcgaacgtgtttaataataaaaaaaagagccgataggctctttttttactataacaatggaaaaagcaccggtgataggtgctttttttaatcttttttgaaggtatttaacattgcacgaactattccaccaagaaatttaggtaacttaattgtataaaatctcatggtttccctcctaatccccattactccacttggtcactatatgatgtaaggagcaaaattgtttcttcaatcagtgcttcttatcaacattaatatgccagaagtaaatgaaaaagtacctttttcctcaacgagttcgttactaatacaaagtgttgatccccactctattgttttattagtaagagggtacttaaaaccaaacaatgtaatcccttccactatttcagtaactggtacaaaagatacataaggaaaatttttattttcttcaattatatgtgtacccatttttttaactgttatttcatttttattgtccacaatacacatttctatctctacttctaacccttttaaaagcatctgtatatttgccaaaccgtgatcaagccttccaccagtagcaccaaaaatacgaattagtgtcggcttctgttctaatgcccagttgattgcaatttctaaatccgtttgatctttttcccgcggaacaatatgtaattcgttcgtttgctgtcccatccatactaattcttcttcagtaactgaatcgtaatctccaaacgcaacagccgnggtaatccctttctttaaagacggtatactcccctatcaaccgctgcccacactacttcctcattctcgtatcgagcaaaatctgcgaaactgttaccacgtctatatgatgtggatcaaggtgaaatatgtatagatggaatagatgttaaaacatatgattt

SEQ ID NO: 226 - DNA, 697 bp, Bacillus thuringiensis
taacaaattcagtgtgaacttaatgatgaattaggttttaattatcaggactattcattaagcctttaatttttaaatacaattgtatccataaaacaaaaaaaacgctattctttttgtagaaatttacagaaaggatggcgtttttgtatgaatctttcgattcaggatgagtttcatttatttgctgaggagctacagcgatatctatatccacatattctttaacaactcgcacaggaaacaagttttgtaaaacggaaaagtaagtatggcgcacgagatttggctgctttatgtatctggattaatcaacaggtagcaagcaattctcttactcgattatgtagccaattttatgcaaatgcaaatacagctacatttaagagtccacaaggacttaattaacgtttatattaccaataaatatcccatgggaaattgttccgatggaacaggttcatgctatctactcaatacgttggcaaatagagattgtatttaaaacatggaaatctcttttgggtatcaatcattgtcacaatattaagcaagagcgtctagaatgtcatctttatggacagttaatcgctatttttctttgttcttccactatgttcaaaatgcgacagctgttactacagaaaaaaccaaaagaattaagtgaatataaagcaatttatatgattcaagatca

SEQ ID NO: 227 - DNA, 453 bp, Bacillus thuringiensis
ttatgaggctctaattgctgctgagacagtgccttttaaagagtttgaaaaagaaattttctttgaaggtagtatgccagtagaggttatggcaagtagagggagacagacgttagtatttggacctatgaaacctgtttggattggaagatccaaaaacagggaaaacgccatatgctgttgttcagttacgtcaagatgatgcagcgggaactttatacaatatcgtaggtttccaaacacatttaaagtggggaccgcaaaaagaagtgttacagttaattccaggattagaaaatgcagagattgtacgttatggtgtaatgcatcgtaatacgtttattaattcacctaatttgcttcgtccaacatatcaatataaacaacgggatgatttattcttcgctggtcaaatgactggagtagagggatatgttgaatcggcagcatcag

SEQ ID NO: 228 - DNA, 1129 bp, Bacillus thuringiensis
  unsure (1)...(1129): unsure at all n locations
tactatttatttttagtaaagcaagaagagcactatgatgttgtcaaggtagaaacagttgatacgaatattgaatattatacgaaggcttataaaataagcagttttaatcatactgcgtatcaaatgtaaaaaaactcccttttgggagtttttttaggaggcttttacttcgtgagattcggttactaatggaacttttttcgtaccgcttaacttagccattgcaagaccaataagagctcctgctaatgctggtattagccaaccgattccttcattatataaagggataaattcaaaatatggtgtgataaatgaaactgaaataccaccttgttttaatccatcaaatacgctcactacagctgctccaattaaagcacctacataaacagagcgatatccaccgaagtatttatgaagcaatgatagtagtacgagtacaatcgcaattggatacacaacaagtagaattggaacagagaatggcgattttttttcggtaaacctaagttgggaactaaaaaatactaatgcggcaaatgatgctcgcgaacgttttgtatgaaaaatgtaggcaataatgtcgaaaaatattggctgcacgcagatacgagtccaacgcatgtcgttaaacaagcgagtgtaacgataagagataataggagcaaaccgtatggaccgaataattgttgtacgataacagtaagtagctgtccgccattttttgcatatccgagcgagacgctagttgccccaagccagccgagtgcaccgtatacaagtacgagccctgtagaggcaataagccctgcttttgctgtggcgatggcaatggacttacgatcattcacacctttagagcgaattgcatttacaacgataattccgaatgcaagtgctgaaatagtgtccattgttaagtagccttccataaagcctttgaagattggagaagtttgatactcttgcattgctggtcctgattgcccaagtggtgtaaatacacttttaacaaacaataagaaaatagagagtaataaaataggtgttaatacatttccaatccgatcaaccagtttagatggattcnnactcagaataataatncgaataaataaagaag

SEQ ID NO: 229 - DNA, 227 bp, Bacillus thuringiensis
taccaggtaaggtcaatgatgaaccaatgatggacatgaccgccgccagtgcgatgatattaaaggcaagggcaatgttagcaatcacaccgcaagcacgataaaatacaatcatccataaaaatacaagcagatagccaattttagaggcattaagccctttatcaatgttgtcttgacccagtgatggaccaatggtacgctcttcaacaaagtacatgggtgca

SEQ ID NO: 230 - DNA, 759 bp, Bacillus thuringiensis
tttcgttcattctctttataagggatcatcttgtagtaaatatagcgcattctaacacacatcatttcagatatataatcagactttttatgttaacaatggtagtatgtatctccatatccataattatatttaaaaaggcaatttgtgttcaaaaaaactcctatcattcatacataacttaataaaaggcattctcaaaattaacatcttgagaacgccttttatttctaatctttttgataatgtaataattctttcgctgtatgctgatcgataattaatacatttgcatacccgccacgtaacgcaccatcaattgcttttatttttctattaccacctgcaactaaaatagagcgtttctttaatttcagttcctctaactcaattccaattgtacgctgattaatctcttcgctactaatatttccgtctccatcaaagaaacgtgaacaaatgtcaccgaccgattgttttttgagtaaacttgtttcatccttatcgaaataacctaatcggaataatagcgcttcgtctcgcactgttcctacagtgaaaactgcaatattcgcttgtttccccatttcaataatgtgatgaatatgtcgatcctgctctactaattcttttgtcactgcattatcaaatataactggaagaggtagatttcttggcgtcgattgaaaagcatctgcaaataaagctatcgtctcattcgcatatgtatttacacttgaatgactaataccacccttt

SEQ ID NO: 231 - DNA, 654 bp, Bacillus thuringiensis
agcaaatgccgcttgaaattgtaaaagcatttgcaattttaaagaagagtgcagcgcttagcaatcaaaaattaggaaagctatcagaagaaaaagcagaagcaattgtagaagctgcggatgaagtgattgcagggaaatggaatgaacattttccgcttgtcgtatggcaaacaggtagtggtacacagtcaaacatgaatgtgaatgaagtaattgcaaatcgtgggaatcaaattttgaaagagaagggatctgacgtacatattcatccgaatgatgatgtgaacatgtcacaaagttcaaatgatacatttccaacggcgcttcatgtagcttgtgtaatcgcagtagaaaatcacgtattaccagcaattacgaaattaaaagaaactttagcagaaaaagtaactgcatttgaacatattataaaaattggtcgtacacatttacaagatgcaacgccgttaactttagggcaagaaattagcggatggcaccgtatgcttgaaaaaacagagcgtatgattgcagagagcaatacatatatgaaagagttagcaattggtggaactgcggttggaacaggtattaatgctcatcctaagtttggtgagatggtatcagaggagattagtcaatctacaggtaaac

SEQ ID NO: 232 - DNA, 721 bp, Bacillus thuringiensis
atcccaattcggatacagtcgtcaaataggttctgtaggctcatgctttcctttgcaaggatgacaatgatgcataggggtttctctcctctctcgttaaaaaaatctgattacactttacagtatgagaaaagagagaaagccgtttgttatatatacccatttattacaaggaaatttgtctagtcctttatttcatttacattgtttttatagacaatccttcaacatcacttaccaaaaaagcctccaacttgctttacaatacctgtcacttgattcatcgcattcatcatttgtccagctgtattcatcattttatttacatcatagttaccatctgatgttttaaattgagaaacaaaactagaaaactggcttggctgttgttgcttttgcttaccctgcgtcgggtacggttgttttggtggataaaacatcgcttgttgattagcatacggcgatggtggtggcatataatattgcgaattcatataaggctgctgctgtggttgattcatgtatggttgctgagcttgattcacataaggttgctgctgttgtggttgttgagcttgattcataaaggacacttcaaacggttgataataattttgatttccataataaggctcgaaaggatacatattataccgtaaatatgtattcgtattatattggtacatattttgctgtgcctatggaatcgtttggtgatata

SEQ ID NO: 233 - DNA, 735 bp, Bacillus thuringiensis
acttcgcggcgattctcaagttgtattgcagcaattagccggagaatggccttgttatgatgagcatttaaaccattatttagatcaaattgaacaaaaggcgaagcaaatgaaattaaaacttgtatgtgaaccgatatctagaaaacaaaataaagaagcacatcaattagcaacgcaagcattagaagggacagtcattgatagtcataaagaaataaccgaatagagaggtgcaaaggtggataaaaagcaactcattacagaggtaaatgacttattagaaacatactgtgaaggatgtttcttgcgagaacataatcgaaagacaaatagtaagtattatgctcattcattttgtataagacaatgtacagttggagaaacattgaaaaagtatggagaacagttgtcataaaaaaacatccagagaaaattctctggatgttttttagtgctttgcttcgtttaattgctgctcgcatttgcttagtttcttttcctcgttcattaaaaatggttaatctaaatctactgcaacagatttcataatttcaagctgtgagcgagctgcttctattgtagtagtggcatgctctaacgcgcttggatccattgaaaaagttgcagaacctacccttttttgtgctgtttttacacggaattttacttttttaaaatcatttacttttgatcccattgttactgccttctttggttatatgggcattttac

SEQ ID NO: 234 - DNA, 1415 bp, Bacillus thuringiensis
  unsure (1)...(1415): unsure at all n locations
ggaattgtagagtatgatactgggggtgtctttgattacgatacattagtacaagcaattaatgaaggagatgcagatacattaaaagaaggcattacagatttacaaggtgagattaaaaaaaaccaagcatatacaaagaatttaatacaagaactagctaagttaagagatagtattggagaagatgtccgagcatttggaggtcataaagatatcttgcaatcgattttaaaaaatcaagcatctggaatagatgaagatgaaaaacgtctaaatgatgttttagagcaagtaagacattttaaacaagtagaatcggatggaataataactgtatcagttccctcaatccctacatggattgctggaggtgtaatgataggggtagcaagaaataatttaagtacgctggaaccgctattagcgcaattgcgccaaacggtagactatanaattacattgattcgtgtagttggaggtgcgtataataatattgctgaaatgcataatgcaatggatcagctattaatgctctcacctatagtcagcacaatggcatgatttagattctcaatattcaggagtacttaatcatattgataaagcatcccaaaaagcagatcaaaataaatttaaattcttaaaacctaatctgaatgcagccaaagacagctggaaaacattaagagcagatgcgtttacattaaaagaaggaataaaaacattaaaaatggatcctgtttcttcaaagaaataggaaagtatggttttattgttaagttttctaaaatatagagattttaaaaacatactgttaaataattaaatgattcgttatatatagaaaaggtggagttgtattaaggactctaccttttttgatgatatgcttctaatgagctaaaactttttgttcatttatttacaagaaggtgagattatggtgtatgtcattccatacgccacattcgctagggatgatattagttatttcttagcaaagcattacgaggaaattggttaatgcgttttggtgatgataatgaggagctcgatgcatttaaacagtgtatcttcattgggcgtaagcgtgctgctaagaaaaatgatacatactttaacgatacgctaccctatatcgatcaagctaagataaacggaaattttgtgttttttatagtatcaggtccatttttgttgttttgggggcacttcaaaatgttagctttatgggcatgagggctgtaaccaaaacacacggttagttagtgggggtgttcatctgaattttctattaaattaatctcaagtttatgaagatatcaagattaatgttgtgtgatagtttagaagggaaagaatatagataaatttgaaaaggaggatgcatttgggatgttcaactactataa

SEQ ID NO: 235 - DNA, 809 bp, Bacillus thuringiensis
aatacaacctatgaattccccctagacttttttgaagaattggcatgccacagagggagagttaacattgcgtggggtctctatccatatcgatactctttacatctcgggcgttgtgcaacaactcactgccaactatgagaatgctatgtataaacaggggcaggttgcagcagaatggaagaaaaccgtacacttatgggaagtgcttatgaaaaaagcagcttctctacctaaatcagatgactttgatacagtaatttaatcttgaaaatgggagtttaaagaaaacgtctcaaagaactacattgttctttgagacgttttttaataaagtgaaactcctaattattctccaagtaccttctcaatctcaacctctaaatctaccggcttcgtctgcggcgcaaaacgccctactactttcccgtcttttccgattaaaaacttcgtaaaattccatttcactgctttcataccgagtaaacctggtgcttgttctgtcatgtatgtatataaaggatgagccttatcacctttcacatcaacctttgcaaacattgggaagtttacaccgtagtttaattcacaaaaactagtaatatccgcttctgtacctggttcttgtcctccgaattggttacaagggaatccgagtatttcaagtccttggtctttatatttatcatacacctcttgtaatcctttatattgcggtgtgaaaccacatttactagctacatttacaataagaagtgcttttccttcgtattttataacgattttcttcaccggtattgtttagctga

SEQ ID NO: 236 - DNA, 638 bp, Bacillus thuringiensis
cagatcgaaaaaactttgcatatggtacgcagcgtgattattttgatcatccagatgtgattggctggacaagagaaggtgatagtgtacatgctaattctggtttagcaacattaatctctgatggaccaggaggggcaaagtggatggatgttggaaagaataacgcaggggaagtatggtacgatattacgggtaatcaaacgaatactgtaacaattaataaggacggatgggggcagtttcaagtaagtggaggatcagtttccatatatgttcagcagtaatttggtgatgaaaaagaagaggtagactgaaatataagttttcctattcctttttacattctgtatagttataaaagtatgacacctttacttctcacgtaacatatagtatgatgatttcaataaattagatttcaatgactataatataaattaatgagaggtgctttttgtgagtgcggtaggtattaaataggaaaaatttaatgaaataaatcggataagaccagggtatttttatgtacatcatacccctattttgtcatgcatttatttcaaaacctatgaagatacctacaatactttataaagcgtgtaataagggactgccatctattttttatggcatat

SEQ ID NO: 237 - DNA, 494 bp, Bacillus thuringiensis
tgaatataatgtagttgttccgagcgtaaatattttatgactctctgaaaggtagatatatacgaattccgaattgctgttcattaattttagaagttcactaatggttgcgcttggcacaatacaatttgcttttacatctgaggaaagtaatgtttctcgtatcgctagtctatgtgagtcagttgcagcgcaaattaacttattattagataactctatatgcaccccagtaagaacaggtctagattcattttttgctaccgcaaagactgtttgtttaaatacttcaatcaattgctctgtctctaccttgatttctgcatgattgtctataagcggtacattcggaaactcatctgcaggaaatccatttaaacttaatgtgatttcttctgattgtatcttaatagtttgctcattcttactttttattgcgatatcacttggcattttctttattatttcaatgaaatactttgcaggtacaacca

SEQ ID NO: 238 - DNA, 608 bp, Bacillus thuringiensis
ggattggaagctaggatttattggtagaaacggacgaggtttaccgacattctttaatttattgttagggaattatgagtatagcgggaaaatccttgcttcagtagaattcaattacttcccctactctgtttcagataagaacaaattcactcatgaaatccttgaagaaatttgtccccaagccgcagattgggaacttctacgtgagatatcctatttaaatgttgatgctgaggtcatgtacagaccatttaaaacattatcaaatggggaacaaacaaaagtgttgcttgctgcactgtttttaaatgcgggtcaatttctattaattgatgaaccaacaaatcacttagatacagatgcacgaaagatagtctccgattatctaaggaagaaaaaaggatttattttaatttcacatgacagaatctttttagatgggtgcattgaccatatcctatctattaatagagcaaatattgaagttcaaagtggtaactattcttcttggaagttaaattttgatagacagcaagaacacgagaaggctacaaatgagcgtctacaaaaagacatagggcgattaaaacagtcttccaacgttc

SEQ ID NO: 239 - DNA, 1026 bp, Bacillus thuringiensis
  unsure (1)...(1026): unsure at all n locations
tacggaaaagttgattacttaacacagcatttagaaatcggtaagttattaaacaaagaaaaagaagcaaaaacttgggttgatgacttcaaaaaacgtgcacaagacgctggtaaagaaattaaagcaaaaatcggtgaagatgcaacagtttctgttgtagaaaacttcaacaaacagctttatgtatacggcgaaaactggggccgtggaacagaaattctgtaccaagaaatgaaattaaaaatgcctgaaaaagtaaaagaaaaagcattaaaagaaggttactacgcattatctactgaggtattacctgagtttgctggtgattacttaatcgtaagtaaaaacaaagatactgataactcattccaggagacagaatcatataaaaacatcccagcagtaaaaaataattcgcgtatacgaagcaaacatgatggaattctatttcaacgatccacttacactagatttccaactagacttcttcaagaagagctttcttggtaaataatacaaacatgaggaattcttaaattaagaattcctcttcctttattctatgaacagaaaagatgtgaaaacgaatgacaaaagatcacgacaatccacgttctaatagcttttacatacaaactaattttaagcataattgcattctttcttatttttatggtggcaatggtattaggggctgccgaatacttcaaataaaagatgtatggttagcgctcacttcctctgctaaaggggacaaaatatctattattcgagaaattcgtttaccacgtgaagtagctgcaatttttgtaggagctggacttgctgtttctggagcaattatgcaaggattaacacgaaatccgcttgcagatcctggattactagggctatctggtggagcaaatgctgcacttgcactgacacatgctttcaacccatccatcacctatctttacttaacattagcttgctttaacggtgctgcaataggtgcgattatggtatttggaatcncgaatt

SEQ ID NO: 240 - DNA, 826 bp, Bacillus thuringiensis
tcgtgattgctagttgcacccaagggctcattaacatatcctgtaaataaataaacgacgtaaatgagagttgactaaccattgcccacaataatgggaaagataaaataaacgaaataataaacttcttcttttgtctttcaatttcttgtaatcgatgatcagttgatgcatcttgattatgtggtttcacttctaatttatatcctagcttcgtaatcgcactcttcatttcatttacattaacttcatcaggattaaagtctactgtagctgattctaaagcaaaatttactgtcgctttgttcacaccatctaacttatttaagcgcttttcaactctatttgcacatgctgcacatgtcattcctgaaacagtaaattcagctttatcacttacaattccatatcctaacgattcaactttttctttaaactgttgcggatttgttttagttggatcgtacattatttttgttttttcaagtgcaaaatttacattcgcctcatgaacaccttctactttttttagacctttttcaattctatttgcacatgccacacatgtcattcctgatatttgaagattggcctcttttttttcattcatgtctctcacctctatatacccttatgaggtataattattagcaaaataaatcgtacttcatttaaagtacgatttatttccatatctaaaaataattattgaacatcgtatccttggtcttcgattacagcaacgatatcttttaatgttacggcagacgagtcgatagtaacttcaacagttccttctgctaattgaaccaacacatgttcaaca

SEQ ID NO: 241 - DNA, 500 bp, Bacillus thuringiensis
aaagaacatatattactacaagatccgaaagaaaaaggaaaagaaaaacgccgtgaactcgtttctcaaactcatgatattgtcttattcttcggtgataacttatctgatttcacaggttttgatggaaaatctgtaaaagatcgtaaccaaacagtagcagattcaaaagcacaatttggtgagaaattcattattttcccgaatccaatgtatggcgattgggaaggcgctttatatgattatgatttcaaaaaatcagatgcagaaaaagataaaatccgtcgcgacaacttaaaatcatttgaagtaaaataaaagaggatggttcatagaactgactcggtgcacttaaacctgaggaccatacttcatatcctactataataaccatactctcacgctttaatgaagtgaaatgtcttgcatctgcggcattacgagtggaatttctgttatatgaagtgccgctatttttatttacacctacagctgctact

SEQ ID NO: 242 - DNA, 739 bp, Bacillus thuringiensis
acctgcattttggccaagcatgggagggaaaattaaattacctgccccaaaaaataaagaaaatagcataagacccgtgaaaaaaatatgtttttttgatacagtgttcattgtttttcctccttttttaaattcatttgtaagaacacaaaaaactcgtccctaaagaaagggacgagttatatttacccgcgataccaccctaatttacacatgtagaaataaatctatatgtatacggctttgcaacgtacaacatgatacgtgttccttgtaacgggggacggccggtaagaacttactgtaacattcggttctacttctcggagatgattttcggttacgcgctgaacgttggctttcagcaaatcgccaactctctggggaacagttctataacgtactcgttctcgtcaatgaatttttattcaagtattctgacagtattgttgcatgttttttttagaaagtcaatatgttttttgaaagatatatttatatacggaaatatcgaaagtgatattcgttgttgtaaaggaaatgatgaattgtaaaatgggagtggaaatttgcggagaattgtaaattttatagagaaaattgatatttataggagtgaagaagggattgtttgaatttatagagaataatacaacaatccacttgctggaaagaacaaaccaaaagaggtgactgaaatgcttgcgatgggagtattatttggcattattgctataat

SEQ ID NO: 243 - DNA, 965 bp, Bacillus thuringiensis
tatagccgatataaagagctatctcaaaatttagttgtgttacgggctcattattcaaaaataagtgaaatgaacgaaagtggtatcgttagtgcaaaattaaaagatttatttgagcataatgcaggattaaatattgaggatgagggagagttccgtaaagttgtaacagaaaacttaccacctcagccaaatgcatatgaagaaattcgtcaaacgaatatggggaaaattcatccgagtgtggaagaagagcgtgaaatggagattggcccaaatcgttgtgcagtgcatgagtcattataaaaataacaaattggaggaattgatgatgaatataaaacaagtattagatgcgaaaggtttagcatgtccaatgccgattgtaagaacgaagaaagcgatggatactttgcaaactggagaagtgttagaagtgcatgtaacggataaaggatcagttaaggatattccagcgtgggcaaataaaggtggtcatgaaatcgtaaagcatgtagaagaagctgatgtgctgaaattttggattaagaaggcgtagtaaagaaataattttataaatgtagagggggagttatatgaacacaatattaagtacgcttttcatggtacttgctacatggtttgttatttcgcgctttttaccagtgaaaggtgtgcaaaatatcagcggaaaaaaattaaagaatatagtggaaaaaaaggggaaacaacttatcgatgttcgtacagtaggtgaatatagaggaaatcatatgaaaggatttcagaatatcccgttaaatgagttagctagtagagcaggtcagttagataaaaatatggaagtaatcggtatttgccaaagtggaatgagaagtaagcaagctgcaaagatgttgaacaaactagggtcttagcaagtaataaacgtttcaggtggtttgaatgctttgggaggagggact

SEQ ID NO: 244 - DNA, 937 bp, Bacillus thuringiensis
tcccgaaataacaatacctacagatttttttaacgtaataatttcaataatctttttatttacatttgttaaaacagtcgtgtattttaaaacaccaatagtttgtccttgatgtataagtgggcttagcacctctagttgttttttattacctttcgtagtaacttgattatacatttcaccttctaataatgattgtggaatattcactttaccttctaccttttcaccacttgaagattgtataaccgagccgtgacgatcaattaactgtaattctgttccttctaattgaaagctactaattatgtcaccactatattcttgtaatcgaataaagtatagtgaattgtattctgaaaaaaaacgtgtactcgttttcgcatgagactctatatattgcacaataccattataatagtatcgataaattgagactgaaaatacaacttcaaataatacaagcataagtgtaatgaccgtcataaaatatagagtcactttccgtttcatcttatactttccttccacacatatccttttccccacaccgtaagaataaattcaggttctgatggattacattctattttttgacgtaaccgtctcatatttacatctactactttcgtttcacctacgtaattagttccccaaatcatatttaaaatttcatcacgcgaaactggctttgaagcctgattcattaaatactgtaatatcatatactctgtaggtgttaaatcgactaattgtccatctttatacaatctttcttctataatatttaacgaaaatggacctgacgtaacaatattcgttaattcttcatgtacttctattcttcttaataaagactgtatacgtgcagttaatactactggactaaaccggtttgcaatataatcatctgtacctattttctaagccttgcacc

SEQ ID NO: 245 - DNA, 680 bp, Bacillus thuringiensis
tttttgatcactgcccatgtccataccagaatgatccatgccgttcttatcatcattctttttcgtattttcatcacctttagatttattacctatttgcccttttgtcatttcttttaactgctttttaatttcttctttatctgtaacccattcatccaacagtaatgtgtaatctttatcatatttttcctttgtatcctctacaatgagcgctccatacaaacctctatctaattgatttacagaatcttgatgcgagtgataccagtacgttcctggtacgttcgcttcaaattcgtaagtgaaactttttcctggttcaactgcatcttgtgtcacgcccggaattccatccatgttatttgggacaggatatccatgccaatgaatagatactggtgcagataattcattttttaatgtcactttcaccttttcaccttttttcacccgaatttctggaccaggagatgagccattaaatgtccagactggaacaataacaccgttacttaatttttgcttttcttctttcgctattaaagtaacttctggccctttttcaaccttcaatggtgttgtagctgtttcagtctgtagtgttttgttatcattcatatttttatgatcatccgttgtatttgtcgtcacagaacaggcagcattttaaaattttc

SEQ ID NO: 246 - DNA, 748 bp, Bacillus thuringiensis
gcataacctacaacaactcccgctagtacataaagtaatattagtgaggatgcttgtgaactaagtattaatcctagtcctaatgctaatccagctatcataataagtttacgaagtccccatttttcttgcaatttactcgcaaataaagttgaaaatgctaaagaaagactagtaattgagaaagttatcgcaacagcgttaagactccaaccatatttactaactaaaggctgattgaataaactccatgtatatatcgtcccaagccccatttgtactataactgtgccaaggacaacaagccatggattaacagttgattttttcatacctttccgcctcctctttctatttcaatgctattcgctaaatttactttttttatgttcattttggtcacctcttttgatttgacaccttcattgtataagatgtttttgtttatgtaagcacttacaagatagagcgtcaaaaacatggaatcagttacaaaaaacgaaggatgaaatacaaaaaactactgattaaatacaatagaaaaattttttatacttcaatccaccttattttttataaaatcacaaatttttttccaataaataaaactaaatattcactaatatatctatccgtggtttaatatatataataaaaaaatatttctgtctttaatgaggaggtactatgaaagcaaacgtaggggatactatactttttcaacgaaataatttaaagattacaggat

SEQ ID NO: 247 - DNA, 818 bp, Bacillus thuringiensis
tctttacttctttcttttctttaactgatttttgtactttcgctacttgcttcgttttctcttcagttttcttttcagttggtgctgtacttgataggaaagaaacgtttgcataagcagtttttcctttatactcaaattgcagccatccgtcttttacttgatgcgttgattcaattacatcatctttttttagtctgccaagaatttctgaatccgtgtttgcttcagtgcgtacatttaacaaattcgccgttacatgatatacatcttttgtaaactccgaacttacaaacacttctttaccattcaactcaatttttgaccagccatcttcggtatttatgacttttaactcttgcccattctttactttttcgaccacttttgattctgtagtcggtttttcacgtacgttaagtacatctgctgttacgattgtttctgcggtagcagttgtggtaaacgctcccaatccaaaaacagttgctgttgctgcgccaattacttttttcatattaacctccattaaatttttttgaattttatcaaatgcctccgtaaaattgtataattttacataatatcaaaacatttgcaacggtatattaatattgtttaatatactgttattaaaactccttactccaatactatcaaattctcatttctaattctatatattataaatctccttatcttttataaaagctccatacccttcttcacactaaatagttgtggcaattcccgccaaaaataaacttacgattgctaaaatttgagtagcaacaatagcccctcttaaatgaaactta

SEQ ID NO: 248 - DNA, 472 bp, Bacillus thuringiensis
ttatatttaaacctatttttgacacgtgttactgattcgatcaggcatgagtggagaaaagtaaggaatgtaagctagagaaagggatatactaccctttgtatagctatcgttctatctttttttcctcatgtctttttggcgtttgtcggaaggtatcaatatagataagagaggaagggtttccatgtttaagaagatctttggtgttcttcaaaaagtcggaaaagcgttaatgcttccagtagcgattttaccggcggcaggtattttacttggatttggtaatgcatttcaaaatccacagttaacaaatattattcctgctttaaaagcagattggttcgtaatggttgcaaaaattatggaacaatctggtgatattattttcgctaaccttgcattattattcgcagttggggtagcaattggttttgctggtggtgactgactaacttgtttagcaacattc

SEQ ID NO: 249 - DNA, 625 bp, Bacillus thuringiensis
taaataaaataccatactctgctgatcttcctgatcctgccataatagatgtaggcgttgcaagacctaatgcacatggacaagcgataacaagtactgctatcattttctcaagtgctccgccaaaatcaccaggtgtaacaaatatcatccatactgcaaatgtgataatcgcaatcacaactacaaccggtacgaaaatacctgaaatttgatctgctaccctttgaataggagcttttgaaccttgtgcctcttctactactttaataatttgagctaatgcagtatctcttcctactttagttgctttcacttttaaaaatccatttttatttattgtcgaacctattactacatccccaattgacttatcaacaggaatactttcacccgttaacatcgattcatcaattgctgactttccttctacaatctcaccatctactggtattttttcaccaggctttacatagacgatatcaccagctactacttcttcaatcaaaatttttatttctgttccatctcgcacaactgtagctgtcttcgcttgtaaacccatcaattttttaattgcttatgatgagcgcccttttgctttcacttcaaataatttacctaa

SEQ ID NO: 250 - DNA, 1115 bp, Bacillus thuringiensis
tcccagcagggacaggatggaaatatacagattataattttttggcgcttgcatatattgtagaaaaaatatgaaataaaccacttgctgaatatgtgaaagaaaatattttgaatcctgttgaaatgcatgaatctggaatgggcgcaacactcccagaagatattttcttagcagaagggtatacgaaaaaagataataagttaatagccacacctcgcttaaaaatgaactggctgtatggttgtggtgaaatgtatacgactgttgaagatatgaaaaagttagatgaagctattatggatggtaaactactttctaaacaaagtgtatcagatatgttttctgcatcacctgcaagaaaatatggatttagtttctatatttacccagattattatcataaccacggtgtattagctggctggaacacttttaataattttaactgggataaacgaacgtttgtcatattattttctaacgtccaaaatggtatgaatgatgcatttaatcaagaatttaggaaaatggcgaatgatttaatagaaggaaaataattataaaaaatcggtattgatatggaattatcaataccgatttttttattttgtaaagttttacttactgaataaagtgaaactttaatcagtggagaggctttgttcatccaccactgagtagaagccctcatcaatcgggcttttacgggcaacagggccccacttaaattatttgcttccgctgaattttgaggtgggggtcttactgcccataaatagcgggataaataggtaagaaaggcgattggcatttgaataaatctaaataggtagttaaatgttaagtaatgcaaagaacaattggtaatttttacattgataaaaaagcttgagcttcacactatgtgaagctttacattattggagacaagaacaggaggttgaaaaaatgaaaaaagcaataaagttttgtttaatagctacattatctacaacgattattagtggatgctcttttgaggggaacaatgaaaatgttaaagggaaagaagggaaaaaagtagaggtacagaaaaatgctgggaaatatacgatgccagatgaaaaagataa

SEQ ID NO: 251 - DNA, 805 bp, Bacillus thuringiensis
attttttaataaatttgcatcaaacgctgtatcaataaaagcagtctcagttaaaattgcatccattgtggtttctcttaataccgcataattttctttttttgctcctcgatcacgaagaccatattttgttaatacaggattgacagctgtatgcattttttgttgctttgcatatgcagtgctgctattggataacgcattataaatataactttcaaaacctgtacccccgccgctattaatatgaaatgaaatgaaataaaataatccgcactgaaagcattagcaatattagcacgttcagataaagaaataaacacatcactatcacgtgtcattttaattgtaattgggtaatttaccgttaaaatgtctcgaacgcgtctagcaatttgaagtgttaagtttttttctactaaaccattaccaacagcaccagaatcatatccaccgtgccctgcgtctataacaagtttcattttattgccccgcccctttcttgtaatatgtttgcatttctactcgtcctattttatgtgaaatgtacaggttctgttacaattgcaaataaaaaaaccgccttatgtaaggcggattctatcatcttgctttaaccaatttaaaataaatatatacgattgatagtgaacataacgtatgcaaaataaaataaataaaagtgctattccaacactactataaagtaaaccaaactttaaaaaaacatttacaagtggtggaaagtgcattaaattgtgtaatagtactaaacatacaaaacataatgaattagacagagatg

SEQ ID NO: 252 - DNA, 635 bp, Bacillus thuringiensis
atcattcttttacaaaagctgtatttatttatatttcagtgttcttaacattgcgcataatattcgagccctaagttcatctcgagaaggaatatccattgataatacagaacgatctagtacacttaacattagttttgcttcacggcctgttatgattccctcttctaataaacgtataatcatactctctgcattcccttgtgcaacgctatgatcaatcatatgaagcatttgatcaataatgtctatatcatcatgcagtttgacttttataatgcgaatgtaacctcctccaccacgtttactttctactacaaatcctctttctaatgtaaaacgggtattgattacataattgatttgagatggtacgcactcgaatcgatccgcaatctcatttcttttgatttcaatcacattattattacttaagtcaataacttgctttagatattgctcaatgatatcagatatatttctcatttatccgccacctttattgactttgactatctgtgactttaattatatacggattaataaaatttgcaactcttttgcttatttaatattctagccacattcccctgggtttaatcaaaatagtaactattttagcacatttttttaat

SEQ ID NO: 253 - DNA, 1006 bp, Bacillus thuringiensis
atcggtaaaaaaccaactcgcgatttacaaacagctgctggacaaccatcagtaggagatacaccgttaacaaaaaaagaaaaacaacgtaccgcagttatcgtcattttaacatgcttcgttgtcttcttctgggctggctttgaacaagctggtagctcattaacattatatacaaacaaatttgtagaccgctctgtgttcggatgggaagttccaacatcttggttccaatcggtcaatccattatttattattttacttgctccagtcatctcttgcattatgggcaaaacttgcaactcgcaagcaaggtgatttaaaaatcccaactaaaatgggacttggtatgatcttactcggtatcggttatatcattctcgttatcgctacattaaaaacaggtagtgatgaacataacattacagaaaaagcaaacttactgtttatcgtctttacgtatcttttccatacgttaggtgagctattcttatcacctgtcggactatcaatggttagtgcgcttgctccggtaaaattagcatctttattaatgggtgtatggctagcaagttcaggtatcgccaacattttaggcggacaactcgcaagcttcacaacttcacttggatacgctgaagtattcacagttattggcgctgtggcaattgtattaggctgtgttttattattaatttctaagaaattagtgaaatggatggattaaaaaagatgaggaatttctcctcatcttttttatgctgttttacctttttctattgcttgttcgtacagctctttatgttctttatattcacttggtacgaaactctatagaagaatgagaccagctgtctccttttttatacccttctctcgaattcgctgctttttattcgatttaatccttcagtaaaccactcttaacattaatttcgtcatcttagcagaactttaatcatagtttaaatgctactatagcagccttttactgctttttgagact

SEQ ID NO: 254 - DNA, 737 bp, Bacillus thuringiensis
agaaactttgaacttaagcccaggagaagaatataaagtagcctttgtagcagacaatcccggtgagtggatgttccactgtcacgacctacatcatgcttcagcagggatggtaacggaagtgaactatacagattataaatctgactatgttccaaaccaaaacattcctaataagccagaataataggaagcagttatcctatggatagctgcttattcatttttgttgcaagtactaatgtatatgttgattatgcccaggtgaaggtgaaggtgcaggagtatgatctgggaatgtcgcgaatacggcaacgataattactacactaattgaaaggaataacaaaaaacgacgttggataaaagtagaaaagttctccgataacaattgaatcacacaggacatagtaatcgttatagtaagtaaaaggctaatgaacaatatactatgagcttgttgagcgtttaacatttctgtaatcattgctcccatcatacttgccattaatccagagaacattccttctaaagcagtatataggtgaaaacgtagacccactaaaaaaccgataaaaccactaattaaaatagcaagtaaagtagaatatagtaattcccccttaaagagaatgcctaaataaaaaccaatacttaaaccgatactcatactcaaagacataataaataccatcactactccattagggtaaccttacgtttagaaaaaatggata

SEQ ID NO: 255 - DNA, 920 bp, Bacillus thuringiensis
tggctatggctgtgataaagaactgactgaagttagtgcgacctacatagtgaaagatgttgaagaactgtatcatttttgtatagagaaaaatttaatacagcagtaaatatagattctagcaatccctttataacgtatgacgatgaattcgtttctgtttaaagggatttttcatatgtaatcgaataattataattagacatttttagcataaaaatttgtatgaataagaggagggatgtcagaattaaaaggttagtagaaatttatcaataaaatttagaatattctgtttaatggaggggtaaaattagagttagttattatattattagcactaagtttacttatgttcgtagcatacagaggtttttctgttattttattcgcgccgatatttgcattatttgcagtatttttgacagaacctagttatgtattacctttcttttctaatatctttatggagaaaatggttggatttataaaattatattttcctgtgtttttattaggagcaatatttggaaaagtagtggaaatgtcaggaattgcagattctatcgcaaaaacaattattgagttagttggtgaaaaacgtactatattagcgattgtattaatgggggctattttaacgtatagtggtgttagtgtgtatgtagtagtgtttgctgcttatccgctcgcagctaagctgtttcgacaagctaatattccaaagcgtataatccctggaacgattgttcttggagcattaacgacatcaatggatgcgctacctgcatcaccagcaataaccaatgtaatacctacaacatttaacaaaacggatatgaatgctgcaccgacacttgcgattgtaggagcagatattgatcttacattaggtaaactatatctagaaagtagacgta

SEQ ID NO: 256 - DNA, 1051 bp, Bacillus thuringiensis
acaaaacaatggaatattatatttatgcactttattaagatgtatatactaagctgcaactaaaacgtaattattcgtttggtattaaatgatatttttcttctataattgggaaaaatatatcggtaaaagaaaagaggagaacttcatgctaaaagattgactatattttcattcttacttatttttaccttaattttcgctggctgctcaaataaaaaagaaagtaatgccaagaaagatggaaagctaacagtttatacaacgattttcccacttgctgatttcgcaaagaaaatcggtggcgactatgtaaatgttgaagcgatttacccacctggtgcagattcacatacatttgaaccaagtcaaaaacaaacagtacaagttgcaaaagccgatttatttgtttataacggcgctgaattagaaccatttgctgaaaaaatggaaaaaacattacaaaaagaaaatgttaaaattgtaaatgcatctaaaggtattgagcttcgtgcttctactgaagaagagcatcatgatcatggagatggccataaagaagatgaacatcatcacgataaagacccgcatgtttggttagatcctactctagcaatgaaacaggcagaaaaaattaaaaatgcacttgtagaattacaacctgaacataaacaagaattcgaaaaaaactttgcagcacttcaaactaaatttactgatttagacgatggatttaaggcagctgtagcgaacgcaaaaacgaaagaaattttagtttctcatgctgcctatggttactgggaacaacgatacggcctaaaacaaattcctatcgctggaatttcagcttctgatgaaccatctcaaaagcagcatgctgacattacaaaaacagtaaaagaacataatctaaaatatattttattcgaaacattctctactccaaaagtagcatccgtaattcaaaaagaaactggttcaatagttttacgcttcaatcacttagctcccctttctgaaggtgatgccaaacataacaaaaattacttta

SEQ ID NO: 257 - DNA, 773 bp, Bacillus thuringiensis
  unsure (1)...(773): unsure at all n locations
ttctgctacgagttttacataactcggttcattttttttcccgcgaaatggatgcggcgttaaatagggacaatccgtctctattaacaatttctctaatggaatctccgtagcaacttctttcggtttcttagcgtttttaaatgtaactggtccacctaacgaaattaaaaagttcatatcaacacatcgctctgctacttctacgctaccgctaaagcaatgcataatgcctcctacttcagctgcattctcttcttctagaatatcgacaatatcttgagttgcatcgcggttatgtataataatcggcaaatttacttttttcgctaatgcaatttgtttacgaaatacttctttctgtatttcttttggagacttatcccagtgataatctaagcccatttctccaagtgcaacgactttaggatgagaagcaagttcttctaaccaagctaaatgttcttctgtcatgtcgattgcatcaactggatgccagccaaccgcagcgtaaataaaatcataggcttcagctaattccatcgccttttttatcgttacttcatcaaaaccaacaacaactgtataagtaactcccgcttctttcattcgggcaataacctcttgcaaatcttcttcgaattgctctgcattcaaatgtgaatgtgtatcaaacaacataatacataactccttttatattgaaatcaagtttattctacananataagttctttaatacttaacgatnnacatactacatctaatgcaaa

SEQ ID NO: 258 - DNA, 992 bp, Bacillus thuringiensis
agcctgtaaagtttagtgggcatgataatagaacgtttcatctaggggatgagatgagtgtaagattgccaagtgacgcggcatatgcgccgcaagtagagaaagaaaataagtggctacctatattaagtaaggagctttctttaccgatttctgcaccaattgcgaaaggaaatccatctgaagagtatccatggccttggtctattaataagtggatagaaggagatactattacgaaacaaaatgtccgtgacctaaatgaatttgcggcggacttaggatcatttttagtggaattgcaggctattgatgcgagtaatggcccaatagctggagcgcataatttttaccgaggcgggcttatatctgtatatgctgaagaggcgagagttgctattgaaaataataaggatgtttttgacgaggcattattaaagcacctttggaatgtagcacttagttcaacatgggaccgtaagccagtttgggttcatggggatgttgcacctggaaacttacttgttaaggacggaaagctttgtgccgtaattgattttggtattttaggagtaggggatccggcttgtgatgcagcgatggcgtggacgttttttgatgaaaatagtagaaatgtatttaatgaagtattacgcatggatgaagaaacgtggaatagagcgagaggatgggcactttggaaggcgttaattacatatgatgcgaatagggatagtaatgaaaaagtagcagaagaatcgtatcgtatcattcaagtgattgtggatgattatgagaggtagtagaaaaagcctattttaaaataggctttttttatatgatgaaatagtagaaatggaaagaaggaatccaacataatttatacagaatatttagataataggaggtgtcgaattttgagtgaaattgaattatagagtaatgtaattaagacagggcctgagaagggaattattcttcggtttatactt

SEQ ID NO: 259 - DNA, 943 bp, Bacillus thuringiensis
tattctttttaaagcattaccaccatcaggctgtacacctgaaaaattaggtgctaaaagatggtttgttttcccagtatttggacaaattcagccgtctgagtttttcaaaattgcattgctacttgtagtagcgagtatagcagtgaaacatattgcacagtatatggcaaggacattccaaacagatttaaagctagtcggtaaaattatgctagtgtcacttccacctatggcggttgtatatagccaacctgatacaggcatggggttcttatgtgctgctgctcttgcatgtattttatttatgtcaggtattcaaaagaaattgatagcattatgtacagttattccgttgaccatattatctgctttaatatttattttctttaagtatcaagattttttctataataatttagttactttactaaagcctcaccaacagtcgcgtattgtaggttggttaaatccatttgaaaatgcagatcaaggttatcaaacacagcaatcgattttagctgtaggtagtggaggaatggaaggtaaagggtttgggggaggaagcgtctatattcccgagaagcatactgactttattttcgctacaattgccgaagaaggtggatttatcgtagcagccttagttgtcttcttgttcctattactactatatcgaacaattattattggttattccgctgataatttatttggtacattattatgcgctggatcaatcggtatattaacagttcaaatattccaaaacatcggtatgatcgttggattaatgcctgtaaaaggtattgcattacctttcttatcgtatgggggaagttccttattctcaaatatgattatgatggggctcatattatcggtacggaaaacttataaaaaatatatgttttcagttaaagtaaaaaagctggtttttttt

SEQ ID NO: 260 - DNA, 918 bp, Bacillus thuringiensis
ttctctaaatgttcatataaagattgttgcaatatcttttcgttaatatcttttacaagagctggcgacaaatatgtcgtctcaaaagcaatcggttcatcatcagctaagcgaatacgcctcacttcataaaccgattccccctcctgtattctcaaccggtctgctattttagcagtagctggaactaggcggaaactaagtaattgactacttgggttcatcccacgagaaatcatgtcttctgtgaatcccgtcattccttgcaatttttgttccactttcggaagttggacaaatgttccaattccacgcttccgatataaatagccttgttccactaaattattaatcgcctgtctgattgtcattcgactcacttcgaacttatcacaaagttcattctcagatgggattttatctcccggcttccattcgccgtcctcaattagctgtttcacccactcttgaatctgataatagatcggaaatggtgaatacttgtcgatgttcatcagcaatcgcctcactgcataaagatagagcttcttgatcagcgattacggttacattcggatgacgttgtaaaactgtagccggacactcttcactatattcaccttgcaataattctttaacagcttctgcctttttagaacccatagcaactagtagaatttgtttcgctttcataatgcttccaattcccattgtaatcgcatgagttggcacatcttcttctttctcgaagaagcgaaggtttgcttggcgtgtagattctgttaattcaacaatgtttgttggagaataaacggtgttcctggctcataaatccgatgtgaccgtttcaccgattcaagatctgaggtcaactggtagcagtaaatgcctcgaacgttgactcttttaatacttgca

SEQ ID NO: 261 - DNA, 600 bp, Bacillus thuringiensis
gaagcaaccgctacattacgagttcttattgcatttattctatatgcaaggtcctgttctttctccgcatgatctactttcgtataagcagcacaatgaataattatatgtggttttatttcttgtaccacttgttgtattcgggatatatttgtcacatctaataactttttatcaaatggatatatatcatattcttcagagtctaactcttcaaatagttgctttcctaattgaccgtttgctcctgttatgataaccctctctttcatttaacatgccccttactggtcttttagtggtttccaccattccttattcttttcataccatttcaccgtctcttgtaatccttgttcaaacgtatatttcggttcccaatcaaattcattcttcattttctctgcatcaatcgcataacgacgatcgtgccctaaacgatctgtaacatattcaatgtctttttttgtttttcctaaaagattaataatttgttccacaacttctacatttgttttttcattatttccacctatattatatacttctcctacacgccccttatgcaaaacaacgttaatcgcactggaatgatccgtt

SEQ ID NO: 262 - DNA, 643 bp, Bacillus thuringiensis
agaattattataatattcgtcccaccgttagtaaagtagcaatctctcactctctcatattatttttaatctaatttcaaatattcaacgtagttttaatttcacatcctattcaagattgtttacaatttacctataaaagcataacggagggatttcgatgacagactttcaaaaacaatttttcgcacgattacatatagaagaaaaagacacagtttcatttgaagatttatctaacattatgtacgcaatggcacaaactgtcccttttgaaaacttaaatattctcgaaaagaattttaaagaaatatcaaaagaaaatttgaaagagaaaattttagtaaataaccgtggcggtctttgttatgaactcaaccctactatgtattacttcctgaaagattctggattcgatgttcatctcgtttcaggaacagtttataacgctgcaaactccatatgggctgttgattctggccatatcgcaaccgttttaacacatcataatgaactttattttaattgaagtaggattcggatcatacttaccttttgcccctgtccctttttaggtgaagtcttcactctatacaggagattatcgatttctaaagaaatgaccgaaaaggaaactacattt

SEQ ID NO: 263 - DNA, 510 bp, Bacillus thuringiensis
gtagaaatagcgttagaagtccaattatattttgtaagtgattatgtgtatgagcaattaaaaaaacgaatgcatgaagaaggtaagctagttgaagtagaggatataaaagtacaaaaagatgaatgggaatgggatgagcgtgaatcgtcttttttacagtatgtacaaagtatggtgcataataaagggttatatttggatgaaacggatatttataattttcatataagtgtaaaaacaaatatgttaacgattcttggtggtataccgggcattgggaaatcacgttttgtgcaaacttatgcagaagcattagggttacagtatggggaagagttggtttggattccgatttcgccatcgtatcaagaaccacatgatttacttggttacctttatccaaatggtacttttattgaaagtgaaacgaagttagttaggacgttaatgaaggcgaaagaaaatccaaatcaactgtatataatcgtttttgatgaaatgaacatg

SEQ ID NO: 264 - DNA, 751 bp, Bacillus thuringiensis
ttcaaatcccccttgtataatctcttcagttatcgacacttgaaaagggatagaagccgcaaagtctacacccataaccccaagcgaaatacccgctatatattgagtctgaaatgacatcgaatacacatcctattattatgtaaaataaagcttttttgctggatttattcaatattagctatcctttatatatactataaagaactattgtgaaaataacaaagatttttatgtacatgaaaaaatgaggctacaattagcctcatttttcttataccgttaactccaaacctttcctataatattcattcattacatcttttggaaccatacttccacccgttccccacacaatatgagtaccttttttcaccttctctgttaactgttgcttttgtaaatactcatcttctttacatactttcactggccctatcatacctgctagtgcagaaggctctaaataaatattctccgtgtcagctagttcttttaacaatctatataactcttcatcgcttactgtgtaattcccactcaaaaatggttccatcgttttaccgacaaatccagacggtcttcctaccgctagtccgtccgcgtctgttacattatcaatcccgatatcttgaacagcaattttatcatgaagtcctgtcattaaaccgagtaacatgcatggagagtgcgtaggcttcgcaaagaagcagtgcacgttggttttatacaataactttaaaccaaatgc

SEQ ID NO: 265 - DNA, 660 bp, Bacillus thuringiensis
atgaaaaaattgcaatggggcttctttcgtttatgccaactgaaaaagatgtgaaaacattacaattgacaatgaaagaatatgaagcaaaagatgattggcaattgtatttgtggaaagaaaatgaagattttgttggaataatggggattgtaaaaaaagagaatcaagtattagaaattcagcatttgagtgtgaacccgtctcaccgtcatgtggggattggaacgaagatggttcaagagttaaagagtaaatttcttgagtttacaatttgcggaaatgagcaaacggcaagtttttgcgaaaaatgtaaagggctagaacaaaatatacattcgtgaaagcagagataagtagtttattatctctgctttcttttttgtaattgttcgtttcgttcagtaatgacctctgtgcgatcacgcaaagtgtgcttgtttataatatattcacctgggatagcattcaagtctttccaagagaggttttgtttttgacataactctatgcacttgttctctaacgatgaatctgataagggtaaaaataaaggtacaaaacgttcttttttatggatagattgcaatccttcattgggcaaggaaagaagtttgacctgattaattcctaaaccgtgtaaaggcacccccgtttttt

SEQ ID NO: 266 - DNA, 890 bp, Bacillus thuringiensis
ttatggatcagtgccccaaaagaaccagaaaaggaggtaagcaggcctagttatgagacatggctaaaatcaacaacggctcataacttgaagaaagacgtattaacgattacagctccaaatgaatttgctcgtgactggctagaatctcattactccgaactaatttcagaaacactatacgatttaacaggggcaaaattagcaattcgctttattattcctcaaagtcaagctgaagaggatattgatctgcctccagttaagccgaatccagcacaagatgattcagctcatttaccacagagcatgttaaatccaaaatatacatttgatacatttgttatcggctctggtaaccgttttgcccatgcagcttcattagctgtagccgaggcgccagctaaagcgaataacccactctttatttacgggggagttgggcttggaaagacgcatttaatgcacgcaattggtcattatgtaattgaacataatccaaatgcaaaagttgtatatttatcatcagaaaaatttacaaatgaatttattaactatattcgtgataataaggctgttgattttcgctgtaaatatcgcaacgtagatgttttattgatagatgatattcaatttcttgctggaaaagaacaaactcaagaagagtttttccatacatttaatgcattacacgaagaaagtaaacaaattgtaatttctagtgatcgaccaccaaaagaaattccgactttagaagatcgtcttcattcccgctttgaatgggggcttattacagatattactccgccagatttagagacactaattgcgattccacgcataaaagcaaaagctgcaaggcttgatataccaactgaagttatgcttta

SEQ ID NO: 267 - DNA, 565 bp, Bacillus thuringiensis
agtaaaagttgcaaaaaatttagatgaagttcgtacatatgcagaaagcattttaggaactacacttgtgacacatcaaacaggtcctgaaggtaaggaagtaaaacgcttacttatcgaagaaggttgcgatattaaaaaagaatattatgtaggtctagttttagatcgtgcaacttctcaagttgttttaatggcgtctgaagaaggcggaacagaaattgaagaagtagcagaaaaaacacctgaaaaaatctttaaagaatatattgatccagcagtaggcttacaaggtttccaagcgcgccgaatcgcatttaacatcaatattccaaaagagcttgtaggacaagctgtgaagtttatgatgggcttataccgtgcgtttatcgaaaaagattgctctattgctgagattaacccacttgttacaacaggtgaaggtaaagttatggcattagatgcaaaattaaactttgattctaatgcattatatcgccataaagacattttagagcttcgtgatcttgatgaagaggattcaaaagaaattgaagcttcaaaa

SEQ ID NO: 268 - DNA, 973 bp, Bacillus thuringiensis
ttcttgtttccggtatgaacgctgggatatttggaatggatgtttttcttatcccgaaagtattaggatcaaaaactgcaaaacgccaaaagcaagctgcttaatatatgaaaacgggtatctcattttgagatacccgtttatgttatttttcaactttaatcggattgttcttaaagaaatcttttacatacccgacaaattcttgtggttcttggcgaaatggtgcatgataacctttttcaataatatgtaaagtgctattttttaagaattgatgatacgtttctccttctttccaggaaacgctactatcatttctgccccatataattaaagttggctgttttatttcatttgcattaattttaagacgtctaggccataatttcattttattataatgctcttcatcattacgtttgaatttcactttgctttcatcataatctgtaatagaagaaacggcatttaaatcagtcgacaattgtggttttggtgagccttgtttattaacgaatgtatgagggccacctgtagcatcagttaaaataaggtgagtaactgcttcaggatataaatatgttaaatttagagaaatttctccccccatggaatgccccagtattgcgaatgaatcataccctagttttttcattaatttataatacaaatttgcatgagttggaaaagaataataaaaatccattggcttagatgagcgcccgaatcctaaagcatctacagaaataattgtatgatcttttgctaaatcggagtaaatcttttgaaaaccatctgatgaccctccaaagccatgaatcataagtaaagggtggtttttcattaccaatctttttaaagtaaatggtttgaccatctatttctaccattttttcctcggtagctaagttcgctgaaatgtatttttaacttggtttacttggtctactgggctttctgctgcactaca

SEQ ID NO: 269 - DNA, 803 bp, Bacillus thuringiensis
aacttggtctgccatctttttcgtattcgtgaaaacaactgctaaatacggtttaaattgaagtagcattttatgcactaaatcaattttattacgatgtttagaaggcactaaatagtgttcaatgtttccagctgcaacttgttttggattgatatgaatatgctctggattctccatatacttcttcagaaacggttttagtttttgaggaattgttgcagagaaaactaacatttgcaagtttttaggcatgcgtgctgcaattttatctacatcatgaatgaatcccatatcaagcattaagtctgcttcatcgacaataatcgtatttgctttatgaacaaataatgcttgctcttctactaaatctttaatacgtcctggtgttccaactacgatatgaggttgttttttcaacttttcaattgagcgttgtttatcagttccaccaattaaacaacgtgctgtaatcatttggtcttccgcacaaaactttgttaatttcacgatttcttcgtaaatttgttgtgctaactcacgagtaggcgctgtaataacaagttgtacttcttcacgacttgcattaattctgtttaatgtaggaagtaagtatgcatgtgttttcccagaacctgtttgggattgtccaattacacttacaccttttttcacgaccgggaaaattttctgctgaattcctgtcggctctgtaaagcgtagttcacgaactgcatctattaaaaatggtttaaaatcatactgtgtaaaagtttgttgtgtcataagttacacctaaaaac

SEQ ID NO: 270 - DNA, 562 bp, Bacillus thuringiensis
gggcgtgatatggtagcggaaagaaacaatgctcgctcgaatgatttgttagagaagcttaagaaataaaaaacagctgttatacagctgtttttttatttcttaagccgattcttcgtttgtaaccgcattcaaatttgcttctggatgccaaatataaaaatctccatcagttactgatacggggttgaaatttaatttatcccaaaaaccagctgaatgaatacgtgctatcgttttaataggaaattgcatttgtttcgcatgatttacaagcatttgcccgaatccttgtttttgaaaagttggtaatacttcaagtttataaagttctaggtagggacctgtaatttcgaatgggtctccgccgtttcttttcatatatagactcatacgtgcgattagtgatccgccataataaataccgtaaaatggagattcactgtcgttttcaataatgtttgcttgtaattcttccagcatagatagttcctgggctccgcaccctttaaattttttgaattcatctaacgttttataattgatgagcaagcgctcaact

SEQ ID NO: 271 - DNA, 825 bp, Bacillus thuringiensis
tattcataagatctgttacataataatgaactttgagatgagacggcattgttgcgaaaaatgcgatgttggaggaggacaatagatggacttactacaactatttaaattacaaaaagaattagatgaccgtattgcaaaagaacatgacttacaaccgaaaaaattgttaaaagaaaaaatgttagctcttcttgtagaaattggagaacttgcaaatgaaacacgttgttttaaatattggagcaacaaaccagcttcggaacgtgaagtaatattagaagagtacgtagatggtttgcattttattttatcaatcggaattgatttaggtattgataaaaacttcctattctataaatgtgcacaaacgaataaaacacaagtggaaattttcttagacacatatgcgaaagtaattcgttttacagatcaaccatctattacaaactatattgaattatttacgagctatcttcgacttggacaagcacttgaatttgagcaagaagagattgaaaaagcatatttagataaaaatgaagtaaatcatcagcgtcaaacacaaggatactaatttaatttttgaatatttcaatttaattattgtataataaattgactgaagaaaaaggagggtgttggcaatgacaaaattagacgcgacattgacaatgctaaaagaattaacagatgcacgtgggattgccggtaaccagcgtgaaccacgtgaagtaatgaagaaatatattgagccgtttgcggacgaaccttttactgataatttagggagtttagttgcgaaaaaaaggagggaagaaaaac

SEQ ID NO: 272 - DNA, 845 bp, Bacillus thuringiensis
ttacaagtccgattccagcccataaattagggcttatctctaacgactctctcgtacctttatttaaatgggtcatccgtttttgaccaaccgaatcatatcttgcaaatgtcttttgagcaagctcaattgtttcattatccacatattgaattaaacgttctgcctcttcccatgcttcttcttctgtttctcttacaattacgtgtaatctaatgccaaatcgcactgtacgccccttctcttctgcaagttttcttacttcttctattttctctttcacttgctctggcggctctccccacgttaaatatacatcactatgttcagctgctacttcttttccagcagttgacgatcctccgaaatatataggaggatatggtatttgaactggtgggaatacaactttactatctgtaactttaatatgttttccttctaaagagatcgtttcaccttgcaatgtcgatttccaaacttttaaaaattcatccgctgcttcatatctttcatcatgatcaagatataatccatctccttgtagttcaactggatctcctccagctactacattaataagcagcctcccatgtgaaattctatcaaatgtagatgccatcctcgctgcaactgtaggggacattagtcctggtctcactgctactaaaaattttagtttttctgtttcagcagcaagagctgaagctaacacccaagggtcttcacatccttgaccagttggaagtaaaacacccgtatatcctaaataatcagctgccgcagcaacttgcttataataaccatattcagctgctcttcctcgttttgtcggtcctaaatat

SEQ ID NO: 273 - DNA, 742 bp, Bacillus thuringiensis
tcaagagaaagaaagaatgtaagaatcataaaaatttttccagcctcaaggatgagactgactcttttttactaactagtttaatactttaactgtaactgttttacgtccccagctacttgatgtacctttatctggcattaaaacgtcgattttattacctttaatagctccaccagtatcaccagcgattgctactccgtaaccttcaacccatacttttgaacctaatggaattacacttggatcaactgcaataagtttcatgtttggattagctgttaagttatgacctaaagctgattttacttggtcgcctgctttataaccattttcaagtggatctgctgtgtaagctgttgctacaacttggaactcacgagaagaagattgtgtgtttttctcagtttcttttgcaacaggttgttgtgtagctggtttttgaactttattagccgcttcacgatcagctgcctcttgagccttagctgctttacgagcttcagctgctgcctcttgagctttagctgcttcacgagcttcagcatctgcctgagctttagcttctgcttgagccttagctgcttcttgagctttagccgctgcttgagcttcagctgcttcctgagctttagctgcttcacgagctttagccgcttcttgagctttagtttctgcttgagcttcagcgtctgcctgagctttagaatctgcttgagccttagctgcttcacgagcttta

SEQ ID NO: 274 - DNA, 493 bp, Bacillus thuringiensis
gtatccaactgcgtttgaagaacgaagtaacatttggaataacacgttcggcattttttcacgaagatctagtaatcgttcccatggatcttcttttaagaaacgatacgcaacatcaaacgttgcaccgccccacatttccgctgagaataggttcggtaacattctcgctgttggctccgcaatttgatgtaaatcttttgtacgaatacgagttgcaagtaatgactggtgtgcatcacggaatgttgtatccgttaaaagtacacgtttttgatcctgtacccattttactaatccgtccgctccacgctcgtccaaaatttgtttcgttccattttggattggctctgaatgttttaaacatggaatacgagcatctgggaatattggtttttcttttttccctactcctgggaaaccatttactgatactgcaccaatgtaatttaacattctcggtccacggtctctacgtttcgggaacaagaac

SEQ ID NO: 275 - DNA, 1120 bp, Bacillus thuringiensis
gcataccagtgttttttaaacacaaaatcatttttaaatatttcagtgcttcttcatcaaaaactcgatctcctttttcgtttctttgcagaaaaggaaacagtccttgtttatcgtaataacgtatttgagaaatagttaagtgttgcattttggcgacttgcccaattgtataatacatatcattcatccttttattaccaaggtataatgccatctttgttaagtattttaccattatagtttgtttcacttaatgcatatttaataataattttagcactttcagtggttgtatggccaccgggggaatttccattaagatccgtagttgtaaaaccaggagttaccccaaatacttctggaccgttagtggcaaattctttactaaaagctaatgttaaagcattattagctgtttttgaagaattatatctagtgtattacgggatgtgttttaccattagcaaacattgttagtaagaccatgtcagttgtaacgtttattattttactgttgcttgaattctttaataatggcaaaaaggcttgcatcatttggaaagttccaaagagattagcttcaaatccttggcgtaaagtttcaatatttaattcactaggtagcatattgaagtctagcgctatgcctgcattattaattaataaatgtaagtgatcagtcgtttcgtaaattttctttgttgcttcttgaatggattgtgaatttgaaatatctacttgaatataggaaacgtttgaaacatttaaagattctacggcttgttgtccaagttgttcattacgagcacctaaaaatacgtgataatctttttctgctaattgacgaacaagttcatatccaattcctttattcgcacctgttataaaagcatattttttcatattgaattcctccagtaatgttatagtaggttacaatggaaaggatacagcctaaacttaagtttaggtcaagaggaatttttttaaataaatatagaatatctatatataagagtgagaattcttatcattaagagaatagtctgttattataggagatgtacggtattatattttcagggggatgaaaacatggagtacagattgaaagaga

SEQ ID NO: 276 - DNA, 599 bp, Bacillus thuringiensis
tattttaatgcaagcgcaagaagcgatggaaaacgtacttgcaaatgtaacggtagatcaattagttacaaatttaaagtctaaaatgaaagaataaaaaaaagcgagcttcctcataatgagggctcgcctttttttattcagaaatattgaaaattctatttttcagtatttaaaatgaatttacctacgatagctgcgaagataccaccaagaattggtgctacgatgaatacccatagttgagaaagtgcttctccaccaacaaataaagctggtgcgatactacgagctgggttaacagatgttccagttaacggaattcctaataagtgaattaaaactaatgtgaaaccaattactagtccagctaaagaagaacttccttttttacctgttacagcaacgataactaaaataaatacgaaagttaaaatgaactcaactaaaaatgctccagataaaccaagagttccgaaaccattttgtcctaaattatctaaaggtgttttagcagattttaaaattgttactaacgttgcagttcctaataaaccacctaaaatttgagctaatacataataacaaagtttcatagc

SEQ ID NO: 277 - DNA, 464 bp, Bacillus thuringiensis
ccatacaaaacaaatgattgaatacggtacgaaaattgtcggtggtgtaacaccaggtaagggcggcactgatattgaaggtgtaccagtatttgatacagtagaagatgcagtgaaagcaacaggcgcaaacgcttcagttgtatacgttccacccgcttttgcggcagatgcaattatggaagctgttgatgcagaaattgatttagtagtatgtattactgaagggattcctgtattagatatggtaaacgtaaagagatatatggcgggtaaacatacacgtttacttggaccaaactgcccaggtgtaatcacaccggatgaatgtaagattggtattatgccaggatatattcataaaaaaggtcatgttggtatcgtatctcgctctggtacattaacgtatgaagctgtacatcagttaacacaagaaggtattggccaatctactgctgtaggta

SEQ ID NO: 278 - DNA, 628 bp, Bacillus thuringiensis
catcggcaacgaattcatttacgtatttgatgatgaagcgtttaaattacaaggtatggactttttaacacaaggtacactttacacagacatcgttgaaagtggtacagcaactgcacaaacaattaaatctcaccacaacgttggtggacttccagaagacatgcagttcaaattaattgagcctttaaacacgttatttaaagacgaagcacgtgtattaggatctgaactaggaattcctgatgaaatcgtatggcgtcaaccattcccaggaccgggtcttggtattcgtgtattaggtgaaattacagaagagaaattagaaatcgttcgtgaatctgatgcgattttacgtgaagaaattattaaagcgggcttagaccgtgaaatctggcaatacttcactgcacttcctggtatgcgtagcgtaggtgttatgggtgacgagcgtacttacgattacacagtaggtatccgtgcagtaacatctatcgacggtatgacagctgactgggcacgaatcccttgggacgtattagagaaaatctctgtacgtatcgtaaacgaagtaaaacacgttaaccgtatcgcgtatgaagtaacgagtaagccaccagcaactatt

SEQ ID NO: 279 - DNA, 433 bp, Bacillus thuringiensis
ttcaatttgcggaatcatacaagccaaacagtttaaaccattctattagtttattgccgaatgttagaagattagttggagaattagaactcgagcttatgcaagctcgcgtctttttatatcaaattgcgaaaaagtacgatgaggcagaagataaactatcactgcaagcagaattagcagccgtgaaatatgctgtaacaaatgcggcgatatctatagtggataaatcgatgcgcatcgtaggagcaaaaagtttatcagaaaaaaatccgctccatcgttactatttaaacgtcagagcaggactgcataatccaccgatggatgatgcaacattgtctatgctggcggatgcggcgtttcggtcgtagtttttaaattttacattttattgtttatggatattatagttgttttgaaagcacgggtt

SEQ ID NO: 280 - DNA, 903 bp, Bacillus thuringiensis
atccattattcatttcatcttcttccatcgtatctattctacataaaattagaatattatacaaagaaaattattagcaagaaattgacaattaaaaaaataacttaaggataaacaaaatccctctcattataaattataattgcggagcatttaccaacataacagcaaaataaaaaacgaaaagaataaatctttccgctcttagagtaataaatacatttcatattgcgctaaagaattcttttcaaatccacatttcttaaaaaaaccctctaataaattattgttaggaaacccaattgataaacttgataaatttaattcttctcttgctacttgtaataatttcatcccaacaccaatatttctataacctttgtctacgaaaataaaactaattttaccttgttcagttacgcatagagagccttttaagtcattatcaacatatgcaccataaaatacattatttgtttttttgatataatcaatatcattttgccaatttatatggaagtttaaccatttctgaatttcatctttaaaagttggaaattctaattgttttacttcaatatccttacaaactttattctttattttagtcaaatcatttaaattataataagaaagatcgtacactttttcatagcccaacttattataaaaatgaatcgctcggtcgtttcctacaatgacttcgagaaaaagttgcttacatccatgttgaatcgcctcttctttatgcagttcaaataatttttgactcacaccaataccgcggtaattaggatgaaccgctaatgttccgcagcgcatagtctttatactttcataatcctttatgccacctagtattacgccaacagatttgccttcttctaaagcaagaaaagaata

SEQ ID NO: 281 - DNA, 841 bp, Bacillus thuringiensis
gattttttaccctcttctcgaatttgatctaaattttttgtttttccattcgcatctattcctccataatttgtagtaatttgttctgccgcaacaaagtattgctctcctaaatatggataaattcgcattgcatctgtagcaacttgttgtccttttgtcggcgtgctatgaagcttgcccaatcggccagcatagtaaattccattattaattaaccatccgtttttatttgttactgtaccaagtagtgcaaaacgatttatttcattaataaagttatcgatatttcgataccacatcgtatcttttggctcttttccagtcgtgtacatatccgtctgaatatcaaagtcaattcccttcatcaactcatatatagcgtctccttttgttcggtcttcaatgaaagttgcaagattatcgttatattgtttaaaaatttcacctgcatataaaaccgtttcaacatctgctgatgcatttccaattaattttccatatgatgcaattactttattttgttctgatgtaccaagtttgaaatttggattttttgcaattgtttttaaagctggtaaacatttatcatgggagctacgctcatttagtttgcttgattcttcttggtacaaacctaaataagatgctgcacgtagagcttctgctaatgtttcaattccttttcaatcatctttcgtataagtttgtccctgttgtgatagtttattaataattggttgcatgcgattatcatcttgatacactttccgactatcatcattaagttgcgataataccgcaaaaagattccatttagtagtcgcaacaagctcaggtg

SEQ ID NO: 282 - DNA, 1241 bp, Bacillus thuringiensis
gaaagtaaggggaaaaaaagtgtaattcaaacccgttgcaaatgtgaaaaagatttatatgaaaaagagaaatgaataacaaaatacttattcatgctattttattcaacgatattttgctgttgatatgaaataacaaaggtaaacgaacatattagctttatggaatatgtttgtttacctttgtttgagagatttaaaaattgggatgttgttagttgaaaatttatttactggctaatgagcttatagcattcaatgaatttgttcttcataaacattagattttgtgtcaaatgatttatacattgccgaatcacctatgtatattttattctacagtatttataaaaaatgttggctattcataagaaatataattggcacagtttttgcttgtattacatgtaaggaagggagattgtatgtaaggaatctgtactcgtaatagtataaaacaagctactattgcattattaatcatatttgtatttatggcggaactgtaaatacatacaaataagtggttttttggttttaaaattctgaattttcttttaaattgttagggggcaatggtatggttaaatattcgaaaatttctaagtggattcttggtgtgggactagtgacgataacatgtaatggtttgcaaattcaagcagagacaaaagagaaaaatgtgaagaacgtattacaaatggagccggtaggaatacagaaatctgttgatgaattggcgcacccttcaaaagtacaagaaaatgcatcttttacaaaacgattaaaattagcggatttatcgcagcgtccactagcaccaaccgataatattaaaccgttagctgaagaaaaaaagtattcaatggctgagttaaatcaattaaataacaaacaattaactgatcttcttgtgacaattaaatggtatcaaattccggaattatttcagtttaatagtgatagtcttaaatttcattaagatgatagtcgaatgcaagcaattattaataaactagcagaacaaggacaaacttatacgaaagatgattcaaatggaattgtaacaattttagatgtttttcttgcagcattttatttaggtttttaccatgatgaaataagcatatcttaatgagtgtagcttccattgattattgtttaccagctttaaaaacaattgcaaaaaattcaaattttaaacttggtaccatcagatcaaataaaagttattgtaatat

SEQ ID NO: 283 - DNA, 857 bp, Bacillus thuringiensis
tttccgtatggtatacatttgaaaagaaaaaattctccagcaaaagttaacatgtctactagcaaaatccacttcaaagatacaatttcaattaagaagctcgcggccgctccagaaataacttgtgttaactgtccttgtatttccatcgttccacttaaacttttataatgttctgcttgaaatatctcttggttgaacgcaaatattgtaggataaaataataaatagtagaatgatccggctatataaataagaatatagtgaatagaatgataaggttgcccagcaaatccccatataaccattattccgattacggctattccgattccttcgttacatagcaataaagattttcttgaaaaacgatcaatactttgcccaatgaatggtgttaataaaaacataatgagggttgcaatgatagaaacataaccaaatgttgtctctcctccactctctttaattaacagccaaggaatcgttatcataacaatcccggaaccaatagcagatagactattggctcctagaatgtaatacaagcgagaatcatgataaagtgaggacatatcattccactcctagttgttttttcacctctttatatacgctcatatatgctttcaattctttaactacatcatgaattaatggttttgcatcttccccaagttcaccatcttgcacatgtaatccatcaagcacaacttgttttggaattgcatttgcataaacacctttagcgaccgttcgatgctgtttaatgcatttattccacctttaccgccaccagcaaccgctaacaagcaactgggttatgaataaattactactacttaggaattaaagag

SEQ ID NO: 284 - DNA, 836 bp, Bacillus thuringiensis
agatggtacatgatattgtttcgtggtcatacaaagagctggaagtagcgatgaaagatttattacaacgtgggaaagctgttgtagaaggtgcaggtgcattagcaactgctgcacttcttgcaggaaaagttgatagctatataaaaggaaaataagtagtagcggttatatctggtgggaacgtagacttacagcgcatatcaagtgtatgtgagcacttttttgtcgctaatgaagtgaaatagttttatgaaagaagagctaagagaaatagtcttagctcttactttttgtctactgtttactgtaagtagcaataaacttgcaaaatttgctgtttaaaaattattttatttaagcgcctatttttacacatatctttaatgttacaataattatttcaatattgtcgaaatgtaagcagaaatttaatataatagttttaatgtgctaatgagcggtgaggagggcagatcatgaataaagaagaacaggtcatgaacggtttcagggaattatataataaactggtttggcttaataaagataagatggaagaaggtcttaaaggttttaagtcttctgaagtccactgtattgaatatattgaaaacaatgcagattctaacgtgacgcaactcgcagaggctttttatgtgactcgcggtgctataagtagaatgactaagaagctcatacaaaaaggccttgttgaaagttaccaaaagtcagaaaataagaaagaaatttattttaagcttaccgaacaagggaaagaaatttataaaatccatgaagaactgcacaaagagttcaagaacgggataaagctg

SEQ ID NO: 285 - DNA, 749 bp, Bacillus thuringiensis
taccattattacgctcatttatgcgggttttgaaaagaaatacagcttggacaaattgttgagccagggaaagtaatcggatttgttggtagcactggttatggacctcctggtacagccggaaaatttccgccccacttacattttggcatgtataaagacaatggctatacagaatgggccttcgatccatacatgcatttaagcctttgggagcgcaaagaacgagcaaatacaaaacgataaccgtagctgcattgctacggttattttttatccagtaaaagcctgactgagccgagtttcactttatttacaactaactatctgttttctttttatcaggtacagcaacacttccgcttccataatacgtaggcacttccccttgaacgatacgcgtcgcaatcggaacattttgtttcacctttatctctttcgtatgaaatggaataatcacttgcaatgttacttccatttccataacaatttgaatcgctgtagtattaatcccatgcggctcaattttttgtttaatatctgtattcacatgtccaactggcgtgaaatgaatcggaatatctggtcctatattaccaagaagtgcattatcagttacacgcccaaaaggaactgccatagtcgcgccgtttttttcagcaatacctagctccttcaacttcccttgttctacttgctgcaaatatttttctatgtatgtgggcgctgatgttacgatttcatttact

SEQ ID NO: 286 - DNA, 1001 bp, Bacillus thuringiensis
tttactcacttcatatttttgtgcgccggcttcaattacttcatcatttttcgatagacgaaatagtccttccattacgttattcaaaacgttaaacgagactgcatctgttactttccctgaatttaacgacggaatttcacccgtttctagtaactgtaatactttcttctcatctttgggctttgttgcagttttttcttttgcgcagccaactaaaaatgaagaaactaatagagtactaactaatgagtaacgaacaacttttttcatttaaaaaccccctctatttttaaggtaagtaacgacgagcaccagcgtattcttctatatatcctggtgtatttagcggtataatctctaccgatctttcagctcttggtgagtgaatcatattgccatcaccaatatacattgcgacgtgatggacactacctttcccttgatcatgtgcaaagaaaattaaatctcctttttgtagattttctttatcaactgcaactcctgctcttgattgcggtccagaatctcggggaattgtaatgccgtgcgatttatagatcgtatgcgtgaagccagagcaatcaaatccaaaaccacttgtaccagcccatatatacggtaatcctaaaaacattttccctgtgttaattaaatcatcggccgccggagttggaatatcagtttgagattggtaaactgttccatcatttttacgtatccatgctttttgcccatttggcaacaatacacggtatgaaattgtgtcttcacttaatagcggcagtcttgtattataactgacttcaagtgatttatgtttttcagaagggtttatatataaaatcgctgttggtttggttattaagacaaaaggttcatttgttttatctgcaaattcttgattatatgttaattgtttttcaggcatccagcccggataaccttcttcatttcggggtgttggctgtccatgcactaatacctataacccattcgcc

SEQ ID NO: 287 - DNA, 538 bp, Bacillus thuringiensis
ttccatatttttatatttttagatgaggcgatagaaaagaaagcagcataattcaaaaaattaagactttacaattgaaaataattatcataatcaattataatagaagaatactagtattcgtattacaaagagggagtgggatatatgtttatcgaaacgaaaacatttacagtaaaagaaggcacatcaaatatagttgtagaacgtttcactggagaaggtattattgaaaaatttgaaggctttatcgacttgagtgttcttgtgaaaaaagtaagacgaggagacgaagaagttgtcgttatgattcgctgggaatcggaagaagcatggaaaaactgggaaacaagtgaagaacacttagctggacatagagcgggccgtggtaaaccgaagccagatcatattattaatgtggatcatgcggtttattatgtgaaatcatcgaaatcggtttatcaacagacgtaatatataagtagaggatacatgttgtagatgctaacatgtatcctctttttgaagtaatggggat

SEQ ID NO: 288 - DNA, 865 bp, Bacillus thuringiensis
  unsure (1)...(865): unsure at all n locations
catataaatatctattctatttccctcactagtcctataaaaatcatttattctagtaaaaatataagaagggattgatcataatgatcaatcccttttatcaaaatataatacctttaaagatcttagttccagattttatttacccattcaggatgatcaataaaaggattgcggttatgttgatattttgtaaaaatcacttcattacgctttcgctctaaatcatcgaccgggtcttgttcattccattttaataaaacagatacagtctaagacagaaataataaaaatcaagatgatagctcgacttttcccttttccataactgtctttatttttgtgtaaaacctttttttctctgaataatacgtacaaaaatagattggataccatgtaggcaccaatctattttaattaaagaaactgtgtcaattctgagttcacaatacgttgtgcagtaatgataacactgtcagctgttagtccataaacactatatagtccaccaggttgattaggaacaatttgaacttcatattcaaatgcttgtccaaaagcaggatgaactaaacttagagttacaaaagtagaagcattagaattcacattgaagtttacctgttcaattaatactaatgaaccgtcaagtctaaaaactctagctactccagtaagtgggcccgcagtacggttaaggattttcaccctaactctatttgcattagcaggttgatttcctacgttttcaattggtcctgtagtaagagccatataacatcacctncattatattattatgatattcaacgataaacattaatggtatagtctaattacccaatctacttaagataaaaagaag

SEQ ID NO: 289 - DNA, 836 bp, Bacillus thuringiensis
agtgccatacctctcttacttttgtctttttaatttctcctccatatatgtcttgaacgactagagccgttacaccacactgtccctttgctgggttttcaattgtccactttgaactcgtttcaatcgaccacgattttattagtgcttcatatattcttttttcctttacatcatccattctaatcttcccctactattaatagttttacacatcatatttcaaaagaggcagtacacgacccttaaagacagttgatggtgtctctcctattaactgtgcccccattttcaagtaatatccttttgcattcggatcactatcaatcgtaaaactttttaatcctagttcattggctttttctattacgtactcccaaagtattttcccgtaaccttttcctttgtaatcaggatgaatgtacaagaaatcgagagctttatcattacgtaaaaatgagaaaaaaccaatcttcgcattatcgttttctaaaacatatacaaaattattttttatgtattcttctgtaattgttaaatcttccttacaagcaagtatgaattcttcactataatcccacgttgcttttgattgtagtgcgaattcacttaattcatttgcttcacttaataacgcttctcttatcttcatgattctttctcctcaccttcgatatgtaaactactaaattgattcggaaagcacttcaaaaaacctttttttcataaattagaggttatttttataaatctttattataaccagtacaatttttttttaagaaaaaagactcctttccttaaagtggcggttcatttttttcttaaaatttaat

SEQ ID NO: 290 - DNA, 945 bp, Bacillus thuringiensis
ctgacacgcgcacgtatcgtttccgaccgagtgacgtagccggtagcatcgatcgtcattcggatgacgtgaatatactccttttcctgatagaacaccaagaaattgcattatttttgcagttaaccccgtttcctcaaataactctctacgtgccgtttcttctgtcgtttcacccagttccatcgccccgccaggtacaccccaatcatatgtatctgaacgatattgaagcaatacttcttgtttatcatttaatataatgattgctgatcctacgagaataagcggtcttgtaccaacgacttttcgtaactcttcaatataccccatatgtaaattcccctttccctaacctcccttatcataacaaaatttctctctttttgttcatgtaattttaaagaaaaaaaggaagctttcgcctccgttttttcatctttatttcttaaaactttcatattttacagcttcaaaagcttcctcaatttcatcattacgataatggacatatgtaaaacgacccaattctactaatcttgctatttcctgtaacgctttatgctgctcatatgtttctttcagcttaatatgtacataaaacttcattaaaggatgttcatataaaggttctcccacctctacatatacatcttcaaccccttgtacaactcttacataactcgcaaattgataaagtgcttctctgtctgaaacgatttttaatgtatacatatattctccccctttcctttactatatcaaaaagacgaccacaccatgttatagaactatgaaattttttcgacttgtcatctatatattcaataaagaaggcgtttatccatacatgacatctttttcccacatatattataggaagaactttttttcatttgaggtgttccttatggatccatacgtcaatatatgtatttgcattac

SEQ ID NO: 291 - DNA, 1109 bp, Bacillus thuringiensis
aatgacctgaacttggtgtaaatgattttttaccagatttgtaacttttcgctgctgcatgatctacgaacataaagctgctagccccaaagataaccatgaatgctgtcattactgctacaagttttttcaacatattatatccattctccttttatatagatatatgtgaaatctatctttctagtaaattcagaatgatagatttgtttttaagaacattttaaaagttcttatgaacttattatatgaacttttgtcgaaatatgcaagtattatttactttcaacagtttggtcacaaaggaaaaattaagcaaaacagaattgactttaaatgaaacaaaacatattataagttcataagaactttttattattttggaggtgaaaagatggaaacatttcatctcacacgaaacgaaatggctacccttcttctatcactaagaggatggaatacgaaaaagcctctcggtattttacaagaagcttgggcaaagtcacataaaaaagatattgaaagcggacaaagcgttacagcttttattactaccgcactttcacctatttttgaaaagctgattaaaattgacgatactgatgtcggtttttctttaaatgaaatagttgcgcttggcaatcagattgaaaacacaagtttctctgtaactgctatgcaaaactgggtgaaacgagatataaaagaaatgattggctctcctcaaaaaggaaaaaaatattcaattgaacaagcagccttactatttattgtcgaagatttaaaaacagcacttgattttgaatccattcgtaagctattacgccttattgtaaatgacccagctgatcgaagtgatgatttaatcaatcctgttcatttatatgtagcatactcttctctatttgaagaactcaatcaagggaattgcttacaattaaatgcaacagataccgttcatacaattgaaaacatcgtaaaagaaaaagctgataaaatcgcaagtaagttcgatcaaattaataacgaacaacgcgaagcaattcgtaacgctattattattgcgaccctttctgtacataccgcttatgtacaaatgttagcaaagc

SEQ ID NO: 292 - DNA, 709 bp, Bacillus thuringiensis
ccatattatttttagaatatttgattaaaatcagtgtagccacaaaaatggatttaataaaattaaattttgttaaaaataattaaataaaaaaggctatatagtagctgtaattacactactatatagcttcgattttataccgctatttgcgggtagtaagattttcaccgcacaagatttagctgaagcaaagaagttaggtaggggatgaacaaaacatcccctcatgacaatttcattttatgcattaagtaagttaaagaaacgattcacatcttcttctgaaacgtcacttaactgtttatatttataattcggattttgatctttatcaacgacaacggagcgtactccctcaaagaaatcttcatgtctcatgaaatttttagcaagtataaggtccgtagcgaaacattcttcaacggatttatcttttccatcaataaactgttttaatgttacttttagtgaaataggggattttgataacagtgtttctttcgtttttagagcaaaggaactttcatctttctccaatgaatggatgatttcttccattgtatcgaaagcaaaatgtgaattgattacttctaatgaaggagcaagctcgctttctaagtttggagcagttgcaaatgtacgaataacttcttttaaattagtatgtacatcatcttctttgcatacacttaagtagtaaaacttg

SEQ ID NO: 293 - DNA, 750 bp, Bacillus thuringiensis
agttgatattatggggataaacgacaagatggcaagcacaagttattcaaacagatgcagcgattaacccaggtaacagtggtggtgcattatttaaccaaaacggtgaggtaattggtatcaattcaagtaaaatagctcagcaatcagtagagggaattggttttgcaatcccaattaatattgcgaaaccagtcattgaatcacttgaaaaagatggtgtagtgaaacgtccagcacttggcgtaggtgttgtttcattagaagatgtgcaagcttatgcagtaaatcaattgaaagtaccgaaagaggtaacaaatggcgttgtattaggtaaaatttacccaatatcaccggctgaaaaagctggtttagagcaatatgatattgtagtagcattagatggccaaaaagtagaaaattcacttcaattccgcaaatatttatatgaaaagaaaaaagtaggcgagaaagtagaagttacattctatcgcaacggccaaaaaatgacgaaaacagctacattagcagataattcaactactaagaatcaataagtttaaaccttaattagtaaggttatccgcaaatagtggataaaagaaagtctctttcatattgaaagagactttctttatcggctatactaaaggaataggagggattaattatgacaattgaaaacccaactcgtacggaaattggtgaagtgttaaagaaaagcaaaacaattgctggttgttgggatta

SEQ ID NO: 294 - DNA, 779 bp, Bacillus thuringiensis
ataaaagaaatacgagattttatacaacagtataaagaaacgtcacctaatataattgcaaaaatagaaacgatggaagcaatcgagaattttcaggatatatgtaaagaagcagatggaattatgattgcaaggggcgatttaggagtagagttaccgtatcaatgcattccgcttttacagaaaatgatgattcaggaatgtaatcgaacgaatacatatgtcattacagcaacacaaatgcttcaatctatggtagatcattctattccaacaagggctgaggtgactgatgtgtttcaagctgtactggacgggacgaatgcagttatgctttcagctgaaagtgcatcaggagaacatccaatcgaaagtgtgagaacattacgtctcgtttcagaatttgcggagcatgttaaaaaagatggaccttttgcgatgaaagatgtactgcaattactgcgtgagtctctggatgagtaataaaaagagggcggatatgcatccgccctcgtgtttttcattcatactattcttgctcttgctcatccaaaatcttttcaaacgcagcagatactttatcaaactcttcatcattttcaatgtatgaaaactcattatcttcttctacttttaaaaagaaaatatcaatgtcttcctcagtttctgtttggatatcttcaacaaaggcaactgcaatatattctgcgccttcgacatccatcgctccaagtacttctacttcttgctcttcgttattctcatcactaagagtaaac

SEQ ID NO: 295 - DNA, 1008 bp, Bacillus thuringiensis
ctgttatatctcaatcattctcagctcagcttatgttagcatgaactgtgagtacttttggtattcttttcaagttcattttaatatattctcgacattgtgattttgcgaaccttccttcaagtaaagctctccacctttcttctaatattaagttaacactttaataacttccaagtaaaaattgcatgccctttacacgggccacttgcatatagaccttttaaactctttgggaatacatgaaaaggtcttcttttttcatctactaatgttttgtgtatatcttgtaaagtcataccatcattgtataacgatttcgcttttctaattagttcatccattggataacttgttgtttcactgtctaataccgttaatggaaaacctgccatttctgcagctaacttcatattttgataggttccacttacttttccgctaatagcaactgcaaatccttcttcatattcttctttgcatttcgtaaataactctaccatttccccaatattaggttgtgaagtagtgactgttttaccttcgtttaacgcattataaaccctttcacgtacaccttcttcacaatctttgtacgaaattccatcaataataacttcgattgggataacaaagttatctccttctgttttaaaattcgcagttgtactatcagtaatccaagcaacacgcttcatgttgttcctcccttaattcaattcctcttttctaatttttctatatatttatgttatgaaaagagaatatccctgtaatagtaacaggactttattgttttggctatagtagatgtatattaaatgtgactatttcttgactatttcacagattataaagaaaatcaaggaatttgctcgaaactcttgttatcatatactatttaaaagtttatttattaaaattacaacatagtcattcgttaatcggccagcttcttttgtataactaacaagcccttgtatattatcacagcagagttttgctccc

SEQ ID NO: 296 - DNA, 911 bp, Bacillus thuringiensis
aaataatgcgggatactaaacaaagggttttttgtagtattttatatttctttaaatggggcccgctatcatatatgagagaaaaaacaaatatactacataaaatgtatagaagattatttaatacgttttgattaatataaacaaagtccataatatttgcctcgttattctgaatttacttaacatatgtattatacataataacatatgttaaggtgaataaaccttgttaatacaagatttgtttggctttttgttataaaatgcaaacatttttcaaacgttagctatccaaagatacttttactaaaattttttactccttcttcctgcatgttcggtaaaacatgagaataaatcctaagagttaatgaaatgtctgtatgacctaatctctcactgataattttaggattaactccttgtttcaatagtatagttgcgtgtggatgtcttaaattacgaattttaatttttttcactgctgcattttttatttccttataaaacttttccctgaaagcatttctgcataaccccccacctgatttattacaattaattaaatctaaatcttgataagcagaactgattggtaataagaaacgtttgcatgagattctaaataaatataaaaatactaaaggaaagtaaggtatgaaaaaacaggtgtttcaagaaaagtggacgagctaggtcgtgtagtaattccagtaagagtttatttgggaggtggcttttaaaactgatgttgttgagtacatgtggtagtaaaaggtagatggacatatgaaaaaagtagaaattgatgttagtagcaacaaacttttaatagtgcaggacgggaatgtgacagtagtcaatccaccaatgagcggatttggtgagcaagtcgaggtttagataaa

SEQ ID NO: 297 - DNA, 832 bp, Bacillus thuringiensis
aaaaaatatgtaatgtaagagaatcttttatatgatattaaaaaaatcctgcttgtttttgctttctagtaggaaaaactagaagaccaatggtacaataatacatcgtaagaggaggggtaaaaatgaaagattatcatgatgatccacgctttcgaatagcccatagagaagcgttaattggtcttggacttgctattattaattttataatttggtacggatttgcttatgggcttggtagtaaaaatccgaatgaatatacatatgtattaggttttcccgcatggtttttttatagctgtatcgttggatttatcgttatggttattttacttagtttagttgttcgttttgtatttcaagatatttcactcgatgaggaagaaaaaagtgaggaataatagatgaattggtatgtaatcattccaatgataatttcgtttatcgttgtatttttaattggtgtatatgcttcaagacgcgtgcaagcaactgctcataataaatttttgcaagaatattttcttggtgggcgtgagctaggcggtttattattagcgatgacaatgattgctacgtacggtagtgcaagtagctttattggtggccctggtattgcttacaatatgggtcttggatgggtactgttatctgcgattcaagttgtaacagggtatatcgttttaacggttatcggtaaaaagtttgcaattatcgctaggaagatggaagcaattactcttatcgattatttaaaagggagatacaataataaagcagttgttatactttctgcgttatgtattattatctttttattttcagcgac

SEQ ID NO: 298 - DNA, 886 bp, Bacillus thuringiensis
cttcgtgtggaatatctactagtagtcctaataaaaatgctttttttgaaaatacggaacaaacgataaataacacagtaaacgaaaaatgagaaataattgttaaacctaaaaaaggaccaattaccatcggcagactcataaatacgccgaaatatgcaagtgcttcgcctcgtcgatgagctggcgcatcatcagttacgatcgtaccagtagctgtcgttgccatcccgaacccaataccgtgtaagaagcgaagggcaagtaataagaataaactttgcgcaccgaaatacataacagtagcggctaaaaataatgaaagtgaaataaataatattttctttcttcctaaatcatcgagccattttcctgtgaatggtctacataaaacagaagaaataagaaacacagttgcaactaaaccaatttcctcaggttttccttttaggccgtctattacatagacaggtagagtagtcataagcatgtaaaatgttaagaagagaaatagactactaaaacaagttccgaggaaatccttcgtccaaagtttctcactttgcatcgtcatccctccaatttaatctaaatttttaataatttgttgtaacacttgaaatgcttgatgtaaatcatcttcgttaataccttctagcgttttttcttcgaaagtatcaacttcttcttgccatattggaatcatctttatcgctgtttcggataaagaaatgagcttctcacggcgatctttaccttctgtacgaataatccatcccatcgtttccatacgtgttaacgtacgagtcatcgttggtgattcaacatttaaatactggcacaattctgtttgcgtacagaaaccagtttgattaatgcggaaaat

SEQ ID NO: 299 - DNA, 814 bp, Bacillus thuringiensis
cgatgatgcttttcgtgctgtaaaacttcttacatctaaaatggcagacgcgatccttgaagcaaaacaaggtgaagaaactgttactgcgtaacaaagttggaaaggtgataaggggttcggccttttatcaccttttttaaggtataaacacctttataaaaggtataaatacatattttaggaggatgaaaagtatggcaatcactgctcaaatggtaaaagaattacgtgaaaaaactggcgcaggtatgatggactgcaaaaaagctttaacagaaactaacggcgacatggagaaggcaattgacttcttacgtgaaaaaggtattgcgaaagctgctaaaaaagctgaccgcattgctgctgaaggtttaactttcatcgaaacaaacggtaacgacgctttaatcttagaattaaactctgaaactgatttcgttgcgaaaaacgaaggtttccaaacactaattaaagaattagctgctcacttattaactaacaaaccagctaacgttgaagaagctatggctcaaacaatggaaaacggtaaaaaagttgaagagcacatcaacgaagcaatcgctaaaattggtgaaaaacttacacttcgtcgtttcgaaatcgtatcaaaaactgatgcagatgcattcggcgcttacctacacatgggtggacgcattggtgtattaacagttcttgaaggttctactgatgaagctgctgctaaagatgttgcaatgcacatcgctgcagttaaccctaaatacatcgaccgcgatgctgtaacagctgaagaagttgagcatgagcg

SEQ ID NO: 300 - DNA, 1205 bp, Bacillus thuringiensis
taactattaagttgttaaaaaagccgtagtttttcatttttgaaaaggctggggtcctttttagttgtagcaaagatataatgggaggaagtttttctaaatcacaaaaaattgattaataagttgtataataaactcaatagcgtatatactataagcatcaaaaaaagttgatgaagggaagtgaactacagtgacacaagattttaagttatatgagaaaaagtttaaagcgttggctgatcagaagcgtttagagattatgtatgaactttgccagcgaggccagacttgcgtatgtgatttaacagagatttttgaaatgacgcaatctaagttgtcatatcatttaaagattttattagatgcaggtttaattgtaaaagaaacaaaaggcacgtggagccattatgatctaaatgatgcggaagtaaataatgtattatcagaagaattatgttgtatctttagaaaaacaggagagggtagctgttgttaaaattttgcactattaatcaaaaaaaatcgattaatgacatataaagaggaggaataagctatgatatatggtcacgttggtataaacgctacgaatatagagaagcctattgaatgttacgaaaaggtatttggcgtgccaccagtaccggtgaaaggagaccatgcaaaatctttattagagacgccaggacttaatttcacgctaaacgtacgagatgaagtgaatggaaatcaagtaaatcactttggttttcaagtggatacagctgaagaaattacattacataaagaacgattagaaaaagaaggtttctttgcgcgtgatgagatggatacgacttgttgctatgcagtacaagataagttttgggtaacggatcccgatggtaatgagtgggagttcttttatacaaaagcagatagtgatgttcacaaaatagaagatccatcttgttgtacgacttctaaagtagtagaaaaaaattcttgttgttaataggagctggaaaataaaatgaaacgtttatcttttctagaccgctatttaacactatggatctttctagcgatggctgttgggattggtttagggtttgtgtttcctagtgtagtagacggactacatacattacaagttggaacgacgtctattccacttgctgttggtttaattgtaatgatgtatccaccattagcgaaagttc

SEQ ID NO: 301 - DNA, 1052 bp, Bacillus thuringiensis
aacgttttttttgttatgatagaaatgctgagaaaatgtgaaatagagagaggaaaatggctgtgaagaaattgttaagtgtctttttatcattcttgctattgctttcatttactggaactttagcgcaagcagaagaaactgcttctatgtcagtagaaaaagcaattcaagtatttaagcagcaagggaaaacgaaggggatagtagaaggatatattgttggatatacgcaaagttcttctaaatatacgaaggatccagctaagtttgatgatacaaacgtagcaattgcagattcgccaaacgaaacgaatccagacaaaatcatgcccgttcagttaccgaaaggtgatgtgagaacggcagtgaatgtaaaagatcaccctgaaaatatcgggaagaaagttagtttgactgggacccttgaattatattttagtaacccaggtctaaaatcagtaacagcttataagtttcaaggtgaaggacaaaaccgtgttagcgatgtagtagcttcaccgaacggtggagaagttgctaaaggaacagcggtaacattaacgacgaatacagaaggcgcaacaatctactatacgttagatggctctaatcctactaataaaagcgttcgttataatggacaaattatagtcaatgaaaatagtgtagtgaaagcaatcgcagaaaaagaaggacttactccttcagcaatttcgacattttcatttattatcgtaaataatgaacaggttcgtattcatgacattcaagggaaatcacatatgtctccttacaacgggaagaaagtaaacaatgtggaaggcgttgtcacagcgcttgataaaaacggcttttatatagaagataatcagccagataatgacccagctacttcagaaggtatgtacgtatataaaaaagatgtgaatgtagcagtaggagatcttattcaagttgatggagtagtagaagaatatgttggaccaggatatgcagagcgatttgaaacagacttaacgacgactgaaattaaagcgagccgtgttgct

SEQ ID NO: 302 - DNA, 1082 bp, Bacillus thuringiensis
taggaccccgaagtcgtgatacgtactctttacccacgattaagtctttgcctcccattttatcttggattgttacagttggggaagcgtgtaactctttagaaccatcagctttatttgtagctgtcgttttaatagaaggctctacaaatcgaactgtttgacctacatcgttaatatcagcgtgagttgcaattacttgcccttcatgtaataagtcttcgaacacaactacttctcttccttgctgttcagcaccaacaaaagtaaagtctaatgttacaaaaccgttcttttcttttgcagtaaatttagtctcagctgttacttctttaccatcaattagtaatggtttgttaatagctttgttcattaattttccttttacagtgtactctttaccaacaactaagttagtgtactccactttatcctggattgtgatagaatcctttgaatgaatctcttttccaccatcagctttgtttgttgctgtcgtttttactgatggcttaacgaacttaactgtttgacctttatcattgatatcagcatgtgtcgtaacaacttttccgtctttcagtaactcttcgaatactactacttctttttcttctaaaccagttgcatcaaaagtgaaatctagtgtaatagaaccatttgcttcttttggtgtaaacttcgtttcaacagttacttctttaccatttacaacgaatggtttattagtctctttattcattaatttaccttttaaagtgtactctttacctacttgtaggtctttgtattccactttatcttggattgttacagacttagacgtgtgcatttcttttgtaccatctgttttatcagtagctgttgtttttattgaaggaatcttttcatccttgacaatgtgtttaatgatttgatcattctctttaatttcaaaagagaacgtttcttcatttaatacataaccgtttggtgcaacagtttctttatatgtgtattttccaaatggtaactgttcaaatttagcgattcctttatcgtctggttttccttttactacttcttttcctgcttcgttataa

SEQ ID NO: 303 - DNA, 588 bp, Bacillus thuringiensis
cttttaaggctctagctaatgcaaataaagtgtttattgttggttttctttttcctctttctaaaagactgatataagttctgtctaatccagagttaaacgctaattcttcttggctcatttttgaattaagacgatactcctgcaagacattaccaaaagtttgttcaatactcaagaaaccactctcccaatatttataagataattttggaagaggtatttctttaactctacagactatagtctgcaaaaaagaataaaactatattttactaataaaagaattataggatagatgtcagtattaaattagttagtatgaaaatgaataaatgtttttagtcatgattcagagtaaagatataaattaagatagtgtcataagtacattttttaatctttaaacatgtagactatagtcacggcgagtcgtgtagtctataatattagaatggattctaatattatagaaggatgataaattaagtatgaatagcaccataaataaaataaagttacctgcaacattaaaagattattttttaacaagcaatagaatggaatctttattaagtgaagaaattc

SEQ ID NO: 304 - DNA, 976 bp, Bacillus thuringiensis
tttcgtcaaaacgatccgctgtttagttagtaagattcaaaggacgagagataattataaaagaggcaaaaacaactagctttgaaggtgtagatattgccttttttagcgctgggggagaagtatctagacaatttgtaactcatgcagtttctagtggtgcgattgtaattgataacacaagtgagtaccgaatggcacaaggtgtaccgctcgttgttccggaagtgaatgcgcatactttaaagcagcataaaggtatcattgcagttccaaattgttcagcattacagatggtaacagcacttcagccgattcgaaaatcattcggtttagaaagaattatcgtttcaacatatcaagccgtatcgggttctggcattcatgcgattcatgaattacaagagcaggctaagtctatgcttgctggtgaagaagtgaaaagtaatatattaccggcgaaaaaagataaaaaacattacccaatagcgtttaatgtactgcctcaagtagatatatttacagacaatgattttacttttgaagaagtaaaaatgattcaagaaacgaagaaaatattagaagatgaaaacctgaaaatggcagctacttgtgtacgtgttccagttgtatcagggcattcagaatcagtttatatagaactggaaaaagaagcaaccgttacggaaattaaggaagtattaatggatgcaccaggtgttattttgcaggataaccctagtaaacagctgtatccaatgccattatatgcagaagggaaaatagatacatttgtcggaagaatacgtaaagatcctgatatgccaaacggattccacctctggattgtttctgataacctattaaaaggtgcggcttggaattcagttcaaatcgcagagactttagtagaaaagggaatactttaatctagtttgaagaccggggaatcgataatcattttccggtttttatc

SEQ ID NO: 305 - DNA, 969 bp, Bacillus thuringiensis
aggtattacctgaagaacttgttaaagaaacagaaaagagttgtcgtaaaaaagaagtgtatgtagaagatttaccagctttaatatacatacatcatcgtataacagggattgaaatcgggcagaagtttcatcacgttgttattgatgaagcgcaagatttttcgcctttccaagtttatgtattaaaagaaattacattaggtaattctttcactatattaggtgatttatcgcaagcgatttatgattaccaaggaattgaagattggaatgcttttaaggaagtattccaagaaaccggttattatgaattgacaagaagttatcgttctacaaaagaaattattgaatttgcaaatgaaataattaaaaatgcagaaatcccagtaggactcgcaacaccagtcttccgcagtggggaagatgtgaaagtaattcatgcggaaaatcaatttactgaaattgtgaagacggtaaaacatttgcaaaatgcagatgtgaaaacaattgcggtaatcggaagaacagaagatgaatgccgtgatatatatgtggaattaacaaatgcaggattaacggtaaacgtaattgaagcaaaccaaagtaaatatgaaggtggtatatcagtagtacctgtctatttagcgaaaggtttagaatttgatgcggtgcttttaattgatgtggatgaagaacattacaaagacacaaaacatgatgcaaagttactatatgttggatgtacgagatcacttcatgacctatggattttccatagtggggaagcgtcacctttaattaaaggattaaaataaagtgaaactataatcagtggggagttttactgcgagctaatgtgagataaatataaaaagagggtttctattactgtctacttaacagggagatgactatgaagaccctctttttatattgaaattaatgttcaattttaaacgaataaag

SEQ ID NO: 306 - DNA, 497 bp, Bacillus thuringiensis
acggtaatgttaaatctgtaattttcccaggtgatgggaagaatgttttcggatcctctgcataaatacgagcttcaatggcatgaccactacgttttacatcatcctgagtaaatgatagtttctctccacttgcaatcagaagttgttgttctacaaggtctaatcccgtaatttcttctgtcactggatgctctacttgtaatctcgtattcatctctaagaaatagaagttcttctgatcatctacaagaaactcaactgtacctgcatttgtatagccaagtgctttggcagcttgtacagcaacttctcccatcgcctttcgtgtaccttcatctaaaaatggtgaaggtgcttcttcgattactttttgatttcggcgctgtaccgaacattcacgctcccataaatacactgtgttaccatgtgtatctgctaaaagctgaatttcaatatgatgcgcgtctgctatatatcgctctaaatacatttct

SEQ ID NO: 307 - DNA, 648 bp, Bacillus thuringiensis
ttttgtccaatttcatatgactattaaaaattatcttttgtttgcatcgtaagttgtataacataaaaaacctttcttctagaacttattcactaaaagaaaggttcatgacttatcattttaaaaaaattggttctccatcctttactgtgtacggtaaagaataagctggtacaaacggggaacctttcgaaagtatatttcgaatatcttctccctccgtaaactgcccttcattttttttcaaagcgtcatataagtcgattctataatcaacaaaaacttctcctttttcattaattacaaaaggaagtcctttaccagaatatggacttgtcacttgtggcacatctttatatcctagttttttgaaatctaattcatatacaccatctgaaattacttttttaaaaggtggatattgatgttcatcacgatacatcctaagctttaaagatagttcctgaatttgttcagccatcctaacatcaattaactttactgttggatttgtttcaacgtctattaatacgtattgatatactcctccactttcatacgcattccctggcgcttcttgtatgtaacgcggggcaatctgttgaaaatcgatcggatacttttgataaataggtgtactcatatccc

SEQ ID NO: 308 - DNA, 618 bp, Bacillus thuringiensis
atatgtaccatgatttacgacatgttgcactaattctaaaatcgaagtttctaatttccctacgtatggattctcaataacaaatacagcattcacatcttgtattgtaattaaaaactctttatattgatttgccatgttttcaaacattttttctaattcatgtaacgatttagtttcaatttgttttcgtaaatcttctcggtcttgtattgcttcattcatacttttaccatgcaatatatgtaaccacacttgatctgtaatataaatatgcacaaaagtatccttaatggatgggaatacactctgtatctgctcattaaaaattgtctcatagtttggtaactcttttaatcgattgaataatctagtattagcccaagcatgataatcacactgttttaatatatactctttcaatttatattacctccttattgtatgaaacgaatggtttgtttcttcatttctgattctctatcagcctttgcaatccctttttctttcatttcatgcttatttatcgctttatattttacatacgtataaaatttccgtttgaaatggaaatggtgtaatccgaattgttgcctcgtccacccattgagcttgaat

SEQ ID NO: 309 - DNA, 503 bp, Bacillus thuringiensis
tcgcttctcattcgtgaaaaaagccaaagtcaaggcacgcttgactttgactttttgtcatcttacttattatgtttacaattgaattacttgtcttcttttacttcttcaaactcagcgtcaactacattgtctttctttgcgccagcatcttgtgcaccttgcgcaccttctgcttgaccagcagctgcttgagcctgctcgtataatttaacagttaattgttgtacgatttcttgtaaagcatcttttttcgcacgaatttcttcaagctcgtttttctcaattgcagcttgtaatgcttctttcgcttctgttgcttttgcaacttcagctgcatctactttaccttctaaatcttttacaactttggtctgtttggaaatacaagttgggtcagcttcgttacgaagttcaacttcttccttacgtttttggtcagcgtcagcatttgcttccgcttcttgtaccatacggtctacttcttcatcaaaaagacctga

SEQ ID NO: 310 - DNA, 855 bp, Bacillus thuringiensis
cgttgcgcaggacccaaacgtcaacaccacttacttaaggctgaccttacagcaacataacctcgagaggggattcggcctcgctagagcggattgcgagtatagggcaccgctacctccccgcttagcacggcaaagttaaaaccaatattcggttgccttcattaaaggcattatcagtataacttgtttctttataaaatgcaaatacgttagttcccaggattcttctctaatttttttattgcttttctttttttacgaagctctctaaaaaagcttgttaacaacgtaccgcattcttcctctaatacaccagatactacttcacattgatgattgaagcgttcatccgttaaaagattcatcaatgtccctgcacatccgcccttcggatcacttgcaccatatacaactcgcttcactcgtgataaaacaattccacctgcacacattggacaaggttctaatgttacatacagtgttgcatcttctaaacgccatgtccctaattttttacacgcctcatctatcgctagcaactcagcatgagctattgatctctgctcagtttcccttaaattatgggcaacactaattacctcaccatctaacactatatctgctccaattggtacttcctgtatttcctctgcctttttagcttcttctatcgctaattgcataaaataaatatcttgatcttgttccataacatagtcctttcattacaaataaagtacacttatttccatttactacacagggatactttacaaattaattcccctaaagaaaaagagagtgattccattgaaaataccgcttgttatatcgattgatatgactttattt

SEQ ID NO: 311 - DNA, 1042 bp, Bacillus thuringiensis
attcgttcaatcttttggcgtattcttttattttatatccttgcgattctcgttatcggtttattaattccttatacaactgaaagtcttgctgcaagtgatgtaacagtaagtccatttacacttattttcgaaaaagcgggcgttgcctttgctgcctctgttatgaacgctgttattttaacggcagtactatctgctggtaactctggtatgtacgcatcaactcgtatgctttgggatttagctcgccaaggaaaagcaccaaaattcttaggcaaattagatagccgcggtgtacctgtaaacgcattaatcgtaacgtcaattgtcggtagtatcgctttcattgcttctttattcggtgacggtgttgtatacatttggttattaaacgcatctggaatgtctggctttatcgcatgggttggaatagcaattagtcattaccgtttccgtaaagcatataccgtacaaggcaaagatttaaaagacttaccatatagagcaaaatggttcccattcggcccaatcttcgcatttacactttgtatcatcgaagttttaggacaaaactacggcgcatttatgggtgaatcaatcgattggaccggcgtactcgtttcttacatcggtttaccactcttcttagtactatggttaggatataaatttacgaaaaaaacaaaagtgattccacttgataaatgtgaactaaaataaagtgaaacgagcaaacaaatttgtttgctcgttttttgttgcaaacctctttgcttccctattgctcctgtttttgccataatagaagaaatataattaaaggttgggatacaatgaacattcgcattactgatgaagcaaaagcagctatacatagattagaacgtaaagacaaaaagatcattcgcattagagggacaatgacaaactcttgtagtattttcgttgatgtcgatttaatcccggatccatataacgcagatgatgttgtatatgaagaagcagatcttatcgtacaaatggattcattcacgaacga

SEQ ID NO: 312 - DNA, 801 bp, Bacillus thuringiensis
tacgtaacagattcaatattcagaagtcccaatatgagaacagcagcttgtgtaatcgcaatttgcactctagatacaggtgttgctagcatgtatgccattgctcctttatctacatgacgagcaattaaatgtgtcgcaactgttacgcaaaaaattgttaaaatgataataaacaataaactatagtattcgcccgctagaaaatccattacgttttgaatcggactttccataccaacgatttttttcacactatcaggcatggcacctattaattcatttagccctttcgctgataccattgacgggaatatccaaattaataaccacagatataaagctgcaccagacgcataactcaaaatacttttttgtgtttctttcaaactagctaaaaataattgcttattcatgcgttatcccttctttcttatcgtaataatgcataaataaatgttctaaatccatcgctctcgtttgaagtgccgttacattgtagtttgaaagtgtttgtaaaacagtttgatagtttccttgtacaatgatagatgcctctctgccttttaccgcttcaaattgcaaattacactttgtaagagactcaatctcttcttgtgatgatactgtagcatctatcacttgtcttctcatactttgtaaatcgtgaatattttcaactgttacgagtcgaccatctttaataatagctactctgtcacaagttctctcaatttcagagaaaatatgcgaagacataagatttgctgttcctctttgctgttcctttaatattaaatc

SEQ ID NO: 313 - DNA, 1089 bp, Bacillus thuringiensis
agaatggcgatcagttgcccatacatatggcattctaatctttctcgttttatttttttacaatggtgaatatgaaagaatgatttccatgttttaaataaaatctcgatttgccaacgtaaagagtaccaatcatgtacttgtcccatcgggacagtatctgtagaggtgtttgtcatatatacattgataccactgagacgtttactacgaggggaatactttattcctttctttttctctcttacagcttgatcttgcaatcgtttttgttgttgttcatctgtaagtcgatgaacaatcacacgagttggtactttatcagtcattcctacataagcatcggatatttcataggtttgtcctggttggagagagttcattaatacctccatatctatctgtatatactctgtacctttcttgattcttccatcttgaaaataatcaggtgtgagatttttttgataaatacgtgtattggatttaatacgagagatatagtaagcctttttatcttgtatatgttgaagatctttcaaatgaaaataccctaaatcacggatacataaatcatttggtgttacagttggaacacacagagaaccataggttcgatcatgttgtttccctggacctgtatggatatgtaggaattgtccgcttaataggtcatattcaagttgaattttcatcccagcagtatggctacatcctccagccccaggataaatggttgaaaatatatctggaagctgaaatgcagtggaatctaaaatgcgaatacgcttgaaaacaaaggtgtatggagaagaaagtggcatagatgaagttaattttttatttagaaggttagtcaatatatgttgtaaaaactgaactgctgatgtattaaaccgttgattcagtccttctggactgatgagtacttctgtggatgattctaaacagctagataactgagctaaagaggttgtagcgatattttgactcatccatatacataaagcgacataaatcccttgcttggtatttactagttcgttgtaaaaaacaaacatctctagcaagatcccgtaaggtattgga

SEQ ID NO: 314 - DNA, 975 bp, Bacillus thuringiensis
ttccataatgcgaaagctcttttagcaaaagggagcggcccatacttttacttaccgaaaatggaaagttatttagaagcgagattatggaatgatgtattcgtatttgctcaaaaatatatcggcattccaaatggaacgattaaagcaactgtgttactggaaacgattcacgcttcgtttgaaatggatgaaattttgtatgagctaaaagatcattctgctggcttaaactgcggaagatgggattatatttttagctttttaaagagtttccgtaatcataataaattcttactaccagatagagcacaagtcacgatgacggcgccatttatgcgttcgtattctttgaaagtaattcaaacatgtcaccgccgtaatgcaccagcaattggaggaatggcggcacaaattccgattaaaaataatccagaagcaaatgaagcagcttttgaaaaagtgcgtgctgataaggaacgcgaagctttagacggtcatgacgggacttgggttgcccaccctggacttgtaccggttgcaatggaagtgtttaatcacattatgaaaacaccaaatcaaatttttagaagacgtgaagaaatatgtgtaacagaaaacgatttactagaggtaccggtgggaacgattacagaagagggccttcgcatgaatattagcgtaggtattcaatatattgcatcttggttaagcggacggggagcagcacccatttataacttaatggaagatgcggcaacagctgaaatttcaagagcacaagtatggcaatggattcgtcatgaaggtggaaaactaaatgatggtcgtaatattacgcttgaattaatggaagaattaaaagaagaagaattagcaaaaatagaaagagagattggtaaggaagcctttaagaaagggagattccaagaggcgacaacgttgtttacaaatctcgttcgaaatgatgaattc

SEQ ID NO: 315 - DNA, 880 bp, Bacillus thuringiensis
cccgtgcaaacgttgtaagccaaatgggatcactttacctaatgaagagtgggtagaacaaattaaagactatatcgaaaagcattatgacaaatccttaactctcgacatgcttgcgggaatgtgtcacggtagcccttttcatttacaacgtactttcaaaagaataatagggctaactcctatagaatatatacaacaattcaggattcttaaagcaaccaaataccttttacacacaaatcaatctattaaagaaattagtactgctgtcgggatagaaaacccagagtatttcgcaactttatttaaaaagaaaaccggctttactcctactgaatatcgaaaaaagaacgagatgaaagagggatacgataatgaattcctacaaaaataattatatatattggacgctacttacacataaaaattggcgatttcatattgctgcaactgaaaatggactatgtttcattggatcacaagacgaaaactttgaagaattaaatatatgggctagaaaaaaactgccccaacatatattgattcatagtccagattacttgcaaatatatacgcaagaagttatcgagtatttagaaaacaagcgagaaacttttacattttctatcgatgcttatggaactaattttcaattatctgtttggaatacgggaccgggaaatccttatggaaagacatattcttaaacagaaaatgctgaaagaattcaaaaaccctaaggctgtgcgcggccgtgcttctggtatttgctgctaaccctttcttattactatttcttgacaacgcggtaattggaagaaagggaaactaaccgggtttagggggggattagaaatgaagaaaaaattggtttcat

SEQ ID NO: 316 - DNA, 881 bp, Bacillus thuringiensis
ttaccaatatgtcccagtacacccgaatattaagaatctaatcctcccattgcgtagacatataagtaagagcagtgatagcactatcaagcatctaatgcatatcactaatattatgaaatgcaactccaactacacgattcaatgttattttataatctacagtctgacgcaatttttctaattcaggttctagccaacctaacttacctcttgcatcacctatcattatgccaccagcaatcaaggttggaataaaggggattttcaccatgtctaagcccttagattctatgtctttctgatattttacttgtcctaaaaggtcctctagacgcttttggtcagcctccacatcagcaccttggttttttaaaatcgattgcaatgtctctttatgacttccaaatgttctaacatcttctccaatagcattttttaattgaattaattcttctattaatgcttttgcagacttttgattttgttgaattcctccctgtaaatctgtaatccctttttttaaagtatctccatttccagtattgatcgcctctactaatgtttcataataattttcaaattttgtatcgtattctataatgcctgtcaatgtatcaaaaagctgtttttttacttgtgtattccatgtaacagcatgtgctcttgcattcttttgatcttgtacaattttactaggtaaatctgcatttccattaatagttattccttcaaaactcacatctggattattaattagcaaataagaatattcattcatagcttttgcaaataaaccagcatcttgcaaagcccccttcatctgttctacatcctcccgaaagagacatattttcattgttcgattgatcaatttcaat

SEQ ID NO: 317 - DNA, 676 bp, Bacillus thuringiensis
cgcgcagatgttttagcgatggtgttaggtggcattttcaacgcgttcccatatacaacatactctcaaaacgtaggacttgttcaattaactggagtaagaaatcgcgttattatttatacttgcggtggtatgttaatcgtacttggtttcattcctaaaatcgcagctattacaacaattatcccaaaatcagtactgggcggtgcgatgttagcgatgttcggtatggttatggcatatggtattaaaatgttaagtagcgttgattttggtaaacaagaaaacttattaatcgttgcatgttctgtcggaattgggcttggcgtaacagtcgttcctacattattttcacaacttccagaaagcattcgtattttaacagataacggaattgtacttggaagtgcgtcagcagtacttttaaatatcgtatttaatatggtgccgcagcgcaaagtgaaagtagaagaagagccagtatctatgcaaagtgcagtaagagaagcgtgaaaaagcaaggtctcgttatgagaccttgcttttctttttaagtggcattattttcccgtacgtaccaagacgccaaatgtactcaagtggcccgtattggtaatgtgaaagccaccagcggctaataaagaattgtaacgtgtagaaactaatgcagaatatt

SEQ ID NO: 318 - DNA, 521 bp, Bacillus thuringiensis
tcattgtttgttaatcacaattacatcttaccatacccccctaaggtaatcaatggttttatatcatgatttttcaattattttctaaaagtttattttacacacactttttcacatcaatacgccgagatcttattatgaaggtaaacaaaaaaaacaagccagtgacatactagcttgtttttacgcttttgaaaaacgttcaaatacagtcattaattcttcaattgcttcgtcaccattgccatctttaatagcacctgaaacacaatgacttgtatggttttttaatacacccattcctacttttttcatcgctgcattaatcgctgaaatttgcactaaaatatccacgcaataacgatcattttcaatcatattttgaataccgcggacctgtccttcaattctctttaatctatttataatctgttctttttctttttctgatctatgtgttactgcttcatgctctttatgatccatattatcaccttcttaaagtttctcttcacccaata

SEQ ID NO: 319 - DNA, 714 bp, Bacillus thuringiensis
tttctttagcatgaaatcgatctacttcaaaatcagctaaaattacaggttttttggcgttatttattattgaagtggcatgtagaagcattttatccagcgtttctttattacttaaaatcggtttatataaaattggttctgtaggtttattaattggtttattatacacatcaatcggcaaattaatatgaacagggcgtttttcattccaacatgcacgtaaaacacggtcaatttcctcagcagcatgctcaggtgttacatttgtttgtgctatagtgatttctcgatacatattggaaaagtgatcgaactttccatctcctaacgtatgatggacgattgctccattttccattacttttgttggtggcgtacctgtaatttttataactggcacgttttccgcatatgagccagcaataccgttaatagcgcttaattctccaacaccgaaagtagtaataagagcggcgattccttttatgcgagcgtacccatctgctgcatatgcagcatttaattcattacaattgccaatccactttaaatttttatgtgctaccacatcatctaaaaaggcaagattataatcaccaggaaccccaaatatatgttcaattcctaattcgtgtagtctatccaataaatatgtacttacagtatattgttttttcaaatgaatcatctcctaattatgcaatgaatgtt

SEQ ID NO: 320 - DNA, 1019 bp, Bacillus thuringiensis
ttcatctaatgtcgcttttgttcttaatacatttaccggtgtaagtgcaacaaacacatttgattctgatgttgccgaccaaagccaagttggaacagcctaaatttatttatttccctctacacctgaataaaacccaatataccgttaataatgtatatacagtttctgatttcccttcatacccgaaggcttagcagctagcttttgctagctgcttttagttttgcaccgaagataacttatcaaaagcactaggcacctcttattccctgtctttaattcattttattaacttatatttcaattttttggttaacaattaaatatgcccacgggaaacatattgaaaccttttcaatttttattgtcttttgcaaaaagattgctatagacccactgtatattgaactgataacataaaaaataattaataaaaggtaggggggatatgtaacaatgaattcatcaaaagtagctttttcgtcagtattaagtaacacttttatcgtcattttaaaagttgttattggtatttttactggttcagtagctattctttccgaagcaattcattcctctttagatttattagcttcaatcatcgctttcttttctgtccgaatttcaaataaaccggcggataaattacatccctatggacatggaaaagtagaaaatatttctggaacaatcgaaacattattaatttttatagctggtttttggattatttatgaatgtacccttaaattgatacaccccgaacccattcatctcccatttttaggaatagttgttatgttgattggagcactcatcaattttgtagtatcacgaattgttaacagaactgctgaaaaaacaaattctattgcaatgaaatctaatgcactacatttactcactgatgtatacacttctttaggtggtgcaatcagcttacttttagttagtataacagaatggttttttctagacccaatcattggaattttttaagctgttatttcatgact

SEQ ID NO: 321 - DNA, 845 bp, Bacillus thuringiensis
aatatattctacataaaatccttgattccgtgcgtttttatacatcaattcaatcgctttttgatctttcgcataaatttgtatgcattgagcatccactgctaatacgattagctcacacttactttccttaaactcttcatatgtttcaatatctatcgttttttctcctttaggatatgcttttaaatctgcaaaaataagataatatatgttgtctttaactaactttttcaatgctaacccttccactacacttggttcttctggaaataatgcctcatccaattcaccacgtgctattaagtaggactcctcatccctcactcgccaatcaaattcagtaatatcaattgggtttaacactttccaaagtacattgctgtattcatttggaatatctacaaaaatccctcttttcatatgcttgctcctaacttattcattttcatacattatatatgaaatgtaattactatattttgtcgatacatatgtacatcataaaaaaccgctccactattagcgaaacggtttcctttttcttacatttaaatatttcattcaattgttgcactgccttttaaaataatttctaatatatgcaccacattagccgttcattcttaatgctcacttcgactttacaaaataatataaaaaccatactgcatgattttgttcatccgcagctattctccgtaacaactctttcaaatgtacatcggatgtctcatctgaaatttccaaataaaaatctactgttttttgttcatcttgtatagcgaactctaatccttgtaaatacgtatttgggcagtcttcagtaatttgtggtttcggct

SEQ ID NO: 322 - DNA, 711 bp, Bacillus thuringiensis
gtttcccagtttaaatatcgccggaaagatggatatttagaggtagaagcgaatgagttatttccaaatggagcgtactgtacatgggcaattggtcatttgacgcagttatgtaatccagagcattatcacgcagagtggaaaaaatggtcacttaatacattaccgatgattccagagcgttttcaatttgaagtaacaaagtcaaagtataagcaatttaacgttgtgaaacagctgttacataatccacaggtaacagaaattattcacgcaggcgatgctgggcgtgaaggggaactaatcggacgaaatattattaatctttgtaatgtgcaaaagcctatgaagcgtctatggatttcgtctttaacgaagcatgctatttatcaagggtttaaaagttttacttgatgaatcagatacaattaatacgtattacgaagcatacacaagatcttgtgctgactgggatgttggcatgaatgcatcacgtgtgcttagtattaagttgaagaaaataggaatgaatgatgtatttctgctggccgtgtccaaacaccaacgttagcattgattgtaaagcatgagcactaaattgaaaactctaagtcatagccatcatgggaagtgttagcgacctttaacatagaccgaacgaactttgactgctaatgtgagaaggatctagaatcccggttaaaagaccct

SEQ ID NO: 323 - DNA, 847 bp, Bacillus thuringiensis
  unsure (1)...(847): unsure at all n locations
ctactaacttttttcccatttttaaacaacaaggaagtgtatctcaattttttagtacatgggatcaatttgatggagagtatgcgttacttcaaggggagagttttcaattatttgtacctaaaaaagataaagagttagtaagatctttaaaagattttcaatcattggatgagttaattgcgtattatgaagatatttttgtgatgtatgattcaattattggtttagatggctcaacgtttgaaaataaaaaaagtcaaaatcgttatttcttaaaagcagatatatctggtgctggcggtgcctattatggcacaaattggacagcgaatagtacagatagtacaaagatgtggttagataaactaagttggggaactttacatgaaatcgctcatggataccaagctggttttgataatcaaggaatatttacaggagaagtttctaataatctatttggtgttcaatatcaatatagtaaatacggcaaaaaagcagatcaagttggttggttgtttaatttcgggaaaaaggaacaggtagaacggaatttatataatgctttaatgaaagaaaataaaaattatgatgatttagatttacgacaaaaacttattcttttaacgatggcgaaacaaaaagctggcgatgaagcatttgcaaaaatgtatcaaggttatcgaaaactagctagcaatgctgctttcaaaaaaggtgaccattctttaccagatttaatgaatcagtattatagtgagaatggacaagttgattttacacctgtttttgaaagatggggctnttagcttaatcataaacaaatagagatgaatagggcgaa

SEQ ID NO: 324 - DNA, 1189 bp, Bacillus thuringiensis
tagcaattatttatctacaactatggatttaagccaaaaacattttggtttttattccttttaaattatatattcaatcaagcgttcagctattttcaatttagccaaaagaatttgtttttagcaacaatagattgtttactagtcgctattactacgttgcttctcatagcggtttcttccaatttatctaaagtatcgacatggttgctaattccatattttttatggactgcatttgctacatatttatcttggaccatttatagtataaattaaaggcgtaaataaaaacttgagcataataaaaatgctcgagtttttatgtgtgttaatgataatccgaaatatggaatatatacatcttatggaggtcatctttgtgaagaaatggataaaaattacgctgtactctttactagctattttaattataggaagtattacttttttgacttggtctcagtttacttataaaccgacgcaagaggctttgtcgttagtagatgataaaaaagatgaagataatatcgtttttggagcgaaagatgcgaaagtaggggttattttttatcaaggagctaaagtagaagctgaggcttatagttacttaggagaagctcttgcaaaagatgggcactttgtagtaatgcctcagttaccattaaatttagcgatacttggaataaatgaggtagacagtgtaattgaaaagtatccggaagttcaaaaatggtatgttgcagggcattcaatgggaggagctatgatttctaagtatgcctttcaacatgaagacaaggtagacggaatcattttcttaggttcgtatcctgcagatgacttctctacgaaatcgattccgatgttatcaatttatggggaagtagatgctttagcaactgtagaaaaaatagaaaacaataaaaagttcatgtccaaaaatacaactatgcacatgataaaagggggcaatcatgctcattttggtatgtatggtgagcaaaaaggtgataatgcgagtttaattacgccaaaagcacaacgagatgaaacagtaaaagtaattgagcaatggttattggaacaatgataacgaatttaataaatctaccgaaagaattatccaaacggtagatgggagagagaataaagagccaaatcgtatgaattggctcttttatttatt

SEQ ID NO: 325 - DNA, 876 bp, Bacillus thuringiensis
agaaacgaaagaccatcttgaaacttttttactattactgcaaaagaaaaaggcgtgatttaatcacgcctttttctttatactattcggttgatagtatctattcctttggggcgcttttatatacactttttgaaatttgtccatttgatattacttccccgttttgtgttacttttttatacgtaaccgctgtgattttatcactagtcctactaattacttgagaagaaacttcaacatttttaccagtatttgtaccgaaaatgcgtgtagtaatactacctccatttgaaaatgcttgaatataaatataattgcctgtattatttttaaattttaaatctggaccataatctgctactgctgcatcttgcccaagtggtaaataatttactggcatagaatgattgcttcgagaaacaattcctaaatcagcccttaaagcggcgctgtataaagtactactgacttggcaaactcctccgcctgcactttgtattactttaccttgtgaatatactgctgcagatttgtaaccatgtgcagcatcagttacgccaacgcggacgttaaaactaaatgtttcatcaggtgccacaataaccccacttaaagtattagctgacttatttacgttaaatgattgatatccgttacggccagccattggagtagaatattcagcaatgacttctttaatacccattttctgtatatcttgtgtagaacgttctggttttatgaatgtaactggtaatgtaacatgtgatttaccagtggtaattgcttcccttgttaacctgctgacttttcctttatcaattttatctccgttatggctccgactaacatttactgctgagccttcaacgc

SEQ ID NO: 326 - DNA, 1095 bp, Bacillus thuringiensis
acgatgctagtaattgcatataaactacaaagcacaccaaatcataatgatcaggttagatttgaagatttaaaagggcattggggagaaaaatatgccaatattttaatagatttaaaaatctctaatggtaccgagaacggttggcaaccaaatagatttataacacgtgctgaagctgctcaacttactgcaaaaacagatatgttacaacaaaatttaaacgatgaaaaagaggttattactgctacctcatatgaagatttaaatttaacagtggcttcgaaaattacagctcaagagattgatagttttattgcgaaatatcactcggatagtcctttagttggacatgggcaagattttatcaatgcgcaaaatcaatatggcgtgagtgctcattatttagcagcgcatgcgattttagaatctggatacggaaaatcagaaatcgcatatcaaaaacataatctattcggtctacgtgcatatgatggagatccgtttaaatatgcaaaatatttaccaagctacggggatagcattgcttataacgctaattatgtacgagaaagatatttagaagaaagtggtatgtattataacggcccaacattaactggcatgaatgtgaaatatgcatcagataaaggctgggctaagaaaattgcgggtattatggaacgtattaaaccgtttcatgtagaagactatacatatgcaaaaaaattaccaaagaatcctgaaacattagatgtcgacgcgttatcgaatgaaattccatataaaatgtatgcagacggttcaagctcaaatgttgtatcatcagctgcttactaccaggtaccttatccatttaatttaaaaattaaaagtagaccagatgtagctgtcgaggagaataaagttggtacagtaacccctggaacaaccatctttatttatcgtgaagatccaaatggatgggtagtattctctcttgagctaatggagaaaatattggacattaaaaaataattagtatgtaataaaaagactattcattagttaatcgttagatttatctatatatgggagacagttttattctaaata

SEQ ID NO: 327 - DNA, 784 bp, Bacillus thuringiensis
gtggaccattccaatatgaaccacaaagtgtagaatggatttgtggatttacacaactaggaccttttgatgggcacattgcctgggctggtcagtttcccgctttagatgttcaaactgtagataggtggaagaaagttacgttaaatggcgggacgaatacattcaagtggaaactaacggctcctcatagtacgaaagactggagatattatattactaaaaaaggttggaatccaaataaacctttgacgcgatcagatttagatttagtgccattctatgtaaaaaatgacgggggagctagaccagggacaacacgtacgcacgaagcaaatgtaccaactgaccgtagtggataccatcttattttagctgtttgggaaattgcagacactggaaatgcgttttatcaagttatagatgtaaaccttttgaataatggcttatcctcaaattttgcttttaacaatgtagtgcaagctcctacactattttaattgaaacatacatttcgatcatctaattcattttagatgattttttttatgaaaatgatgaaaaatatagaagaaagtgcaattatttataaaaaaatatgctttaaatattgtcatatttgcttctttaagatatccttttcatgaagaggtggaaaacatggaaaaagtactagttttcgggcataaaaacccagatacagatgcaatttgttctgcaattgcttatgcagaattgaaaaaagaattaggaatgaatgctgagcctgtacgtttaggcgaaa

SEQ ID NO: 328 - DNA, 615 bp, Bacillus thuringiensis
agatttcttgttcatcttaacctgattctttgctattgaaccaaagtaagtatctgttccagtacctacaactattacttttgctgtaccacttataatatgagttcccataaaacagagattttctaattcaattaaattttggatttttctaattttacgttttttgtacatatggaaatactgatttgatttttcaacgggtaatgcttctcctgttagagatgattgatttacaagtaaattttctgatgagataatccgtacatctgcaggcacaatatttccagcagataattctataatatcccctggtacaagatcctcaagaccaatttgtaactttccactttcctccaataaagttctcttattttctttataaggaatatttcccttcctgagaacagttaccttttcatatacaagattttttaatctttctatagacttctgagaacgaatttcttgtatgaaccgaattaatacgcttaacgtcaccatgattcccacaataatagtaccttttatatcattggtaaaaaaagataacattcctaatataattagaagagaaataaacggacttctaaaagaattaaataatgttatata

SEQ ID NO: 329 - DNA, 901 bp, Bacillus thuringiensis
agaaaagctttgttcataaagtagacaaaaaacacactcaaatgattttaagtgtgctgtataaactatgtgcatattattttgcttattcagatggcatgttccttataggcgtatattagatgaagtcttttatattaagtataaagtttgatatatgcaattatctgtcctgtttgatctagtggggggaacggtgagtggatttaataggaagttttgcacaacaatccaaccgcttgcaatacgaataaaaaataagaaacaaatttttaatatcacatcatctctttttactgaaaattccttttagcgtaacaaagaggttaattatagttcaactacattacgataggttatcaattatagacggtattttacaataccgttactgggcatttcaatgaggtgaaaatataacaaaaagcctgataaaacaacgtttgcaagcaaagtattcgtaggctgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcatgtacccaatttcatcaataataagtaatttgtattttgtatagtgctttaaacgagattctaggcgattctcaatcttggcacgttttaaattttgaagtaaattatgacatttaataaaataagtccttgttcgctttttagctgct

SEQ ID NO: 330 - DNA, 612 bp, Bacillus thuringiensis
cggaataattacgttttagtttgcgaacttagtataaggcatctttaataaagttgcaataaataataatcattccgatttgtttttgttataaagttgtcaaatataggtgtattatttttgcaaatgcatgcatatgtgacaacgctgttttcatatattgaaaaggaggtaaagagggggatgagcgcttgggttatttaatggaagctattttattaatattagcggtagtattgccattatctttcgtattaatttttttaagaagattaataagtaatttaggggacgctacacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgtcacaggc

SEQ ID NO: 331 - DNA, 833 bp, Bacillus thuringiensis
ccttcaaggtggagatactggcaaggcgacggaacgtttatccccaaaagaggaaaagcagtatataagagaaatgaagagtaaataaaaacatcgccaacctagatgacgatgttttttcattaagaatgttttcgtattaaaggtctagttggctgaacggcaacagttttgaaatgagaaaataaataacatcctgttacaacgacaattgtccctaaaatttgtatccacgttaattcttctccgagaaatatgaatgctaaaatggctgtgaaaattggattgaagtttagaaaaatacctgatgtagttgcgcctaatttttgtacgccaatattccaaaataccatacaaagaactgtcgaaataagcccagtatataaaagtgatgtgatgaaagaagtatttatatttgaaacagtgaagctacctatgttaaacggtagtaataaaataacgccgaaaataccagagtacaacgttgccattagtggtgtatttgcttttgttgcccatttactacaaactgaatatattccctaaatatcaaaccgctgcaatgattcctaaatcaccggtattaaaatgttgtgaaaataaccgcgtgaaatcaccttttaataggacgaggatgaccccgatgaatgaacgaaacatggataggatttcaactgaatttacttgttcttttataaattttactcaacaggatgcgattgaaataggattccatggagagatcttacctacatttgtggcggctgaatggtcataggctatcgattgcgtgatgattttgaagagcaacctcgtgaaattcccattaatat

SEQ ID NO: 332 - DNA, 889 bp, Bacillus thuringiensis
taatgaatatttacttcattacatggaaatgaaaggtgtagacattcgaaataaagatattctaattcaaaatggatttacaaaaggattggatattgtactctcttctttatcaaaaaaatctggtcgtgtcatttgtgagatcccaactcaccacgctgcactaaagctgttccgtttacatggacttgaagttcatgggattgatatgaatgaggatggtattgatacgaataaagttgaaaaaagcttgcgtgaaaaagattttgattttgcttatttaattccttcttatcataatccaaccggtattgttacgagttcagagaaaagaacggaattgatgaggttattctcaaaatacaacgttcctattatagaggacggatttaatgaagaattacgttattcaggttcacatttagctccattattaacttttgcgggagctggcaataatgtcatttatattagtagcttttcaaaggtacttttccctggtttacgtgtaggctggattattgcagataaagagctgattcattatttagaaagcgtaaaaagagcaagaacgattcacacatctacgctagatcaagctgttctgtttcaatatttacatgagggatattttgagaaatatttaaaaaaggcaagatctgtttataagaaaaaatatgagttagctgtcggggcatgtaaccagtacattcatttcaaaagaatgactggagatggtggacttcatttatttatagaactagaagagcatatgaatgcccgcacacttttacaaaagtgttatgagaaaggcgttacgttttcacctggagatgttttttactctgatggaaaaggagcgaacactttccgattagggttttcgcgc

SEQ ID NO: 333 - DNA, 1072 bp, Bacillus thuringiensis
aatatccccccatatttttctaccaaatccctctttcaatataatataaagcgctctcgaattccatcgagagcgctttattattacctatttcggtaaacgtgatagcttttcagcaattgttctataaaactcttgaatgctagaaaaacctaatgagtctgaaacacttaatcctaccatatcgagatgatcccaattcgctttcgtttcgatatgattccattttccaatctgtaatgacccattattatttacagcaacattagaagatggtgcaatcatagaattcgtatttactacaccatcattttgccaccaagaagtatcaactaacggacggttttcttcatatctcgcataagaacctaagaaaaatgcattccccatcaacaatttattcatcgtaatatgcggtaaatgtaaacctgttataggtgctgcttgtgatgcatgtccactataggataaataatacacatctggttgcgtctttacccaattatttaactcctttgcaccatctgtacttaaatcccattgacttatatcttttgtatttttccaaagtgatctatttagaatacgattactatattggaaaaaggactctccagcatttttctttataccccattgatccaatttaaaatcatataatgataaattattgtttcctccaaagcttgcagctgtaatgagtaaatctttaacgaacggcagtagaagactaccatccgcaagtgttgtaccgttgtgaggggttgctaatgttgtaacactatgaacatatgattttccgccttcaaatagtggtgatattttgatgtctgggtgatttttcacataattcttttcttcaaaactaccttcttttaatagctgtactaatgttctaatcgctcgcccacccatgctatgtccaactaaatgaactttatttgtttcactccaattcggtgcaaaaccactataagttctgccataacgatcatgtccatgtttccttagccatgtacggcacccatgcctactgacccaccgctcatttgcgcatacaattcacatgcac

SEQ ID NO: 334 - DNA, 1148 bp, Bacillus thuringiensis
  unsure (1)...(1148): unsure at all n locations
ttgctaatatatctatgctctgaataccgtcataccacttattatttttaaaaatatacagtctttgttccatcttactttgtagttcttgagaaagctcatacttctcaactacatcttcatttcgaaatgaaacaaatttcatcttaccctttttatctaattttttcgtacgttctgcaacagccgtacacatcggacaccaactatcatagaaaacaatcatacattattcccctttacgtgactccgtcatttgtttccatacagaaccttttgcttcttctccgccttcaatacgctctaatgctagacgtgcttgcatcgctacttcaaactctggatcatcttgcgctgcttttaatgctggaatcgcgctttcatctccaagttcaaataagaacatcgctgcacgccagcgtactaatttacttggatctttcagagatttaatcataacgaacatcgctgccggatcacctacatctgataaacaatctcctgcagtacggcgaacacttacagagcgatctaacaacgctttatataataacggtaatacttcatcaccttttaccatacctaaatacgctgttgctaaacggcgtattgaaactttttcatcatctaacgccatcttcaacactggaatatcttcttcagtaggatccatttgttctaatgctgcaaaacggtttttccagtcagaatctttcatcatctcttctgttactttatatggctcacgcttttggatcgttacttcaacagcacctgcttgatttaataattctttaaccgtttcatttacacgttcttctgaataagcagcaacaatctcttctactacttctttcccgatttcttcaaagttaccgtaacgtgtactttgttccacccatttacgctcttttacaacatttggtgcagacatttgcactttcataattgattctttaaaacgatcaggtaaaccaacacgttcttccgtcgttccatctgttaactttacttgcattggaattgtaaagaacatttgaacaaacactttcacttctncaaatgagcaagttgttgttcttcactttcttccactacttcttcgccgaaacagcacgaacttgttgttataaaactttcagtcatac

SEQ ID NO: 335 - DNA, 920 bp, Bacillus thuringiensis
ctgtgcaatttgctggataagaatatacaagcataaaggtgagaacctctatgcttgtatacagttacgactatttatcccgctatttatgggtagtaaaatccctactgattaaaattttactttatttaaaagagattcaataactgcaattgcttcttttgaaccaccacattttaaaaagctatcattaagttttcttataccatgtttatacttttcatttgaaagaacatctgttacggcctcttttaaagtgtgcacattaacatgttctttcaatagtctatgtgccgcttcaagctcagttaatctttgcgctatcattggctggtctttatcatgcggtattattacaaatgggacattataatgaatggcatcgtgtacgctattcataccaccatgtgtaataaaaacatctgcttcatttaatatttctgattgaggtacgtatggagcaattataaaattatctggtgctttcttaattttagaaatatcatttctatcaccaattgccattacaactatcccatcaaaatctgaaaaagtatcaatacaagtattaaagaatggttcgagtccttcaagcagtgttcccattgaaatataaataactttcttttctttaagtgattccagtggaaactttatatttgttttacgctttgaaatactcggtccaataaaaatgttattttctccgaacgattcgttattaggttggaaatagcgacttgtgtatacgagacaaacatcacccttattattcataaattgaagattattctttggttttactccaaatttatgttccatctgatttagtaatttttcagagatttcctctggttggaatggcatatctgcatttggataaaagggtatgtcttcaaaaatctggcgggattaaaaat

SEQ ID NO: 336 - DNA, 1207 bp, Bacillus thuringiensis
tcgataaatgtgagatgatttggatagatgttgaaaagctgtttctttgcatcctcttctgatagagtaataggttgtttcaaatcttcctgttgttgtaaattttgggcactatctcccgaaacgctcgtaagtacaccatcatcattaatatgtgctgttagttgatatccgtatacatcacgtccttcatacgtttgttgaagacgtaccaatgtagtaccatcataagatttacgactttgcgtaacattataattaactttggattccgtattaacttgctttgatgataatgcttgttctgtttttccttttagtgcatcctttgctacattttctgccgaattttgagaaggtgctgttaaattacctgttcggaacgtatcttcctttgtttccacttttaaatcttctgtttccgcatgtactcctccataaggcataatcgccgataacaccactcctgtagttaaacctacctttacgaaattattcatatttttacccctttataatcgtattattaaattaaataaatgtattttagaattttaagcatagataaaaaattttaactatagccaatcgtttttacatacctctacatacataggttaatagattggtttgctacttttttagattcaattcatttctcaaaaattattcattatataagctatctttatatttattcatatacgttattttttggggttctgataacatatttattgccatccacacattctttttcatttctaatttttgcattggtatctcttttaaaaactgattacctataatcgcttccatttcttcatcaattctttgtataagattttcttctggattattttgcaaagaagtatttttcaatccccattttgttattataaattcattcattttattcataggattaataatagtagctttactagttaatcgtttttttatttcatcatgatagattttaattctatatccctcttttagtggaatgatatcttttacaattgttacatttgttccttccatttccttcgtataaattttttcacctttttcattaaagacctctatcgatgcatatttttcacctgcataatagctatgaggcgttttagtagtaatcgtaaaaatagctcgattttgctctaagtctgtatttaatacggcaaactggtcatctcctaatcct

SEQ ID NO: 337 - DNA, 854 bp, Bacillus thuringiensis
ttgccttggtgtgccgttacctcaccaactagctaatgcttcgcgggtccatccataagtgacagccgaagccgcctttcaatttcgaaccatgcggttcaaaatgttatccggtattagccccggtttcccggagttatcccagtcttatgggcaggttgcccacgtgttactcacccgtccgccgctaacttcataagagcaagctcttaatccattcgctcgacttgcatgtattaggcacgccgccagcgttcatcctgagccaggatcaaactctccaataaagttagtttgtctagcatctaaaataaaaattgacgtttcacgttgtttgtttcgtttagttttcaaagttcaatatcgcgtttcagcgacttttataatttaacacttctcgttaaatctgtcaacagtttttttctttcgttgctgacgacgcttattaatttaccatattaatcatttaatagtcaacactttttaaaaaaatgccaaaataattttatcttggcatgatataaagcttaataatcactaatgctgccacacccggtaagcctaacaaactcgttattgctgctgtccccatgttaatcgggatatgaaaatcaaaatatgtccctacaacatttacgataaaaagcaatgctattcctaaagtaacatgaaaaatcaccttacctataaaacgtaatggcttagaggcaacaccaaaaacaagaaaaataaatactaaaggaagaatgccaacaataataattgtagaattcattttttccttcttatgaatgacctatacatctatttgtatgggaccaggacaataaaaagaacagttatcatatgcagca

SEQ ID NO: 338 - DNA, 1096 bp, Bacillus thuringiensis
tatttgaatggacccgaggtataaatggtgaagaaggtttaacgaagttatcggtggaagaacagtataaggcaggaagaaaagcgggggaagtattaaagaggattcacccaattgaaagagaaagtgcaagtaataaatgggaaacatctagatggaataaatacgaaagatacatagaggcactaacagattacgaggtgaattttctggatttgaagccagtattaacctttgtagaaaatcataaagatttattgggaaatcgtccaataagatttttacatgatgacttccatccagcaaatagcatgattcataataaggaatttatcgttatcgattttggtggatatgattttggtgatccaatacacgatttttataacgtagcgatttttactataagaataaggtaaccatttgcggttggacaagttcacggctatttcggaggcgaaccatcgcttcatttttggatactgtatacattgtacgttgcgatgacattcccagcggatatcgtttggacgaatcgaagtacaccgcatttagtaagatgatatgaaggaaagattaaatggaattttagaagatcataatcatttttcatcttatattccaaaatggtatcaatcaagcgaatttaataaataaaggagtaatttatatggataaaatagcagtaatttcagatattcacggtaatattcaagcattagaatccgtgttgaatgatattaaattaagaggaatcgagcgcattatttgccttggagatttagtaggaaaaggacctcattccagtgaagcaattgaaatcattcgtaaagaatgtgaagtagtcgtaatgggaaactgggatgattttattacaaagccgactgaatttgaagcattgaaatggcatcaaaaacaattatcggaagaacaaaatgactatttaagaaacttaccattttcaatcgagttttatatgagtgggaaattcattcgtatgtttcacgcttcaccgagaagtttatatgaaagaattcaaccacacgcttcaagagaagaacgtattagtatgttagaaaatagtgatctgacggaa

SEQ ID NO: 339 - DNA, 952 bp, Bacillus thuringiensis
atgcgaaatatacattcctatcccaaaaggaactagataaactgcaagatagaattaatcatccaaaatggtcaaacagtgatgagcatatttataaaaaaatagtaggaaaaagattagaagaattaaaaaatcagccattagaaattgatgtagaaacaattaaaagtaataaagatagtcgctttcttttcgaaggaaagttagtaacaattagtaatcctttcaatgttaaacttgttagccatcaaggaacacagggtgctaacaggggagaaaaaattagtgtaatggcaaaacgtaatcatgcacttgttgctgtgaatgcaagtggatttgctgacgaaacaggaaggggtggaggaaatgttgctactggaattgtgatagaaaatgggaaagctattgatacaaatatggatagaaatgcccctacaattattacgggattaacaaagtttggtcaaatgataacaggaaattattctacccaacaactgttggataaacaagtcgtttccgcagctggatttatgccacagttaattgtaaatggagaaaaaatgattacagaaggagacggcggttgggggtcggctccaagaagtattatggcccaaaaagaagatggtacaattatgtttctagttattgacggtagacagacacatagtataggagctacgttgaaagagtgtcaagatattctatatgaaaaaggagctataaatgcaatggcaatggatggaggttcttctgctacgctatatttaggaggaaaggttataaattcaccgtctacattatcccatgaagatcgttatttaccgaacgcttgggtggtaacagcaaaccaaaaacaaaaaataaagatgacaattgatgggagaaaaatagataccaaaacatcagatgaatttgatgcgaacatttcaacgaatttatgaattat

SEQ ID NO: 340 - DNA, 1074 bp, Bacillus thuringiensis
ttgaccatggtaaaacaacacttgttgaccagttattacgtttatgcggggactttccgtgcgaacgaacacgttgaagaacgcgcaatggattcaaatgatctagaaagagaacgcggtattacaattttagcgaaaaatacagcgattcactatgaagataaaagaattaacattttagatacacctggtcacgctgacttcggtggagaagtagaacgtatcatgaaaatggttgatggtgttttacttgttgttgatgcatatgaaggttgtatgccacaaacacgatttgttttaaagaaagctcttgagcaaaacttaactccaatcgtagttgtaaacaaaattgaccgtgactttgctcgtccagatgaagtagttgatgaagtaatcgacttattcattgagcttggtgcaaacgaagatcaattagagttcccagttgtatttgcatcagcaatgaacggaacagcaagcttagattcaaacccagcaaatcaagaagagaatatgaaatcattattcgatacaattatcgaacatattccagcaccaattgataacagcgaagagccacttcaattccaagtagcacttcttgattacaacgactactttggacgtattggagttggtcgcgtattccgcggtacaatgaaggttggacaacaagttgctttaatgaaagtagacagaagtgtgaagcaattccgcgtaacgaaattattcggttacatgggattaaaacgtcaagaaattgaagaagcaaaagcaggggacttagtagccgtttctggtatggaagacattaacgtaggtgaaacagtatgtccagatgaacatcaagatgcgttaccattattacgtattgatgagccaacactacaaatgacgtttcttgttaataacagcccatttgcaggttgtgaaggttaatacattacatctctgaaaattgatgagcgtcttcgttacatttagaaccgatgttaggttacgtgtgaataatacagattctcctgatcgtggatctactggacgtggggaactcattatctatctaatgaaaca

SEQ ID NO: 341 - DNA, 1026 bp, Bacillus thuringiensis
tgatgacggtattttttattgcatacaccctcgtgtatttactgacctaatatgatttgagcagcagatgaatctacacatcgggatgatgctttcttcgctggacaatgactggtgctgagggatatgttgaatcggcagcgtcaggattattagctggaaccaatgctgcgcgtcttgtgcaaggtgaagagccagttgtattaccgccagtaactgcgatgggtagcatggcaaattacattacggcaacgaacgctaaaaacttccaaccgatgaatgcgaacttcggtctatttgcaccgttagagaagaagattaaaaagaaagcagaacgaaatgaagcgtacgcagcacgagctttagaaacgattcgaaattttgtaaatatttagttaaatttcttgcaaaggctactaagttgtgatacgatttagtagcctttattgaggtgagttgtgtgaatgtgaagaaattgttacaattattcgttggatatttacaaattgaaagaaattattcaaaatatacaattgcaagttatcaaaatgatttagaacattttgtgcaatttatggaacgagaaggcatatcctcttttttagacgttacatacgcggatgttcgtttgtacttaacgacgttgcacgatgagaagttagcccgtaaatctgtcgcaagaaaagtatcaagcttacgaagtttatatcgttttttgatgcgtgaaggttatcgaaaggataatccgtttgcacttgcgtcactccccaaaaaagaattgtcaatcccaaagtttttatatgctgaagagttagaggaattatttgaagtttctgacacagaaacaccatttggtcaaaggaatcaagctttgttagagttgatgtatgctactgggatccgtgtgagtgaatgtgttaatttacaacttaccgatattgactttgcggtgggaacaattttagtaatgggaaaaggaaaaaaacaaaggttttttcctttcgaagctttccccagattttttat

SEQ ID NO: 342 - DNA, 811 bp, Bacillus thuringiensis
tgcacgtcttgcagctaaattaacaggctggaaaattgatattaagagtgagtctgatgcgaaacaacttggtattgtaacagaagaagatagcgtaatcgcatttggattcgattcagtggaagacgaaatcgaatagaggtgatgagtatgagcaatcgaaaagttccgttacgaaaatgtgttgcaacgcaagaaatgaaatcaaaacgagagctcgttcgcattgttcgttccaaagagggagaagtgtccattgatttaactgggaaaaaatcaggacgaggtgcttacttgtcgaaggacaaggagagcattcttcaagctcaaaagaaaaatgttttggaacatcatctaaaagcgaaaatcgacggttctttatatgaagagcttcttgagcttgttgagaaggagtcgaaataagtgtccgattggaaatcgtttttaggactagcaaaccgggctcggaaaattatttcgggtgaagaactcgttttaaaagaagtacgaagtggcaaagcaaaacttgtattgctatctgaagatgcgtcagtaaatactacaaaacgcatcacagataaaactacgtactacaacgtaccaatgagaaaggtcgaaaatcgacaacaattagggcatgcgattgggagagatgagcgagtcgttgtagctgtgttagatgtaggctttgcgaaaaagctgcgtagcatgctcgatacaaattaccgggggtgaaggtatgagtaaaattcgagtgcatgaatatgcaaaaaaacataatatctcaagtaaagatcttatgacaaaacta

SEQ ID NO: 343 - DNA, 836 bp, Bacillus thuringiensis
taattttgtaccaaccattttcagcaccagtaacgtttaatactttaccatttgttactccaccgattcaagcgttgtatgtagctgggcctgtacgtacttttaaagcaccagtgttaacaacataagaaccaccagtttgaactgttgtagtattgttgtttgtagttggttgttgtgtttcgttagatacagcagaaccaccttttgttacgaagtctttgcttacgtatccagttccaccattgaagttgattttaaaccaatcttgtacttcacctacaacttgtactgttttacctttgtttacagaacctaatactgtatgagatgtacttgggcctgtacgtacgttaagtgaagaaacgtttactgtgtaagtacctgttccttgttgaacagtcgttcctgttttgccaccagtcgttacgaagtcaccacttacataacctgtttgaccatttacgtttactttgaaccaaccattttcttgtccaactacttgtagcacttggcctgattttactttagaaataacgttatgtcctgtaccagcacctgaacgaacatttaatacatcagcagttactgtgtattttaattcagatgttgtttctacagtttttgtttcagttacagtcgtttgagtttgagtttgtacattaatttcttttagcgctttattcgaaacttgtgcatgagcaggatccatttctggaactgcaacgccagctacagaagctgctgctaaacctgcaattacttctttcataagccggatttacttacttttcctactatccttttaaaaaaactaacctttattctttacaatt

SEQ ID NO: 344 - DNA, 708 bp, Bacillus thuringiensis
cacttttataatacaaagtgtgttttttattgcatccagatcacatacgaacgataacagaacctccagctggtgcacaaacttggtttttttgttgttccattgatttaattaattgattattttcctcgattaatgagattaatttagttaattgattttcaagacttgcaatacgctgcatcatatattgtgaatcatgatgcaatgtattccttgcgggatgaggggaataaacatactgttgatttatatttggattccaatgaggatacatttgaatcgttcctccttcaataaattacgaagctttcttatagtaaatgcctatgtataattaatagttacttgaaaattttccaatataaaaggagtatgtacagaaaatggaaaatattatatgtaaagttacagtacattttttggaaatatttaagcgagatagtccttatattaatacattcaagtaaatgtatgttatttagggagaaatgatgggaggagatgtaattttggctaaaaataaaaaaagaaatgatgctttggcaataggtgtcggtataggagttgtaattggtgtatttcaagggcactttacaaataatttagtaatcggaattgtgattgggattataattgggattgcgtttttgaagaaataatgagatgtaaattcatttcaaaaattgttgtatcaaaagaatgaaa

SEQ ID NO: 345 - DNA, 1443 bp, Bacillus thuringiensis
gagcgaacgatacttatacctgttacaccacgatctgagacattattaggaataagttcagcctctaatccatactcggttatacatgctcctataacaattataactgcttgcgagagtcttattaatttattaacattttgagtccttatacttcccatctcaagtcctcatttctcacagtgttctctctttgtcattttataatcacaccagcttctttaatcttagtgttacaccgtactatgtaacttctctcaaactataacttcctatacttaatccaaagggtattcggtatatgtatggattcttataagcactaatcatgcgttaccctattaaatacgttatccactttgccatttaaacaccatgaaattattgttaatagaccgcacacagaaactactggctgttccacctcccaagagtttaaattatttccgtccacttacctatcacacagtatcaaaaccgtagttcatgaaatcaattccataaacatactgagtgctactttacaagtctcaaaatagcactaactgaccaatatactcattcagtcaattataatatacctaaaactaaagtgaaattccattaattaatattctttctctttattaaaacaagatacataatgtaggattgtttaagttttttataaaataagtaagttttataaacactctagttttcaatgtttttatgatgtgaaaactatttaaattacgcttaatcgagagtaatttattcaatatattctttcttttcactcttgtattttatcttcattcgtgtattatatgatgcaagaatcttcacatagaagaaaacttttaacaacgaggtgtatcatatggagacaaaaaataatgttacaattggttcctacgtacaatttccctatcgtaataactccaccttacaattaacaggttgtgtagttaatatcttacaaaatacgattgtagttgatattgctgaaattgctgaaacacatgctattgaagaaactaggcaagttgtaaaacatggttattataaagtgaaactttaatcagcccttcaccatttcgtgcttttacgggcagcagggccccacctaacttcttttctttcgttgaattttgaggtggggtcttactgcatggcaaatagcaagattaaaagatgaagtaaatcggtaacataaaaaagacactagtacacactaggatcttttttatagcgttgtttttatagtattttaatttacagccatcatactaaaaagaatcgctttccaagttcttatttttaatgatattacataaagaattgagagattattatctaagagccttaactataactttagttgcctctgcaatgagttgattatcataggttgcctctttctcatctttactagataaaattacgatgataattggtgct

SEQ ID NO: 346 - DNA, 1386 bp, Bacillus thuringiensis
tatttatctaattacaaaagtgtttgatttcctcatgcctgggttccccactatgttttagcaattaaggcaacatacttattccggatttcgtttttttagtgtatatttataaatttaataacgtttttgcaaccatgaagtaaattattaatcctgttccgtcaacaaatgttgtaataaatggacctgaaacaactgcaggatctagttttaattttcttagaattaaaggtaaaacagctgctacaagagaagcccaaataacaataaataataaagtaattgctacaacttgcgcaacttctgctccaactcctaacatataagcacgaatgagcccagctatcccaagtgcaagtccaagaagcataccaattgcaaattcttttttcattacacggaaaatgtctttaaattttaactctccaataccaattgcacgagtaattgttgctacaacctgtgttcctgtattccctccagtacctactaataatggaacaaagaaagcaagggcaactacagtttcaatttcgtcttcaaaatactttaatactgtacctgtatatgcctcagcaacaaaaagaagtaataaccatggtagacgttttaggaaaatgctccaaatactagcttcaaagtaagattgattcaatggttcacttccgcctaacttttgaatatcttctgtagcttctgcttccataacattcattacgtcatcaaatgttataataccaatcattttattatttgctgttgtgacaggtattgctgctaaattataattcagtagcttttttacaacttcttgctggtcaacttcagcgtgtactgaaattacctctggcatcatgatagtagataatatctcttcatctgctgctagtaataactcatgtatggaaacgattccctcaagataaccatgactattaagaacataactataagatattgattctacattttcagaatgttccctaatgtacttcaatgtcatttttactgaccaatttcctctaactgcaacaaaatcacttgtaacaagacttcctgccgtttcaggtttgaaagtcattaatttttttacgttatgttttgtaattttatctagatacgccattaatttagcctgttcttccggatgaaccgctagaagtaaatctactaattcatcaatcggttgtaaattcagtaactttttagctttattttcagataagtgaattaagatattatatttttcttctgcactcatatattgaagaactttagagctttttaatacaggaatcggatttagtaatatgacttgatcttcaattgaaaaactgtttaccttttgcgcatatcatacgacggaagacgaaaacttttttt

SEQ ID NO: 347 - DNA, 1105 bp, Bacillus thuringiensis
ctttcttttttaattgtagatatatataatgatggggcagcctcaaagtgtaaattgtaaagtatacctacattattcaaataaaaaataatatcccacatagttaaagacatttgtaaaccctacattttccacaactgcaacagaaggcttgttcaattccatacagtcccaatatggaataatatcattctccaaacaatctttcacaaaactatgcgctatcttttgagctaattttctcccttggtgaccttttatcgtttcaatatctatacaatggatatttgcaaatacaaaacctgaaaaacatacacttacaattagatcatcataaacaacgcaataaccgattccctcatcgaaaaaacaatccggtgaagaccaaaactctaaaatttttgattgtaaaaaatcaatattcttaaatgtattgttattattttcatagagagctttactcattttcagcacagtatatccctgttcaaatttaggctcatgatgattgtcataatcctcttttcttagcgtatacactctttgattccaactctttaatttacggtgctgaaatattctttcaattgttttgttccattttgaatgattaccgattccttcaaagcaatctagtcctaccttcctcgcctcaggtactattacattattaataaaatgattcatttctttattaaactcttcatttgcagaatctccaatgaagaagaatccatcattattacctaaccaaataagtcccgaattaggagcagtactattatctacaaatatacgaccagggttcactcctgcaattacagcacgtacctctaattgaccttgttcattcactaaactattacacctataaaaatcattcttgcttagttcacagatcatacgttacatccccttttttaaactgttctattctaactttaccactttcacataatattctgtattattttcaagagtggctttaaagcgatgcgataagtaaatgaaatacataataaaaaagagccaatcccctatagatagaagattgactctttcctttatttactcccctgtttcagaaaatcgctttatacgttca

SEQ ID NO: 348 - DNA, 762 bp, Bacillus thuringiensis
cttctttaagttaattggtatgtctgctggggggttaactcaattcatgcggtggctcgcgtaatggaagacatcggttgggcaatcattacaaatctacacatcttattcgcagtagcaattgggggatcttgggcgaaagatcgcgcgggtggtgcatttgcagcgctattagcattcgtcttaacaaaccgaattacaggagctatatttggggtaaacgctgaaatgttagcggattcaaaagcgaaagtttcttcagtaatagcgggagatttaattgtaaaagattactttacttctgtacttggtgcacccgcattaaacatgggagtgttcgtagggattatcacaggtttcttaggagctactttatataacaaatattataactataataaactgccacaggcattagcattctttaatggaaaacgatttgtaccattcgttgtaattctttggtctacagttactgcgattgtattatcacttctatggccattcatccaaagtgggttaaatgaatttggtcgctggattgcagcttcaaaagatagtgcaccagttgttgcaccgtttgtatatggaacgttagagcgtttattattaccatttggtttacaccatatgttaacgattccgatgaactatacagagctaggcggaacatatacgatgctaactggttcaaaagttggacaagttgtagcaggacaagatccattatggcttgcatggattacagatttaaatatttac

SEQ ID NO: 349 - DNA, 1424 bp, Bacillus thuringiensis
gaaacaactcattgaggaacaaattggcgatctaattttagcaatacaccatattggtagtgcttctattccatatttaagtgcaaagccaatcattgatatagcaattgaattagaaaattatacggacggtatacattgtattaaaaagttagaactactaaactataaatatagaaaagaagtattacccgaaagatactattttaataaaggtgaaccaagaactcatcaaattcatatgtatgaacaagggaatacatatttaatagaacaattacaatttcgtgattacttaatagacaataaaactgcacgcatgcagtatgaacagttaaagattcaactttcacaagctaatcctactgataaacataagtatgcagaggataaaactaatttcattacatctatattaactaaaataaatgcttaaataaacaagaaaccatttagtagtaaatggtttcttgtttattagttatttcattatttgcactatcaaatttttattatacagcaggtggaaagaagtaaaatagtatcgaagtcataaaaataaacgtgaataccccaattaccgaaaatatatattctttcgactctctatcatacttccattccatcaatgctcttaagattaacgtcccacctaaataagtaaaaatgacataagcaatattaatactttcaaatttaaagataaacataaagctagttattaaataaataaaaagtagtcctatttccaattttttatgtaaactatttacatgttttttatatccccaaaaaccacccttgggcatattcaatttttttcttaaaaacttatcgagaaaatagacagctatacaaaaaacaatagttataatccaaaaagtagaacctcccattttcccccctcctattatttcatttaattacttgaaataaattggactatattacggttatccccttctaaataacttatgatgccttcaggatatgtcggcttctcctgtaattcctctagacttttccaaattaatataatatcctcatgctctttatgccttatttcatttgtaatgattttttcaacagtcccccaatgtatcaatgtacaatgatgacctttttcgttgtcccactcaaaaatgtgttcatttacaattgctaactcttgaacatcaactttcaaatcgtattcttctattaactctcgaattattgcttcttttgacgtttcaccaaattcaatagagccacctggaaaacgataaaatgattcattttcattgcattgtacaagtactttagaatgatcttcatttaaaatcattgcttcagcacgtaatttaggatttttcattttgtctccccattcattccacatatgattaaatccaataggtataaaagaaaaaattaagaatatt

SEQ ID NO: 350 - DNA, 1016 bp, Bacillus thuringiensis
tagaaatagtagtctataacaaaaatttgtgacccaataatgctgcttatatgtaaaaaatcgattgaacggtattccctcaaatacagctagtatactagctaaatccgctactctaattgctgacactagtcgattttgcacatgaaatatagtagtcgctctccccatagaaggcggcgtgatattgtaaaggcagaaaattgatccgcacgaacagattgacctaagaaaataccgataccaacaattaatgcccggatttgccacggattcgtatcgtgatttacaaaactcaataaaacaaatataaccgccgtacatattaatccaatagaaattacctttcgagctcctaatttcttatatgaccatggtacaatttgtgaagaaatcattaatccaatcgcctctggaaatgtcgtaagtcctgattccagtgcagaaactcctatcacattttgatacataagaggaaaaacaaataacattcctaataaaccagctgatgaaaataatgatataatgctcatctttctaaagactggttcttttaataagcgtaaatctaacatcggttgctttactttcagttctacaattataaacaatgtaatgaatacaaccccagctatcccagtactcataatttctggagaaatccacccttttgatggtccctgactgagtgcatatatgagcatcgcaaatcctggtgctgataaaataaagccgagcgaatcaaagcgaccagctgatttttcaacatgttctgctaaaaatagaagtccaaatagcaatgcaacgattccaaacggtagattaatataaaatgcccaacgccaagacatttgatctacaaagaaaccaccgatgataggaccaattgctggtgctacagcaattggaagtataatgaaccgggaaatcttcggtctttcctcgggtgaaaatgttcgaaataacatcgccattccaaccggtgttaaaagccctccgccagcaccttgaataat

SEQ ID NO: 351 - DNA, 570 bp, Bacillus thuringiensis
gtaaatccgggaaccaatattgcatatacgctccaaccgcgataatttctgacatcccaacgataacccactggaaccagttactccacgctgtcatataaccagctagtggatgaatatacttatgaccgaatgtcgcaaatgagcctgtacttggctccatatacaacatttctcccatggcacgcatgatgaagaagatgaaaatacctgcaattgcataagcaagcattactgacggacctgtccatttaattgtgctggctgatcccataaacaaaccaacaccaatcgttccgcctaaagcaatcatttgaatatgacgtgcttctaaacctcttttcaattctttgtttgccacttcacttccccctcttagatgattcatagccgcattttaacacaagatgctttcccctaactcctttcggccctgaaaatgatgaagcaaacgtcattttacactagctttaaagctatcctaaaatcgttttgtgctcctaataaaattctcaaaacctttcatcttccaatattctataaatcttaaaattacttatcttatattaa

SEQ ID NO: 352 - DNA, 1121 bp, Bacillus thuringiensis
gacaagatatgtaaacatcttgtcttttttgtcgttacattttaggagcttccattccagccgcagcccattcttcttttgcggggccatatacgccaggaactgttaagccagcttgtcgcattaaaaccgtcatttgtccgcggtggtgattttgatgattaatgagtgtcattaaaaatatagaattcggcatagggcgaccaaagaagtcattaatagtagctaagtctttatcagtccatttactttgaagtgtttcaacaaaagccgcgtttactttacggtattcatctgcaattgtttttgcagaagttggaacaggataatctttcgtttctccttcaaactttagccctgtgccagatagtatcacaggaactgccgtcacgatgtgccaagcaattcttcctaacgtccagtgcccaggtgcaatttcctgtgataaagatgcatcggttaatgaatcaagcattttctgagtagactcagcctcgtatgtccatgattgtaaaaagccttcaattgtttggtacatagttatccctcctatttttgttcatagattaaattcgtgagagataatataatccctgttccacaagaaataattaattaagcattgctacaatatgaaaacaattagaaaatatttgtaaaagtgtcaggaaacgaatgtgctcattcgtatatataatgaataaagaatgggataaagagtggtgataagggtgaaggatatagaaatagtagaaggtcttcgaaaacaagatatgttagcattacatacagcgattgatcgatatggagatttaatttataaggtagttcatagtattttagatacggcacatagtaaggtgttagtggatgaatgtgttgacgatattttattaatcgtttggtacaacattagtagttatgatgaaaatcgtgggaagtttagaaactggcttatatctgtcgctaagtttaaagccattgattataaacgaaaaagtaataaggcttatcaattacaagagtttcagcaagaaagatatgaagatagaaaaaatgtcaatttaacaaaagaagagagagattataatttttacgttttaattaaagaattgaatgaa

SEQ ID NO: 353 - DNA, 1009 bp, Bacillus thuringiensis
agagcgatttgtaatcagacttaacgacgactgaaattaaagcgagccgcgttgctgtaatcgcaaaagatcaatctttgccagcaccgattgtacttggggaaaacggtgtgaaaatcccggaccagattattgataatgatgcatttggtttatttgatccaaatgaagatgcaatcgacttctatgaaagtatagaaggtatgcgtgttacgatgccaacaccaaaaattattacacctcagaaaaacggaaatttatatgtaacagtaaaaaatggtggagataaaatagtaacacaatatggcacacctctattagatgaaaatcaattaaacccagagcgcctttctgtaaaagtacctcgcgattatgtagcaaaagtaggagatacttttactggagatataacaggggtagtaggatatgattacggttctttccgtatttcgccaataacagaactgccagctgtagtggatggtggatttaagcaagtaggggcaaatattcagccacgtcttgataagttaacggttgctacatataacattgaaaacttctcggcgaataaaaaagaaacaacagatgaaaaagtaaaagcgttagcgtattctattaaatacaatttaaaaatgccagatattatcggtgtagaggaaatgcaagataataacggatcaattaatgacggtacaacagatgcgtcattaagcgcaaaacgtatcattgatgcagttctagaaattcgtggaccgaagtatgagtatgtagaaatcgctccaaacaataatcaagatggaggagcaccaggagcgaatatacctgtcggcttcttctataatccatcacgcgtgaaattagcgacggtaccgaaggtacttggtgcgaatgttgttcgtattggagacgaaaatccattggttgaaaagtcacgtaaaccgcttgcggtagaatttaccttccaaggacaaaacatttgttgcgttgcaaaattacttaaactcaa

SEQ ID NO: 354 - DNA, 839 bp, Bacillus thuringiensis
cctcctcctactccgcacggaagataaacaaataaatgatgattttcatctactacaacctctaactcttctaattgcttttgtaatcgcaatgctgctactgcgtatcctaaaaataaatcatgggaattttcatcatctacaaaataacagctaggatcggcatctgcttgctgacgcccctcttctactgctttactataatcagcttcatactcaataacgtttacacctttacttcttaataaatcttttttccattgtttcgcatctgctgacatatgaaccgttacgttaaaacctagtttcgcactcataatcccaatgcttagccctaaatttcctgttgaaccgaccgcaattgaatatttggcaaaaaactctctacatgtatcactatctaaaatggaataatcatcttcttctgttaacataccgtgctgcaaagctagttgttcagcatgtttcaacacttcataaatgccgcccctagctttaattgatcctgatatcggaagatgactatcacattttaataataattctcctaaaataggttgcttgtaatttgtctctaaagcttctttcatagaagatattttcactaaaggtgattcgattatgccattcgtccctttcgtttcaggaaaaactttcgcaatatatggtgcaaaacgctttaatctctcttccgcatcttttacattctcttcattaagtggtgaatcttttattgccctttcatacttttctatgtttggatttatccaaaatacttcttctgttgcaataagtttattcactaatgggtattctgcttgtaatgcccctatttcttt

SEQ ID NO: 355 - DNA, 1241 bp, Bacillus thuringiensis
ggaagttataatgatacacttgtagaaatgatacggcatgatttgaagaagaaaaatgtgcattattccttcaagaagatataggttattcttcagaagcgaaggaagcaatcgcttttgcctttttagcaaatgaaacatatcatcgtaatccgagtaatgtgccgagcgcaacaggtgcaaaggaatctgtagtttttgggaatataacattccctccaatttgaaatgaatgaggcgaatagatgaaatatatgattggagtagacggcgggggaacaaagacagaagcaattgcatttgataaagacggaaatgaacttgtaagagctacaagtggttttggaaatatattaatagattttgaagaagttcttgtgcatattatggaggtgattgatcaatgccagaaaggtgtattaaatgggcattgcgtttgtatttgtttaggattagcgggtgtaagtggagtaaatacgaatgaattaacattacgtctaaagaagaagtatggaacaccaattgaagtttttaatgatgcgatgattgcacatgcagctgttttaaaaggaaaagatggaattttaacaattggcggcacaggtgcaatttgtcttggaaagaaaggagaagtgtacgagtatagtggtggatggggacatattttaggagatgaaggaagcggatattggattgcattacaaggtttaaaaagaatggccaatcaatttgatcaaggagttgcactttgtccattaagcttaaggattcaagatgagtttcaacttttgacgtcgtctcatataaaaagactagtttatagttcttcaaaagataaagttgcagcaatcgcgccattagttattcaggaagcgagaaatgggaatgatgatgcacgtgaaattatcttgcaagctggaaaagaattggcaaggattacagtaaatgtttataacaagttgaactttaagcactcaacgccaattgcagtaagtggcagtatattgcgtttagttcctgaaatatttgctgtatttaagaaatgctgtgaagaaagtatgaaagaaattacattcgtatcacaagcagaaatggcagtgaaaggaacatattatttaatgagggatatatatttttaaaaatagcgtatgagaatttttgtatgatttgtaaatatatgatgttaaaatgtataaagggaaggggataaaaaagtacaatatacatagttcatgaatatt

SEQ ID NO: 356 - DNA, 1072 bp, Bacillus thuringiensis
tagtaacgtgttttttaatttgaaaatagtataaatcctatagctcatgaatataggagtacttctaatttgccattgataagttactgaaaacactttgttttaatggaagtgtcactctaaatgacaacatgagatttccggtatttaccaggtgtttcattggtgaattttttaaaaattttagtgaaataactttgatcgctaaaattaagcgaagcgcatatatctgataagggataggtggtgaaagttaataatttctttgcttcttcgactcgttcacgttgaatgtactcaattaatgaaataccgacttcttttttaaataatatagataaataatctgaattcacatttgcaaatttagcaagttgtttaacagatattggattgtaaatatttttaaaaatgtagtttttacaaatagcaatagtctgtgaatgttgctgtgttttttgtgcctttacacggtctgcaaaggtacaaaaagcattttttaataaatcccaaacagattctttgtcttttaaatcttctgttctttgaatatgtaaatcataaattttgtaagcaatcccagatggaagtcccccttttatcgcatatctagtagcgagcgtgatggatgaaatacaaatgtttttatgacgtcttaattgatggaatgaagataaagatgaaagagtctcttgttggaattcgtaataatatttgagtacggtttctttatccccgtcttctatagaactaagtagttgctgctctatatataaattatgataaatggattcgtctttttgcattgaaatatatacatcttcgtttaagatgctgctatgacttatatgaagtgagtcactgttatttgaaaaggtgcttacatctgaattttttttatagagaatgttatagaacaatatcgctatatttacaaagaaattttgatctttgactgacaatgaaaaataatggtctcttgttcttttataatttggaataaaattaaggttactatccgctttacttgtagaaaaatttacatgtgtcaagggccccataataacagtac

SEQ ID NO: 357 - DNA, 1101 bp, Bacillus thuringiensis
tcggttttcccgagttgacaaagcgagaagtcgaaaacaagggtggaaacgggactaggtttgtctattgcaaaacgacttgtagaaaaatataacggagctattaaaatagagagtaaagaaaatgaaggaacaatcgttacgattacattaccatgtataataaaataagccttcaaagaaggggtgcttcttgcattccttctttttttacgatcaaatcattttgtttatttcgaaatttctagtacattaaaattattaagggggaataataatgaaagctatcgtacatcaatataaaactggatttgacggtgtagaatataaaatatcacctgagagagcacttaatgatggggaagttaaagtgaagttaaaatcagcaggcttaaatcatcgggatttatttattgtgaataatagaaaagaaatgcaattgcctttaatcttaggatcagatggtgcaggtattgttacggaaattggaaacggtgtttctgataacatattacatacagaagttattattaatcctagtattggatgggaacatgctactgaagtaccggagttaccggaagtgctaggtggaccgaaagatggaacgtttgctgaatatgtaattgtaccagctgaaaatgtagtagaaaggccgtcatatcttacttgggaagaatcaggtgttttatctttatccgcattaactgcatatagagcgctttttacaaaagggagattgaagtgcggcgaacacgttttaattccgggaataggcggtggtgttgctacatttgccatgttattcgcgaaagcaattggcgcaaaagtgagtgttacttcaagggtagagaataaaagggaacttgctgcaaaatatggtgcagatatttcttttcatagtgccggaaattgggaagagggcttacaaggtgaaaaagtagatttaataatagatagtataggtccagcaacttttttgaaatatttgatgtattaaaaccaaacggaagaatcgggaattttggtgcaggctcaggagataaaattgaattaccattacgcgcgctattttacaatcaaattgatattatgggaaca

SEQ ID NO: 358 - DNA, 682 bp, Bacillus thuringiensis
tcaatcttttacagtacattgttgagaacacagcgttctcggaattatcagtaaaggcgttaaagaatataaagcgctgtgcaattacaatcagtggtttgtatgtattaagtttgccactttttcattttatagcgaaaaaaatggaccctcctattgggttagtgggactcattatcgtttttgcttcgctcgttatcgccgtttttgctgctatcctccaacgacttctacaagaggcaattaacataaaatcagaaaatgatttgacggtctgaggtggcggatatgacaatcattattaatattgacgtcatgttagcaaaacgaaaaatgagtgtaacggagctttcggagaaggttggaattacgatggcgaatctttctattttgaaaaatgggaaagcaaaagcggttcgtttttcaacattagaagcgatatgtaaagctttggagtgtcagccaggggatattttggagtataaaaacgatgagaatactcaataaaaacagataacaaatgtaaataatagaagtcaataaagaagggatagccactaagctattccttctttacgttaattgctgttactaataaaaaatataatttgaattgcaatgtttgcgtatcaaaagggaacttgctaccttttgaggtgatccggtttgtggaatacaatta

SEQ ID NO: 359 - DNA, 798 bp, Bacillus thuringiensis
agcagttaacattgacagatatttcgaaatatacacatacgacagagcaagtacaaagtcattcatttgcagatacatttgtaaatattgttccaacgaacattatgaagtcgttagctgacggagatatgcttgctattatcttcttctctgtactatttggtttaggtgtagcagcaattggtgaaagaggaagaccagttcttcaatttttccaaggtgtagctgacgcaatgttttacgtaacaaaccaagttatgaaatttgcaccatttggtgtgtttgcactaattggtgttacagtttctacatttggtcttgcttcattaattccattagggaaattactaattgtcgtatatggggcaatgatcttcttcgtcgtagttgtcttaggccttacagcgaaaatatttggaattaacattttccaattctttaagattttaaaagacgagctgatcttagcgtattctacagcaagctcagaaacagttttaccaaaaatcatggagaaaatggagaaattcggttgtccgaaagcaattacatctttcgttattccgacaggttattcatttaacttagatggatcaactttatatcaagcaattgcggctattttcttagcgcaaatgtacggtattgatttatctattacacaacaaattacattattgcttgtattaatggttacatcaaaaggtatcgcaggtgtaccgggcgtatcattcgttgtattattagcgacacttggtacagtaggtattccacctgaaggcttagcgttcattgctg

SEQ ID NO: 360 - DNA, 1270 bp, Bacillus thuringiensis
  unsure (1)...(1270): unsure at all n locations
tacgaaagcatgagccgcaaatttagcgtttcctttcggaatttctccgatgtgcatcgcattatcgagtgctttttctagtacttcatacatattatcttcagcattttttaattgtttcaattgttcttcagataacgacagttttgcatctttcataaaatttttcatatcaatatccatcgttgcgtgtaagtaaactttagcgaagtctaataatctttcttctaaagttttgtttgtagagagtatttgagacatattctcacgtatacgtaccatcatttcgatcatagtagcggtaaataaatcggcttttgttgaatagtaatagtagacagttgctttcgtaacaccacaaacttttgcaacctcatccatagaaacgacttgataattttgtgtaagaaataagcgggttgctacttctaaaatggtttcttttgtagattttgtatttttattttgacgcggccttccgagaggacgttgtttttgttccaaatacattcgctcctgacatttatgattgagataattataacataattttcaatcattcttgattaattaaccgaccagtatatataattaataatggaggaaaaaaggaaggtgggtttttatgaaaaagcacccgttacatatgttagggaggcttgtagcagggaaaaatatgcaatggatcactttatcggtgtgggttcttattacattattactttcatttacgttaccacaagtaaacagtacgaaagaaccgaatccaaaaaatttacctgaaacagctatgtcacagcaagcggaagcgcttatgaaaaaagagtttccgaataatgcagggaatccgttgttagtagtatggtatagagatggtggattacagtcacaggattataaactcatacaagacgtttataaagagttaaaagctagtcctttaaaagaacaatcaacgttaccgccatttgatacaattccagagcaagtattatcaaaaagtgcatcaaaagatggtacatcatttgttacaccagtattctttaataaatctgctggtacggatatattaaaaggaaatctggaagagtttagaaaaatagtgaatagtaaggtggatgaagatccatttaaacaaaaaataagtgaatctggtttacatgttcgattatctgggcctgtaggtattcaaacggaaacagttcctccatttagtcnagcagatgtgaaattngagggggctactgtattattagtcttggtcctataa

SEQ ID NO: 361 - DNA, 1030 bp, Bacillus thuringiensis
tgattaatttttaactaaaataacaataaaatacatctattcaatatgattccggcatgtatattattacaatataaataaccgaggagatgctatcttcctcggtttcatatctcaaatacttcaacctttatagttgataacgtaatttcccacacattcgattcatataccaataagaaatttaatatattaataaactactaacttctttaccccagccaaattttgaggcagaaacctttctgcctcaaaacaacgggataaaatataaaagagtctcattaaaaaatgagactcttttacaatttcatatttaaatcgatttcgaagtttgcttaccaaagataaataccctagtaaacactgccattataactacaataactagaaaataaagtggcatcaccagtaacgagcccgtatgcaattgactcattccccaaattgtcatcgttacaattacatagtatcctaagctaaacaacgctccagctgtaccaatgacatcttgaaaatctactaacgctaaacttaaacaattaggtaacgctactccaattcctaatagcaatataaacatcgctattaaaaatacaaccatatatattacattcggatttgatcccacaaacgtaataacagataaaaagatagctcctcctgtcattacgagacaaccgatatatataattttctctggtttataagtagcaagtaaacgttttgaaattttcgctccaacaatagaagcagacgctacaacaattcctagaaatccatacatactaggcgataattgaaaatattcaataaagataaacggcgcttctgcgtaatagctaaataaaacaccatttgctcctccaattaacaacccatatgttaccactttcggatttgtaattaacctcttcaagactgaaaatacatttattttattcgttactgagcccgtttttgtttcaggaagagaaacaaacgtatacagaaaaataccgatactcataactactaaacttaaaaatac

SEQ ID NO: 362 - DNA, 1190 bp, Bacillus thuringiensis
ataccgcttgatcaccactatagcctataaatttttttgcaaccattgatatgagtgcaatgacagctgcgattggtataatcatttttaacaacgttgtatatacatcaaaataacgtggtccaattaaatgcatcggtttatccaaataaccattagtcaatgaaaccggactccccaatttttcgagaacgctctttacatctttctcattataatcttcaggtaacatatcatctatagttgaccttagttcaagtgtaatatcttcacgatttttttcaggtaatctcttcgcaacctcttggatatagagatcaattaaattcattctcttcctcctcctttaataagttataaagttctttcgaatcctttatccattcttttttcaactgcaaaaatatttctaatccataatcacttaaaacataatacttacgaggtctactctccgttttatcccaactactcgtcactaattcctgcttttctaatcggcgaagtagtggatataaagtactttgatcaattgtaacccctgattgctctaataactggacaagtgaatatccgtactgcggcgttcttaattgacttaaaacagctaacgttaatgtccctcttcttaactcagtaattaacgaatttaataaattatccattcactcacctcatttccattactatatgtcatacagtatgtgttttatactatgtatcgtacagtattaatgtgacaaaaactataattttttaccaaaaaacaggataatgaacagctcaaattatatgatttgtgcttttttagctaagttatatataacactctataaggtaacaacctaactactaattttgaagttccagtaatgctatattaagttacaaatatcgtatacatatgatgtgaacataacatctcactataggaagctataaaaacggtgaattaccatgcttgaataattcccgttttcagcacctaatcaacgttatttccttcataaacttcatcttgttcaaaatctttatttttgtttggtttattagagaaaaataaaaaaacaattaaattaggttaattgtttttcaaatacaaaatctttatttttttaaataacctatgatattcgaaaagacaaattctccaaatgcaagtggtatataaataaaccataactttaata

SEQ ID NO: 363 - DNA, 715 bp, Bacillus thuringiensis
gtgtcattttacgaagaagtaatgacgttatttctggattaacaacagcttctatggtgtgggctgcttcagctttagggatcgcaattggtgcaggattttatttacaagcgacagttgctatggttttaattattttagcgattaatgtacttccgcaacttgtgaaaattgcaggaccgtattcattaagacaaaaggatttatctataaaaattactgttaaagagcatcatgagttagatggtatatttaagcaaattaaaaatttaggcatgcatgtgaaacgcgtgaaaattaaagatatagatagtggagcatttcagcaactggagatggttattttagctccagaagatttatatacaacagagttatatagttccctgaaagagattgatcgagtagtttcagttgaagtggaaagtagataattgtgataaaaaagagtgaagtgaattcactcttttttatttggatttttaaggaatgaaattgatataatgatgagtaataaggggggagaaatgatgggaatacatattagaagagcaataaaggatgatataccaggtatagcaaaggtgcatgttgatagttggaagacagcgtataaagggatatttgctgacgaaattctagataatatagcatatgagaaacgagaaaaacaatgggaagatatttttcaaaaagaaggtaatcatcaatttag

SEQ ID NO: 364 - DNA, 839 bp, Bacillus thuringiensis
aaaattaagctactctccgatgtaaatgttttagttcctttttcttttctacatttggtgggcggattaatattgaaataatgaaggaaataacacttaaaacaccgattataatgaaagttggttgaaatcccccgagtatcgctccaataaatgatcctgcaagcgcaccaaatccgaaaccttggtagacaatcccgtaatttgtactatggttttttaatccaaagaaatctccgacaatagctgggaatatagttatattaccgccgaagcaaaaggcgacacttgctacacaagcaaaatagattccgtaatttagcggaataaaacttaaagtaaagactgacaatcctataataataaacgttgcagagacaattttcattcggccgattttatctgataacgtcccaagaataattctacctactgtattaaaaattgcaatcatagcaacggcgtttgcagcggttgctgcgctaagtccaacgagttgtacaccgatatcttttaccatactgattaaatacaaaccacccatacacgaggtaaataacataaaaaatagcagatatacttgtttcgttcgcatcatttcacgcggagtatagtcattgtgcaatgtttcagttacagcattacttacaattgcctcacgtaagaagaacgatccgattaacactaaaagtaacacgataataccccaatataagaatgcttgtgatacaccaaggttatcgataaaatttccgtttatatatctaaagattaagctgcccattccatacgctgatacagatatacctgaaataagccctttccgatttggaaaccat

SEQ ID NO: 365 - DNA, 834 bp, Bacillus thuringiensis
gacttaaacaaccatgacgaataaaagaaatcttcattcttttcactctccattcatcacttatgaactctattatgcactagttctaaacatcataccacgcaagaaaataaagttatatacctttacatctccccaccactatcatgtgttatcgaagcatggataccatccatcccatcaaaatatgtactcgtatcatattgacgaatcttttttaaatgcatataagaaaataaaaataaaattaaagctataacactccccacaaattcaaacatcattttaccgcctctaatttctcccacttcagcaggttattctactttttcattatacctcgatataaagattcttgcatttttgctattttttctaaaaaacatggattttctacatattttcttacaaaaagtgaatatttttcgaatttttactttggaaacatttacaaagtaggaaatatggttcaaaataggaggaaataaaaaaacccaaatttattctttttttgggaaaactgtaacaaggagagttgcttatgcagatcgcagaaactggagatatcatcgaatttaaaggtggaatgcaaggccgtgttcaaaaagtaaatcaaaactctgttattgttgatataacaattatgaagaattttagagaactagatatggaacctcttacagttgtaagtcataaaaactatactgtcattaatcaaaatgcataatataatagaaagaaagggcctgcctcgcctacacgccctttcctcctatcaactatcaccaaccgccccccgctatacctcgagcctcaccctcccgtacccacccc

SEQ ID NO: 366 - DNA, 912 bp, Bacillus thuringiensis
  unsure (1)...(912): unsure at all n locations
tcgcctatgatttctttatttgttatgaaacagagagctacgtatggaatagatgctactgatgctaaatgtgctcaaatacaaaaagtttgttatattatgacattcgtagttgttatgttctttgtttggagcagtaccttaagtttgactccaaatgatcttaaggtggcaaaagaacagaacttgtcaatcctatcatatcttgctaatgagcttaattcgccagtaatcactattgcagctcctatcattgcatttgtggctattacaaagtctttccttggtcattatataggagcgtatgaggtaatgcgtgacatgattatcaagtccagtaaaaaacgtgggaaagatataggagaaaaaacagttaagacaatgattcttacttttgtcgtattaacatgctggtatgttgcttatacaaatccaagtattcttggaatcattgatgcccttagcggtccgctagttgctgctatcttatgtatactaccaatgtatgcaatccataaagtatcagtacttgctaaatacaaagggaaatctagcaatgtatttgtcattattataggtattcttactgtcctagcaagcattaagtcattattctaatccactattgctagtatcgatgcaaaaaccgcgggatatggaaaaaagaaagattcttatcggaactgaattctatattgttaaactaaagaaatcatggttttggacaaactcctcacattggagagcacgactttttatatcattttagccaagaagaccccttcctcacatgcccatcaacttaagaatttgcactacccccaagtgtcacaaaacggtattctttctaaaaagctagcttgaaaggatgacattntttatgaatctttcaattcaagatgaatacaactt

SEQ ID NO: 367 - DNA, 807 bp, Bacillus thuringiensis
cgttttacatttacttcaacgaattcaccgttataatatacaacgacgttataaaaattatctttttcttaatagatgatacccaaatcttcataattttattaaattcacacgattccccaatttggtactcataatgaaattctcttttttctggaacaaatttcggttttctaattttactttcattcactttttctaaagcgtactctttatttcccatgtactctttcgctcttttcagcacatgttcttttacgctcattttattcgcaatccaaagtgcattactttctcctgattttccgataactaatttataaagcggctctagcgtttcactattaaactgcatcgctgcattcataaagtcatcgtgcatttctgagaatcgtttaatttctccgtaatgcgtactcgcaacggtaatacatcccgtaaggtacaactcttctaaaatagatattgcaagtgctgcaccttcatttggttctgtcccgctccctatttcatcaaataatagcaacgtattattatttgacatcctcataatctcagaaagatttttcatatgagacgaaaatgtacttagtgcattttcaatactttgattatcaccaatatctacgaatacattttcgaaaatagcaatttctgtacctttatctcctgcaatatgaagacctgacattgtagctaatgttaacaatccaatcgtttttaacacaattgtctttccgcccgcattcggccctgtaataattaaactacgatactcttgaccaattttaaaatttaagggtacaa

SEQ ID NO: 368 - DNA, 948 bp, Bacillus thuringiensis
ttttgtggctatatgcaaaatatactttcattatatgcttttccgttagtatttccaacattttcgcagaataatactaaaaaccagtaaaaccaccaaataaacttgagaaatatacgataattttcgtcatccagttaaagtataggaagacacccataacaatcataatatatcctccgactttcatgaaggccatactatttcttttaatccaagacattttcgtaataaagaatgacagtacgaaaaacgggattgcaaatccaagtatgtaagcaatcatatatatcattgctgattctggatttgttgctgctaatccaattacagacactagaattggtccggtacatggcgtccaccctgctgcaaaagctaatccgattagtactgatccaaaatagccacttggacgatttttaaatgtaaatttacggtcttgcattaaaaatttcggcttaaacaccccgacaataattaagccgaacacgatgataaatataccacctaactgtctgattaaatctttatagtcagtaaagattcctccaataaaacttgtaccaaatccaattgcaataaatataattgaaaatccaagtaagaaaaacgctgtatgtatcatacttcttttgcgaagcattgcattttcttctttcaattcagaaaccgacatacctgttatgtacgataaaaatgccggataaagcggtaagcaacatggggaaataaatgataagaacccggcgccaaacgctaaaaaaatactaatatcttgcatcattccactcctctccctaaatattgtaacaaaaacacataaaaatactatgaacaattcgtgaaatcacttttacaacgtggcaataagaaaaaccgcacttcctcacagttttctataaaacgttttcatttcctctatttatagaaaaacccaatggatat

SEQ ID NO: 369 - DNA, 1058 bp, Bacillus thuringiensis
acgttgacttatcaattacatcgccatcacattttttacagctaccaacctttttacccgttgtaaatttcgatccttttcgttcaatcgattcaacatgtagtcccgtgaaatcccacttctcagacatttccactgcgtcttcaataattttagctgatagctttttcgtctgttccataaatgtagctggtgaagctgtaccttcaccaatttccgcaagacgttgttcccatttcgcagtcatttccggtgaagctagtattttgtcaccaattgcggtaattaatacttttcctttatcagtcgcatacacttggtttttctttacatctatatatttacggtctttcagcatcgtaataatacccgcgcgggtcgcttccgtacctaaaccttctgttttcttcaataccttctctagctcttcattctctaaatacttaccggctgttttcattaacgtaataagttgtccttctgtataacgcttcggtggctgtgttttttcttctttcactttcacctttacaacttttccttcttcaccttcagctacaattggaagaatggtttcgtcatctttatcgtcttggaaaataactttacgccaaccttcttgaatttgctgttttccttttgaaatgaattcagcacgttcatctacaagcgttacaatcgttgtatagtcaaagattgcaacttcataatgagctgcaataagccttcttacgatcatatcgtatattttcttttcatcacctgatagtctgcttgggtttgtaacttgctctgtcggaataatcgcgtagtgatctgttactttcttttcatttacataacgcttattgttcataatggattcaaccggagccggtaataaacctttatattcatcaaactgacttaacttctgtaaaatatcagggaaagtcgctgcttcttcttgagtaacatagttagaatctgaacgggggtaagaaaccaatcctttttgatagaaggcttgcgttatatcaagcgtctttttcggggaaaacttaaaggctttatttgcc

SEQ ID NO: 370 - DNA, 835 bp, Bacillus thuringiensis
tttttggaacttttctttatcgatcataatcatcccacgaaaatataaaacgagtctttttccctaaaccttgaagtgctcttactacgaaataagtcgttacgatttcacgaaagttcccaatatgaacagaacctgaaggactaattccagatgcacaaacaaacgtttctttatttggatgtttcctaattaattcatgtgctacttcatacgcccaatgcatttattgctcacctcaattattttttgttttcgtattctcagttttatgcaataaaaaaactcccacccccaagattattcatcttgaggacgagagttgttagcttcgcggtaccacctcagtttgttaatatgtcaccatattaacctcttcaggtacggcaaaatatgcttataccctatctctataacgggagaacccgtcgcaccatccctaaataaattagttccttgcgcagctccaagtcttttttcgttaagatgtataccgctctttctcagctaccagagctctctgtacgtattctttcttaactactcttctcttccatgccattttaaatattagttttttaatatgataatttataacacttttattgtcaaacttttccgaatcaaaaacatataattacctaaaaaaaatactttatcgcttctaattgaattttgtgactacactcatcacaacaatataccccttttggtttttctttaaatcgcttatatttttcactgccttcgtaaacacgaaatatattcttacaagaaaagcaaaccatcttataaaacaatatatgcattttcctcttcttgtttatacactttt

SEQ ID NO: 371 - DNA, 853 bp, Bacillus thuringiensis
aaagcgataaatttctatcaaaacaagctaggattaaccttagcaagaaaactctccaaaagaagagtggctttcttttgggtcggagaaaataaaaaacaaatgcttggactatgggaagtaaataatatcgaagactttgagctgagacattttgcttttggtgtaaatttagagtttttaatgacttctaaagcgtggttagaggagcgtggaatagaagtgataggaagtcaaggaaaaggaaatcaagagccaattgtccaaaggtggatgcccgctgcaagtgtatactttctagattgtgatagaaataaattagaattcatttctatgttacatgacaatccagatgaattagaatatgcatcctatttaagtgtatggaatgcggaacaccaagaaaaatgaatgaaatttccgttcaagtcttttctaattttttagatatactgttgtacgatcccccttttgctattaattttcgtcggatttatgaacagttatcgtaatggaaaattcatgataactccacttgttaacataatgcatttattgttatcttgtatttgtacttacgtactagcaattcctaatctgcttccattacaatttgaaacatttaatttttcttcttatctggcatctaatctttaaacaaaaactccccttaaatcgaaaatgattaaggggaattttatatacgatgcaattatagttcagatttcacccgaacagaaacattatttttaattatatttttgacatctttaaagctaacaaaattgttacttttctcatcccaaagacggaaacggtgtgaacgcaagcttgtagcaagcgtatttgttgg

SEQ ID NO: 372 - DNA, 1996 bp, Bacillus thuringiensis
  unsure (1)...(1996): unsure at all n locations
tatttttaaaacaaaatggaaattttagaagaagcctactattgggtgagagaacatccggaatatcgttttcaattatctttttacgagtacaataaatttgaggtagtaaagtgaaatttgcattttaacaacttatagaaggacttggtcaactagaaatattgaagtagatatttctaatggaaataagcctgtataacaaggaagggatatatttgattctgcaacaaatgtcatcttgcatcaaaaaaatttaaaaataaacatgttttattataaagcagaaaaatcgattcttagtagaatcggtttttaatataaataaaagagcgcttattaaaagcgcccagtaacaacagttatatggaagtatttatcccgtaaaagcccgattggtgagggctaataattagtgggggatgaacaaaaccccccagattaaagtttcactttattcaataccgctcggatcaaacgaatactgctgcttattctcaatccgctcaatcacatcttgcagctcatctggcttcagaaactcaataggagagaagcctttttcaaatgtaagtgtgtctgcttcaatcataagtacatatcgatcatttaccttcgcaatatgtatttgatccccaaaatccgcaagcaacgccttcacagagatatgatcggcttttagttttaattccacttcaggagcatgctcgacgatttgagcggttgcttccattacttcttcagttgaaaattgttccataatttcgcgtttcggactggcagcccatacttccatcgcttggtcgaattgttcgcgttcttccgtaccttcttcaaatacatcttcaatttggtcgtataccatgtccattacttgtgttttcataatttcaggcatagagcgttcatattcgacgaattttaagaagtcttcaaagtagcggcatgtgatgcttgatgtatttttagttcgcctacttcaaccattccttcttcaggcatgtacggatattggatagatttcatattctttgttgtgatggccatttcaacgttacgaatcagtgttgattcatcagaaatagaagcaacctttggttcaaagtcgcatttcattacgaatacgaatggatcatcaaagtatttgcgtagttttgcctgagcaattaaaaatacaccaccacgtacagcgncttgtgtcaagatatgtataaacgagaggttcgctcatatctttaaagttttcttttgtttctgcaaagcgaatacgattaaaaaggttgtatgagggtttgaatcaagttcgtgcccttcttctacaataaagcgaccaatttttgttggggcttgttctgtttttgcatgacgttctacttttcgcttcgatatttttaataactcaccattcaaaaattcttttaaggaactatcttcatattcttcagcgtctaaagtttgaaaatgtttgtagcgtttatcaactgcttcaccttttccttctacttgtacaacataaaaggaaagataatttatttcaaaatccatatttatcaccttgtttcatttcattaactcttatcagtatagagatggaaaaaactttcgtcaatttatataaggaaggggaagccccttcctttatataatctttattttctcgattaaaatccgtcttctaatgctgcgaatggaatgtttagtctgttttctactgtgcgtaaacgttggtttaagcggtttagtctacgtgtatggcgctcaactgtattttctagttgacgaactctttgttcaagctcatttacgcgtctttctaattgacgatttccagtgccaggaaaagagattggaagttggaattgtctattttggtcatatggagtcgtgtactcgcctgctctatataagattgatattgtgtttgtaagtcatcccctggttgttggtacgcaccccccttatatggatcatatggagtgtaaaaatacataataac

SEQ ID NO: 373 - DNA, 1243 bp, Bacillus thuringiensis
attttcaattacttttatacgaaaggttttaaccttactctcgatatcgtgatttttatgttattaattgcaggtcttattttccaccgtactccgattcagtatattcgcgctttttcagactctacgaaaagtgcttctggcattttacttcaatttccgttttacgcaggaattatgggcatgatgattggagcaaatagtgaaggactttcacttggaggagctatttctaatttctttattagcatttcaaatgaaacgacttttccgctctttacatttttaagtgctggcattgttaacattttcgttccatctggcggcggtcaatgggctgtgcaagcaccaattatgattccagctggcgctgaacttggtgtacctgctgcaaaaacagcaatggcaattgcatggggcgatgcttggacgaatttaattcaacctttctgggcattaccagcattagcgatagctggtttaggtgctcgtgacattatgggattttgtgttgtgaacttactatatgcgggttttatcattagtctatgcttcttatttatttaaacgaaaagctagttttatactagcttttttacataataaatcacttatttcccatgcaatttataatcttctcccactctatctccgtaagatgtaatgactcaaatgcaaaaaaatcttcgcaaatttttccgattaagtgtggatgttcactcaaaaaattccactgtaacgctttaggaagaaaatatgtttcatattctttacttccccgtactatctcatctacttctctttcacaaattcctcttattaaataatcatttcttaactctatttgaatttgctgaaatgtttcgctacattttttcaattgaagtaaacgcgtaacatacttccgaaaaagttcgccatcatactgaacacagtttataatacagtcaacttcattcataatgtacgagccttttcttctatttgtaataaccatttttcacgctttgatactttactctttttcacagattgaaacactgaccgttttatattgcgaatgccacaaaaacgtaaaacacctctcttcatcataatccaatctgctgatcgatataacaatgcgacgtaccataggggcgagtctaacttattaataacccatgcttttttcccttgcaataatcctttcggcagagccccttcatatttataagcaaatccagctacgaaaatacgatcg

SEQ ID NO: 374 - DNA, 1037 bp, Bacillus thuringiensis
cttggatcggtcgcttcatatcgaggatcgtcttcagtaagagccggtggtcttacatcaacacttcttctccaaatatgaacttgctcctcaccatacttttgagcagtttcatctttattcagcccttgcaatgcaccataatgtctttcatttagcttccaagatttatgtattggaacccaagtaagatccatctcatgaagtacaatccataacgtccgaattgcgcgttttaatacagatgtataagccacatcaaaagtatatccgtttttctttaatattgctcctgcttctctcgcttcacttaatccattctctgatagatcaacatctgtccatccagtaaagcgattttcaagattccataagctttgtccgtgacgaataagtacaagttttatcattataattcccctttcggaaatgtgaattttattgttccattgcgtacacgtataaagtatctagtaatgtatctttttatccattcactctatgaccaatcgatagttgccaaatgtatggataaaatttgttctttttcaaacgataaaaacagaagttttttcattatttttgatcgactggtatttcacgtttcgatatccaagcatcaaaacctgatcggctatttgccatttcattcataacttggtgccaattgtcctcacatgattcaccaaattttgaaaaaatagcacccatttgttgtctttgtacatcactcagttttttctctaaatctgtacctttttctgttaaagacaactgtttcacacgtcgatcatgcatagcttcattactctcaattaagcccttttccacaagttgacgtagcggtccgtggagcgcttgcttacttatttctaatagtgataataactcatttacacttatccctggaaaacgtgcgataaaaaataaaattcgatgatgtactcgttgaatgccatattcttttataatttcatctggcttttcagtaaatgttttatatgcaaaataaaataatgctaatgcctcattcatct

SEQ ID NO: 375 - DNA, 503 bp, Bacillus thuringiensis
atatgtctttctttcaatcatcacagtctaacttttcatttcatgatgtatttgctggtttattacacggtgaatcaacaatgtttggagaaggaaaaaacgggttttcaaatacaaatacaataagatgtccaggttgtaagatgacatacgaacattttacaaaggtgggacgccttggttgtgcttcttgttacgatacatttaaaggacacttaaacccattgttaaaacgacttcatggtggacatacagaacattgtggaaaaattccggaacgaatggaaggaaatatccacttaaagaaagaattagatgaactaaaacttattctgaaacaatatgtacagaatgaggagtttgagaaagctgctgaggtaagagatgaaattcgagggcttgaaactcagcttagtgagcatagagagggggagtagttctatgtcactggacaaaattatgaatgaagcgattagtccatggatgaagggggatggccctga

SEQ ID NO: 376 - DNA, 1251 bp, Bacillus thuringiensis
atgcgcgagtgaaaaaagaattcacagaaaaatatcaaaaaatctatgaggggattggagctaaggatttaaaagttaaaatgaaaggagagaatacgaaagataaagagctttttctttttgaagttaagatggataccgatgtaggatcagtttcattcatccatgaagcaaaacttgtgaaagataaagagtcttggaaaatagattggacgccagacttcatttttccaggaatgaaaaaagattacaaagtacgtatgcaaatagagcaaggaaaacgcggagaaatatatgatcgaaatggaaaagggcttgcaacgaatggtaaagcgactgaggttggaattattccagagaaactaggcgaaacagcagcgcaaacgaaagaaatagtagcacaattacttgatatgtctatagaagaggtcgaacaaaagctcacagcaaaatggataaaaccagactcctttgtaccaattggtattttaaaagagggaaccagacagaatgattatattgaattagaaggagtttcatctcacccagtaaatattcgtacgtatccattaggtgaagcagcggcacacttaactggatacataggaaaggtgaatgcggaggagttaaaatcacttcaaaaacaaggttatcaagcagatgatttagtaggtaagaccggtttagagaaagtgttagaaaataaattgcgtggtgaaaagggtggacgcgtatttatagaagatgagaaggggaaagagattaaaaacgtagcaaaaaaagaagcaaaagaaggagaaaatgttacgttaacaattgatgctgcaattcaagaaaaaatctttaatgagatgaaaactgaagcagggtctagtgcagcggtcaatcctaaaacaggtgaaacaatcgcacttgtaagtagccctgcttataatccaaatataatagttagaggagcatcgaaagcccaacgagaagcatggagtaacgactcgaaactaccaatgacgaatcgctttacacaagcatttgtaccaggttccgtatttaaaacgatcacaggtgcaattggtttggaaacaaacacaataaatccgaaggaagaatttaaaattcaaggatcgaagtggacaaaagattcgtcttggggaaattactatgtaacgcgtgtaaaggatgcaagtccaattgattttgataaggcaatgaagtaaactgataatatttattttgctcaacaagctttgaaaa

SEQ ID NO: 377 - DNA, 1389 bp, Bacillus thuringiensis
gggtatgaaagtgtttactaatatattccggagaatatattacatacagcttatgaagctaaaatgattttctctggagataattcgccatctataaaaataaaaggaacgaaacttcaatatttacttgtaatgcttcatcttggatcagtaaagatttagtcttattgtttaatgaaaacgataaatctttaaaagaatactttgccagcagcagatactcaaaagaaattacttatgaagagttttttatctggtggtatcactttttctatacaaaagtaactgaagaattaataaaacaaggtgtaattataacaagcacaaaaaaaatcaaacgtacataatccatcaataactttaaattaaagtgctaatacacttttacaaatgtagcagctaaatcgataaataattattagtaaatagaggataatctgaaatcaaaacctaacattaagaaaatgaaatgtttaaaggggagaagagccttgcaaaagaaatttatcaatccagaaacgatgccaccaacttttggatactcgcatgtagtcgaagttacaaacgctaaccgaacaatttacatatctggacaagtagcgattaacactgacggtcaaatagttggaattgacgatttagctacacaaacgcgacaagtattcgaaaatattaaaagtgcattggaaacttcggaattaaaatttaatgatgtagtcaaattaacattttttttaacagatatttctcaaatggccattgtgagaaatattcgagatcaatacattgacactaataatccaccagcaagttcagctgtagaagttagaaagttaattaacgataacttattaattgaaatcgaagcaatcgctgtagcaaactagttataaaaaaatattcgtcatcataatacaattcgtttaaaatgaacagattaaacgaattgtatttttattatttaaaatctaatttatatccgaaaatattattatcaatagctaataaagcgaataaatacataaccaatcacacattactaattcggtggaaaaggggatcataataagcacaactaaaacttagtaagtttattacttttttacagttaacataatatatattataggcagttatagggacaaagcgatatcgggtatcaaaaaccaagtaaactatacttaatgagacgaaacagagatttttagtgagatttacacaaaatcttatctaaacgaatttctacagtttttatcatttattttgctataaatccatcacagcaaattcaaatcaataatcaattaagaattatcgaatcaaaaacatttttgatcgacaagaaattttttatacagaaaaattatttctatacaaaatataaattaa

SEQ ID NO: 378 - DNA, 1083 bp, Bacillus thuringiensis
agcgtgtgtaaattcatgtccagctacgtcatatgctttaacaataggatcgccatatacaagcatacttccattattagcacttaatgcattctgccaatttttcggatcattcgtctcttcagaatcccaagcgtgtacaactgaaactactttttgtcctttattatcaaagctattacgcttgtatttatctttataaaaatcaaatacttttgttgctaagtaatgagcacttactgctttcggatcgttaaatgttgccgaagtactagtcgctaatgtaccaggataatagctttcttctttagtaatatctctgtaattcacatcatatgtttcaatgccttgccctcttgtataatcagcaagagcatatttgccattactttgtttagagataccaaatgaacgagaaatacccaaatcatcttttcctgttccagttaatgatgtaagactgctttgtttacttttctttaaagctccaactagtttgtcactggcttttaagttagattcttgtaccatattttttaacatatcaccattttgtgcatttactaaataagtaccagaaacatagtttggtgttgcagcttcaaaggtaacttggtatgcatttttagcttgtccattattttcatcaacaaaaataacctctttaacttctggctcagaaataaacttgagatcgttcccgtacttcgtataaataaattgttttgcttcatcttttgatagattaataggttttttcaattcttcttgttttaaattttgtgcgctatcacctgaaacacttttaataacaccattattatctacgtgtgcagttaattgatggccatatacttcttttccttcgtatgtttgttgcatacgcacaagtgtagttccatcatacgaaccacgtttttgaagaactttataatctactcctgcttctccattgacttgtttttgggacagagcttgctctgttttctccttaagtgcatcctttactacattttctggtgccttttgtgacggttgtgtaagttcacccgaacggaacgaaacctcttgaatttggacttg

SEQ ID NO: 379 - DNA, 919 bp, Bacillus thuringiensis
cttatatcgatatattttattaatatccgtttttatagaagaaaatagtttgattaacgcgattggtctcgtttttatacttacaaataaacgcgagaaaaaaaagaaagtttacttaaatgaaaaatttgcactaatagatattattgattctaaagaagtatttgatgatgaagggaatcctttagtagaactaacatgtaaatacagtatatatttagatgaaaaatattactgtaaatctctcgatgattataccggacaagtctttcctttcttaagtgcaaaaataggaaaaggtcttctaagaaacttaaactactacttttcttacgttgatgcctatgataagaaaccaccagttaaagaaataagaccacttatgaaacaagtaactaacagatagccaaaaataccaaaaaaagaaagcatctaactaatctgtaccctttgtaaaggacattttgaaaaaagttaggcaacatcaagaagatgatttctgtatccaacaggagtcatcttttttaaattccattgatatctataatgattataatacgtcatatatttcttaatctcttgtttcaattcattaaaggacacgcaaggttttatatgagcttcatctttcagatgaccaaaaaatgattcttgtggggcgttatcccaacagtttcctcttcttgacatggattgtcctaggtttagctttttaactagcttttgataggtagggcttgtgtagtgggatccttgatctgaatgaatataagcaccttcagtcaatcgaatccgcggattcctttttagtttatggagagttggtcgccactagctctaatgtcatctgttctgaaacatggttagctaaaatttcattagttgagcccgctaaaatgtagataaataggccctttga

SEQ ID NO: 380 - DNA, 926 bp, Bacillus thuringiensis
attttagttgaatccttcattgtaacggtcatctgtcatggaaaaatatacggataaggagatggagttattcatggcacaaattcatccgaaaacacgtattggtcatgttgaatttaaagtgaaagacttagagcgtccaattgctttttatgagaatgttgtacgattagaggtaattaaccaagaggggaataaagcatatttatctggaaaaggtggaaagaacgcgttacttgttcttgaaaagctagaggacggggtactgcaagaaccgcgtacgactggtatatatcatgtagcctttttagttccgactcgtgaagcttttgcttctgcgctatttggggttcttcgtaataagaatgtaattgacagcccggatgagcaagaagggcgttatacatattcaaatgaaattttaccaatttcaaggtttaatagtgcaagtgatcatacatatagcgaagctttttatttgcaagatttagaggggaatggtattgaaatttatgcagaccgtccgcgtgatcaatggggagaagggtcaggaggaagtacaccacttgatttaaaagaattggcgacactcgttgattatgagtttgatggtttgcctgctaatactgtcgttgggcacgtacatttacgaatagctgatgtagagaaatcacatgaattttatgtggaaacagtaggttttgaagtacaacagcgtgaagaggattgcttatttatttcagcagggggatatcatcaccatattggtgcaaatacgtggaacggagtaaacaatccacacccaccagtatatgcaactggactaaaggtatatgctattgtactaccgcataaagaagcgttagacgaagtgaaagaaagattaatagaaaaacaacatgaaataaatgaaactacaaatgggt

SEQ ID NO: 381 - DNA, 899 bp, Bacillus thuringiensis
tactatagagcgacagttgaaaatgcaaagtttgaaaaaatagacaaagagcgacgccttactactcgtgttatgattaataatgttcgggacgatggacaaactattgatctttcggaaataaaatatttcatacaagatgaaaaaactggtcagaaatatgaaggtgaagctcatccgatagatgacgagcactataaaaatgttccacacgaattctctttaactactgacgttgtgtttgaactgaaaacttcaccaaaagatttaaataatatgtatttatacatagatagcaaagcagcgccgttaacagatacatattggaagcttgataatttagtatctaaatagaaagaccagtcttacatgactggtcttttacattcatacatttaactttcattaacacttatattcattttctaataacaacttgaataacatcagctaaaccagtgtgccctttcccttcaattcgctcttgttcgccattaaagaaatgaattaccttatgttcttcacaccaagtaaggatatcaattggatcatacagcatatcaacatcttttggtccaccagtactatagtttatttgtttttttgagtaaacttcaaacataattaaaccaccaggctttatcgtttgtatcattttacctaatatcatttttttataattatcatgaaaatgtccaaataccataattgctacatcatattcattttctggcaaactatcagctaataaatctactttttttgtatgcacgtttacgttatgcttctctgccaatttttttgtcttctctaatccatcttccgaataatcaatagctgttacttcgttcccttgtcttgctagaaatacagcatttctacctttttccctcgaaatg

SEQ ID NO: 382 - DNA, 651 bp, Bacillus thuringiensis
aagcgaacgcttcaagtacatgatgccttacaatcttcattaaccgcccttcaagaagcagaactagatcaactaagtccttctctaccagtttggcaacaatatatgaatatccttttgcatgatgcttatcatacaggacaaattatacagcttcggaaacttcaaggttcatggccaactcaccgttcttatttataaagtgaaattttaatcagctcttaccaatcgggattttgcgggcagcccatccccacttctttgctttccctgaattttgaggtaaaagtcttactgcccgttaatccgggataaacgatgtttaaaatcgcatacgtttaatatccaacaaaacaattgaaaacaactaattgttcgataattactgcgattactcaaaataaagcaaattaaaatacattgattcctaacataacttacatgcttcataacttctaatcataatccaaatttggaagaatagatgcttttttatatacaaataataagcctcaaggagttgttgacatgcatttcatattgaatatgttagggatttttcgttgtcatattaatcgttttcttatgttcgcctaataaaaaacatataaaatggagaccaattgtaattctcatcctattggagctttt

SEQ ID NO: 383 - DNA, 778 bp, Bacillus thuringiensis
tgcaggggcgagagtagctttatatacgattttttatacaagatataaatgtagatggttttggggttatggcaccatggcttcccgagattgaagaatgggatgagttgctaagagtgctgaaggataaacatataaaaggatatatagtatgcgggaatcaagatgaagattgtttcgaatccacgcagcaatttgtacaactattaagagagaaaaatatagaacataagtataaagttgtgcctgacttagatcatgattatcctattaactttgaagagctattaaaagaaactattgaatatataggaaatgaaaacaataagtagtaagaaaaagagatgcatcacattaatctgtaccctttgtaaaggacattttgaaaaaagttaggcaacatcaagaagatggtttctgtatccaacaggagtcatcttttttaaattccattgatatctataatgattataatacgtcatatatttcttaatctcttgtttcaattcattaaaggacacgcaaggttttatatgagcttcatctttcagatgaccaaaaaatgattcttgtggggcgttatcccaacagtttcctcttcttgacatggattgtcctaggtttagctttttaactagcttttgataggtagggcttgtgtagtgggatccttgatatgaatgaatataagcaccttcagtcaatcccacccgcggattcctttttagtttatgaaaaatagtcgttacgagctctaatgtcgtctgttctgaaacat

SEQ ID NO: 384 - DNA, 563 bp, Bacillus thuringiensis
aagaaaaattggtgcaaactatccggtgacgacaacgttagcatttacagcaggtagtaataactttgagttagcaattgctgtagcagttggggtgtttggtattcattcaggcgcagcatttgcagcagttatcggaccattagttgaagtacctgtaatgattgcacttgtaaacgtcgctttttggtttaagcgtaaatattttaatgatcaaccagcataatttaaaaacaaaggcggaaaacaacatggaaaacaaaaagacaatctatttcttatgcacaggaaattcatgccgaagccaaatggcagaagcatggggcaaacaatatttaggtgataaatggaatgtatattctgcaggaattgaagcacatggagtaaatccaaatgcaattaaagcaatgaacgaagtaaatatcgacataacaaatcaaacatcagatataattgatgcaaacattttaaatagtgctgatttagtcgttacgctgtgtagtcatgcggattctgtttgtccatctactccgccgcatgtaaatcgtgttcaaaggagattt

SEQ ID NO: 385 - DNA, 926 bp, Bacillus thuringiensis
agaaggggtaatgatatcgaagtttgcaggaaaagttgctatcgcaactggcggtggcatcggtattggacgtaatacagctcttttgttggctaaacaaggcgcaaaagttattgtgacggacattgatcaagagagtggacaagcaacagtggaggaaattatgaatctaggcggagaggcactttttgtatcctatgatatgggaaagcaaggagattggcaacgcgttattagcattactttgaatgcattcagtcgcattgatatgctttttcaaaatgcaggtgtatataaaatagattctattttttctcgccatcaagagaacgattccaatgtactttgtattaatgacgtttggatagagataaaacaattaacgtcatcttttatgaaacagcaagaagaagtggtgcttagtgatttaccgattttcggtattattagcacaaaaggacaatcatttcatacagtagaagccctagtataataataaaaaccgccctcaatatatgtggacggtttttttgtatgtgtatagtaaagataaattttttagcgaatacgttgttcagtttggttatcaaagaaatgtgctttattcatatcaaatgctaatttaatttgatcaccaggtgaaaatgtatgtcttgcatctacacgtgctgcaaaatcttgatttccaagtttcatatataaaatggattcagcacctaataattcagcgacttcaatttttgttgtgaaggcagtagattgcgaagcttctaaaaatagtagttcatcatgaatgtcctctgggcgaatacctaaaacaatttccttatttacatagccttgttcacgtagcatcttcatttttccttcagatactttaatttttatagtattgtctataacgaaatcggtttctagtcaattta

SEQ ID NO: 386 - DNA, 807 bp, Bacillus thuringiensis
cgaaaagtgttttattacaatctatcgcatctgtagacattattaagaaaaataatgaaaagttaacagaggcaattcgtaatgcaattacgatgacgcaaaacgttgtaacggtttcagctgctattcagttagcgttaacaaatcaacggaaaacaatcgatgcagtgaatgcgacaaatgaagcaattgaatcgatggtattaagtaattctcaagcgttaaaacaaaatacagaagaaacgacaaaattgcttgaaaaccctgctattagcatggataaattacgtgaatcattccaaaatgtgttcgctgcaattgaagcatctgaaaaatcgtcagaacgtattatcgagtcaagtaagaagttcgttattgaactagacacatttaatgatgagatgaagcagaaactcattcagcgtccaaggaaataacggattattagaggaggtgaacaaatgagtttcattcaaacagtattattactactcggtacattgcttttaatagcatttactgtcgttgttttagtcgtatatttcggacggaagctgtatttttcatggacgaagccatataaaagagcgcaagattctttagacaagttatcaaacaaatcaataccgtttctacaagaatttacacaacatccactgttttatcgctggattcgcactgaaggaaagaaagaacaaaatacattaaatactctattttgtgcatcaggtcaacgtacgagagaacatgtctttctcatgttaccgaaagaaaagcaagaaatagtgcatgtaatggcataaacta

SEQ ID NO: 387 - DNA, 1199 bp, Bacillus thuringiensis
ttagtgcagttgttattgtagttgctgcattaaacttattactagatttcgatttaatcgaaaatggtgtacgtagtcaagctccgaaatatatggagtggtatactgcgatgggactaatgcttacattagtatggttatacttagaaattcttcgtttcgtttcttactttacgaaaaatgactaataaaaaaatcctgcatgaaaaatgcaggatttttttattttcaaagatatattgaatgtatggtataatatggatgatagcaacttgaagtgaaggagatggaatatgatgaaagagaagaaggggattatgaaaaaattattttctaaaagttttttcatagaactagatgaagctttaacgtatccatcatcaaaagttattacttcagcgattgaaggatatgcaactgaatgcaatgaaagactaaaatttgagagtaaagttaaaccgattactttctacttagaaaatgtaatgtaccgtgctgaaataaagatggctcgcggaggatattacatatcttgtactgaagtgtaataaattttgaaactatacatgtttgaactatgtatggtttcttcctttgttctgtaaggtccaaaataatactttctacttacggatatatcattttgtgctctttaccattcaaacatctctccttacaatgaagaaaaacatgtgaggtggtataacttatgatgaatcttctctgtacataatagtgctgaattttaaaaaaatgtacagtatggggtactaacacatcactatcaagctaagattatacaatatcaagtatagtagagattatttcttttttctaaaagccaggcttagaaaatttaaaggtttgcatgcgaaataaaccctatcgggtttcattttttgaattaggccgcttgatcttcagaaatggtagaattgtaaacgacacctaatatatcaaagactgttttcttctcatatctgtgagattttcgcccattttgctgtaggaggttgaacaggcgaatgagaatctttgataattcttgggtgtctttctgtatggcttgataaataagaaaaaaataatctctaatcatatatatggccttatattcactcagctttcgtttctttttcataagaagtagttgacgcattcgaaacatagttgaagaacagaggaaaatggcgatcagt

SEQ ID NO: 388 - DNA, 898 bp, Bacillus thuringiensis
caatatacagttttatatacgacgcttatcggttattattgcattagtagtaaatgttcttatacatgcggtatattaccatccgcgtccgttcgtatcacatgatgtacatcaattagtaccacatgcagcagattcatcatttgttagtgatcattctgtacttgtattttcaatcgccttcgtatttattcttagaggagaaaaactgaaatatatcgcgctattatgggctgtgttagtcggtatatcacgtatgtacgtaggtgttcattatcctttagatatacttggtgcagcattcttaacacttgttacgagcggtttagtaatgcaaagtacacgtatgtttgaaccaatagcgaaatttgtattcaaaatgtatgcattagtagcgagacgaattcctttcttagcaaaatataaccatatcgcataattttcttataaaaagttcccatttggaaatccagatgggaactttttatagtaaataagaaaagagtttagagtgctatgcaatcaagttttggtgaagttaatattcagaaatttcacgcaccgtattttaattaaataaaacaaaaaataacaatagttagttttgcattgttttaaaggaattaaaaagaaaacttcgaaacatatagtatcgtaaacaaaaactacaaattttaaaacgtatcttcgtacgaatccattccaaaagagaggagataagtatgcaaaaacttcaaacgaataaaggcgctcgatatatgatgattgcttttattgctttgtttcttattatgattttgcgtatattctatattcaggcagtaggagtcgtgcataatgtaaatgtaaaggacctcgcggatgaacaacataataaaaaaggtgttttagaagcgaa

SEQ ID NO: 389 - DNA, 1158 bp, Bacillus thuringiensis
  unsure (1)...(1158): unsure at all n locations
caggatcaaaagaatcggaatttttggaaacaaataatgcaggaaacagtacagcttggaacaccaggggtattagcgagggcatcaaacaatggaaagattagtagttatactgcaggcgtcgcggatttaaatagtaagaaaccaatgaaatcggattatcgttttcggattggaagtgtgacgaagacttttactgctacgactgttcttcaattagtaggagaaaatcgtgtacaacttgacgattctattgaaaagtggctacctggcctcattcaaggaaatggatatgatggcaatcaaattacgatacgtcaacttttgaaccatacaagtggtatagctgaatatttaaagtcaaaagacgctgacattatgaattcgaaaaaaacgtatacagcagaagaaatagtggaaatagggcttgctctacctccagatttttcgccaggtaaaggttggtcgtattcaaacacgggatacgtaatactaggaatgcttattgaaaaaataactggtaatagttatgcggaagaaattgaaaagcgaattattgaacctttggacttgttaaatacgtttttaccaggtaattcaccagtcatcccaggaaagaatcatgctcgagggtatatgaaaattgacgaaacaagtgaattgaaagacatgacgtattataatccgagtttagctaattcagcgggagatatgatttcagatgcggacgatttaaataagttcttttcatctttgctcggtggtaagttattgaaagaacgcgagctaaaagaaatgcttactacagttccaatagaaggaaaagatcttggtgatggatatggccttgggatctatgagacgaaacttccaaacggtgtttcagtttggggtcacggaggagcaattcctgggtttatgacttttgctggcggagtaattggaggcaagcatacatttgctgtcaatgttaactctttaggtgcggctggtattcttacaaagtttaataaaatgatgcaaattgaatttaagaaataaatgaaaagaatgtaaatgggatcctgttttaagggcagtattagtattcatagtatggcatcaagtgtaattcanacttatagtctggtggtaaaaaaggatgcggttacacgacat

SEQ ID NO: 390 - DNA, 1541 bp, Bacillus thuringiensis
tcctaataaaattggtcaatttgtttctttttgggagaaagagtaaatatgcgaaatagagctttctcttatgaagctgctcctgatttattagtaatcacttgtattgctgataataaactaggacaatttatttttcctaaagaggttcttcttaaagaaaaaatattgagaacacaaagtcaaacagggaaaatggcaatgagaatttatcctgtttgggataccactgttagcaatcaagctaaaaggagccaaacgtggcaacttcactattttgttgatttaagtgatagtaataatttgcctatagataaactattaaatttatattcgtagcttttgatttgcctcaaaaagaagtaattacagaaaagacatttgtaatgacgctttctattaatttacctcgtgaatcgtaatttttgtaccggtacagttaaatgaaatgtacattgttacagtgccccttaaaatttacaatcagcatatattatttaaacttataaatttttaaggggtgctaattatgacaagtttacaaaatcagcttttcacaagattaaatcttaaaaaacgtaatgaagtaacgtttgaagaattacctactatactcttttcatttgcacacactataccatttgagaatttagatgttatagcacgaaatacgaatcaaatctctctggaaaacttacgagagaaaattttaactagttcccgtggtggactttgctacgaattaaatactcttttttactatttcttaaaaaactgtggctatgatgtacaactggcattaggtacggtgtataaaaatgatataaatgcatgggcactggaggatggccatataacaattattttaacttatgataatctacagtatttaattgatgtaggtatagcttcgttagtacctcttgttcctgtaccttttactggccagtctgtttcttcaaaaaatggttcgtaccgagtgagacgaaaagatacaagtaaaggaaattatgttttagaaagaatagatactgatggagaatggaaagtttgtcatgctttttataaacctaatattgatgagatagtaataaacgatgttcaaagaagagtgatagaagatgagaagtctatttttaataaaggaccaattgcagtaaagttgacgaactccggtcatatttcattaacgaatacaagtttaactgaagttattcatggggaaaaaactaagcgtgaaattacagaaaatcaatataaagagtttttatatactttatttgctattaagttatgaataataaagatagccggttcttattcagaagcggctatctttattattttggtgtaaatggttttcttctaatatgtttcggaaactgcggtatagttaatgtttttaatgtttcccccgcttcttcatatgtatgaaaaattggtttcttttccatcatccccttgtaaaactagcccttcattttgaattacatatggcataaaaccaccccatctagtaaagaattatttttttttgcagc

SEQ ID NO: 391 - DNA, 1049 bp, Bacillus thuringiensis
ctatcaaattaccagttccataaaaaccatcgcattcaatttgcatcggatgcagcaatggtggaacttaatttttgtttacaaggatccggggaagtacaagttggttactctacaaataaattaatggctgggaatagctatttatactttatgaatgactttgaagttctatttgaatatgaaaaagaaactccactatattcattagcaattggaattcctgtacagttgtttaatcatttcatgctaaattgtgctattgaaaaaagtcatgattttcatactataataggaaatcaatcttttaaaaagtttcaaacccccattgatgccctaacatctaatattattaagagaatgttagagaatccccaaaaggatcgtattaatcaactcgaaatagaaagtaaagcgctcgaattgctttctatatactttgggaaagtattactgaatgatcgtgatgcaaataaaaggagccaattatccaaaaaggatttaaataaaataaaacaagctgaagaaattttacttcaaagaatggagtcaccccatgcccatcaacttaaggatagaaactctacggttttccattaattgaaatgaacaaacttttaaacagtataatcctcttaaaaatgagcatacgaaataaaccctaacggggttcatttttttcttatgcagctttcttttgttttctcgatccattatactcatagacaacacccataatatcaaagatagttttcttctagaaagaaaggattacgtcacaagttcttttgaggggagacagggggaataaagccaatggtgttaagcgggtgggttattggaaccgcggatgaaaacagggaaagatgatcttagatcatcccagaggctgtagaatccgggtgagttctctagttgtgctatttgcagacagaaagttggcgcatcttaagcgtggtggacgcacatatagttaaaaaaccccccagcaaaggaggggggcctcttttaaataactcgaattaaaataataccgacaatccatatga

SEQ ID NO: 392 - DNA, 970 bp, Bacillus thuringiensis
agttaagagaagttcctacagaggagcttcttttttttgaataaattgtgacaaattgtgacacaatatcgtcacaattattgtgtttttgtaatttatgtgagcgtgttcattgcgtgacgtatataagtgttgatattatgtgtattgtgtacaatgctgtatacagaatatgaatttaaagaggaatgtatatgaaatcaaataaactcatggctcttggtatagttttttctatcgcagtattgattgtaattggaacaattgcgtatagcatcataaatgacaaaaaagataaagggaatgagatgtttgcttattctacgcaacaatctttagggaaagatgatgctccagttaaggtagttgaatttggagactttaaatgtcctgcttgtcgtacttgggatgtaacggtattacctcgattaaaagaagagtatattgataaaggcaaagtgcagttatattttattaacttcccatttatcggaaaagactcggatttaggtgcagcagctggtgaagcaatttataaacaagataaagattcattctggattttctatgatgagatttatcaaaatcaaaagaaagatacggcagaatggattacagaagatttgcttcttagcattgtgaaagagaaacttccaaaagttgatgtagagcaatttaagaaagatttacacagtaaagacattaaagaaaaagtacgtaaagattcagatcgtgctcaaaaattaaaagttcaaggtgctccttctgtatatgtaaacggaaatcttgcaaaccctgatttcgatagtatgaagaaggcaattgataaagaattgaaaaagtgatgaagtctctcatcactttttcgacttttttcgataaaattcttgcctctactttttttacatgctatactactttacataagttattctaatatcttatatgtaattcatatttgcgggtgtag

SEQ ID NO: 393 - DNA, 1188 bp, Bacillus thuringiensis
  unsure (1)...(1188): unsure at all n locations
acactcctatacacataaaacatctatacctttcgtaacattaaggaaacaaaaggaaatgatatagaaataattataatatttcgtaacaaccttgtaacacaaatgtaacacaatacatttaatcgtacaatacttttttagctaattatcaacaaagcattgttaatatcgttcaaatttaataatgttcccataaagtaatacatattgtttgtgaagtgttttttcaaaatataacgaaacctaccatgacggaggaatgttaattcaatttaagaataaatggattgatacctttctagcttttgtatcccaatcatagtatagagaggattattgttatccaataaatgtatgtgaacatatacaagctaagccttctaaataattactgtaactaaaaaaacaagtaattatacttgtttttttagtttactttccaatatcgcaacagttttatgtgctctcttttcctgtctacattattggatgcatatcttactaaagatagcttctttttttatgattctattgaagtaattaattgctgacgttctttatctctataaattttcatttcatgtttaaactcgtaatttcctacttcaaatctagcccattccttacttgtccaatatactacatctacattttcttttaagattgcagaacacacatccactaattcatctttgtaaaatggagcttcttttgctaattcaaaagcaagcacttttggatccttagttttaatttgaagttccctagaggtttgccctaaatactgccatggcgatggtattgattgaacttgggcatctcccctatcttgaaactgtgatggagaataatttgttgaagcaaatgtaggtttacttactcctattgctgttcctaaaacaatagaaccaataataagttttttaatcattttttcagcccctttaataattttggatatgcttcatttttataccacgttcacagtcatgtaaataaagataatttgacataattctgcgttttcctcgaaaaatgcatattaattacacaccttaaatttaccgaaaacaaaattgttggttaatgtaaactttcttgtcgtaagtatacaatttttgtataaaaattagtttttaaaatatttgcatacttattgataagcttnctgccataccttattcg

SEQ ID NO: 394 - DNA, 867 bp, Bacillus thuringiensis
tacattagctatattcatctgtattttatttatgaattctataaaaggatgatcatgcaaacgagtttgcatagcatctgaaatttgcatgtccccttgaatgattccaataggttgatcaagccacttttgtgttttcttttcgtaatcggctaccaatgaaagtacatcttggtccgcctcaaatccttgtacagataataattcagaagaactctcttttttcacccatttatgtttcgttttttcgaatgttacttttacttttccaactgagtgtccattgcatccggtctgtaaaattgttacaccgttagccattgtgtgagaaatttcccggtgttggtggcctgttaataagatatctatgccttcaatttcatggcacattgcatatccttggttttctcctgttaacacttcagtcggtaccccggtttgtaaatctcgttcaactcccccgtgatacgctacgactagtaaatctggtttctcatgttcgcgaatataagaaacccattcttttgtagtctttaatgcatcttcaaatagtaaatctttaatgtgatgggactgttcccaatttggtatgtaatgtgttgttaccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttggtttctcaatccattatactcatagacaacacccataatatcaaagatagttttcttctcatatcgatgggatttcccgccatttttctttagtaggggtaacaagcggattaa

SEQ ID NO: 395 - DNA, 1010 bp, Bacillus thuringiensis
tctattctaaaactaaaacaaactttaaaaacacagtggtaaagtattattcagcggcaatatgcatgaagattttattgaacagcgtgttaggattgccaaaaggcatgtacaaattggtttacatcgaaaatggtatactgctgcttatcaagaattgttccgctctatcatgaagattttgcaaacaaaaataacaacaatcgatgatttttcctattctataaatgttataaataaattatttactcttgaacaagaacttgttcttgcagcttatgaatctgaatatgaaagaatgcaaaaagagcatgagaaagaaaaagaactaactgctatgacaattacgcatatcgcaacagaactagctgctgtatctgaaaaaacaagctcttctattcaaaaactaaccgccaaatctgaaactattgtagagattgctaaaacaggtacatcattagctacaacatctgaagaaaaagccaataaagggaaagaacaattaaaccagcaaaacaaacgaatgggatctattcaaatgaatatggaaacgattattacagatactcatgaactccttaatatttctaacaaaattaatgaaatcatagatattgttaaatcgattgcggagcaaaccaatttactcgcactaaatgcagctatcgagtctgcacgtgctggagaatttgggaaggggttttctgttgctgctggtgaaattcgaaaattatcagagcaaacgaaagaatctatatttaacgttacaaagctcggtgaaaaaacaaatgaacaaattacccgtgtctagtcgtccgtgaaacaaattagctctgtcgtatcggaaggaacggatagtatgtcagcaacagatcgatacttccaaggaattgtaaaagatatgtctaagtcaaaagaacagaataagaaaattgatgtcgagctaccagctatttcacaagtgatgaaagagattccatgatgattcgtccaccatggctcctaacagc

SEQ ID NO: 396 - DNA, 1141 bp, Bacillus thuringiensis
gataaagtgaaacgtgaattatccaggacatctatcgataattattagctcacttcaatcttgaaaaaacgtaagtgtaatgcttgcgttttttctttgtaatggtgagacgtcacagaatagacataatttgtcgttgttatagtaatatcgaaatttgtcaatttatagtaggagatttacaaaggaattttcgggaaagtagagaaaatctttttataaggaaaactttttattatgaaactggtagggtgattgaagtgattagggaaatcgaaatagaagatgcagcatcatttttgcaattaagtaagcaattagatgaagaaacgaagtttatgctatatgaaccaggagaaaggaaaactacagctgagcaacaagaaaaaatgatccatcgatttatggaaaatgaatatgcaacaatatttgtagcagttgaagatgagaggatagtaggttttatattagtgaatggaaataacattcaaagaaagaggcatgtggcaagcattgtaattggtattttgcaagagtataacgggcgaggtattgggactagattgtttaaagaggttgagaagtgggcaaaattacatgatgtatggcgtttagaattaacagtaatggcccacaatacaagagctcaggcactatataaaaaagctggatttgagaaagaaggtgtcaaaaaagctgctcttattatcgatggaaagggcatcgatgagtatgaaatggccaaattattaaaataagaggtcgttatatgaaaaaaagatgggcactacttggtattgtagctgcaataattattattggagtagcaggaatcaattataaaatgtataaggataagcaggcgcgggaagtaagtgtaaatagcatatttccgaaagcgaaagaaacgattgctaatatggatggggatattgcggtaattaataatccgaattcaatgcttgtacttgtaaataaaagtaggcgtttaccagatgggtatagaccgccagatttagttattccgaaagtgcgctactctagtgaaggtgatcaagaaaagaaaaagatgagaaaagaggcagcgagggcgcttgaggatatgtttcagcaggctgacaacgagcgtatttttcttttt

SEQ ID NO: 397 - DNA, 953 bp, Bacillus thuringiensis
tggaacagcacgtgcgattccaatctttattttcattgataaagatggaaatgaacaagccgtctttggaccacgcgctccaaaagtacaagaattagtaacttcaatgcgcgctacattacctgaaaaagaagatccaacatttgaagaaacacaaaaagaaatgtatgctaatttccgtgctacattagctgatgatacttctctttgggaacatgtaatggaaaacatgatagaaaaattagtaaaataaaaacctgccgagctcggcaggtttttattttacataatgaagaaatagaataccgcagctaaaatgaaacgataataagcgaacggtgttagttttacacgagctaataattttaagaatgagacaattgcaagcatcgcaacaacgaatgcagttacaaatcctgttgcaaatagcgttacatctgccgagcttaatacatgccagcttttaattaaatctaatccagttgcagctaccatcatcggtactgctaaaatgaacgtatattcagctgccgctgtatgcgacacgcgagctaataaaccaccacttattgtagggccagaacgagaaaatcctggccaaagtgctaaacattggaacattccaattgtaaatgcttgcttatatgtgatttcatctaacgttcttgctgtacttggttttgaaaacttctcagcaacaatcattaaaataccaccagctactaaactaatgacaactggtcctggaccaaataaaacctttttaattgcactatggaataatacaccgagtaccccggcaggaatcatcccaataataatatgtaataaatttaacgatggcccttcttttactttcccaattccaactaacgaccataatcgtttccaaaatacaactacaaccgctaaaatcgatcccaattggattacaacttcaaaaacttttgctc

SEQ ID NO: 398 - DNA, 968 bp, Bacillus thuringiensis
ctatactgtattattcattacttgattttggttataaatatttaatagataatttgagtgtagctaaaaatagttttgatcaaattgaatcttttaataaaccaactgacgatttcttatcgtattattatcatttttataaagcaatctactctaatgcagttggtgactacaatgcagccaaagagcattatgaaatagcagaaaattcacttaaaaatattccggatgaaattgaaaaggcagagttttattataaccaagctgtgttccaatatcattactatcaggcttttgtggctttccaacaagcaacaaaagcaaaagaaatatttactgaacacaatgggtaggaagtgaaaatcggttattgtaataaccttatggcgttagcttgtacgtatatgaaagaatgggaatcagctgaagaactttatatcttttgagcgttttccgtgtgcatcaagtgagtatattgttaattttatctgtattcattttttattatgaaacattttaaggttgataaagttttattgtgtgggattattaaataaaaatgataaattgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcaagtacccaatttcatcaataataagtaatttgtattttgtatagtgctttaaacgagattctaggcgattctcaatcttggcacgttttaaaatttggagtaaatcatgacatt

SEQ ID NO: 399 - DNA, 717 bp, Bacillus thuringiensis
aaaggtgtagttgttatgccttatcaaaaccgccgttttgatggtgattttttagctgtgaagcaagtaattgaacaagggttccttggtgatattattgagattgaatcacatattgattatttccgtcctggttcaatcactcatgaagctccaaaagaagaaggttcattttacagtttaggtattcatacgatggaccgtatgatttcactattcggccgtccagatacggtgacatacgatattcgtaataatgaaatggaaggtgcggttgataactatttcgatgttggtttacattacggaaatcagttgaagattaagctgaaaacgaaccatgtcgtagcaaaagattatccacgctttatcgttcatggaacaaacggatcatttattaaatatggtgaagatcagcaggaaaatgatttgaaagcgggtgttatgcctgagagtgcaggatttggtgaagattcaccgatgtactatggagttgctaagtatcgtaatgcaaatggtgactggattgaaaaacaaattaaaacgccacttggtgattacggtcgtttctatgatgccgcgtatgaaacaattataaatggtgcaccaaaacttgtgaaagacgaagaagcggtaacgaatattgaaatcttagaaaatggatttgctgccccatcaccttcagtttacaaacttgaggctttacatttgaatgaa

SEQ ID NO: 400 - DNA, 744 bp, Bacillus thuringiensis
caatacctactcgactattttcatatatgtttttcttacatagatcccatgcaaagtgtgctgtatcacccactgtaatttttgatccaccctctggcaatatatctttttcagttcgatatacctctgtcgcctcaccatctattaaatgtgtcggacaaacaactgtccaacataaattattactattacttagtactttatatgcagccaaatgatcttccgctgccgttgtcgttttccttttggattccgttgattgaaaacgatataaatttagatttgttcttgcttgtaaaataccagctgttcctattgttatgattctacgaaccccttcttcttccatttgcttaatgatttgtggcatactcttccctaatgttccattttgatccgttccaagtgcactaattactatatcgcttccttctatcactttctttatatcattttcgttcaatacattaccttctatcactcgtagcctttcatgttgtatttctattctatttaaatcacgcgctaatgcagtcacttcagctgaatcctttaatgctaaattaattatgtttgaacctactcgtcctgttgctcccaatatacatactttcatttgttttccccctctttcattctctttctatttttcaataatctcaataaatttacaacaaaaaagcttcctcatatatgagaggaagctttattattactttatttcttttctttagaatcaatcac

SEQ ID NO: 401 - DNA, 766 bp, Bacillus thuringiensis
cttggcgatttccgcgaagagttctttgaacagtatggctttaataaaccgaatgctaaaaacttctaatacataatttaaaaggaggaacaaaagatgaatgcaggtatgatgaatatcgttatgatcgttgcgatgtttgcgattttctatttcttattaattcgcccgcaacaaaaacgtcaaaaagcagttgctcaaatgcaaagtgagttagcaaaaggtgatgctatcgtaacaatcggtggtttacacggtacaatcgaatcagtagatgagacgaaaattgttattaaatctggtggttcacacttaacgttcgatcgcaatgcgattcgtgaagttgtgaaaaactaatttggaaggccctgcatgaaatatgcagggccttttttagttactttgctttgacatatttacaccgaaaataccaccgagtgtactcgcccccattaatgctaattgataaagtaattgtgagttcgataaagtttgagaaaagcctaaatagttaactagaaaaacgagtatagtgaacgtgagacctgttgtgagacctactagccaaccttttccttgagcctttttgccggcagtaaatccagacataagcatagataaaagagcgagtataaaaatagtaacggttaatgtcccttcgtttatattcgtaaactttaataaaagagccataatcatactagtaatagatgcgagaattagtagtgtaacaataccgaagccaattgcagttgataattttttc

SEQ ID NO: 402 - DNA, 822 bp, Bacillus thuringiensis
ctttagttatagttcgagattcaatctgaagctgcaaatctttgaatgtaagaaatgaaacctgcttgttttcaatatgttcttctcttctaaatatcactctcatacgtgctaacagttcttcaattgcaaatggtttcggaagataatcatccgctccactatctaaacctgtcacacggtccataatactatcacgagcagtcagcataataatgggtgtatttttagtcgctcttagtcgacgacatacctctagtccatttaatccaggcagcattaaatcaagcaaaatgagatcgtaattcttttcaagtgcttcgcttaacccttttcttccatctagttgtatatctactttatacccttcatattttagttctaattctagaaaatctgctaaactttcctcatcctcaataattaaaatgtgttgcaacgatagttcctcctagacaattaaatgaataaataatcctattccaaatataattacaatgatttgatgcacttttctatacatcataaatttttcttttttatttacttgctgtaaagaaaacccaaaaacccctagtacaattaaggctaatagagaaaatataccactgtatatgagtaaaatatgacgactcccttttataaaaaagtaaacaccatgagtaattgcaacagctattatagcgtatccaattaatacatgaaacttttttgcaaatagatacacttctttaacttttttaaacccttgtatatttttcttctttaaaaacatccatatatggcgtaaaaaccataatgaagcagagataatagccccat

SEQ ID NO: 403 - DNA, 1317 bp, Bacillus thuringiensis
taacaaaacaaaaaggagagttcaaaatgaatcaatatattgggaatttaattattcgtatcgtgttaggagttacgttctttgcacatggtttagcaaagtttcaatcaggtatcgataatgtagcagggtggtttacaagcatcggtttaccaggtggccttgcatacggcgtagcaacagttgaattagttggtggtatattattaattatcggtttaggtgtacgatatgtaggattgttattcgctcttattttagctggagctatcgtaaaggtaaatggagcagcaggtttattaggagatggaaagaatccaggatatgaattagatcttgcattattatcaatgggtgcgtatttattcgtagtaaaagcagaaggatatgtagatcgtttcttaaaagagaaagtaatgaaaacgaagtaaattttatttataaatgttgacttgaagaatcattgtaactataatgattacagctaatagattaagagtaaaacaatttaaatgtttttttacacaagatgtaactgtgatggttacgtctcgtgtaaaaataaataaacgggaggaagtaatatgcctaaatcaaatttagaaattattaaaagcacgtatgaaggatcagcttcttcgaatgcaaagcatttagcagaagccctctctgaaaaagtggaatggacagaggcagaaggttttccgtacggcggaacatataaaggcgtagaagctataatggaaaatgtatttagccgtttaggatcagaatgggatgattataaagcaagtgtaaatacatatcatgaagtaaacggaaaagatgtaattattgctgaaggtatgtattctggagtttataaagaaacaggaaaatcatttgaagcagaatttgttcatgtatggcaacttgagaacggaaaaatcgtgaagtttaagcaatatgtagatagtcatattgttagggaagcgatgaagagataatgctttttaaatggatcgtaggtatatgcattacaattatagtaattttctcgtctatagttggcggaaagaaattgcttgcatatgtggaaaaagaaaataaaaatattcaaaccgagcgagcggcaaacgaaaaagagaaaaaagctgcagaagaagctccgcaaattagtgaaggtgaaattatttctactatgcataaaatggcgcaccaaaaggttaaaccctttgcaaaatggggatttgtagagatgacacaataggaaatttctaatgtaatatgagatattgaaaatagtacaggttccaatatacaatgaagttattttct

SEQ ID NO: 404 - DNA, 1044 bp, Bacillus thuringiensis
tcaatttcccattctttattccacggcactaaaaacactttcccatacggtaaacctaacatttaattagcatccctttcaaaatagttttcaaaaagtttattacattttcttaaagcttctcaaaacaaggtgttcccacaatctccaaggaagaatcttcttcgcaaagatcataaatttcacacctttaccgattggatatcgtaaatttgtacgcttagattcagcaatttctgcaattttattagcaacatctatcggattaccaaatgtatcactgccgctattaatatgtttttgtattttatccatatactctttgtaaggagatgttgtatcagattggttttcagcgagttgtttcccaacctcccatatgtttgtgttataagaacctggttcaattaaagcaacatctattccgaaaggttttacttctaagcgaagtgattcactccagccttctaatgcatattttgaagatacataaggagataaaccagggaatccaacttggccgctaatgctgctaatattaatgatttttccacttctttgttttctcatatacggtaagacaagctgagtaattgatatagccccaaataggttcgtttcaaattgtttgcggtattcctctactggaatttcttctacaaagcccccatttgcatatcctgcgttattaataagtaggtctactctgtttattgcttttatatataattgaaagttatgtatagaattttgatctgttacatctaattgttgaacttttatattttgctgtaagttgagttcagtaacttgagatagtaaggttccttggttttctaggtttcgcattgtagcaatgactaaatagtcttttttcgcaagttcaagcgttgctaataggccgaatccacttgaagccccagtaataattgcaatttttttattcattgtcggctcgctttctttttctcttatcataacgagatataaaaggtaaagctatttattgtataaagatatttgttataactgaaaatgattatc

SEQ ID NO: 405 - DNA, 1138 bp, Bacillus thuringiensis
atcccgatcttgcaggttatttttctttccatcaataacaatgaaaacgtcacttactatttttgctggtataatcccgacattttctacttgcaccgctttctgctcattcaattgctcgatatgttctaacgggacgataatactaaattgtgagcgaataccacgaaagtttgtatttaattccttcgcagcttcaaaaacaacaattttcgcgccaatcttttccccatatgaatctaaaaatgcatttaagctctttgtatattcctcttccgtatgccattccatcgtaccgaatactgctggattaacattttgaataattgtcgtgtatatttctcctcttgctttagatgcaattaatgatcgttttatggattgaactgtcttgccaatatcgctaaatttcgcaccccatatttctgaaatattaggcgttaaaatgaacgcaatatcaacaaaaataaccattgcagtaaacattaaaagatttttccagagggttaaatcgattccttttatcatgaaatacacggtgacagatatgataaacaaaccataccaagtctttctaatacgttgcttcttctcctcgtacaactcttcattttttctttaaaagaaaacaaggactacaaagacaatcgctaaaacaaataagccaattcgaatgttagagatcattaatcacatcaccctccattcaaaaactactcacgatatcattacatgcgcaagctgctctctttatgacaaaagacgtggacaagcttctaaaattagctacatcgcatatatattagaaggtaccacgtcttttatcctgctatttgtgggcagtaagaccccactgattaaaatttcactttaccatgagtctatattgtatatgtagacaagcattcatttcaaattttcgtattaaaaagaaatatgtttcggaatttccccttcaggtacttctccatccatacttaaataataatgacgaatcggacgtaagttttcgtctaattcataaacaagcggaatgctagttggaatatttaatgaaactacaccatcacttgaaagggttgtctaaatattttactagcgagcgaattgtgttaccgtgtgatgaaataattacttt

SEQ ID NO: 406 - DNA, 594 bp, Bacillus thuringiensis
ctaacatttcctctaaactatcattttcacaatccaataattttttatcgatttgttcatacatggctttaaagctctcgtatcgctttatttccgttacttttaccgtcatcatttcttttgtcgtaagattcgtaaatacgatttcatcgcctttgtttattagttgacgtttttcatcgtataggcgtacttcatatactttttttcctgattgaattgactgaaacggtttattatataaacccatttcgtatcgcatacatcccactcccttttgttcatttcacctattaatacagttcacattactacatcttgcatataatattccatacgtatcacttaattgagaaaggaggctgaagaagcatgttatatttaaatcaaaaacctgaatataataaatatgatattggtgattatacttatagtaaagtagggccaaccattttttcttggaacgatgaaacaaaattaaaaataggtaagttttgttcattagcagaagaaatcgttttcatacttggcggagaacattgcgcagactggataacaacttatccatttaatgcactttttgatgaaggagca

SEQ ID NO: 407 - DNA, 896 bp, Bacillus thuringiensis
taaataatcataaaaaatttcgaacatgttttaacgatgaaggagttttaggctattgggaggaaatgataccgagttatacaatctttcataaagatgataagtctttttcaagtatatggacggattattcaagtgatttccgcactttctataaaaattatgaagacgatatgagatgctatgctagtgttcatggtcttttcacgaaagaaaatattcctcctaatgtatttccgatttctagcataccttggactagttttactggatttaatcttaatattaataatgatgaaaattttctattgccaattataacttgtgggaaatattttaacgaaggaaataaggttatgctaccagtttcattgcaagtacatcattcggtttgtgatggatatgatgcgagtcaatttatagaagatttacagcagttaagtaacacttgcaacgattggcttaagtaatatctaatttttaattatataaagtgaaactttaatcagtggggtgtcagcccccgctgattattagcccgacccccacctaacttctttgctttcgctgaattttgagatgggggtcttactgcccggcaaatagcggaataaaattgaaaatgaataaaagaagagaccatgttgatattacatggtctcttcttttattcattaatactaagtaattgtggaaaatataggatgatttgtagtttaatagtaaagagagtgattagtattaattttctttgtttttaaaattttaagtatgtaaatgtttaacaggggggaataaagtgaaattcgtaagcattgaaaaagatgaaatcttaattgaggatatggcacaattgtattgtaaagtatttgagaaaataaatttcaatgaaatga

SEQ ID NO: 408 - DNA, 996 bp, Bacillus thuringiensis
ctataggtttttttaaccaattgaacagttcggattttatgaatatcatatacatttctaattaacataacgtcctattatcggttgcaacaaaaagggattccttactctcaaaaggaatccctttttttattttctatcactcgattcatctttttatacattcctatcctgtgatgggttttatggttctcgtttgttactggattagccaaaaaacgttctaaaattttgtatactctttacttattttttcaaaaaagctggcggtatcccctctttaagtttattaaaatactttccacaattttttccgaagctattacttaaaatcaccttttattacgatgccccctcccgccttctctccaaaaaggtaatactctcaatcacaacttcagttctatatattctcttgccttgttcatcatcgtaattactagtctgaatacgccctgtaatcccaacgagcgaccccttcttacaatattcagctacattctcagccgatttgcgccaaacgacacaattaataaaatcgacttgttgttcacctaaactatttcgaaatcctctattcaccgcaacacatattcgtgcataagcgacgccttgttttgtgtagtataattctggctcctttgtcaatctaccgattaatacaactcgattcaatctctgtacttaattatgtgtgtaataacttatttttgttagtattaaaacgttctctttatttctacacattgcttttatgtagaaatagattagaaatatataaacctgtctaaattaattactttttaaacataaaaggtaattaatctatattattataaggataaaacatataacaccatccatatacatagatggtgttatatgtttttataaataggtacaaaatgctctagactggagaaaatcattctattctttatttatataattctttacagtatactagtttcttgtaattcaaaatctaaaattttc

SEQ ID NO: 409 - DNA, 721 bp, Bacillus thuringiensis
gttcagtgtcattttaccaactaattttacgggaacttcttcttctggccataatttcgttggatctaaaatatcaaaatcaaatttatgttcatcttcttctggaattagctgtaatccaagctcccattcaggataatcccctttttcaattgcttcgtataaatcttgacgatgaaaatcaggatttttcccggcaatcttttgagcttcatcccatactaatgaatgaaccccgagggtaggtttccagtgaaactttacgaaatgggcttttccttctgcgttaatgagtcgaaatgtgtgaactccaaaaccttccatcattcgtaaactacgcggaatagctcggtcgctcatttgccacatgaccatatgagtggactcaggattatgcgcaacaaagtcccaaaaggtatcatgagcgctagctccttgaggaatatcattatgtggttctggtttaactgcatggacaaaatcaggaaatttaatagcatcttggataaagaatactggcatattattacccactaaatcatagtttccttcatctgtataaaattttgtggcgaatccgcgtacatctcttactgtgtcgttggatcctttagaaccttgaacggttgagaaccgtacaaatacaggtgttttctttgaaggattagtaagaaaatctgctttcgtatatgtttctaaagattcataaagctgaaaataa

SEQ ID NO: 410 - DNA, 1336 bp, Bacillus thuringiensis
taatccaaccagcaatacgccaaagttaataaaagatagaattagagggccaactcgaagatcgtaggaaaattcccatgtatggaaaagaaaaagaacattaacgtaactgcaataatccctccatagagcttttcaaaatatcgactagaattaattgtaaacacttgaataaatattgctgcgctaactaataaagaaaaaatagaaaggttgatgaaataatctttaataatcatgtaatgtccctccttgcattaagtgtattcgacaaaaaagctaaaaatcctacaaattgtataaacagttcaaatgcataaattttaaactaggataaaatctagaaaagtaaataaggggcacagcagatgagatattttaatgaaaaatagttcaaaaaagataatagtaaccgttgactactattatcttttttctttaatttatcgtaatatgtctgaaactctaagggacgtggtatgtcatttcatcaaacaatgattatatgctgagtgatgaatatagaaatttcagcagtaatttttgaaaaataacataaaaaacaaaactatctttaaaaatggaaaaaaactatataaatgtcaactaatctatgtacaaaaacgttcacttaattttgcataaaattactcaacttaggaagctaagtagttcttcaaggtcgataagaacacctgtagatgcttcaggataactacataattgtatgagtaatgtacttgaaacctttcggtaaaaccatacacataagacaactaactccttggttcaatatttactttttcgctgaacaaattctttttcttgagcaaaatattctaggatataaggagatttttcaattaacttgttgtctagtttattgtccagctccaattacttcgttactttcagattcagttcattatattttgtactttgtctttatacacaacatattctttaccatccactactgctactaccgcaaattcatcatttggattgaatgaaagccaatcagcccacatgttagtattagcccctccactccacatattatgaacagtgtttttagttaaattcataactttataagacgcatttggcgcatttgttccagtctttatttcaaaagtgtatgcgttatgaatttttttataaaagtagaacacgtttgatggacgaagctgattcaaaaaatcctgttcttttttctctgcaatttttatcccttcttgcaaagtgacaacatctgtttttaatgttttccaactgtttttcgctgcattcaagctaggggttaagaatttatatttattttgatcagcttttt

SEQ ID NO: 411 - DNA, 968 bp, Bacillus thuringiensis
aatcgctccagttttagacgcgataaaaaatatgaacaaactatattaccgtacagtatggaatctattaatatatacgcataaccaacctgaaccggaccgttatgaaaagtatttagatgatatgttaacgcaacgtaatttcgtagatgtgaattatgcgctcattacatttaatatttcagatgaatataatggggttgtagagggaagtaagcaaattcatcgtattaaagcgccaacactcgtcatacaaggcgatagagattatgtcgttccgcaagtagtcggtgaggaattagcgaaacatttgcaaaatgcagagttgaaggtattagaagattgcggacactcgccgtttattgattgtttagatgtatttataaaacatgtagagaattggttagaacagaaataatccccgaaatgaacagtattgcatatactataacatttgtatgttaaaggggagattatcaatgcatcaaccatttttcatcgcttattcgccatataatcattacgcatatacaaaaatgatgataaaaccgctgtatatgcaagtttcgccagctgtagttcctttacaaatgcaatatccgcagccaccaatcgctaacgcacagcaatacttatatgaaactgctttttataaacatccatactttaagcaatttcataacaatgtgaaagcacaagtttgggaaggataaggtaacaagctaaaagattcattcttttagcttgttttttattgcgaatattcgtccacgcatttgcagatgcagtttataatgaaaagtgtaagcgtgagaaggagagggaaaggtatgtcaatgcgttttactttttgaattatggttgggattgtagcaatctcgggctatctcaatgaacctcccccggccattgcaatgatttttgaacaaaaaggggttagttcaagtattaatggtattcatgcgatc

SEQ ID NO: 412 - DNA, 838 bp, Bacillus thuringiensis
tcaggcaatccaataatatcgttcatcatatatttaatatactctgcatcataatgcatatctttaatgtttcttgaaagaacaatgacgaaatggcttgctgttgcaagttgcccaccagcgccccatgaatacggttgtagtttttctcttaattctttattttgtacgacaataaatttccaaggttcatatccaaaagaagaaggagataatctgcctgtttctaaaatgaatttaaaatcctcttctgaaattttgtgcataggatcgaactctttacatgcatgtctgaaatgaaaagcctccataattttctcttttgtaatttcgtttgtatttgtcataaaagttcctcttttctttaatttattttgtaagtaaattatatttttaaagtaacatagatacaagtacgcacatttatgtggtatagtatcaaaaaagatactaatgttaagggaagggatttattatggattgttcaaatgaaaataatataaattacccatttttaaataaatattcttgtccagttgaagctatggttgaggtgattggtggaaaatggaaaggtgttattttgtatcatttattagatgggaaaaagaggtttaatgaattaaaaagattaaaacctaatatcacacaaagaatgttaacactgcagcttagagaacttgaagcagatggcatcatacatcgtgaagtataccgtgaagtgccacctaaagtagaatattcgttaaccgagcttggtgaatcacttcgtccaatgattctattaatgatgggatgggcaactcataatatggagaaagttttggagagtaggaat

SEQ ID NO: 413 - DNA, 991 bp, Bacillus thuringiensis
tttctttgctgcttctacaatatatttgggacttcctggtttttcttcatcgtataccgctaaaagcgcatcacttttttcaataaaaaattgattttttaatttaaattgctctggactttcatacttccgtttcgtgatactatcaacatggtctgcttgagaaaggataaattcataatattcacgattatcttctttccaattttcttcttgttctaaaaacggagtgaataccgctaattttaaatctggatattctacttgcatttcaaaaacaacttcagcagcccataattctacacctaattggccacttattataacccactctaaaccatcttctacaaaattggttaatttacggtgtaacgctttctttatacactccacccctggatgatcatttttaaatattccaagttcaaatggcttatatcctgttactgcaataactttcatatcaacactccaattacaaaaaaagaactagcatttcgctagttctaacatatcatttactttttaaacattccaccaacgtttggtccgatatttggaccgaatggtgatacgtttggtccaatattcggtccgaatggtgatacgtttggtccaaacggagatacatttggtcctggaccaaatggtgatacgtgatgtccatgatgtccatgatgaccatggccacacggtccacatccgccgccgaatcctgggtcgattgggtccacaacatttacatttggaatttgtttgcgggaagaagttttggtttttaatttgttgatgatgtacatgtgttgtatgtgttgggaaaatgtgtggcaccaccgttgttgaaaaagagtgtgttacgcattgtttcgtcggatgaatgacaggagcagtcgtacaaataggaccctgaggcttatgcccttcaaagcaagggtgacaatgatgcataggttttttcttctctttcggtaaaaaatctgattacacttta

SEQ ID NO: 414 - DNA, 1162 bp, Bacillus thuringiensis
  unsure (1)...(1162): unsure at all n locations
tctaaaacaaaaactagcaatccacaaccaggtgatttagtatacttccaaaatacttataaatcaggtccttctcacatgggtgtttacttaggaaacggtcagttcattagtgcagaaacagatgcaactggtgtacgtattagttctgtaagtaactcttactggagcaagcacctattaggttacacaaaagcatactaagaaaaagtagttttatatacttttcgtatagagaaaaggctttccaaggaaacttgggaagcctttttatagttgaataaattggaagtttaatagtttttattttaactttccatttaaaaatcgatcatataagtcatggaaatagttaggacgaaataagttcgctgcatgtcccgctaacggtatttccttatatagaacgttaggcaaaatagatttcaaatcaaatagacaagatttatagagatgatcatgctctcccattacccatagtatagggtgaggaagtgattttaatttagattttaaatcgaattctaaccgatgtcgtaatgactgggcaattatggatgaatgtaattgtaatccgaaacggtagtaaatatttcttgaaatgactgcgaacggatttgcttttaatataccgcttggaaaaatagtatttgcgtattgagagagccatttagagtattcatctcctcgcttctcccaaaaattttgaaatacattatataaacgagaagggttattgtaatgtcctccaatatgacaaatacttaataccttttctggatgcatttgtgcaaaaattgtagagatgtaacagccgtaacttagcgcacaaatatgtgcttttttaataccttcttgttcatataagtttaataattgatctacgaggcgctgtaatgaaaagtcgattgcttctcctttatcatcaccgtgacctaataagtcataagttataatgttgtaggaggcagaaaatcgtttttgctcttttttgaaggcgcgacgattgccaactaatccatgaataaaaataattgtttccttttcagaatgtatatttgtttgcaaaaaggatactcctttcactaactggagatttatatcgngttttaaattatttatctatattttacatagaataatattaagtaccaggtaataa

SEQ ID NO: 415 - DNA, 1090 bp, Bacillus thuringiensis
ctgaagacgaatcttttggattaaatgatttgattgaagactgtgaggaattaaaaaaagtattacaaattgagaagtggtctataattggacactctttcggtggatatgtagcattgctttatgcgtcgatatatccaagttcaatagagaaaataatatttgaaggaccaacttttaattttgcattaacaagtagggctttgttacaaaagacaggacatttattaaaaaagtatggaaaagaagaaatagcaaaagaatgctttgcttattcatctagcgatgctagttcagaagagttgttagaagcttatataagactaagcgctgaattagaagaaaaaagaatggagatttacaataataaggaaaataggacagatgagagtttatacagtgatgaagagtgggaaatattttcaaatcgctccaaaattcactttgatagattaaaattagagggagcatgtcatacatcattattatcaaaaataaaagatgtacaaaatctaatgttattaatagtaggaaaacatgatgtagtaacgtgtgaagaacaaattaaaacatttaataaagatgcccgaaacggcaagtatatcgtatttgaagagagcggtcattcacctcattatgaggaagcagatagatttgcagaaacagtcatacattttttgaaatgaagaaaagggtgcttctataaatgagaggcaccctttctaaatttctggatatgtgattgtgatgttaggccacttactttgccaattcttttttataactctgtttttgtacatatgtaatcgttctttcgattcaagaaaatgagctgttggtttcacttgtaaggaaaggacatcttcaataccacatggggctgttaagataacgttgtttagttcatcaagtgtaactcctaaagccgttgctgtttcagggaatttagaaatagcattaacagaagaagaatatggtggcatattattcactacatgcatacgagcttggattttttacagaccaagggatagtagcatcaatattcattaatttcgtttctatgattggtcgtatatctcatcttgat

SEQ ID NO: 416 - DNA, 759 bp, Bacillus thuringiensis
aaatgtttggtggtgtaccgaaggtaattgtcacggataatatgaagacggtaatggatgaagctcgaacagaacactttacaggaacgattaacaataagtttgcccaattcgctcaagattttggatttaaggtacaaccttgtatcgcagggcgaccaaataccaaagggaaagtagaagcgccaatgaaacttctagacgaaattcatgcttatcaaggaagattcacttttgaagaattacatgaatttgtgcaaaaattatgtgcaagaattaatcaaacatttcatcaagggactggtaagattccagtgtttgccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttggtattatacgggtgtttctctgtatcgcttgatataacagggatagatgatcttgaatcatcccaattgctttatattcgcttagttctcttttgtgcttttgcaacagagttggcgcatcttaaacatcgtggaagaacatataaaaatggcaatgagttttccata

SEQ ID NO: 417 - DNA, 927 bp, Bacillus thuringiensis
gtaacacagtatgaatgcacgtaagcaattattgatagcatttatatgtatgacttttgttgtaattctaggaacgataggatttatgacgattgaagagattagtttgtttcaagcattttggatgacaatgattactgtattgactgttggatacggagatgccgttcctgtaacgcaagcggggaaagtatttgcgcttcttattattcctgttggcgtaggtattgttacgtatgcaattggggtagtggcagctatgattattgaagggaatttatttcatgcagtacggaggaagaagatggataaacaaatagcgcagttgaaaaatcatattatagtatgtggttgcggtagagtggggcttcaagttgtacatgaattgcaagaaaagaatattccatttgtcgttgttgataaagatgaaagtatattggagcaggaaaagcttttatttgtacatggagatgcaacggaagatcaagtattacataatgccggaattttaaaagcagctggtttagttgctattgttgcaaatgatgccgaaaatgtatttattacattaacagcaagagggttaaacgatacgattaaaattgtggcgagatctgaaaagccagaaactgaagagaaattaaggcgtgctggtgcaaataaggttattaacccatctagtatggcgggtattcatatcgcaaaaggtattgcaaatccattaaccgttcattatattgatacagtgttgtatggagtagaacagtcatttgtcattgaagaaattctagttggaaaagattcaatattagttggtaaatcgttactagagagtaatgtaaggaatcagtttgatgtaacaatattagcgatttcaagaaatggtaatattatacataatccggcaggacaggaaaaattgaaaga

SEQ ID NO: 418 - DNA, 1586 bp, Bacillus thuringiensis
tcccaattcgtgattagttacaataggctggtcgtttacagttgcaatacttttaccaagaataaaacctcggcgattgcgcgttagctcataatgtaaatcaagtttatcaccgggatatgcttttccgtggaattcaactccatctaaagaggagagaaatcctagtccttcagaatcacttgtatgtacaaatgcactaagctgggcaagtgattctacaattaacatatgaggcatatgtttttgactatcatttataaaccattcgttatttgtaatgagtttatatcctgtaacggattcaccttgttttacatttgttactttatcaatcattaaaaatggataacgatggggaagcgtgtctttaatatgcatatgaaagtacctccaattaataataccccctgctaaagttaagcaggggagtgggaactaatttttaactaattcatctactttttcaaggacgaaaatgccgctatttctaatattttcaacaacttgttgcaatacttctttattttgaacgagtgcaatacgtacgaagccttctccatgaggtccaaatgcatgaccaggtgtaacaacgacattcgcacgatccattaatgcataagcgaagtctagagaagtccatccttgtggaatttcagcccagacaaacatactaccagctggcttatcgacattccagccaaatgctcggaatccatcgactaaagtatctctccgttcttgataaatatcgcggtttttctcacaaaatgcagcgccatttcttagtgctacagatgccgctttttgaattggtaaaaatacaccgtaatcggtattagatttaaattgagtaagtgcacgaacaatttcttcgtttccaatcatatatccaatacggctacctgctaaactataactttttgacaaagaattgatttctacaccaacttctttagcaccaggtacagagagaaagctaattggcttattaccatcgaaataaaattcagcataagcaaaatcatggacaacgataatattatgctttttcgcgaatgcgattacttctttaaagaaatcttcatgagccattgctggaacgggattccctgggaagtttaaaatcatcatctttgcttgatcggcaatttcttcagggatgacttctaagtctggtaagaaatcattctctttctttaaaggcatgtagtaagatgttgcaccagccatttgaatacctgtttcataagctgtatatcctggatcaggaactaatataatatcacctggatttgcataaaccataggtaaatgaacgagcccgtcttgtgaacccattaacaataaaacttctttatccgcatttaataaaacgttatgagtgttgttgtaatattcagttacagcttcgtgaaattcttgaatacctgataatgtatacccgtagctctctttctcactcgctgtatgtaccattgtttctcttacaaaatcagcgggcggcatatcaggatttccgatgctcaaatcaatcatgttatgacctgctgcatttttttctttttataggctcctattcacta

SEQ ID NO: 419 - DNA, 656 bp, Bacillus thuringiensis
cgtgatcaaattacaaacaaaattacgggatattacataattgggatcaatacttttcattttttaaatatagactcatgacgatgtctccaggggacttacgacatatatatgaaatagaagaaggtttagagcatcgtattttatcaaaaatacaaaacagttcctccttctattcattcatggaagcattaaaaacaaaacgttatacatggactagattacaaagagcttgtacacacattttaacaaacacaacaaaagaggaaatacgtagcgcaaatatagaacaacacgcaccatatattcgcctgctaggtatgtcacaaaaaggacaaacttacctttcaaaaaacaagaaaaaaatcgaacttccaatccttactcatacaaaaacattcgaccatgccgctttagatatagagaaaaaagcaaactctgtatatttctccatcatgcacgaaccgttacgcacacaactattaaaacaggatataacacaccatcctgttcgctatgatgaaacaactacaaaattcctataaaaaaacctctctatttcagagaggttttttccttatccatcttttctaaatatgttaacgcatcatccagcgtatctactggtacaattttatttttgtttaatattcttt

SEQ ID NO: 420 - DNA, 1276 bp, Bacillus thuringiensis
tatttaaggcgaatcaagaaaatcccattgaaatattaaaatatcgggctcaatcgccttttgaagggacgagaggaaattgtcaattaagtacagagaaagcgattgaaattacaaagccgattgtagaaaaaggagcgtattatttaatcattaaagaagcaaataaagtaatgggatggatattaataggggaaaatacagactatttttctcgtgaaaaacttggatttatatatgaattgtacgttttcccagaatatcgcgggagaggattatcgcgtgaactgatggaagctggtattaaggaattaaaggaggaatattcagaaattaggttgaatgtatttactgggaattttgcaaaaaagatgtacgaagagtttgggtttgttgaaaggcaggtaattatgactttgaagtgagtagaatagtctgaatgagagaagagaaaataatgatttagtggctactttatcgctggaatttaaagcgaataagtataaaatagatggtttgcctttattttatagtagatttatagagtgtgcttaaaaaacaaataaattagtattatacaatatatcgttattatagtaaaagagaaattttggaaaaatatcatttttttgtttagaaatttttaaattattgatataatcaatttgtagaattgattattggttaattttactattttttaattttaagggggatttaataatggcaggacaaattcgtatgtcaccagaggagcttaaatcgaaagcgactcgatatggacaaggtgcaaatcaaattgaggacattttacgtcaactacaaaacttacaaaatgaattaagaggagaatgggaaggtcgtgctttcgaaggttttgaccaacagttcaatcaattaaagccaaaagtacaaaacttcgcacagctattacaagaaattaatatgcagcttaataaaactgcagaagctgttgctagacatgacgaagatctttctcgtaatttcggtctacaataagacagataaacagaaatatataatttagccatgcaaccatacgttgtatggctaaattactttaaaactagagtaagatacgaagtctttcattagatagacttgcagtcgcaggagtgattagagtgaaaagttaaatggagcatcttgtgttattatttgctttgactataacaggggctctattaggataatcaaatgttagaagctatgagaactcacaaaatgacagtggttgtaaagagatcagcactga

SEQ ID NO: 421 - DNA, 1060 bp, Bacillus thuringiensis
tcgtgatgtttcatttgtttcattcttctaatcacaattacctcaaattctttaaatatctctcttaacttttcttccgagtatgcaagaccaccttgtagactgcaccctctatatacgtcccaatctgttatttccgatccatttcgctcatctaaatcacctgccgcaaaacatgttaatccgaaataaccacccgattttaatgagtttttaattaaatccacataatttattcttctatgcggtggaatgtgatgcaaacagcccgaatcgtatacaaaatcaaattcgttttgaacctctaaattaaaaattgaatcacaaataaaatgaattgctacctcttttgccaatgccctttctttagcccaattaatgccttctacagataaatccactgctgttacatcaaatccttgagtcgctaaataaatggcatttctacctggaccacatccaagttctaatactttcccttttgaaactctctctttttgtatatacgaaactaggttctcatctggaacattttcaaaaaatggaacatccttttctctattctcataaaattcattccaaaatggttctgcaggtcttaataatgaatcaagcatttttaaaatgtcttcttgtgtgtgtaacgtttcatttttcattaatacccctccacaaattaatagtcagaaaattattatatatctttttgaactttcaaacaaagaaaaaactcctacattcaataggagtttttccctttaaaatccaagtatagctaaccattttaacaacttctcttctcatactttcaaatgatcatgttcctatttacccatccgtatttcactaacaatttctccgtctgccaaaaaaagaactctttctgttttcaccgctacctttacaacatgagtcacttaagaagaatactttgctgaaaaataaagccgatttcgttaaggcatatttttgctaacgcctcttctttcatacatgatatttcatacaatcatacttttctaataaaataacgtttttgttcacttttttgatacattta

SEQ ID NO: 422 - DNA, 1218 bp, Bacillus thuringiensis
aatttagtaggtagttggagtgagtatgcgattaagtgaagtaagcggtaaagaggttgtagatatagaaaaagcgaaaaaactgggagccttaggttatatggatttagagattaataagaaagacggccaaatacaaacacttataatacctgtaggcaagtggggaggttttataaaggaacctcaagaagtaagagtggcatggagtcaaataaagaaagtcgtacacgatatgcttctttgtgatagtatagatcgttcaaattcggagtaaaggatggccattttggtcatctttttttgtatctacatagaaacctgataaatcatatgtgcatttggattttcaatcaccataaactcgtacattacatatgatgtggaggaaaaagaaaaagtaggcacttttcttataaatgacagaaaaagaaggtgaattagggaatgttgactgagatgcatattgctgtcataggaggagatgcaaggcagctagaagtaattcgtaagctagttgaattggatgcgaaactttctttgataggttttgatcagttagatcatggtttcacaggggcagcaaatgaaagtatacaaaatttagatttcacttctgtagacgcaattattttgccggttgccggtacaaatgccaaaggagaagttgatactattttttcaaatgaaaaagtttcaataacgaaagaacaaattgaaaatacaccagaacactttactatatattcaggtattggtacaccttacttggaaaatctcgtatctactacgaatcgaaaacttgttaaattatttgatcgtgatgatgtagcaatatacaattctattccaacggtagaaggtacattaatgatggtaattcaacataccgactatacaattcatgggtccaatgtaatggttctaggatttgggagaacaggaatgagtgttgcgagagcatttcaatcattaggagcccatgtcaaagttggagcaagacgatctgaacatattgcacgtattacagaaatgatgttttctccttttcatatgcaagacatagagaaagaagtaggaaatatcgatattgtaattaatacgattccgcatcttcgtgtaacagcgaatgttattgcaaaaatgccagctcatacgttagtgattgatttagcttctaaaccaggcggtactgactttagatattgcggaaaaaag

SEQ ID NO: 423 - DNA, 1038 bp, Bacillus thuringiensis
tcattgtttatgcttggtggttttattgatatgttagcgattatgactatagttgggtttgaatgggaagtagatcctactatgattggattgattcctgttgcatatgcacttcctggaattatttttggctcatgggcaggtgttattgcagatcgttttagaaaaattccaaatatgatgttctgtaaactaaagggtggtctaataacaattgctcttttatttgtacaagatattcactggctcttagtggcgttaatgattccttccatatttattggtttctattatcctgcacagcaaacactaacaagacagattgtatccccggacttgcttactaaagcagtaagtatcaacggaatagtagagcagggtacaaagatagtaggcccacttatagggggcatgttgctgagttggtttcaaccagagttctgcctcattataagagctataagttgtttattagctaccttagttctcatacccacaataaaatttaaagaaactatatcgaaagaatttgttgaaaagcaaaaacaaagtacttggaccgcttgggtacaagggtggggttatgtgttatctaatcggataatattatcaaccatgattttcgttacaatagccatggcagtattacaattagtagactcacaattcccaactttatttaagagtttattcccacatgataaaagtaaaatgggatatatcatttctattattggtcttggcggaatacttggtgcattactaactcagaaattaaaacaatttcaatatggctgggtagtatgtggaggtatggttttaatgggaattggttttggggggattggtttgataacgcccggtacggtcttcgttttagcctatttaattagttttatcgctggtattggaagtgggctgatgcttgtatctaatcaagtcatattacaaatagaatccgatcaagatcaagtaggaagagtatttggtatacaaagcagtaaaacaaacgcagttttaattatttcccctgctatg

SEQ ID NO: 424 - DNA, 1079 bp, Bacillus thuringiensis
atggaaaatcaaccgaaatcttttgggtaactgataaaaaaagaaacggcggacaaagttaggagcttaatggagcgtgtcataacatcttcaaaaggaactggtacaatgtataaagtggatggttatccaattggaggtaaaacaggaacagcacaaatcccgaatcctgaaaacggccgatatatggaagggaaagagaattacattttctcctttttaggaatggctccaattgatgatccggagttaatcgtatacttagctattaagcagccaaagttaaaaggagatgagtatggagctcagcctcttgctgaaatatttaaacctgttataaaaaacagccttgaatatttaaaggtgaaaccgtatacagaaaaacaaatagctgatgcaacgaagcaatctcaattaaaagtacaaaattatgtaaatcaatcgatgggtacagcagagaaaagtgtagaaaaagagaagatacagccaataattttaggagaaggaaaaacaataaaacaatatccacagtctggcgaggtaatgagtgaaggggatcgtatatttttattagggaataacgcacaaatgccaaatttaaaaggttggtccatgcgtgatgttatgtatttctctaagcttttgaaattagatttgaaaacatctggtacgggttatgtaacgagccaaagtattgaaaaaggacaaagtttacaagaaggagatacactagaactagaattagaaccgccgttacaaccgttaacagaggcgaatacgaattaattcaggtatttggaaggagctagatgcaaatggctctttctttagagctgtaagtaatttcacgcaccgtaatttttagaaaaaacaataaataaatgaattaacagagacacatcattaaatgtctgattattttttatttacagttaaaaacaattgtgataatatggaaaaaattaaatgcagtgaagagaagagtaaataaaatgaatttttcacagagagctccatttagctgaaaaggagtaaaaattctttattgaaccaagcctctgaacagacgcatcggaacc

SEQ ID NO: 425 - DNA, 965 bp, Bacillus thuringiensis
aatccttgatttaataagttttctcttttctttcataataaaaaagtggacaaaatgagacatctgtctcgttttgtcccacttttttcacctaatttgagaactattattttattcattatcaaagctccgctgtaattttcggatgtaaataatttggccaatatgatatgcattatgagttgttacattcgctaacacttcccaccactttgcagaaacaggaaatcctactacatcactttcaaccttttcttcatttataagattttgccattgtaacagtttttctagtagtttttcccgtaattcatcgaaagtttgattatctgaaagcataaaacttttgttattatctccaatagcgggtactgcattcacatttgattctttatacctagtttgccacgttgagttccaatacagtaaatgttgtacaatttcagctatactattactctcttcattcggtttccagaaagcttctctctcagatagatctttcactgcatctgaaaatggaatataccaactgggatcgtttgcattcgccaacaattgatccgctaatacatccttcacatggaccatttttcttccctcctgttaaaaagattcatttcatgacaatactcacttctctaaatacgctgagtttgtaagatttcctctttttaagcataaccccatacatatgcacataaagaaaccgaaagcacctaatacataagctaatgcataaccacttctcccaataacccagcccgcaattccaggtccaatcatttgcccaactgcatagaaaacagatataaaactaattgccattgagacatatttcggagatacttgctttgaagctgcaacttgaattaataatagtatacctccgaggctagaaccccaaataattgccgacacgataaaaccagttatatttccaaatataattggagccgtatcac

SEQ ID NO: 426 - DNA, 748 bp, Bacillus thuringiensis
taacaagtttctctaaacaaaatgatttagctacaaaattcactgagtgggtaacaaatgaagaaaacgcaaaaattcgatttgagaaaacaaaagaaattcctccagtaaaatcagtaatggaagatccaattattaaagataacgaagctgcaaaagcagttgcaacgcaatctgaaaatggaattccaatgccaaacattccagaaatgcaagaagtttggaaaccagctggagatgcgcttcaattagttgttacagataaagaggcaccaaaagcggcgcttgatagtgcagtgaaacaaattaaaggtaatattgaggcaaatcataacaagaaaaaataaggtgaaattcgtgcctctaatatgagaggcacgaattctctcccttccatgtaggaagaaaaaagggggaaggaacatgcaaacatctatggaaccagcaaatgggttaaaccattcaaagcataggaaaatggcaaccatgttatcaatcattccaggcgtgggccaaatgtataataaacaatttgtaaaaggtcttatttttctagtattaacaggttcttttattgtagcctttgctgatttattaaatatgggattatggggtattgtaacgcttggtacagaaagtccacgtgaccattctggctttctattagtagaaagaatcttggcccttatcgttatcgcttttgggctaggcatatatgcatttacttatatgatgcataccaaaatgg

SEQ ID NO: 427 - DNA, 1365 bp, Bacillus thuringiensis
tacatattttcccaagcattaagctcatcttttattaacttagtattatctgaagtttccacttcattatgttttattacttgctgtaattcattttttagttccttcactttcacggtcaatttagtaaggtcagatggtacactttcttcaactgatctacagtacaaatagtattctgttttctcaatagcttgtattagctttgaaagaacctctacatcttttgttacaaaatatttctctttcaactccaaaattggaaatagaatatcctcattcaaatacaagcgatttaaatcccatctagcaatttcttgcatttttatagtcgcctcctatttttacaaatagttacagatatttctccccacacaattatatatgaaatggcaaaattttgatatcttcaaatatttaaattcctacaaatacattcttatttatactcttttcttctaccattaagtatcattccacatataaaaaatactccctctacaagagagcaattcatataggaaaacttcaaagattttatcttcaccaataccatatcgaccggtaatcacagattaaagaaaaaaggattgatcaaatgatcaatcctttactctacttcatttaagaaaaataacgttataacgccaggtcctgtatgtgctccgattgctgcaccaattgtatttacgataaatacttcacaaccgaatctttccgtaattaatgattttaatgcttccgctgtttctaagtcatcaccatgagtgataccgattgtttgacctttaaggtctttaccacgctcttccataatatcaacaattcggcttaatactttctttttccctcttaccttttcaagtggtacaagttttccttcttccacgtttaagataggcttaatgtttagtaaaccaccgataaaaccagctactttacttaaacgtccacctctaacaaggtactgtaagtcagctacagtgaagatgtgctccatatggttcattagaaaagcgacacggtttaaaatatcttcttttggtgcgccgtcttttgccattttagcagcttctaaaacgacaagaccttgaccaagcgaagcacattttgtatcaataatttctaaatctaaatctgcatatgtttcttttacttcctctttaatgacaactgatgattgatatgtaccagacagttcagatgaaaaagctaaatatatacaaggattaccttcttttgcataagaaacaaatttttcttggaaagtttcaagtgaaggcaatgatgttctataaacagcgccttctctcattttttggaataatggaactgactctaatgttacttcatctaaatactctg

SEQ ID NO: 428 - DNA, 1284 bp, Bacillus thuringiensis
cgttatatcaccaggatggttcataatatcatacatactattacatttcattccatactgcttattccatctttccattcccgctaaacaagattgatataatggatccatttcatctacttgtctcgcttcttgctcatcatgaaaattaatgtactgattaacagcaaacgttgtacaggatgaaacgcttggtaattgtaaaatattcgctataatacgtcctactggaaaatgattatcatatattaaataatcatatttttcctcttttgtttcttctacaatttgagtaacaatacgctctgatgcttcaatcatatgagatagcatcgtcaaagggctcccaccttcatttactcgttccataatattaatttgagagagaaaattctcaaacactcggaattccgcacctgttgcttcaaccttctttctataatcttcaatacaataagaaacaactgtttcccctcgctgaattaactcacttacaacagctaaagtcggattaatatgaccttccccaggaaaatttattacgagtacatttgccataacattctctcctatccaattaatataataaaattaacaattaattatattaattaatttaagtctattataaatgaatgcattctacttcttcatgcttttctcttcattttattattgagaaatattttctatagtctacattattgtgattcacaatcttataaatgaatgcttaattttacttttactcttcatagatttaaagatacgagtcttacattcaagtattaccaccattatttttagactacttcatgcaaaaatagagttatacaatattgctactgaatgctcactataaatgcaagtatgctagcaatcatttaatctttatcctcataactcatcctgtgctatataatgcatatacaccatttacagatctcctaagcacatgccttttagcgtggccggaacatacgcctattcctctcttagaggtagatcgtcagcctcatcgttatgtattgctgcctgctatctgtgcatggcaatgtggtattacacgtgatggtttcgtcacccatcctattttttaagctgaatgagagcgtatactcaatggagattcacatccagagttctgtaacagtaactgcaatacagcaaatagaggattcggctcagcctcgtggtcaacaagactattctaacaactcctcagtctttccctccaactttttattcgttcagcctgaagcttatacagcgaatgctcctcct

SEQ ID NO: 429 - DNA, 1042 bp, Bacillus thuringiensis
actcttttactaactctcctgcgccaaatatatcataaattacgaaatcaaaatttatactttcacataattgtttcgtaatttctaatatatataaagaagtttgaacatgcacatgaaaaaaagcatttaacccagatgaggtttcagcatcaatagaaatctcttttaatagatccggatgagtatgtacagtagctcctaaatcttcaattctatccttaaagtttgccgttgtaatataatgtacattatctcctcgttcagtaaaggcttttactaaatttaatgtaggatttacatgtccctctgctggaaaattaaccactaaaatatttagcacttattcctcactccttacatttcattgttttaattaagcatactgttatttgtacaagtaatcttcccctaatagtcctaatatgcttgctacattatattgataaataattttcagtcatcaacataaaaaaaagcatctacctatgtagatgcctaaccgtgataaggagtgttctgtgaggttagaacaagcttttctgcttgtcctatgctattaatatatgattgattttataaaacgtgaatagttaatagaattattttatccattttatatgatcaaatggataaaataccatttctactttacctattatatttgactcatcaataagtccaagtgtattcctactatctttactatgattacgattatcacctaacacaaataatttatgcgtaggaacttttatttctctaaaatttgaaaaacgattggatacttgtgacatatctaaatgtatatacgactcatcacgctttttaccgttaataaatacctcatccttttttagttgtatattatcccccgataatccaataattcgtttcacatagtaagtaggctcgtcttctttttttataatgacaacatctccatgatgaaaagacgataaacagacgtttaccttattaacaagtatataatctttttcattcaaggaggttgcatcgaaatccctctaccatacaaaat

SEQ ID NO: 430 - DNA, 1278 bp, Bacillus thuringiensis
cgcaagagaaatgaatccaaatcttttaacattctctgttggttttgagcaacgtggtttcagtgaagttgatgttgcgaaagaaactgctgagaaattaggcgttaaaaaccataacgtattcatttcagcgaaagaatttatggatgagttcccaaaaatcatttggcatatggatgatcctttagctgatccagcagctgtaccattgtacttcgttgcgaaagaagcacgtaaacatgtaacagttgttctttctggtgaaggcgcagacgagctatttggtggttataacatttaccgtgagccaaactcactaaaaatgttctcttacattcctagcccaggtaagagcgttctaaaagcattaagtggtgctcttaaagaaggatttaaaggtaagagcttcctagagcgtggatgtacaccaattgaagagcgttactatggaaatgctaaaatcttccgtgaagaagaaaaagctgaattaatgaagtattacaatgaaagtgttaactatatggatatcacgaaaccattgtataacgagattaaagattatgatgatgtaagtaaaatgcagtacattgacatgttcacatggctacgcggtgacattttattaaaagctgataaaatgacaatggcaaactcattagaacttcgtgtaccgttcttagataaagaagtattcgatgttgcatctaaaattccaactgaatttaagattgctaacggaactacgaaagctattttacgtgaagcagcacgcggaatcgttccagatcacgtattagatcgtaaaaaacttggattcccagtaccaattcgtcactggttaaaagacgaaatgcatgattgggctataaatattataaacgaaagtaagacagagcatttaatcgacaaacagtatgtattaaacttactggaagcacattgtgcagataaaggcgattatagccgtaaaatttggactgtacttgcgtttatggtatggcaccaaatttatgttgagcataaatacgatacgaataagttccatgaagaaacaaaacgtgcgtatagcttagtttaattagaaaaaccttaagatcgcatacggtcttaaggtttttttcataaataggaagtattattgatacaataatagttaaaggatggacaacatatgattacgtttggaaaagttactggagaaaatgaaagcctttgtaaagaaaatgttaaaatcgcatagtttaagggagaaaaaggttcagttctgtgttgaaagtt

SEQ ID NO: 431 - DNA, 1807 bp, Bacillus thuringiensis
gtctaaacttccacctactccaacagccattttcgtttctaaacgctgcttattgttttgtataaagttctcttgtctcgggaaaccaagtgcaacaagtaataaatctggttttgcttcttgaatgcgagaaataatattctcttcgtcttcttgtttaaaataaccatcttgtataccggcgatggatacagctgaatatgtctttgttaaatgatctgctgcagcttgtacaacatgcggctttgcacctaataagaaaacagataccggcttactatcttctgataacttcgcaagtaaattacacattaaatcaaaacctgctacacgttcttttaaaggtgtaccaagcatcccgcttgcctttacaaccccaataccatcaggtgtaattaaatctgtattcaataatgtttgatagaacttttcatccttttttgcgcacataacaatttcagggtttgctgttactacctgaaacgtatgagttcgctccgcttctagttgttcttttaaatattggaccgtttcatccattgtcattgtagaaaaaggaacgcctagaatatcaactgtttgtactgccatagttaactatcctctctatcattacaagtttttcgctattaattgcttatatgtttcctttgtatcttcatatagtttttgaagtgagaagttcatagtagcatgctcataaatatgtttacccattgctgctaactctccagttttccacttatcatacgcttcttctaaagctaatgctaatgcctttccatcacctgttggcacaatccatccgtaagtttcatctacgattaatggttcaatttctccagccctagtcacaattgatggtacgcgttgatttgccgcttctaataaaactagtgagaacccttcactatgggaagttaataaatttacatgtgacgacgcaaataattgttttacatcttgacgatgtcctaaaaactctactttatcgttaatccctttttcagtagctaatgactttagattttcttctaatgggccatcgccaactaataatactttaattttctctaattttgtttgttgtaacgcatcgaataaaacttcatgtcctttgacaggatgtaatcgtgctacttggattgccgtaaatacatcttcatcaatattgaacatttcttttttattatagccttctgctttttccttatcgtattcaattccattataaataacatgcatcttttcatttgaaatacctaatgctgccaggctttttttcaatctatttgttacaacgaaaaataagtctatattttttaaggctttcaaatttaatttcgtaaaaatccaaccttttaagccctgtttagtaaagtcttgaaatggatcactatgaatagtcgttacccattgagcctttattctctttctcattaaagaaacatacaaattaggcctagggccatgtgtatgaactacatcaaatttttctttattaataaattcacttatattctttaaaatggataaatcatatgcgcgatttttgtgaaaacacatggacttttatccctaactcccttgcttccttcggaacaattccatcttcaaatactggtaattctacttcaccagttggaaactgatcgagaagtgaaataatatgtgttttgcctcccccatcttttggttctgcattcatatgccatattttcatatttttttctcctttaaattctcggttcggttgcatctatttttattttacttggctaaaaaataaaagcttacaaaaggtagc

SEQ ID NO: 432 - DNA, 780 bp, Bacillus thuringiensis
aaaggagataaattatcatggaaaaaatctttaaagtaactagcgactcaggaattcatgctcgtccagcaactctacttgtaaacactgcaagcaaattcggttctgacattaacttagagtataacggaaagaacgttaacttaaaatcaatcatgggcgttatgtctttaggcattcaacaaaacgcagaaattaaaatcactgcaaatggtgatgatgcagctcaagcactagcagctatcgaagaaactatgaaaaacgaaggattaggagaataatgactcttaacattcaagggatcgctgcatcaagtgggattgctattgcaaaggctttcagacttgaaaatcctgaatttaacatcgaaaagaaatcaattacaaacgaagctgcagaaattgcacgcttagacgctgcgcttgaaaaagcaaaaactgaattagaagctattaaggaccacgcatttgctgagctaggtgctgacaaagctgcgatctttgaagcacatttattagtattaaatgatccagaactagtaaacccagtaaaagataaagtaaatagcgaaaaagtaaatgctgaatttgcaatggatgaagttgcatcaatgtttatttctatgtttgaaaacatggataacgaatatatgaaagaacgtgctgcggacattcgtgacgtaacaaaacgcgttcttgcacatttactaggaattaacttctcaaatcctggtacaatttctgaagaggtaatcatcattgctgaagatttaacaccatc

SEQ ID NO: 433 - DNA, 1222 bp, Bacillus thuringiensis
caaaatcggcatctataaagtatttttatatctcctatggcctcctgcgcaccaattgcacgcccgacatcatgtcctaacgcttcttgatagacaatcactgttgctcctaattgctttgaaatttcctctgtccgatctgtcgatccatttataacaacaattatttctttcggttcaatttttcttgcctcaagaataacttgtttaatcgtcgcttcttcattttgtgctggtataataattgatagctgttttccattataaatagaagacttcattccccatcctttatggaaacgcaaataatttttttgtatttttagttgctctataatttctcttttccttcctccatccgtatagttacctctatcaccttttcgttgtaaccagttttctaatacttttacattttttttaatctcacgcacttctaatttagttaattcatttccagagaaagagtttttatttgtagatatattattcaaagaggttttagtaattgctgatgaggtgtgtactcgccaccctttctcaataagtgttgcttgagcaagtataggattctgtaagatgtcatatccaatgtcttcaattactttttttgaaatggcatatggcatagataacatcgaatcatactttaaatccatatgtcctaatacgtcatttaatacttttctatacaccatagcaatactcggccactctattttcattttttcaaaatatacggagtctgcgttattcaatattacatctgtttctttttttaatagcggctttaaaaattgtgctaactccactgaaaaaacaacatcttctccgtctaaaaataagacagcatctccattggctattcttgccccattaactggtgctttacatttgtttttctcttcaataacaacaacattactttcaacaattgtcgttattgattgtatagtattcattctattatcagctacaatgataatttctagtggttttaaataatttaaattcttttaaattcgatttaatttcgacttttgctcttccacgaccataaccactgaaattccccctctttttttcccctttttaagggggggggggggggcccttctttttatttaaaaaggaattttttttttttataaaaaggcgcccccctgttttttgtgaaaaaaaaagccctcaaaaaaagggccccccctccattttttacccc

SEQ ID NO: 434 - DNA, 1365 bp, Bacillus thuringiensis
ttaggggagaaaagagaagttgtgatactcctcattttgttttatagaaatacgggcgtagaagggggaagaaaatggaagagatattaaagaagtatatgaatagatttacaacactaagtgaagaagagcagcaaatgattctcagtgaattacaaattgaagaatataaaaaaggaacagtgctcctaagacaaggaaatgttccgttaaaatgttattttgtattaaaaggatgcgttaggcaacatagtatagatgaagcagggaaagaagttacatcaaatttttatacagaagagcaggcaatttcgaatttcaaccatcataaacaagataaatcttcatcatatacgttaacgtgtttagaagattgtactgtagttgttggtgatctacatagtgaaaaggacatgtataataagtattcacaattagaagaaatgacgcgtaaaatgatcgagtacaatttcggtgaagtacaagatgaacttgctgtatttatctcatcgacaccagaagagcgatataaaacattgttacgaaaacgcccgtatttaattcatcgtgttccacaatatcagctagcaagctatcttggcatgacaccagaatcattaagtagaattaagaaacggcttaattagagtgtttaccacctttcaatagtagccatatcgcaagtgctaattcacctgcaatcataggtaattggaatagtgattgtatgagtgaaatcattgtatcgtattgagtgaacattgtattcatgacgtgaattagcatataaccggtagcagcaatgaacagcagtatactaataaactttggtatctgtttagagagaaaagctacatagcctaaaacgaaaagatgcaatccaaaaatgatcaatcctacagaccaaatgtattcgaatgcactgagaaacaacattgtatatgtttctggatttgcaattgtattttttgaaagcaataatgccaatattagattgaatatagcaatcccaagtatagctgtatacataagacgaagcaaagcggctagtaatgagaggctagtatgaattggttttagaaagaaataaagagcccacgcagcgacaatatcagtgataaaaatgataatccacccaaaaacttccgctttgaaaagtgaatttgaagtttggatattatggaatgttgtactcgcatctccttgtataacgaggtttccatgaacaaaaccgtaagagaaaaatgcaatgaatgccataacaagaagagatgtgctagcaaataaggcgtactttcgttcagtcataatatgtcctccttttctaatattgttttcattgtaatagggaagaggaggagattc

SEQ ID NO: 435 - DNA, 861 bp, Bacillus thuringiensis
  unsure (1)...(861): unsure at all n locations
gatatagttttttttaccggagatttaatagataaatgtgggtcttatagtgcggaaagagaagaagcgaaggttattttgcagaaaatttacgctcccttagggaaatatgctgtgtttgggaatcatgataggggcgggggcggtagtttattttacaaaaaatatatggaagaagctggtttttctgtattagtaaatgaagtgcagaaaattaaagtggaaaacggcaaatatattataatatcaggtttggatgattttctattagggaagccgcaaatagattcaactttaaaaaacttgaaacaaaatgatttcaacatgttattagtacatgagccggatgttgtaaccaaaataaatcgttacccagttgatcttcaactgtcaggacatagtcacggaggacaagtccaaattccttttgtaggtccgttaattactaccaaactagctgagcactacgttgaaggtatgtatgaagtagaggggaagagtaagccgttatatttatatgtaaatcgtggcattgggactactaggatgcctgttagattttgtagtgtacctgagctttcaatttttgtgttgaagcaaaatagtaactagaatatttaacaatatgattccaaggaacgtgcgatgttggtcgatggaaaagagtttcttaaaactttagatgtgacaaagtaattttcataagtaaaaaacaacaataggacctataaagggaccttttggtggttttatcctgcattgattgcccataaatgtccgattgatgaggggctattatagttttactttngtatttttgcagggatgaccatcaaaatatgttctatagttactagagaa

SEQ ID NO: 436 - DNA, 1043 bp, Bacillus thuringiensis
acctctggtttacctgaacatgcgaaaggaaatgtgaatgctgcttcccgtttacagttaattaattggattggacgtcaaaatttagaatttcctgcaggaacaggttggagatatacagattataattatatggttcttgcttatataatagaacatatctccaaaaaacctttaggagattacataaaagaaaacatatttataaaagcagatatgcatgaatccggtatgggaaatatggtacctggagataaaaattttgcaaagggttatgtgaaaaaagataaagagcttgtaccagcgcagaagttaggcatggattggctatatggttgtggtgagatgtatacgacagttggagatatgaagaaattagacgaagcaattataaatggaaaacttctttctgaacaaagtatacaagcaatgttttcaccttcagcagaacggaaatatgcatttagtttttatatatatccagattattttcataatcatggtgtattatctggttggaacactttcaataattttaataaagaaaaaggaacttttgttatgttattttcaaatgtgaaaaatagtatggatgatgactttaataaagagttccgaaagatggtaaatgatttattagaacagcggggatgagaaaatggaacataaaactttatcaataggtttcattggtattggcgtaatgggaaaaagtatggtttatcacttaatgcaagatggtcataaagtatatgtatataatagaacgaaagcaaaaacagattctttagtgcaagatggtgcaaattggtgtaatacgccaaaagagttagtgaagcaagttgatattgtaatgacaatggttggatatccacatgatgtagaagaagtgtattttggtatagaaggaattatagaacatgcaaaagaaggtacgatagcaattgactttgcgacatctacacctactttagcaaaacggattaatgaagttgcaaaaagcaaaaataaatatactttagatgcacctgtctcaggaggag

SEQ ID NO: 437 - DNA, 1137 bp, Bacillus thuringiensis
  unsure (1)...(1137): unsure at all n locations
agtcggtgtaccagatgaagaacatggagttaaaccacgtttaccagtagcagcagttcttcatgaaaatggatatgatgaacaaaaatatgatgaattactaaacgaatatgatgaaacgatgaacgcgtattataaagaaagatcatcaaacaagaaaaacgtaacatggacggaatcaatgagttcgtttatgtctaaagaaaaaagaatgcatatgaaagagtttttaagtganaaaggattaaataagaagtgagtaagaggcaaacctgtgatgcaggtttgcctttttgagaaggagaaatacctaaggccagaaagttgtttattctttctgaacttaggtattttgtttgttatcatgtacatagaaataaaaattaataattttttacaaaagtgatagaaaatgagaatgaaatgccaatagtaagtaaaagcggcataatagccgctttttatcgttttatttagtatttgatttgaaatattttccttatgaaagaaagattattgctaattgtaaactgtcaataaagttatttaagttttgatatggaataccccgccggaaaatacagcaataatttcgtttgaacatatctgttattgcacgatctaaagcatcttctataacaagttcaaactttcaataagaagataaccccctgtacaacttaaaagaatgtacgtaaatattttaaaaatccgttgattaagccatttaaaaataatttgacctataaacaaacctaaaaatacaattggaatggcataaaaacttgattcccaaatggttttgtttgtgccagtaaagagtatttgagttactagactaatgaaatatataaacagataaaaagctaatgtagttgctcttaacttctctttttcagtattagttcctgtaaaataaagtaacaggggtggacctggcataccgatacttgtcgttaaaagaccagataatccgccagctatgaaatctctagattgtgttgatttaaccttaacgttgcatataagcaacaatgttaatagtaagagtaggatgctaactgctaatttaaaagtgtttatgttaacggaaatgaaaattaaaatgccaaaaggaacaccaactatacttccaaa

SEQ ID NO: 438 - DNA, 1264 bp, Bacillus thuringiensis
aataccctctattgtacggttcactctttcttttcttaaaaaagttcttaattgacgtatgagtgagatgtaaagtaaataccatattgctgtcaaagtcgtaaatgtgagtcctaacaaaagaaattggaagaaatgattttgattactcacaataaattggggtaaaaaactaaggaaaaatacagcggtttttggatttaaaattgccgtagtaaatccttgtctaaagcttttaattgccccaatatccttagagtccatttctgctgaacctgacatatcttcttttttatgtaaggcacttttaattgactttacagctaaataaattaaataaacagccccagcatattttataaatgtaaataacatagcaaatttcattaagatagcagaaagtcctaacgtagccattattgtatgaatcatcattccagatatcgttcctaaaacagtctttatcccgccatttttaccatgcgagatagtattttttgtaactagtgcaaaaccaggaccaggcatcattatgattaacattgctgtaaggataaataatagataattttccatgttgtagtatttcctctccaatttttagttttgcttacagtatagcttttttcattaaaacattacatataaaagacttgatcagaaatgtatttaggttattcgtatcaatttgattaactattacccaatagccacattgataaaacacatgacaaacttatatataattgcaagctcaactctcacaaaaaaacaggatgaaaaataaacagcagaactagtccactgtttactttgccacaccttcatgtaatttttctgtataatcttttacatctttccagctatctttcgctgtatgtaaatcttcttttataaacgtaaactcttccggactaattccttttacgttttgtaataaattattatactttgcacctactgtataccattgatttgatatgttttgtagtgctgtaattgctgcatcaattgtttctgtcatgtttgttgttttattttttacatcagtcaaaattacgacttctgcttgtgctcctgaaattctatcttttaaattggcgatttctctttctgcatttgcgatatcttttttcgcaaccgcaatcatcggcccgccagcaagacatgttattagagctacgcaaagtacgccaccagcaatgaccatatcattactctttttaatcgaatcgttatatggatttaaaaggtgctctagagc

SEQ ID NO: 439 - DNA, 1320 bp, Bacillus thuringiensis
aaaaccttgggaagaatatatccccaaccccatttgtataaggttttatcatccattttacctgttcgataaaaaccatcaaaagaaaagttacctgaagcaagcgttgagttttctcgagaatgttcctcactctttatatccaaatcgtatctttctactcgtattggttgataataattcaagccaataaaatcattttcttctgcattttgtttaatgatttctaattcttcaaccgtccaattaggagtccatcctttttcctttaattgttgtacaacataagacggatactcgccttttaaaattggatcataataccaatacgtttcatattcattcgcatgatttgctgcttgtatattttctttttgatcatccacactataagctggtaagaaaacatgtgtaatcccaatttcaccatattgtttcagctgcttgtacaccgcaactgttttcgcgtgtgcataaaatacataatgagtagcttgaaaatactttggaacatcattttgtattcctggtggatgtgcaccttttaaataacctaatccacaaaacattacggtctcattaaaagtaatccaatgcttaactctgtcaccaaatgccttaaaacaagtttctgcatattttacgaaagcctctgctgttcttttattcgtccatccaccatctttttctaacggtaatggtaaatcccaatgatataaagtgacaaacggcacaatcccgtattttaaacattcatcaattaagttgttataaaattcaatccctttttcatttacctttccatctccagtcggcaatattctcgcccaagaaatagaaaaacgatacgattctaatcccatctcagccattaagcgaacatcttccttatatcgatgataatgatcaacagctacatcaccatttgttccattgtatgttttgccaggaatttttgaaaactcgtcccaattcgtaacaccttttccatcttcattccatgcaccttctacttgataagaagctgaagcagctccgaataaaaaatcatgtggaaacttcatagtatatacctccatttcattacaacaaatcaaattcaatcatacatataaaatttataggtacaaattttatatgtatgattatatcttatgtttttatttttttctattataaaagtacaatttatattgttggttattggaaaagaaaaagaagcgatatattttatcgcttcttactctcatcatctttattcttttattaatgacttattcgctcttataacttcttgatacaataatggtgaccactttt

SEQ ID NO: 440 - DNA, 1200 bp, Bacillus thuringiensis
ttttaaacgattggctatacactacttgcaattagcatattgttacttacatttattccgactgcagtaatgcttaaaattcaagaaggtattgtcacgagttcagttattgttatgcatctatattcattgaagcaaattacatggcttatagttggaaatgaaattgctatattaacgatagggattagcgtggcgttattagtaaatatgtatatgccgagtagtgaaaataagctaaaagagtaccaggataaaatagagagtaattttaaaacgattttgtttgaaatggttgtgtatttacgaaatcgagaaagtagttggagtggagcagaactcattgaaaccgagaatatgttaaatgaagcaagagatttatcgtttaaaaaacttgagaatgcatttatgcgagaagatgattattactatcgttattttaatatgcgtatgcaacaattcgaaattttagagcgaatgataccactagcagcttctttatcgtggacatatgaacaagctgacatgattgcagatgttgttgaaaacattggtaatgctattagccctgaaagtactggcgttatttccttaaggcagcttcaagaaatgagggaattatttagagacatgccattgccagctacacgcgaagaatttgagatacgtgcgaaacttgttcaacttgtgtatgaaatggaacaatatttactcattaaaagtcgctttaagggaaaggataatataaaagaacttatatagaaggtaggaattatctatgccgtatcttctctctatcatattatgtctttctttatcaccgatttggcctcttggggataatccacgtgccggagatccttttattattgtaaataaagcaacgaataaattagcttacattgacgatggaaagattcaaaaggtttttccagtagcgacagggaaaacgaatgaattaactccagaaggaacttttgatgttgtaatgaaagcaaaggatccgtattacattgcgaaggatattccaggtggatcgccaaaaaatccacttgggtcaaggtggattggatttaatgcaagaggaactgatggaagtaaatatggaatacatgggacaaaccaaccgagttcattggaaagtatatttacaagggtgtataagaatgaagacaacgatgtggatatttgtttgatcgc

SEQ ID NO: 441 - DNA, 885 bp, Bacillus thuringiensis
acgttttatttatttttttcaatcgcaccctataatgaaatactccgtatatcctacactaaaaagagtgatgttgtgaaaggagtctatttcatgcttcgaaaaatttctcttttgctttctatttgttttcttctccaccaaaacatcgcttacggtgaagataatcagcaaagcatatactaaaagcgcatggcactatataaagaaaccgagcagtcttcaggcatttcattggattacttagctgcaatggatcaatatgaaagaaatatacggagcgtaagaaaagatattccgaaaaaaccagatgccatcatttccctttatttcaaaccagaaatatgggctggacctattaatagtaacgatactcttccccatacaatttctctatttggcggaataggtttagatggtgacaaagatggatttgcaaatgcaaatagcgaccgtgatcttctgcataccgcagcgactattttaaggaaacaaggaacatcagaagaccgtattaaaattatgctctgggaatattatagacgtgccaaaacagttgatttaattagcgaatacgcccaaatttataaacattatggacgtattaatttagaaggaaatgcttttcctcttccgatccgtagtgaccatagctaccgtagtactttcggcgctggaagaagttttggcggcagaaggattcatgaaggaaccgatatttttgccggatatggcgtgccagtaagatcgacttgctatggcattattgaaacgaaaggttggaaccgccttggtggatggcgcattggtattcgcgaccttataacaattaccattattacgctcatttaggcgggttttaaaaagaaatacagcttggacaaa

SEQ ID NO: 442 - DNA, 1332 bp, Bacillus thuringiensis
taaaaaagaatcgtcccaccctatactaaagaaatgatattcatttgtcaattaataatcacattttcctaaaaagtttttctcaaatacgcctggaatgaaatatttataaggaaataatgcattcacacaaacaaaaaagaaataaatagtatacaatatttatataattgtgttatactcttgttggggattacgagaaatatttcattaaatgaaaaggatggtatataaatatgagtactgtgaatggtccaaattggtttacacgaattattgaacggaagcaatgcacagattcaactaagtgttccgcaattagtggaaaaagtattaatgcgaaatgaagggaaattaacttctactggtgccgtttctgcttcaacaggaaaatatacaggacgttctcctaaagataaatttattgtgaaagaagcatcggttgctgacaaaattgcttggggagctgtgaaccaaccgatttctgaagaacattttaataaattatatactaaagttttagaatacttaaaagaaaaagaagagttattcgtcttcaaaggatttgcaggcgctgaccgcaattaccgcctaccaattcaagttattaacgaatatgcatggcacaatttatttgtacatcaattattcattcgtccaactgaagaagaattaacgactcatgaatcagagttcacaattgtttctgcaccgaatttcaaagctgatccagctgttgacggtacaaactctgaagcattcattatggtttcattcgaaaaacgcatcgtattaattggtggtacagaatacgctggagaaatgaaaaaatcaatcttctctattatgaacttcttattacctgaacaagatattctttctatgcactgttctgcaaacgtaggtgaagaaggcgatgtagcattattcttcggtttatctggaacaggtaaaacaacattatctgctgatccaaaccgtaaattaattggtgatgatgagcacggttggtctgataacggtgtattcaatattgaaggcggttgctacgcgaaatgtgtaaacctttctcacgagaaagaaccacaaattttcgatgcaatcacatttggatctgttttagaaaacgttatcattaatgaccaaacgcgtatcgcagactataacgatactactttaacagaaaatactcttgctgcataccctatgcatgcgatcgacaatatcgtactgtcaagtggtgctggacacccaaatacaatcattttcttaactgctgatgcatatggcgtattggcttcaatccgttagttatcaaaagaacaagctatg

SEQ ID NO: 443 - DNA, 1263 bp, Bacillus thuringiensis
tttgcatttgggttttggattcagctatgcattttcattccgcgccattctcgattaactagttacaatacgatttacttggggttgtcatgtttgggatgggattaacattaaaggctgttgatttcaaaatcatagctacaaaaccattaccagttattatcggtgtatgtgctcagtttattattatgccacttgtcgcatacgtactagcctacgttatgaatctgccagcggaattagcagctgggttagtgttgctcggttcagtaccgggtggcactgcatcaaatgttatggtttatttagcaaaagggaacttagcgttgtctattgcaatgacttcagtatcaacgttactagcaccaattgctacaccgctcattctactattacttgcagggcaatggatgccagtaaatgctatgtccatgtttctttctatcgtacaagtcattattgtgcctattattttaggactagtagtgaaaaagtttttccctcatatcgttaataaaggaatgactgttattcctttaatatcagttgtagcaattatcataattgtttctgcagttgtttcagcaaatgtaagtagcattacttcttcaggacttcttatctttattgcggtgatgctccataatgctttcggttttttgctcggatatataactgcgttcgtacttggactagacgaagggacaagaagggctatttcaatagaagtaggaatgcaaaattcaggtttaggtgttgcgctggcgacagcacattttggaccggttgctgcactcccaagtgtattagcggcagtatggcataacattgcagggccaatattagcaaccatctggtcaaaaaatacaatgaatactttcagcgatgaaactgtatcaataattatagaaaaataggaatgataaataatgctaaaacgtattgtacattttgaaggaatggttgtatttttagccacgatttatatgtattcgatatatgagtttagttggattatatatctcgcattccttttagcgccggatctatcaatgctagcatatgggattaataatcacgttggtgcgaaaatatataatgaatgtcacacatatatcatatccatattaattggtctaataggtgtctattctaagataaatgccgctgtaatgattggcttaatatggacagcacatattgaaatggatcgaatgtttggatatggattgaaatatgagactgattttaaggatacttata

SEQ ID NO: 444 - DNA, 1248 bp, Bacillus thuringiensis
  unsure (1)...(1248): unsure at all n locations
gcatgctcccaaacatctaaaccgataactggcgttttaccttcagttaaaggagaatcttggtttggagtgcttgttacttctaactcaccattgtttactactaaccaagcccaaccagaaccgaagcgagttgcgccagcttttgcgaattcttctttgaatgcatcgaagctaccgaattttgcttcaattgcagttgcaagttcacctacaggttgtcctccgccgtttggagataggattgtccagaagaatgtatggttagcatgtccgccaccattgttacgtactgctgtacggattgcttctggtacttcgtttaagtttgcaactaattcttctacgcttttgtcagctaattctgcatgaccttctaaagcagcgtttaagtttgtaatgtacgtgttgtgatgttttgtatgatggatgttcattgtttctttgtcaaagtgaggctctaaagcatcatacgcataaggtaaatttggtaattcgtgttttgccattgttatattcctcccagtttatgtattgccacttaagtgacatacaacttcattctaccctaattgccatagggtgcaaacaaataaatcacattgtcttgctatcattaaagtagcaaaatccccacttcttttcaattaaaatgctcatatattccgtaaaaaaagcttccttctacaaggaagcttcctgctaacataataaacatgtgaaatggatatggaccctgtaggactcgaacctacgaccggacggttatgagccgtctgctctaaccagctgagctaagggtccacaattatgtatgtaacaacatatcaaataaaggaattcctatcggatatgctctttaagaaatgtaagataaatttaccatatagaaaagaaaagtgtcaattgtatttttcttatttaaaagaagaaagttaataaaagaaatttagttatctccactatatgtaaatataatatatcttgagattctctagattactacgttacaatgattttatacatacataaaggaagtgaatctatgtccatatttacccaattcgtaaaaagcatatactcgcctaaagatatggcgctattccgttttcaaaaaatcggtaaaaccattttgtatattatgctactttgcttaattactactattccaagaacttntttgtcnggaagtttatccaagatgttgtagcatgtaattcaagtatcgataaagattacctgatttaa

SEQ ID NO: 445 - DNA, 642 bp, Bacillus thuringiensis
ggatccaccaatccgtgattaacattaacattaaaagaaaacaatataaaaaacaatactttttccattcaaataaaataaataaaaactgttcctccattttgctgaaggaacagcttttatttattctacagtattatttatttaatgtagccattatttcattggctatattttttccatttccaatacacgcaccaattccgacaccataatatgaggcaccagctaaatatacatttggataaagattcgtcattttttcttgcaatgcttgaaccgcttgattatgttctaaatgatatttcggcattaaatctttccaatttgtaacttcgactacttctggttcacctttaattccgagactcttttcaatatcatataaagctactcgtactaattcttcttcactataatttttgattgtttcatataccggattggtgctcttataaaacattcttactaataatttttgtttacccgatgtatgtttccactttcgacttgtccatgtacaagcatcacaatgtaaatcactgttttccgttacaataaaccctgtgccgtcagctggtagttgttcatctagtatgtcaaatcctaagtaaatacttataagagatgagtttttaaatg

SEQ ID NO: 446 - DNA, 1620 bp, Bacillus thuringiensis
atgtcatgatttacttcaaaatttaaaacgttcttagattgagaatcgcctagaatctcgtttaaagcactatacaaaatacaaattacttattattgatgaaattgggtacttgcctattgatccggaggatgcaaaattattctttcaattaatcgatatgcgttatgaaaagcgtagtaccatcctaacgaccaatatcaacttcaagtcttgggacgaagtattccaggaccctaaactcgccaatgccatactagatcgtgtcttacatcatgccacggtggtcagtattgtaggacaatcctatcgaattaaagatcattttagcaaagaaaatgattgattttgtacatgcttaaacaagcgaaaatgtacatgtttatcttgacatttacacttaaaaataaatcattttaatatagatgaattatgtattccagaaagaacattagttaggatagaaaaataagctttgaaatattttttagaaaaaggcgatttcactttgggtgaagtcgccttttagttgttatatgcatgttatataagaaatgagaagtttatttgataaaggaaaaaagtatggagataaataaaattatgttttttgttaagaaataataagtatggctcttctcaaaagaacgtaagttcgtgtataataggaacgaatgttcttttaagaagtaacctaattatagtttagaagtaaattcgagtttaggaagtattaaaaataactgagggatagtatggctaaataaatgtataaatgatcaaggagataaaaaatgaacgatgtaaagatacaaaaagaagaaagagagtgggttccgtttacagtaatgtccgaacgacttttaaatatgagaaagattattggagagaaattaaaagtacaaaaaccgcttttaacaaatgaagcaaaagagagaatttctgataaattattaacgtcattactgtctgagaaagaaatattggtaacatattttgaagatggttacatactaacaagctacatgactgttgtacatatcaatccggtaaaacaaattgtaatttgtacagacgctttttataaaacttacgtatttaacgctatggatattattgaaataacgtaaaagaagctgagtattaaatggcagcttcttttatttctgatttatgagacaaataatacaagaaaaagcagctagcttcgtgctagctgctgagccccagggaaagggagaaaaagatagggtactccaaaatcgacaagagctgtcaaacagcctgattatagtatagacaaattaaaattttctatacagaaagttgcacatagcaatagtctgtacccacttggttctgttgtgcaaggtcatattctagatgtattggtcgcgctatctcccctataagtattaacacccaatccagcgaatgctgtgccggatccctcctaagccagcgaaaactccttttgataatacgttgtagaaatcccataacaggaatgatcccacgcgcatttgtagaacccaccgttcccctacctggggggggattctcccaggcaatataataagcccccatcgtggctaaatggagttattgaacaacagggct

SEQ ID NO: 447 - DNA, 1427 bp, Bacillus thuringiensis
  unsure (1)...(1427): unsure at all n locations
gagttagattgtttttccaaaaataaatatgtagataaaacgaaaaataaaagagttgattatttctcgttttattctttaaaatctgcaacagaatcaggatttcccctcaaagtataaattccaagaggaaccgtttttttatttacttatatacgtacagctgtaccactgacagcaaccattaacattccatcacgaacaacttcgtaatctacgtcaataccaacgatagcgttcgcacccttttcttttgcaagttctttcatttcgcccattgcaatatcacgagcgtcttttagtttactttcataagcaccaacacggccaccgacaacatcacgaacggaagcgaatacatcgcggacaatatttgcacccataatagcttcaccatttacaatatcaatatactcaataatctctttaccttgaattccagaagttgttgttacaatcatgactgacactctcctaatattttataatttttgattagctttcttatgtcatagaaaaagtagttctggtaccaaaaatgcttgatagaaacatagaatatttttggcatcagaaacaagtctagtttcttacagaatgaaagcaaggcaattgtttaacatatgtatcgctataacatatgcaatggatcttttagaaataagataagccgcagtaagtatcaacgatccaggtaaataaatagcaatatccgaaagttggttcgtatgaagaagtgtaaaaatcataatcgaaatgatagatgcaatagcagtaccaatatggtaagaaaaacgatttattaatatgtggcgaaacacaatttcttcaagtattggacccagaataccaaatacaagcaatgtaaatacaagaggtacctctgcacccgtttcaaggagctgctcttggttctctggttgaccagttgctagaaaatgcataacacactgttccacaattaacgtaaataaaactaccataggaatacttactattttcaaaattgtcttctctttaaaataagtaaaactttcaataatttctttcctaaagtaaatgattcctacaatagcaggtacagtaaaaccgatggcactaagaacaaattctgattcaactaaattgacattagctaaaagtgatatgccaaatagtatgtacaagccaatttgaaatggtacaaacagtgtaaagattattagcataatgatttcttttttattcatttttataaagntcactgtattgcccccataattaaattacctataatttttgatttttctttctgcataacgctctccttctaaatatatttatataagattataaaccggacggttcggtctgaatcgaaatctaatgatactaccaagttctagntttttaaaccctttttataagtattaacanaatcaaaatgg

SEQ ID NO: 448 - DNA, 1016 bp, Bacillus thuringiensis
cttctactaaaaaaataaaaaccagcctcaataaaaacaactgacttctatttggataattattgatactataaaaatttcactctaacagattgtcttacccaattcataactttactttttgaacccattaaaacatcaatacgattacctttaattgcacttccagtatcaccagcgatagcttctccataaccttctacccatactttagatcctaatgggattattttcgggtcaactgcgataattctcatattcggatttgccgttaaatcatgccccatcgcagttaaaacgcgtccaccatatgtaccattttcacttggatcagcagtatacgctgtcgctactaccgttaattcacgtttagcagactgtatgttgtttttagatgcttctttcgctctctcttcttctttagcttttgctatttctcttgctttttcttcttctttagcttttgctatttctcttgccttctcttcttctttagcttttgctatttctcttgccttctcttcttctttagcttttgctatttctcttgccttctcttcttctttagcttttgctatttctcttgctttttcttcttctttagcttttgctatttctcttgctttttcttctttagcttttactatttcttgcgctttcggttcttctttgacttttgcctcttctttaggctttactatttcttgcgctttcggttcttctttgacttttgcctcttctttaggctttactatttcttgcgctttcggttcttctttgacttttgcctcttctttaggctttactatttcttgcgcttttacttcttctttgacttttgcctcttctttaggctttactatttcttgcgcttttacttcttctttgacttttgcttcttctttaggctttactatttcttgcactttcggttcttctttaacttttacttcttctttgacttttacctcttctttaggctttactatttcttgcgctttctcttattttttaac

SEQ ID NO: 449 - DNA, 914 bp, Bacillus thuringiensis
ttacttttgcgatttgttttaagagctctagtcgctcgttgttatcgtaaatattaatatttttacccttcataagtaaaacgatttgatcagcttgtgcggctgtaatgggaacttcatattctttgctatattttaataactcttttgtagaaatatgatttaattttttattaacaatttgtttaatgaggttcatcttattatcctccttcacgcgttcttctatcgaaatatatgagcatatagcttgtacatattcgtatggagtttcttttttcatgaggaaaagaagcgtatgttataatataaggacaaaactacagaaaaagagtaaagggaggacttatggagcaaaagcaacatcgaaaagaaagtgttattcatctcatttatcgtttagttatgattatttttggagcagcatgcgcggcggtagcaattgaactatttttaatgccaaataaaattattgatggtggaattattggtatttctcttatattagattatcttactcctaacatttggtggttaagtttttctactttagtcgttgttctcaatatcccatttatgtattccggttataagcaaattggaaaaacatttatgttatcttcgacatttggtattgtagcattagctttcattgagtcaacgttacatgcggtaccaccatttacaacagaacctattttagcgacagtgtttggtggtcttattttaggtcttggtgtaggacttgtaattcgtcatggtggatcgctagatggaactgaaattatggggattttattaacgaagaaattaccgttctctgttggtgaattcgtaatgtttgtgaacttatttatttttgcatgggcagcatttgtgtttggtgtggaacaagcgatggattctgttatgac

SEQ ID NO: 450 - DNA, 1249 bp, Bacillus thuringiensis
ccatttggggatattcttttaaagctacgattttccctttcgttgagactagcgtactgctaaacaaagactgggcgctcatcggtatcccaaatatagtatcagaaggaatcggatgtaacatgttttcagaatatatgtaagaaatacccgtttcattatataccatttcatcttctaaatttaaatcttttacaagtggcataacatattcattacgagcaacgattgaatccgctcctgactccataatgaaatccttttcttccacactatggattttaccacctaaatactctgctttctcaataagaattaaatttaaatcgatattataatccttttttaatttttctaaataaaacatagtagaaagtcccgttatacctccaccgataacaacaacttgtttcatatgtgctgcgctcctaaccgatacaattaataattcctttttattataaccaaaagtccttatattcgacctgcttgttgcgcattctgtaaaaaattagacggtatttttgaatatattttcaaattacctaataaaaaagaactataacatatacaaaccacgtcatagttctctttattttaaaaacataaagttattgattaatttgtctaggtcttgactcaatgccaatactttttcatgttgaattccataatccgatactaaatataaaagttcttctttttttatttcaattactttttccaatttcgctagttccatgtcgttttacatctctccaaaaataaaatgtatgtatttcagtatagcctacttacataattagtaaaagtaaaatacgcatgtaaaatcttacatatttgaaaaaataatatactactaacaaaaaaagaaactagattaagcttccttttacagattattgacgttcattaagaatgaataacataccggaatttttctaatgttatatctttataatttggagctctctttatatgattaaaataactagcaattgcagctgctccaaaatgcgcatgccaaatatcatttgtttcttttttacattgagaaataattgaaaggccgccttttaaaatacttttgttttccattttctttctcctctagttaaaatcactatattttcatcctaaagatggtgtcagtacaaataaaatgtgattcgattcatcacttttattcaaaaatcgatgcttcacatttggtggaatacgtacaacatcgccttcttctaaaaaatat

SEQ ID NO: 451 - DNA, 845 bp, Bacillus thuringiensis
tgacctttagcagttgggaaaccaaattcttcttttaagtatggtaggatagcctttgtcgatgcatccggccatgctccccaatgatcaatatatgtataattattttgcgttgcaaattgttttaatgcttcaatcgatttcggataatttttcgcaccatacactggattcgatggttgaatcataatcgtagcgccttttgcactagtagaaagtgcttgaacaaacttctgtgtattcacaacagagttcccattaccagttttaccgttatcggtaataaatggtggttcaaataaaatcacatctggattgtctttcgcgatctctttatcacgcttattcgcgattaactcttctgtgctttcacccttatattcctttacagtcacattccataaacccttaccgtaagccgtttctaaattagctgttaacttagctgcccaagcacctttttcagatgaagaaccttcatcaccaacgataacaagatttactgcctttttatcctcagcagctttctttaacttctctttcactgcatctggcaagttcttcgcgtatgcttcgttaaaagatgacttcgcatcttgttttttctcttcctttttctcttctttcttcgctccgctatctttcacttcagcctttgttttcgttacttcactcgtttgtcccgttgcattcgcaatcttcttattccagtacaatttaccgctcacaatcgaagcaacaaacaatacaaaaataacaaggacaagtacccgctttcttattcatcgattcacctcattctattaatcctacaatatataatacttatataaattcatgcaaaa

SEQ ID NO: 452 - DNA, 1063 bp, Bacillus thuringiensis
aacatgttttagagctgatggttggtgcgaatcagtatggaattgatgtggaatgggcttcggagcttccaaaccgaaacgaaagaagtaggctttggcgacatgatctcatcgatacaagagacacgtattgtttttgatacggtaaagtgcgttacatttgtaacgaattaaggtggcaccacgggagtacccgtcctttctataggatgagtactccctttttgtgtataaaaaattaaataaatgaaatcgtttaagtaagaagagtacgtatattggagacgttacagagagccgggaataggtgggagcccggtacggtgccgtatacggaatgggcttacgagaggtatgctgaacaattattttcagtaggcaacccgggttccgccgttacaaggataaggtataaattttgtacctgaacaaagcgggatgcttttgcatccaacacgaggtggtaccgcggtatatttatcgtcctctacatattttcgatatgtagaggacttttttatttttcagagcgaggtgaaggacatgatgacgaaagaagaatttataaaacaaaaaagagagagaaagacatttttagtaatcactgaagaagaaggagatagcattacgccaatttctttatatagacgtatgaaagggaagaagaaattcttattagaaagttcacagcttcatcaagataaagggcgttattcttacttgggatgtaatccttatggagaagtgaaaagcgttggtacgggagtggaacgaacgatttacggccgcgcagaaaagttacaaggtaacgtactacaagtgttagaagaagtaattgcaccatcacaagtagacagtccatttccattttgcggaggagcagctggttatattgggtatgatgtcattcggcagtatgaaaacattggagcggatttacacgacccatttaatattccagaagtacaccttttactatatcgtgagtttatcgtttacgatcatttacgccaaaagctgtcgtttgtatatgtatgccagctagatgattcagcagattatg

SEQ ID NO: 453 - DNA, 938 bp, Bacillus thuringiensis
tgcgtaggggcgtttttatttaggtggtttcttagtgttcttcacaactagggtggtaccgcaaattttttgtcgtccctacgtatttacgtaggggcgtttttttattattagggaggaagtgaacgtattagaaaaaagtattgatagaacaatataaataccgaattgtaacaaagaaaaagagatagagaggagattaacaaatgaattcacagcaatggacatcgaaattaggtttcgtattagctgcagcaggttcggcaattggtcttggggcgatttggaaattcccatatatggccggcattggaggaggcggagcgttcttcctaattttcatcggtttcacattattaattggtttaccgctattattagctgaatttgttattggaagaagtacacaaaaagaggctgttgatgcatatagagagattgctcctaaaacgttatggccttggttaggtaaattaggaattgtaacatgtttcatattactttctttctacagtgttgtaggaggctggattttattatatttatggaatgcgattacaggtagactatgggaaggaaatggagcatacgaagctacgtttggtgaaatcatttccaatccatatttagcagttggatcacagctattattcatccttattactatttttatcgtaagtaaaggtgtacaaaatggtgttgaaaaagtaaataaatatttcatgccagcactattcgctttattctttgtatcaatcgttcgtgcacttacgttagatggtgctggacaaggagttcgtttcttcttacaacctgatttctcacatgtaacatcagaagttattttatacgcaatggggcaatcgctcttctcattatctgttggggtagccgctatggtgacgtatagctcatacttaccgaaagaagaagcttac

SEQ ID NO: 454 - DNA, 1369 bp, Bacillus thuringiensis
gcaattggtggcgtcgtacttatacttttatacttcgttataaaaaaatggacaaaaaagcgtaaaaatcttgcttaagaatataaaaaagccgctataaattcagaattatagcggttttttatttatattaatcttcaggaattatataacacctttccatctacatttatatggataagcaaccattcaatcatttctttcgtatattatctcaaaaaggagtgattcccctatgcattggcagcaaaaaatacaatacttaatcggacgtcctatcggcatttctttcatgaacgggcaaggaacttctggtgtattatgttcagcgcatgatgatcaattatatgtgtatgaataccttatcaagcccagttcgcaatgaaacattatgattatagacagattcaagatatacatgcattcccaaattgtcctcaccaaaatcctctatactaaaaaaatcggaacgggtcatagccattccgatttctatactttatttctcagaattaaatttttgcactgcttcatcaaaataaatccaacctttccagcctaaatgaatcgtatcttttaagaaatacttatcatattcatgaccagagaaatcaactactggatatcctgctttctcaacctgctctcgaacttttttataatacacttcacggcgttctttcgggaagccagtataatcataccaaggcccatttacaggtacagaaataaagagtggtttgacatttttctctttaaataaatctaaaataatttgtaaatcatcgtattctggtgattcatcatatgtttcatttgctctaaagttttttaaaccttttagttttttcttcagattatttttatgataatacggattttcaattccgaatgtatttgtagtagactctgctttcccttcttgttctgcgtgtttacgtgcgtcttcccaagaaattgaacgaagtccgatatttgttttctctttcatcggttcgattttaaataaagagttaaataaatctctatgatctaaaatatttcgatgcatataagcaagtggtttaactaaacctgcttttatgttatgtttcgtatcattatatacaataccttctaatgaattttttaatatatcatcttcttgaacaactttataatctaatagccgtttcgcgatttgcttcttcattcctggatttatcttatcattaaaaaataaatgatatgctcgttgtttggagaaataattagtgaaatccccttgtgatacaccagtctttgtaaaccattgtggtgaaagaacaaacactacttttttaccttctaattcatccatagtagatgtcatattttaaaatatgagcta

SEQ ID NO: 455 - DNA, 1331 bp, Bacillus thuringiensis
gcagcggttgatgggagagaagctttagagagatggaatgaagggccggatgcattgatcttggatgttatgcttccggatacggatgggtatgagttgcttcgtttgttccgtgagagggatagggatattccggtgctgatgttaacggcaaagagtcagatgaatgataagttgcttggcttgcagcttggtgctgatgattatgtgacgaagccgtttaattatgcggagcttattcttcgggttaagaatatggcgcggcgtgtaaagaagacggaggcggctgtaagtcatgaagtaattgaggctggagagatagtgatttgtcctaaggaaagaaaggtacatgtgagtggacaagagattcagttaacgtaccgagagtttaatttatgtcagttatttgtttcaaatccgcagcgtgtgtttatgagggatgagttgcttgagaaagtatggggatttgagtatatcggaaatacgagagcagttgatattatggtgcagagacttcgaaagaagcttgggacgagcggggaatatattaagacaatttatggcgttggctataaactggattgttaagtggtgatggtatgtctttaaagcgaaatatggtgtttggaatagttgggctgttaattccgatttttgttcttttatatgcagttgtttatattacgttagaaaagaatatgtatcataacgcagcagattctttagaaaagttaagtgtagaagcacaaatttatacgatgaattatttagagaaggaagcagaagtggatacgcttggtccgaattcacttttaattgcgtcgtatttagcgaagcgtatggatgtccgtgtgcagatgatcgggaagaatggcgatgttgttgcagatacacataaaggagcattgcttcaccgctacatcgacattgagagttctttgaaggggaagaagacttacgtattggaggaggcggatccagctgctactgttttgatttcctgcccaggggattatggcatcgatgccaccgtctgtgaccgttacttgcatgatcttccttgcgctattggtgttatcaccaatgttgaacaggattaaattgtgacgtctttttgttttgcaactagtgcattgctatgcgcaaacagaagcggttgcacttaatggtaacaagacagttgtagtggcattccttgctgttattttattaagtgtaggttatgcatctatgatctatatggaagaactaaaagaaatgggaatccttattgcattttttacagcgacagctggtacttacatgccttttgggttacttttttcggtcgt

SEQ ID NO: 456 - DNA, 738 bp, Bacillus thuringiensis
attagatcaaactgtaggactagcagtagattctgtaaacatctacgtacaaggagttaaagtaataaacttgtaatgtgcattaaggaggaaaatctgtgtcaattcaaaaaattgatggaaaacgtttatcacaaatgatcatgcaaggagcgaataatttaacaaacaatgttcagcttgttgatgcattaaacgtatttccagttccagatggcgataccggtacaaacatgaacttatctatgacttcaggtgcgcgtgaagtgaaagcaaacccttcacagcatgctggtaaagtcggcgtaagtttagccaaaggattattaatgggagctcgtggtaactctggagttattttatctcagttgttccgtggtttctctaaatccattgaacaaaaagaagaattaacaacagttgattttgctgcagcactagaagctggagtagaggcggcttataaagcggttatgaaaccgattgaaggaacgattttaacggttgcaagagaaacgggtaaatatgcagtaacagttgcgaaaaaacagcgcgactttgttttgtttatggaagacgttgtgaaagaagcaaacgcatcgttaaatcgtacgccagatttattacctgtattaaaacaagtcggcgttgtaagtagcggtggttaaggtcttgtagcggtatacgaaggatttttagctgacttaaaaggagaaacgatttcttctgatgcaccga

SEQ ID NO: 457 - DNA, 1290 bp, Bacillus thuringiensis
aacttaattatgttctgcattatgatactcatggttgtaattgcaggatgtagtaagaagagaaaaaagaaaataatatatcagcgaaagcaaaagattcatatacggtaaagcatgcaatgggtgaaacgacagtaaatggtacacctaaaaaagttgttgttttaacaaatgaaggcgcagaggctctcctagctgtgggcgtaacgccagtggggactacgaaaccacgtgctggtgatgaatggtatcctcatttagcgaaagagttaaaaaacacggaagttgtaggaactgaacgtgatattaatttagaggctgtaatgaagcttaagccagatttaattatcggaaataaaatgcgtcatgaaaaaatatatgatcagctaaaagaaatcgcaccaactgtttatgcagaaacattacgcggtgattggaaagaaaactttacactttatacaaaagctgtaaataaagaaaaagaagggcaaaaagctcttgatgattataaaaaacgcattgaaggaatgaaagagaagttaggcgataaattgaattctaaagtttctattattcgtttcgtgccaggtgatgttcgtatttatcaaaaaaactcattctcgggtgttgttttaaatgatattggatttaaacgaccaccattacaagataaagatgattttgcgataaaaggaattacaaaagagcagattccaaatatggacggagactacttattctatttcacgtctgataaagatgcagataagaataatgaaggaaattcgttagcgaaggaatggacagaagatccactctttaagcaactacaggcttctaaaaataataaagtattccaagtagatgaagtgatttggaatacagcaggtggtattgtagctgcaaatcttatgttagatgatattgaaaaatattttctgaagtaaatgaatagtcgagtgcatccctttaaataagagatgcacttttttgtttgttaaaatacagaaaattccttcttttgagtgtagataagttgtacaattaaaacaatcatgtgataaaagagtggggaagaatgaaagctactcataaagattggattttatttaacggaagaattgtaaatacgaaggaagaacagccgatgattccattagaggagagaggctttcaatttggtgatggtatatacgaggtattcagactatatgacgggaagccacatttattagatttacatttagaacgattctttaactctatggcagaaataaaactaattccacc

SEQ ID NO: 458 - DNA, 1110 bp, Bacillus thuringiensis
  unsure (1)...(1110): unsure at all n locations
ttttatgtaaatgttcgatatttaatgcagaaaaatgttggattttgttgacacgtatgagagcaagtggtaagattacttcgaaaagaatcactgcctcatataatcttgaagataaggtccataagtttctacctggcaaccatgaattgctagactatgaggggaaaagtgtgtaacaaaggatgtaaaggatctttgtgccgaactttttctcgaaatgaggaatgtttatggtgcaaagttttttttatgcaataaagagtgaaaatttcattaaaaaaaattattattatttattcgacaattacgcttattttggtgtttagtcatttgtactatgttgtaagttgaaaaaagagaaaagaagtcttacatcagaggtcgaataattgaaatgcgggggagtcttatgtcagtaaaatccgatagtcgtcacctatatctacgggtgattgatcacatcaaagaaaaaattaaagatggggcttataaagaacgacaaaagttaccatcagagtttgatttagcgaaagaacttggcgtaagtagagcgactttaagggaagcgttgcgtattttagaagaagaaaatgttgtcattcgtagacatggtgtagggacatttgtaaatgcaaagccattattttcttctggaatagaacaactttctagtattacagatatgatttctagtgtggggaaaacaccaggaacaatctttttatcatcatctactacaactttaacagaagaggaaaaagagaagtttaatagtgaagatggttttaatgcagtgatgattgaacgcgtgcgtacagcagatggggaacctgttgtgtattgtatcgataaacttgcaaaagaaatattgccagatttatcgggttacaatgaggaatcattattaacggtgatacataataacacacataagcgcataacatatgcggttgcccacattgagccaattggctatcaccctaaaatctcaccgattttagaatgtgagcctgaaacagcactgcttgtattaaaacatatgcactatgatcaaaatgatgagccaatcttatattctatcaattactntagagctgataaaattag

SEQ ID NO: 459 - DNA, 1530 bp, Bacillus thuringiensis
gtaacgtcgccggaattcgtgattaaagacaatcattcccttttcccaacttttatccatgtttcattaaatctaattcagtgcggtaatgctgacactgggggaagtttatttttccaatctatttcaacagacgaagtgttagatatatccaccttcgcaacaaagttcccttttcctttaactgcataaatgagtccttcttgttctaaatctgcataagcagcgagtacagtgtttctactcacacttagtaattcacttagttcccttgttgatgggattttttgatccccgagcaaatgccctttcataatcatcttcttcaaataatctttcaattgaatataaacgggacgatctttaacaactttaaaatccttaaacaattccttaccccctgcaatcattttttcatatttatttcattctcaaaaggtccacgacatatgtattttttataaagggcggtacggtcttacaaatcttttcgatataagttaatcacatcttttaaagctgcagctgcagcgcctcgtggattagaagccccaccaattgtagtaacttgtcccatcgtatctgtaaagaacgtaattcctttttcggtcccatttacttttgctaacggatgatctttttctatttcgcacggttcaacatttaaattcacattgccaccctcatccttatatgttgatgctattaatttaataattttatgttgttccttagcatttctaatttgctgttttgtaacgtgctcgattccttttatatgtatatcagtaagtgttttctctgtttccattaagctgtttgtcataagtaccaattttcacgccctatctgagccacttatatctaatatagggtttgtctcagcaattcctttatcttgtgcttctttcaatgcttcttcaaatgtcatatcttcctcatacattttcgtaagaatataattagttgttccatttaatattccttctattttttcaatactgcaaccggctaaactaaattgtccgatatctagggtcggtaatgcagcggctgttgcaccgctatatcgaattcgtacatttgcgcctcttgctgcttcatttatttctctccagtttgtaacgagcgcccctttagaaattgctactatatccatctgtttctcaatcgcttgtttcatatattgtttccctggatttccatctttaagatttgtaactgttgattctaccaatacagtaccacttatgctagttgttgcacgttccttcggatgatactctaaatatttttcaattgcagcggtaccgccaccatacatcaataaatgatgaagtgataagccgtcttcattatgtattgcaatatttctccctaatacgccacttacaactaattgaatcccatatgtttcatatatatatgaatatttttcattaataattttataaactctctgcctacttgtccgtatcctgatatacaacttgaatttaataaatcccccatattttctacaaatccttt

SEQ ID NO: 460 - DNA, 1339 bp, Bacillus thuringiensis
aaacttgttacacgtacacaacagattgatacagctctcgctgcaattactaatattgccgaacaaacgaatcttcttgccttaaatgccgctattgaagcggcacgtgctggagagaatgggaaaggatttgcagtggttgccgcagaagttcgagacttggctgagcaatctaaagaatctgcaaaagaagttaatcatttaataaaatccattcaaaaagatacccaagatacagttaatgtcatgcaaaaaggacaacaaaaggcagtagaaggaaaagaagctgcttacaaagcgaatcaaaccttcttgtctattatgagagatattgataagattacaggtcaaattcaagaagtatccgcagcgacagaagagatgtctgctggtacagaagaagtaaatgcttctctttcgctagtttctgaaactgcaacggatgtgaaaaaggagactcttcaaactgtaaattcaattcaatcacaggccgtatcaattgaacaaatatcaatccaatccaacaaaatgaaagaaaaggtggaagaattaacggaattggtttcaaaatttaatattacagaacaaaaagaataagtaaattgtaaaagattaggtacggctatcagcctaaaaataattgattttttacgattaaaaagattttagtaattaattcaatcacaagtgtaataacatgtataaaaaacatgaagacttaagagtcttcgtgttttttttattgaataatgtctgaaaaaatattgataattatacgatattttggaatttatcacaaaatattcatatatgcaaaattacatacatttaatgattgataatcacgagttaatgtaactataataattacactgataagtaacttattgacgacaattataagtgaagaaggagggctttattgtattttgtatataaaaaaatagagaaggagatatgcaaatgaaaaggttacttgttataggcctaatgtatacaatgtttttcctcataggaaatatacacttacatgctgatgaacgaataaatgcaaaaaaaattactagtttagaagagcctacttggatatttcaggcgggcataagtaaggggaaatatcatgaccgacaagatttaggatttattttgaagagaaatacaccattaaaggtaagacaaacaaatcctaattttaaagacaaattaacattacgtttattgtctaatgactcaaaaaatgaaaaatccatacaagtaggaaatgaatgggttactatccaaggtgatacgtctttagttcctttcatagatactccgtatggtgaagagcacgctgtac

SEQ ID NO: 461 - DNA, 813 bp, Bacillus thuringiensis
tttcattgctgcatcatgtagttcatcttttaaatactccggtattttcccttcatatttataataaagtttgtgttctaaacttgcccaaaagtccattgccagtgtacgtaactgaatttctgcaaatacatcttttgtaccagaatttagtgataaagggtatttaatgatcatgtgtaaacttttatatccgtttcgttttgggttagcgatataatcttttacttctatgacttccatatcttcgcgtttttgaatgacttctttcaaatgatagatatcttctacgaagcaacatgtaatacgaataccaataatatcttgtaaatgtgtttgagcattttcaactgttggtaataagcttttgcgctctagttttttaataatactttcaggttgttttagtcttgtttttatatgttcaaacgggttgtaatcctctagaaattgagcttcccggttcataatttcaaatttagtttttaactcttctaaagcaaatgtatatggtaatacaaaagctttccagtagttaactgttgattgattatattccatttatatacacaccttttcctatttgcaagtgaggtcgttattatactaaataccaaatcatataagcgcaagcagcaaatgatgagatcataaagcgatatttagttttcatactttcaactcctttcgagtaagattttatataaataaaacgtgattggtaataaagttcactatgtacaagttctatagtaatagattcgcgtgaatttccgaatgactaattgttcaagcttttggcttttttggtgt

SEQ ID NO: 462 - DNA, 1373 bp, Bacillus thuringiensis
ccatgtcttcagtcgctacttttttaactcttcagcaatttgtttattggacgcagtctcgtatgctttcattaatccagttcaagctgcagttcctgacactttaaaaggtgcagtaatttgaatttctgcatcttttacacctgctgtaatcaaagcgttagtgtacaatgcatctgttacccagttaatgttctttgatcgtacaataagaccagatcctggttttgtgtatgtactcatagaagaagaaattgctctcgtaccagtgtgtgcttttggaacaatgccttctagagatttatgttctaccgcattagatacagtgataattgtagcatcttttggtgttttcatttcttttaacagatcttgtttttgttgttcgcataagttctctcctaatgtagcaattgattctcccacgatgatgtctgcaaatgaagctgttggcatcataaataccgttacagctaatagcagagctaataatttcgttttcacgaaaaatcgctccctttctctttctaaaattttcgggcaacaaagttattatagtatatatttcttatttgtcacctagctttttccacatttcaaaaaagaagtatctagattgtcggattctttttgtttctagtcatgaatgtggtaatatagtgctgagataattgaaaggagacatatacgcatgaaaactttaggatacatattaatggaaaacggtgaaaaaatcgacttggaatttttcccagaagaagcaccgaaaacagtagaaaactttaaaaaattagcagagcaaggattttatgatggtgtgacattccaccgtgttattcctggcttcgtaagccaaggtggagacccaacaggtacaggtgcaggtggcccaggttactctattccatgtgaaactgatggaaaccctcatagacaccttgtaggatcactttctatggctcacgctggccgtaacacaggcggtagccaattctttatcgttcatgagccacagccgcatttagatggtgttcatactgtatttggtaaagcaacaagcggtattgaaacagtattaaaaatgcgtcaaggcgatgtaatgaaagaagttaaagtttgggaagaataaggtaaggaaaaagagagcttttgctctcttttttatttttaatgagattgagtacttcttctacagctcatcatacaagtagtattgttgctaaaatatattgcttgtgagaacaaacctttaaccaattacatagaatacattacattatatgtttcaataaatattttttgttatattaattttgctagaattgtgctgctttagggtaactatgaatgaagtgctgttgatgatatgtttc

SEQ ID NO: 463 - DNA, 1277 bp, Bacillus thuringiensis
cgttgctttctcaatggcaacaatcgttggagacctaggaggatttgataagtttgtttgggtcacatcagcttatatggtagcaacaatggcagggatgcctatcttcgggaaactttctgatatgtacggacggaaacgtttttatataggtggcctcattcttttcttattcggttctgcgctctgcggaacagcttcaagtattgagcaattaagtatttatagagctattcaaggtatcggtggtggtgcccttatgcctatcgccttcacaattatgtacgatatcttcccaccagaaaaacgcggaaagatgacaggactattcggtgctgttttcgggacatctagtgtattcggtcctttattaggtgcttatattacagactatataagttggcattgggtcttctatattaatattccattaggacttatctcctttttcttcattactaaatactacagtgagtctctagaatttagaaaacaaaaaattgattgggctggtgctattacacttgtcataagtatcgtttgcttaatgttcgcattagaacttggtggtaaagaatatgcctggaattctactgtaattattggcttatttacaacagtagttattacgcttattattttcttctttgtagaacgaaaagcaaccgagcctattatttcgttccatctatttaaaaaacctttattcgcagctagtcaaggagttgcctttttctatggtgccgcttttattatctgtacagtttatattccaatcttcattcaaggcgttcttggaggttccgcctctaatgctggattaattttaacaccaatgatggttggttctgtaattggaagtcaaaccggaggacaattagcgtctcgaacaagctatcgtaacattatgatggtatctggtttcttcttcgttcttggtatttatttattaagtactttaacaatggacacacctcgtttactcgtaacactatttatgattctcgctgggcttggtgttggtttctcattctcagtattaagtatgtcttctattcacaagttggaaatgcgggaccgtggttcggcgacatcaacaaactcattcttccgatcactcggtatgactcttggtgtaacgattttcggtacaattcaaaatcatatttttacagataaactaaactctgtatttccccctgactagcaaaattagctccaaaaggcggagacacaagtttcttattatcaccaggcgctaccgcaaaattctgctg

SEQ ID NO: 464 - DNA, 1370 bp, Bacillus thuringiensis
attggagaaaatgaaattgatttaatggctaataaagcgatggcgtatggtgaatttggtaactttaaaaaattaaataaagatgatgttttaagtatatataaagcttctttataagtgaatttagaaaagaaacctatttgattgtttaatcgaataggtttctttttactgtttataaatgtttatgggtgtttttgattatttttgattgtttgtggttgatttttgtgaccgttttcattatactgccatcaaagaagaggtgaataaaatgttaactcctgaacgtcatcaaatgatattgcaacttgtaaaagaacagaaagttgtaaaattacagcaattagttgaaagaacagaaagctctgagtcgacaattcgccgtgatttagcacaattggaaaagcaaaggttattaaaaagagttcatggtggtgccgctgttttaacaggaaaagggcaagaaccaacgatggttgaaaaatcatccaaaaacattcaaataaaacaacaaattgctaattatgcggctagcgttattgaacaaggtgattgtatttatttagatgcaggaagtacaacatttgaaatgattccatttttaataaataaagatgtgactgtcgttacgaatggacttatgcatattgaagctttagttgaaaataatattcgtgcgtatttactaggtggaatgatgaagagtaggacgaaagctttaatcggtgctatggcacaggaaagtatgcagaagtatcgttttgataaatgttttttaggtgcaaatggtgtacatgaacagcttggctttacaacgccagatccagaagaagcgctcttaaaacaaatggcattaacattagcaaacgaaggatatttcttaattgatgaaagtaagttttcagaagttgcatttgcgaaaattgcaaatgttgaagaagcaaatattattacaaaccatttagaaattgatttagaaaaatataaaagacaaaccaatgtaattgaggctgataaacaatgatctatacagttactttaaacccatctattgattatgtagtacaagttaattcctttgatttaggcgcagtcaatcgagcagacaaagatatgaagtttcctggaggaaaagggattaatgtttctcgcgttctccatcgtttaggtgtggaaaatatagcacttggatttactggtggattcaccggtcaatttattaaaggtgtattacaggcggaaggcgtaatgacaaacttcatccaagtagacggagattcccgaattaatgtgaaaataaaggacaaggagagacaagattaatgggcaagtcctatgtgacaatgagaatttgaacattaatgaac

SEQ ID NO: 465 - DNA, 1036 bp, Bacillus thuringiensis
aaagtctgtgaatttttctggcttttcctcaatgtaaacacctaattgttgaaaagtgttatgtttagaattaagtcgggatttctaaaggtcacgtacattccagacaatctcaccacgttcgtcatcccacgtactgtgatgacgcttaaatcctatcttttctagtacccggagggaagcgatattccaagcacctacagtcgaccaaagtctttggcgcccagtagcaatcgccgcgtccagtacaacagatgccgcctcagtcgcataacctttaccatgagcgctgcggaacaactcgtatgcaatctccggctcttcaagtgtggaacgaccgataatcaagccgcagtatccgatgaaatcgccttcgtctcttcttcgaatagtgagaagggaaatgccattttcatctgccttcttacgcatctcaataagccggttacgaacggagtcgagggtcggcatgtccacaccacgttcgccaattaatttcctcatccaaactgaatcggattcctcccacatactcaggtcaagtcgttcggtttttagctggaactccatagttttaaataaagatggcatagtggaacctcctaattatgtcacttaactcataatagcttcgcaccgcatcatgttgaaccaatcgttgattcgcgaatttattttcctaactcccgcgagagtttatagcaacagtatacaatagtattattttatgcataagcaattcctttgcaaaatagacccttttctcaaacttttctttcattctaaagccgtcccgttaaatacacaggctcctactatttctaaatgcataaaatggtaagcgaaagtatggggggatacgatgtataattcaaattattatgattgttataggcaaaatgataagttgattagtgatattgaaaaagctataaatggagagtatagcgccataagctgctatgcaaaattagcgaatatggctccgaatcaagtagcgcataatcaaaatcttgccactcgtattgatgcagta

SEQ ID NO: 466 - DNA, 929 bp, Bacillus thuringiensis
ataaaatgcctgatagtcaattcattgatacgctatcaagagtttcatggaatcaaattacagacttatttcaattcaatcaagatacgaaagctttttatcaaaataaagaacgtatgaacgttatcattgatgaattaggacaaagagggacatcttttacgaaagaggattcaaagggaattgaaacttttgttgaagtattacgttctgctttttatgtgggatattttaataatgaagtaggttacttaaaagagagaagcttccatgacaaatgtttaccatcattaaaagcaattgcaaaaaatccaaactttacattaggtacagctgagcaagatagagtagtagttgcgtatggaaagttaattagtaatgcttctagtgatgctgaaacagtacagtatgcagcaaatattttaaaacagtttaatgataacctttctatgtatgctaaaaattatacgaaagaacaagctgtatatgaaattgtaaaaggtattgattatgatctacagtcttatttgcaggaaacgaataaaaaacctaatgcaacaatgtggtatggaaaaattgataattttataaatgagattagtagaattgctctcatacggaatttaacaactgagaatagttggctaattaataatgggatttattatgcaggacgtttagggaaatttcatagcaatccaaacaaaggattggaagttattacacaagcgatgaatatgtatcctcgcctaagtggaccttattttatagcggtagagcaaatcaaaacaaactacggtggaaaagattatgatggaaatacagtagatttacagaaaatacgtgaagaagggtagatacaatccttccctaaaacatatacatttgatgatgaatcaaatgtttttaagacaggcgataaagtaaca

SEQ ID NO: 467 - DNA, 770 bp, Bacillus thuringiensis
cggttattgaaatgtattaaaaaaaattacagtttagaatcaaatacaagcaatattatttattcgagaatatttaatttatctacattttacagacgataacaactcacttctaaaaactatactgtaattttaaactttacagttctataaatcaaatgttaagtcttggattcattctattaacgtataataggagcagttgagacaatacttgcctcaaccgatttttatatctctttataattttttgcagtaatgactgtttcaaactcaaaggtttcgggtagatgatctgcataagaatattcaaaagttcgtccatccgttaaataagctacttgttcaactcgcattaggaaatcctgatttgttaagttcataaactgcttttccctatcatgtgggcgaattcctttaaccctgacaacagatgtccctacttcaagaccaagtttattttgaatatgtgagtatatcgactcctctaaaacagaagcctcaacacctgggataaccgaaattggcatccatgtatgctccataatcgtcggaatgctgtgaatgatgcggaggcgaatgattttatagacgaaatcaccgattgaaactcccaatttctcagcaactacttcatcagccccaacaatcgcaaactcgataattttactttctacctcactgccgtatacagctttcgtacccgttaaagtttgaatcattcgtgccttttcctgttgacgccaatcttgcaccactgttccacttcc

SEQ ID NO: 468 - DNA, 1112 bp, Bacillus thuringiensis
ttgctacgggatttaagcgagccaattgtatcatgcggaatggatagatagcattcgtgcaacgactttggggggactcgtgttgggatacggttttttgtggagtgatgtagtggcttatacaattggtgttggagtgggaatactgtgtgaggttatttttcggaagaaataagaattgtaaaaggggtatttgtaaatggaacaagcactggaaattgcaaagctttggtttcgaaatgaacatgtcacagctactgtaatgcaaccaaaagtagcgaaggttttatgcaagaataaagagtacattttaaagagaacgggatcgataaagcaacttctagttgaattcgatgttttgaagcaactgtatgaaaagggaattaaagtacagagagtagtaaagacagaaaatgatgaacaatatgtattatataaagaaaaatattattgcttatatgagtatgttgccggaagtgttttagaaataaaagatacgaataagctggaaaggctagcaagtacaattggagaagaaatagctaatctgcacaaagcattacatgcggtgaatagtgaccatgagttaataaaaagagatttatataagatggtatttgaatgggctataccgattttagaaaagaatgagtatgttcatcgagaggtaattcaaaagatggagcgaatgcacgcagctttcaaggaaacggtccattcattgccgagacaaattattcatcgtgatatgcatctatcaaatgtaatctttaaagatgatacactggaagggtttatagactttgagactataggagataatgtaaaaagattcgctctatgctattgctgtacaagtgtattaaccgcgctcgttagtaatgataggttaataggtgttatgtgttgcacttttgtttgctaggtctttgaaggttattatacacaaacttattttgcgagaaaagagctactagctatttggtatgttatgctttcaattcaaattatctttattgcttattttgtccagtgaccagatttattagagttagatgaaaaaatgttcttctggatttttgctaataaggaagctattaagaagatcacga

SEQ ID NO: 469 - DNA, 995 bp, Bacillus thuringiensis
accttttctaaaattcataaaagtttgatttttttcggggatctcacgcggtgtacttcatcaactagctttccaccctgaatgcccatataaagcttcacaggtgcatcattcgtattttcaaatactaaatctaaatatggatatgcaattgtagcatctcttccttgtggaacataacctaccgttttagaatgtgtagttctctccaccattttcaggccagcttgatctgctgcattgtataaagttgaagatgtttgacaaacaccaccgccatatccatctactaatttaccatcaactatttctttccctaattgatatcctttatctggtgttgtatcaccgattaatgaattaaaagagaaacggtctccttttgctaacacaactccatttatgctcgctgctgacaaacgaatattctcaatacggccacctgttgaaccacctaagttcgtttcatatctaccaattaccgcaccatttccttgcgcatcacttaatgttgcgactggttttttctccacgatcggcaactgatacgtagcatcccacataccaacatttaacaatttatctactaattctttttccattaattcataagaaggttttccttcttgccaacttccatcaggtgctatacgtgaaggaaccatttttttgtcgacgctttttccaatctcaccaacaacctttgtgacagactttttaaatttcgcttcatcttcaaaatagcctaaactagataaatctaattttttcacttcagtaccagttcgaccatcaactaaactaatagtatcctgtacttctgctttagcctctacagtgtgcccaccaatatcacttaccaatgcaacatcacttacttttgcaccacagccacttattatagctacacataacaccccaactaatataccctttactttacggaacaatatactctgtgcctttccccacatcactattatggatttatttca

SEQ ID NO: 470 - DNA, 1198 bp, Bacillus thuringiensis
aaccccgttccatcgactaatgtcgggagtgaactgacctgagataacagctggatccagctttaacttatttaaaatcaagggtaatacagatgaaacaatggacgaccaaataacaatgaacaatccagtaatagctacaacttgcgcgacttctgtacctacgcctaaagtgtacgcacgaattaatgctgccacggctaatgtaagccctagtaaaaggcctactaatgcttcttttttcataacacgaaatatatctttaaatttcacctcatttagagctacagctcgaaccaatgtagttacgacctgtgtacctgtatttccaccagttccaattaacaacggaataaagaaagccagtgcaactacatgagttaatgtttcttcataatgccgaagtacagaaccagtatatgcttctgctacaaacagaagtaataaccaacctatacgtttacggtatatttgccaaatagaagtttcgaaatatggcttatctaatggggtgctccctcctaatttttgaatatcttcagttgcttcttcttcgaaaacatccattgcatcatcgaaggttataatacctatcatccgattatccatcgttgttacaggtatagcggataaatcataatccattagtttttgtacggcttcctgttggtctaggttcactgaaactgaaataacatctgatgccattatcgatgataaagttttatcatctgaagctagcaataattcacgaatagaaacaattccattaagctgaccacgtgtatccagaacataaatatacgaaattgattcaacccctgccccaatttttctaatatgcgacagcgtatctttcactttccaattttccctggcagcaatatagtcaaattgtcatcaaactgcccgctgttccagattgaaaaaccagcagacttctaattctttgttgagattcttcagacaaaagttgtataagtttttcagcctgaagtggatgaattgaaagaattacatcaacaaggtcatcaatagattgcctagctaatagctcttctcctctatccacaggcaaattggtacaaatattatattgctcctctggtgtaagataactgagaattttcgcacctttttcagtaggaaaacattttattaaagatatctgatctttatgttgaaaaccttttatttc

SEQ ID NO: 471 - DNA, 926 bp, Bacillus thuringiensis
cgtgatttcagtcaacagttttttgttatagaacaacacattttttcataaagctgtttatttcggtgaaactataaagtgaaactttaatcagtaggggtggttcatcccccactgattattagttgaacccatcgggcttttacgggcagttgatttcctaactaacttctacttatccaacattttttgaggtgaaaggcttactgcccgttaaagcaggataaagtgaaactttaattagtacaacatctatcctctaaagaaatttataataacagccgtgctacccgtatcatttgtaacatactgaaggtgaaaagaatgcgaaggagggaattcactgatgctctacttatctcttttgttaatatccgttgctctttggattacaattgacctttcatacgggagacttcttcatttaaaacaggtaagctctcgcactttccctttacgtcaaagtgattttcacctttatacatatgggaaagatttatatgacgctttatttactgatataaaacaagcacagcaccacattcatattttattcttcattgtaaaaaacgataaaatcagtcgtgaatttttaaatttgctgattgataaggctcaggaaggaattgaagtacgacttttacttgatcgatttggcagccattctttatcaaacgaagctattcgctccctgcaaaaacatggtgtatctttttcattttgtcataaggtaaaatttcctcttcctttcttttctgccaatcaaagaaatcatagaaaaattacagtgattgatgggaaaaccggctatatcgggggatttaatattggcgaagagtatctagggcataatgaacacttaggattatggcgagactatcatttacgtcttacaggagaaggggttcaagatttacaaaagcaat

SEQ ID NO: 472 - DNA, 1018 bp, Bacillus thuringiensis
atacactgcatgaatcttttatggggaattggcggcgtgattggagtattagcaattgcttttctactatcttccaaccgcaaagctattaattggcgcacaattttaatcgcgctagcattacaaatgtcattttcatttatcgtattacgatgggacgctggtaaagcaggtttaaaacacgctgctgacggtgttcaaggattaattaatttttcttacgagggaattaagttcgttaccggggatttagtcaacgcaaagggaccttggggatttgtattctttattcaagcactacttccaatcgtatttattagttcattagtagcaatcttatattatttcggtattatgcagaaatttgttagcatcgttggtggtgcattaagtaaacttcttggaacttctaaagcagaaagcctaaactcagtaacgactgtatttttaggacaaactgaagctccaattttaattaaaccttacttagcacgcttaacaaatagtgaattcttcactattatggtaagcggtatgacagctgttgctggatccgttcttgtcggttatgcagcaatgggtattccgttagagcacttattagcagctgcaattatggcggctccatcgagcttattaattgcgaaactaatcatgccagagacagaaaaagtagataataacgttgaactttctacagaacgtgaagacgcaaatgttattgatgcagctgcacgcggcgcatctgaaggtatgcaacttgttattaacgtagcagcaatgttaatggctttcatcgcattaatcgctttattaaatgggctattaggattagttgggtctttattccatattaaacttagccttgatttaatcttcggctacttactatcaccattcgcaatcttaatcggggtttctccaggtgaagctgtacaagcagcaagctttattggtcaaaaacttgcaatcaacgaattcgttgcatacgcaaacttaagaccacacatggcagatt

SEQ ID NO: 473 - DNA, 1381 bp, Bacillus thuringiensis
tggaaggaaacctattgttagaaggtttcctcttaatttttttaaaccacatagggtatgtggatggattagtatataaagaattctgattgataaagagtggtattaaaaagtacaaaatctaaaatgagcatttaattaatgttttacgattgaaacggcactgaaaactaataaaacagccataatgatgttgaataattggttatgttttactaatattttttggaatattgaaccaaataaactccaactaaatgtacttagtaaaccgactatacctagaaataatgagaaaagcagaaaacttgaatatgaattgtagtaggggagtataaaagtagagactactgtgagcccgaataatattccttttggattaacaaattgaatgaaaatacccactgtaaataagtttttattatttttttcattgtgatctgcaccgcctttactagtaattattttaaaggctaaatatagcatatacgcgacacctaaaatttttaaaggaaattcaattatagggataatattaattaaaacaatattaaagaaactgcataaagaagtgaggatgaaaaaaccgaatgctactccaaagcaaaagtttatgcttctctttaatccatgttgatttgcgtatgtcatagctaagaaattgttgggaccaggtgtgaagctacttataaatacaaataacaaaaaagaaaatataggcatttcaaaacctcccaatttttgtatgttataatgatcaaaaagaacaatataacgtgtgctttttattatacataacggtcgttatattgtatgcggtgtaggagtgttttttatggaagaaattcaacttattctggcaaaaaatttaaaatcaatacgtgaaaaagaaaaattaagtttagaaaaggtctctcaattaacaggtgtaagtaaaacaatgattggacaaattgaaagaggggaatcaagtccgacactaacaacaatatggaaaattgcaaatggcttgaaagtttcttttacttctttaatcaataatcctcagcctgatacgaaagtgattttaagaaaagatattcaagtattgtctgaagacaatggaaaatataaagtgtatccttcttttccatttcaagatgatagacattttgaaatgtatacagtggaaatagaaacagaagggaaattaagttcagaagggcataaagaaggcgcagaagaatttataacggtatttgaaggtgaattgacagtaaaattgaataactgtcaatataaattaaatagtggagattcaattcgttttaaggccgatagatcacactcttattataatttaggggaatctttaaaacgattaagcatgacaatttattat

SEQ ID NO: 474 - DNA, 1100 bp, Bacillus thuringiensis
cgctccatgatctattacacgaattgtaactttccctgagtgtaaactggattctatgcaaatatatttattaacctcttttgtatacttaactgcattatccattatgataataataatttgttctaagtaagatgatggcattgacacataagcctcgtcatccccgaatttcatatcaaattgaaaattactttggagtactacaaagttttgtgtaacatgttttaatacgctatttacatgaactggctcagctgctattggatgcaattgttcagattcagctcttgatagttctagcaattctgaaactaatttatttaaacgaactacttcctttaaactagattgaagagatttatctaatactgctggatcatttttcccccatcggtttaacatcgctaagtgaccatgaataattgttaacggtgttcttagttcatgagatgcgtcttcgacaaactgtttctgttgtgtaaaagaagtttctacttcatccatcatctcgttaaagagaaatgataattttgcaagctcatcattattttctcgtactggaacccgttcatttagtccattctttttaatacgtttcatcgtatctgttatattttgaacacttgataatagtttcttagttataagaatcccacctaaaaaactaaatatcaatccaaatattccagcaataagcattaccactaaaataacttttaataaataatcaaatgtctctaggtttttcgtaagttcaatagttccagtaaactctttcgttttaattggtatgcgcttaactaatattcgatcttctaaatgcctttttataaatgactcatcttttataacctgtttcggctttatccacgtttcattaaaatctcgtgaaacagtaataatcggctccccatccatgtcaataatacgaatcatttgatgcttatcaatcatattgtttagaaaatctttactgtttttaaatgttttactcgaaagggtatcatttttatcttggaaatatgccgctatttccgtaacttgcctatttatttgtttctgttcataatctatagtccacttattaattacaataa

SEQ ID NO: 475 - DNA, 687 bp, Bacillus thuringiensis
cttgtttcctcataaaatacgccagttctctttgtaattttttatagcttttcaaacgatctatcgtaataagtccgttttcaattgcactatacaccgcgcatcctggttcattctcatgcttacaatcacggaaacgacatgttgtcgcaagttcttcaatatcagagaatgctgtttgaatcgcttcgctgccttcccaaagttgcaattccctcatgccaggcgtatcaatcacgagagcgccactaggcaattggaataattctcgatgcgttgtcgtatgcctccccctactatcctcttcacgtatatctcccgtttttgctacatcaattcctattagagcatttaacaaagttgactttcctacccctgatgatccaactaaagcaattgttttccctgaagaaacgaattgtttcaacgaatctatacctgtatgctctaaactatcaacaacgaaaataggaacaccaattgctatagcttccgtttctacaattttctcttccacatcattacatatactactctttgttaaaacaataactggcatagcgccgctttcatacgctaataataaataacgttccatccttctaacattaaaatcatgattaagtgcattcactaaaaataaataatctacatttgctgctataatctgttcttcagatattgttc

SEQ ID NO: 476 - DNA, 804 bp, Bacillus thuringiensis
gtgtttgctgccagttattacttgatgtcccaccatgaccaccttggtgtagccacattttacgcggaacattattttctccaagtgcttcccaccattgcgcgaactgttttgttttaacattccaatcgtttaaaccatgaacaacaaatacactcgcttttacatttttagcatcttttacatagttacgtttatcccaaaaatcattataattacctgtttttcggtcttgtccagccgttaactcttttataacttgtccgcaaacttcagggttttcccttgtcagtactgcttctgccatattatctgtatcttccccttgatatccgcctggagcaatgactgcaccatttgcacgataataatcataccaactactaattgctgcgattggaataattgtttttaaaccttcgactccagtagtcgcaacagcatttggtaaagtaccattataggaaactccagtcatacctacatttcctgtagaccaatttgcctgaacttcctcaccctgttctgtaaatgctttcgcgcgaccgtttacccaatcaataacagattttgtcccgagtatctcttgttcatctccagttgtagggcatccatctgattttccagtaccgatactttcgcctagaataactgcataacctcttggcacgtaatagttcccatacgaaccaagattaaccgctccatacggttttcctttatacgcatacaattttttatctacattatatacaggaaacattttttatccagatcgatatggactaattttataaaattaca

SEQ ID NO: 477 - DNA, 1113 bp, Bacillus thuringiensis
taccgtttttgtgatattatgttagttggaaatatagtaaaagaagtgcttgcatataaaaaaggacaaattcagcaaaagctaagtagtccacaagcatttgttagtagtcgttttcaagagaagttgcagagtgaacctgcgagggagacgaaggctactacgcagccggcaaaaatagaagatatgagtcagccggaacaatctacgaaaatagaaacggttgttaataagccggaacaatctattaataaagtagatgaagcgagtaagcccgaagaaaagggtgaaacgaaaaaagtagatgaagcgagtaagcccgaagaaaagggtgaaacgaagaaagcagatgaagtgcaagttgcgcaaaaagagtttgaacgacgtttcccagaaacgaaaaatgaggctgctgatacgtggggattaacgaagaagtataatattcaaaaaatacgttcttccaatgaagggaagtatgaggatattattgatcgtgtaagtcgtacatatggaattccgaaaacgttaattcaaaaaatgattgaagtagagtctaattttaatccgaaaacggtgtcacatgccggtgcgatgggacttatgcagcttatgccagcgaatgtgaaggagatgggtgtgaagaatcccttttcaccagctgaaagtattgaaggtggcgtgaaagagttaagtggttatttaaagaaaaataacggtgacttagtattggcacttgcttcttacaatgctggtcctggtaatgtgagaaagtacggaggcgtaccgccatttaaagaaacgcaaggatatattaaaaaaatattaaatatcgacgtttcaaaataagaagtttcatatatagagagaacatgaaattttcgtgaacatgatatgggagttggctagatttgaaattacaagatgatattccgttaacaatttattttgaaatcggaaataccgaaaagaaaattgaagatctgcttcatattacgaaaggtacattgtatcgtcttgaaaatcaacgaaaatacggtgcgtcttatgcttgaaatgaagagatggacccgaagatttaacgagatggaaatgtacttgaatcgtgattga

SEQ ID NO: 478 - DNA, 1372 bp, Bacillus thuringiensis
atcatatccatcttttctaaatatgttaacgcgtgatctagcgtatctactggcacaattttcatttttgttttaatatcctttgcagtctcaagtgcatctttatagttcgatttctccgcaccttttccatttggcgcaaagaacactttagccccggcatcgctagcagccaccactttttgatttataccaccaattgggcccacttctcctttttcattaattgtacctgttccagctatttcatgtcctttcgttaagtcttctttccacaagttgattatatatttctaatgtgaacattaaacctgcggatggttcaccaatttcatgagaattaattttcactttcggatcgaccactaattctctttccgtaacgatagaaacacctatgccgacacgcccattcccattaggaatcgtctttacatttaaattctctttcaattgttttccatttctcatgtactcaatacttacagcatcgttttcttttttccctgtcatatattcaataaattgctccgtcttttcaaatgtttttccgtcaacagctataataacatcaccaagcttaagctttccttctgacggcattccttttgccacaccagcaactaatacacctttattttcaaaagatactgagcgatttgcacgtttatatgcattataaattgctgcattttgcgaatctttcatcgcataattttggcgaaattgatattcttcatcactctcacctttttgcaatatttcttccgctttcgaaatatgtgtatatttattaaactgtgccgctattaaattcaccacatttgctggtcccattgaaaccgtaacaagcataaaatcaccagattctttcgttccaccctcaacttgaacataaggctctaatttggcagccattcctggttttgttatataatacggtaaacgtacgtaaacaagtaacatcgccaatataacccctattaagattgcatatataaaccgaaaacgcttaaacattatgtttctccttccactgctcaattaataaataaatatttgaaacatgtttttctgcttctacttctccaactcgaataatgtcttcaatgtttgtaaaagcacgtgaactaaattgctctacagctggtcgcatcattaaatccgatgcaatttgccgattcattacaagctcatgctgcataatttcaatactttgtatgattacgtcataaatggacgtaacatcgccattcaccttaattggagatacatcaacagcgataacaatatcggcccctaactctttcacaaccgatactgggatgcgatcaatgactccaccatccactaataatcttccatctatttt

SEQ ID NO: 479 - DNA, 1425 bp, Bacillus thuringiensis
ttactcgctgtatcgacactattaactattacaactgctaatgtagtttcaccagtaacaacttttgcaagtgaaattgaacaaacgaataatggagatacggctctttctgcaaatgaagcgagaatgaaagagaccttgcaaaaggctggattatttgcaaaatctatgaatgcctattcttatatgttaattaagaatcctgatgtgaattttgagggaattaccattaatggatatgtagatttacctggtagaatcgtacaagatcaaaagaatgcaagggcacatgccgttacttgggatacgaaagtaaaaaaacagcttttagatacattgaatggtattgttgaatacgatacaacatttgataattattatgaaacaatgatagaggcgattaatacaggggatggagaaactttaaaagaagggattacagatttacgaggtgaaattcaacaaaatcaaaagtatgcacaacaactaatagaagaattaactaaattaagagactctattggacacgatgttagagcatttggaagtaataaagagctcttgcagtcaattttaaaaaatcaaggtgcagatgttgatgccgatcaaaagcgtctagaagaagtattaggatcagtaaactattataaacaattagaatctgatgggtttaatgtaatgaagggtgctattttgggtctaccaataattggcggtatcatagtgggagtagcaagggataatttaggtaagttagagcctttattagcagaattacgtcagaccgtggattataaagtaaccttaaatcgtgtagttggagttgcttacagtaatattaatgaaatgcacaaggcgcttgatgatgctattaacgctcttacttatatgtccacgcagtggcatgatttagattctcaatattcgggcgttctagggcatattgagaatgcagctcaaaaagccgatcaaaataaatttaaattcttaaaacctaatttaaatgcagcgaaagacagttggaaaacattacgaacagatgctgttacattaaaagaaggaataaaggaattaaaagtggaaactgttactccacaaaaatagggaaatattaattctgttgtaaagtgaactaaaacatagaaagtctatgattacactgttaaacagaaaagtaataattaataaatccttatataacagaaaggcggagtctcattaaagacttcgcctttcaattatatataagtatgattcgaataaagaataaccttgtagtttaattgcttttttaaaatttgcaatagaatcggttaatttgaagcagatgatatacattttctttaatacttaatgatttgaaggctgctaaagaaagttcaaacgatactgattaaagatgtagaactcattttgaaagacatc

SEQ ID NO: 480 - DNA, 1278 bp, Bacillus thuringiensis
gtattccactaataatgaaatttgtaaaaacagaagtttcaatcgttatgaggatgtccatttatgtaatttcaattaccgcaatgattattgaaccttcggtaattttcttatatggacttgcaatttttcaagcagttgaaaatgcgggtacaagagtggcgagaaatgtattgatgatggaggaaattccaaacgaagtaatgggaggtgtagacagcttatttcgcctaattggtactggaatacgaattgtattattaatgctgtttacagcgggtgtatctaaagccggagtaatgcttccattttacgtattaagctgcatattgatcttctcattaggaatcgctatttattatgtactatcacaacgtaaagtagcggcgaatgtttctaataaatcaatcgtttaaaaaacacttctgccgccctttctttttctgtataataaaaagaaagggagtgcaaacttatttatgaaccaatggatctttcttatcattttattattaccgccactatatatcatttatatgacgtttagaatgaacaaagttgctcgtgaaaagttgagctatcactctccgtacgttcttatactgggtgcaaagttatttggagatagaccgtctttatctcttcaaaatcgtttggatgtagcgttggagtatttattttcccatctgaagcgaaagtaattgtttcaggtggtcaaggagaagatgaagatataccggaagctcacagcatgagaaactatttaatggtacacggtatagatgagagtcgtattttaatagaagatcaatctacaaatacgtatgaaaacttaaagtttagtatggatttatataatgtgaaacatgcggtagttgtaagtaatacgtatcatttatatcgaacgaaaataattgcaaagcgtttaggcatgaagatggaggcactagctgctgaaacaccaattcgttctaagagaaaaatgtatgttcgcgaatatgctgctataatgaaaacaatattgttcgaccgttagagctcaaatgtgagctcttttttaatttaaaagcgtatcatttgaaatgaatgccatattccatcaaaataaaggaaacaacagtaaaggagttgtatttgtgattcaatttaatcatgtgtcaaaatcgtatgaagatggcacgaaagcagtggattcattgcatttagaaattaaaaagggagaattttttgctctcatcggtccgagtggctgcgggaaaacaacgacaatgaagatga

SEQ ID NO: 481 - DNA, 979 bp, Bacillus thuringiensis
atcgtcggattattattggtgttattaaaaccgcaatatgttgtgaaccgctttagtgcttaacttattcggtggcttcatcattgcttctatcattaacccgtatgaagttactgaggaagaagatatgttagaagtacaagaagaagagaaaaagactttctttgaagtattaggggaatacattattgatggatttaaagttgcgattacagtagcagctatgttagtcggtttcgttgctcttatcgcattcattaatgcagtatttaaaggtgtaatcggtatttcattccaagaaattcttggttatgtatttgcaccatttgcatttattatgggtgtaccttggcatgaagcagttaatgccggaaatattatggcaacaaaattagtatcgaatgaatttgtcgctatgacagatttagcacaaggaaactttaatttctcagatagaacgacagcgattatatctgtattcttagtttcatttgcaaacttctcttcaattgggattattgcaggggcggttaagagcttaaatgaaaagcaagggaatgtagtcgcaagatttggtttgaaattactattcggtgcaacattagtaagtttcttatcagcaacaatcgttggcttattattttaatagattcgtatcatataaaaaggaatggtgattgtaatgagaatggtagatattattgcaaaaaaacgtgacggcaaagaattaacgactgaagaaatcaaattctttattaatggatatacagacggaagtattcctgattatcaagtgagtgcgcttgcaatggcaatcttctttaaagatatgacagatcgcgaacgtgcagatttaacgatggcgatggttgagtctggtgaaacgatcgacttatcagcaattgaagggattaaagtagacaaacattcaactggcggggttggtgatacaacaatttagtattaggacattagttgc

SEQ ID NO: 482 - DNA, 993 bp, Bacillus thuringiensis
ataaacattatataaaaacctatacacttcttatcactacataaatgaatataattgaggatagaactagcataaggggaaacaaaataatgaataagttacttacatcgaaaattgaaattatagaaagaaaaatccggtataactcaacaatagtagatcacaattgcttattacttgaaaagcaatcacaaagtatcgttttatttcacgaggtgcagtattcatttacaatgactgcaaatgatactaagttaacaatcccaaaaggaagttatacaatcgcatattactggaaagatcgtccgtacaatttatacgtatggagagatataaaaggaaagtatttaggttcctattttaatattgtaaaaaacacacaaataaaagatgaagtggtttcctttgaagatttaatcatcgatattatggtacttccaaatggagaatacttcatattggatgaagatgaattaccagaaccattagggaatttcgaaggtggttatgtgaggaaagctctttatggattaaaagaaatcattcaaaaagagctgccaccaatagttttggagacagccagggtgcagaggaaataaaatttaattacataaatattttgaatgggaatgagtagtctcaagttatatgatctaacttttttaataaatctaaggttagtagcatatttcttgaaattactcttttttttgtagaaatttcgtcgcttagttattaaattccatcaaatgcatttagcgtgtgagttttcttattggttacagtggattaaaaatcagaaaaaatagtaagtaaatgatatcgttcaaataaacaacagtaaaaatattcaaacgaatcatatgtatgttttgataaaacctattttacttatcggaaatatttgtataatatgtacttaataccataacgtattgctgattggagaaacccaaaggcattttaatctgtggataaatgcttttggttttt

SEQ ID NO: 483 - DNA, 973 bp, Bacillus thuringiensis
acaatcttttttgtcggttctgcactttgcggagtcggtacatcgatggaacatatattctttttccgcgcgcttcaaggtatcggtgctggtgctgttatgccaatcacaatgacgattattggagacttatatagcgaagcgaaagaccgcgcgaaagcacaaggttggatgagtgccgtttggggtgtatccggtgttatcggaccgttagtaggtggatttttagttgattccctttcttggcgctatattttcttcctaaacgttccattcggaattatcgcttgcttaatgattgcaatttactacaaagaatctattaaagctgctaagcatcatatcgattatcttggtgcaacagtcttctcattaagtacaatcgctctactatatgcattattaacaggtagcagtaagcaaaactggggagacatgacaattatcggcctattaatctttgccgcgatttcatttattattttcttattcatcgagaaaaaatctccagaaccattaattccgctagcacttttctctaaccgcacattatctacgataaatatattaactcttattgctggcgcaatgattattagtattacaatgtaccttccaatttggagccaaggtgtattagggaaaaatgctacagaagctggacttattttaatgccaatccctgttatgtggacatttggcgctattttctctggtaacttagtaggcaaattaaaaacgaaacaaatcattttacttggagctagcattttatcagtcgctacgttcttattatttacactatcaacaaattcaccatcgttccttatttatgtagcagtcggattattcggcttaagaatggggcttgtgacaccgatttacatggtaacaattcatgcagccgtaccagctcatacacgcggtacagccgttggtttaacacatttattatacattcagtcaaacgtta

SEQ ID NO: 484 - DNA, 1209 bp, Bacillus thuringiensis
attcatatattcttttaattgcatttccttgtcctttctactggacaattccttttaaatcccagtatgcttcttctagccacggatgtataactttaaatgtatctttcctttcccacaaatatgaaatatatacaaaagctgctttttccaaaaattttgccaatcctttttttatttctattaaatatggtggtgtcccgttttgatcccattctattttatctgcaacaaataatactaaatccatcttcgttgcatgtttacgcaacgttgtatggcaacaaattgcatttaaaatttcttcatcttctactttaaatatttcttttgcgattactctcgatagtttttgatgaataatcataggaaactttctttctgcttccactatttctatcccaaattcttcagcaactgcaatccgctcctcgttcggaaaaatgccactaatatcatgtaaatatcctgcaagtgctgctttttctttatctacgtgaaacttttctgcaatcttttttgcctcatttgctacacgaattgaatgtttatatgtaaactctttattatattttagtagaaaagctttaatatcattttctatttttccagtttgagtaaatgaatatatatcattacataacatagaaaatccccttataactacctttcattataatgtagaatctaaatatccttgttattttatattcgttattaatctttttactcctttttaatacgttacatgaaattttatacagaatcatcgctacaagtacataaatgtttgatattatagtaatgttgatgatttgtaaggaaaggaactacacaatgaataaaaacatattaattattgatgatgataaagaaattgttgaattacttgctgtttatttgcgaaatgaaggctataacatttataaagcttatgatggcgatgaagcattgcaaaaggtttctacatatgaagttgaccttatgattttggatattatgatgccaaagcgaaacggattagaagtttgtcaggaagtgcgtgaaaataatactgtaccaattctaatgcttagtgcaaaagcagaagatatggataaaatattaggtcttatgacaggtgccgatgattatatgatcaagccattcaatccattagaattagtagcaagagtgaaagctttattacgaagatcatctttccaaaac

SEQ ID NO: 485 - DNA, 1207 bp, Bacillus thuringiensis
tgttgcttgatttttttcgcaaaccatatccatatgatcataataataatagctggtacattttcataaccagctgttgcttcttttttaataatgacatttaatgcttcatcttgaatgacttctaagttacgctcttttgcaaagcccactaaataatcactaatttccttttcattacctgatcctctaggaatctttgaaatttctgcaaaatgaaaaaatacagggtgctttgttaattgttctaaagtagaatacatttttcaagctcctctcaaaatgaaaaaataatatgtaagtctcatatcattataccatgattcattattttatctttcttttaacttttattgttcattttatgtacaacactcttacaacattgtaagcgcgttgtaatctacatcgatttttctcatttaataatagtcgtatactttctaaagaaacacattaaaggagataaagaaaatgaaaaagtttttagcaattattacactatgtttattattttttagttttactattggctgtgagagagcgtcactaaatagaattggtaaagatgtatattacatgcagataaaaggcgaaggaactatcgaaaaagtagatcatagaaacttacgaaactatacgctgtccgcatatgatgaagatggcgtcaaaaaacaaattacatttagaagtacaaaaaaagaaaacaatcataaattaaatgaagacgcgtttttacgcctttatgtagatcaagatgataatagcaacaatgaaatatcatcaattgaagtaaagtcctatgaagagattcagaaaacagatttacctaaaaaagtaaaagataagtttactattaaataaaaaacaaaagaaaatgctctatgcattttcttttgttcttttcacctgtatatattttgaactactattattcatcagtttctctaaccgatttatattctccgttaatgcacctttcacaagagagaaatctgtattggattcttcttttttttctttaaaaaacgaagacttttgtacattgacttcagccatctcttctcccccttttcaaaaagatacaaccttttatttatattatatagcaaatgtagaaagagtgtacacttatgattttctttttaattcttcttctaattcttctacttgctgcaacgtatccccttttattaaagagaaatct

SEQ ID NO: 486 - DNA, 1100 bp, Bacillus thuringiensis
ggggtagtgcaaattcttaagttgatgggcatgtggagtcacccccatcattattagaattagctaaaatagtaggattaaatgattataaattaaaaattggttttaaagaattatttggcacgtccacatttgcatatttaagagaacagcgaatggaaagagcaatgcttttattgcgttcgggaactagtaatgtgaccgaaacggcagttgctgttggatacaataatattagtcatttttcagagtcatttaaaaagaaatatggaatgaaaccttctgaaattttgcgtatgtattaaaaatccgttataccgtaaactcctccaccatttggtagttgtatttcgtcataatcattataattacaatcaacatccaattggaaataattttttatggaggaatttaaatgaaagagcggaatgaaagtcatttttggatatttgtattaataggaatctttcttattataacaacaactggtttcgcccgtatggcatatggaattatactgccatttatgcaggaaggacttcacttatctacggctcaatcaggtatgctaggaaccatactttttttaggttatttattaactgtaggaacatctggaatatttactatccgttttggcgcaaaatcagttttattaataggcagttggttcgtcgttataagcttaatgggattagcgtttgtttcttcgttttggatagttgctttttgtatgctatgtgctggagctggtagtgctcttgtatatacaccactcatgtcaataacggtagggtggtttccagacaaaagaggatctgtaatgggactgttattaagcggtgcaggtataggtatgctatttagtggaataattgttccttatgtagtgcgcacatttcctgagtatagttggcgtggtgcatggtttttgtttggagttattacatgtatcattgtatttgtcgcttcagttgttttgaaaaatccagaagttactgaagatgagcaaaaaatgagtaataaatcgtttttatggacaacgaaagaactatatatcattgcatgaatatattttattgttggtgttgtatatttaa

SEQ ID NO: 487 - DNA, 1332 bp, Bacillus thuringiensis
  unsure (1)...(1332): unsure at all n locations
caacagtaagaatatcggcatattcaatcagttcaatctcacggtttgctcctactgtaacattggttcctcttaccgttcttatgtgagcataatcaatatcgatattgtcaccttctaatagctcagcttctaactgcaagccaaacactgttttaaatagtctactaaatgtacctgatctatgtcttactttaatcgtttgaccaccaatttctttcgctcgacatgtaccgtgaatatttatattaatttcatctgcgcttaataaaccaccgattgtaaattgtccttctgaagaaaaagtatccacttcacaattaccgtcaattgtagcttgaccattgactttaaattcttcaccagtgacatttccacctatcgtaccttttcctgcaattttcaaactgtttgcttttacattttgcgtaattgttgcttttccatcaattcgcatcgtttcagcttgaactgtgccatcaactttaccagatccgctaattcgtgcactgctacttttcaaatcgccagtaactgcaccgtaaccgttacattcaaattgctcacattcaacatttccattcacagttccttttccgtttaattgcactttatgaaactcgccaccattcgatgaaccgtaaccatttataatcaaattatctgtacgcatactttctcctccactacaacaatttagtttttaatgcttcggtatatttcataatcgcttcgcgtaaaacgattttggtgcctttttcaaaaattaaatcgtccacgtttgagactaataaacatgtagaaatccctaactttcggacaataattaagtcacaagttttatgtttaattgcttcataattttcacgtaaaacttgcaagaccatttttccttcttctaaactaatctctcctgattgcagtaattcttctaacatgtacacataaagaatatctacaaattgaaactctgctcttttattcgtttgttctatgaaaaattgtaaaactggttctgatgcaatccccttgcataaaatgtcttcctttgttaaaagaatttctctcacactcggcgaaaacatgttcgctagttcatcaagtgataaatcctctttcatcgtttggaatttatcgatacgctctaatatcttttctttcggaaaaaatgtctcttgacctgtaaacgttgattttcgtacaaaccaatnttccggaattaaattttttcttttccacctatataactgtccgtatggaataccagttagttctaataaatctttttttgaaattaaatctgtactcaantctataacactccttcctgat

SEQ ID NO: 488 - DNA, 1154 bp, Bacillus thuringiensis
aaagtccgggccgaagatctcattcaggcgatttattcattggggtagacagtgaatatcataataaaggaattgggaaagcacttcttatgaagatgcttgatctggctgataattggttaatgttagagagagtagaactaggtgtgttagaaacgaatccaaaagcaaaagctttatatgaaaaatttggatttgtagaagagggagtaaagatagggaatttgaaagctcacggaaaatttattaatgaaattatgatgagtcgttttagaccgaatggtttaattgtacataatgaatagttaaaagcatgacagtatactgtcatgctttttcattagaatttggctgtaataaaaataatactaaaccaataaaaataacggtaattcctagtccttgttgtaaagaaatagtctcatgtaatataaagtacgctagcatacaagtgccaattgtttcacctaaaatactcattgaaattacagtagcactcatccattttaataaccaattaaaaatggtttgtcctaaaattgtagcaatgaaagctaatccaataaagcacaaccaagtttgtgtagagtaatggatgaaagattcttgttgcatgaaagcaaatatgctaagaaagccagcactacttccataactaattaccgaatatggtataagtgacaaatctttacgaacgtgttggctaatgaaaaaataagcagtaatgataccggcagcgataaatgctaaaatatctccatataaagcttctccactaattttgaaatcttgccagccaatgatgatactacctgaaatagcgatgaggcaaccaataaccgctcctttcgtaaatctctccttaaataaaaaataaccaccaatcattgagaacaaaggttgtacgttacgataactgtagagcttgctacagaagtatattgtaatgattcaaaccatagtacataatgtgcagctaaaaatagcccagatgtgaatccgaatgtccattgttttttcgttaaagtttttagctcatttcgactatttttattaaatagtaataacggtaacaggatcagtgtggcaaagaataatcggtaaaaagcaatgattgtcgcaggagcatctgccaattttacaaaaattgctga

SEQ ID NO: 489 - DNA, 1091 bp, Bacillus thuringiensis
  unsure (1)...(1091): unsure at all n locations
ccgatacaagtgagctgcaaaaagaatcattggtccctcagcctcttgcttatttctatttcgaaacagtatagcaatgtcttcatgcttatttttccatacattcaacatcactggaatgctgttttcaatttccttccatggctcatactgtctttcaatatcaaatataaagtaagtattttgtattatctcttcaaaagaattgtctgtatgatacttaattaaatttacactttctttaaaaaatggtaaacagtgaaattctttcggtatttctataactcgttccatcctttatttcaccttcattcgcttctttccttcacgacatacttctaacagtctgcattcctcacattgcggtcgttgtgctttacaatgataacgtccaaagaaaatcatacgatgatgtgtaactccccactcatccattggtactttcttcattaatgttttttctacttctaacacagagtctttccatctacacatagctaatcgtttactcactcgctccacatgtgtatcaacagcaattgccggaattccaaacgctacggaaactacaacattcgctgttttccttcctacacctggtaatttcgtaagttcatctcgatcgttcggtacttctccattatagtcatctaataacattcggcataatttttgaatgttttttgctttatttctatacaatccgatagagcgtatatcttgttgtaattcttctagagaaacacttaaataatcttctggtgttttatatttttgaaataaatttcttgtcactttatttacaagtacatccgtacattgtgcagataacgccaccgcgattacaagttcaaatggattatcatgaaccaattcacaatgtgcttctggatacatatccgccattgtgtctaaacaataacggatttgcgttttgttaagcatatttttcctcctatattactgctccaaccaattataaaaaggcactnttccagtaaatttcgtctcttgttttgtcatttggtgtgccctttggtgattcgctctaaattttngaccttgattttgagcctgatctaccgttttaa

SEQ ID NO: 490 - DNA, 1365 bp, Bacillus thuringiensis
ggtacagttgtaattgttgtaggagaacttgatgaagcaccgatgttgtatattggtgaagaactaggaacaggtaacggtccagaagtagacatcgccgttgatccattagaaggtacaaacatcgttgcaaaaggtcttgcaaatgcaatggcagttattgcaatcgcagacaaagggaaccttcttcatgctcctgatatgtacatggaaaaaatcgcggttggtccaaaagcagctggtaaaattagcttagatgatccaattgaaaaaacaattgaaattgtagcagaagctaacaataaaaagattcgcgatctaacagttatcgttcaagaacgtgaacgtcatcaagatattattgaccgtgttcgtgcaaaaggtgcacgcgtaaaattatttggtgacggtgatgttggtgcgtcaatcgcaacagcactacctggaacgggtatcgacttattcgtaggtattggcggagctccagaaggtgttatttctgcagcagcattaaaatgccttgaaggtgaaatgcaagctcgtttagttccaatgaacgaagaagaagaagctcgttgtcgtgaaatgggattagaagatcctcgtcaacttcttatgttagatgacttagtatctggggatgatgcaatcttctcagcaactggtgtatctgctggtgagttattagacggtgttaaattccttggtggagatttagctgaaacatactctatcgtaatgcgttacaaaacaagaacagtacgattcattaaaacgcatcaccatttagatcataaaccacacttaaacttagatatttaataaaggagccatgtgtatggaagaacgtttctttctgtacgacgatactgtcgctacaaaaactcgtttcgttagctttatgggagaaaatgagcgtcacgatttatcgctattatactccgatcgtttttatctgtaaaacaattgtccttgatatgcaacgcaataaatttgcaatcatcggtgctgacgatttaaacgaaccaggctacttagagcacgcattttctatgactgaagaaattgcagaagaattacgctcatttttatttgaacttatataatttatcgtatgcaccagctattttagctggtgtttttttattgtaattatttttaattttcaaactaatatgttataattaagaataaatctatttggatagaaaggacgttatctacgtatgccaacatttactttgtaatggaccagcaattggatagcattactctcaaaaaagcaccacgctttttcaagggagtagtctgcccattcccattacaaaggaacgtaacgcatctgtagtatgatgtttacggagg

SEQ ID NO: 491 - DNA, 1242 bp, Bacillus thuringiensis
tacatttagtatcgattctttaactctatggcagaaataaaactaattccaccatttacgaaggaagaattagtagaagagttatatcaaatgattgaaaaaaatcagtttcaagaagatgggaatgtatatttacaaatatcaagaggtacacaaccgcgcaatcatgtatatgaatcagatttacaaccgacatattttgcaaatcttgtttcgttcccaagaccagttgcttcaatggaggcagggattaaggtgacagtagaagaggacatcaggtggaagttttgccatataaaatctttaaatttgcttcctaatatcatgatcaaaaacaaaataaatgaacaagggtatcaagaagcaatattagtacgagatggtattgtgactgaagggtgtcattccaatttctttatcgtgaagaataataagttgattacacatccagcggatcatttcattttacatggtattacacgtcactacgtaattacattagcgaaagagttacatatcgatgtagaggaacgagagttttcattacaagaagtatatgacgctgaggagtgcttttttacagcgacgccacttgaaatattcccagtcgttcaaattggtgatgaacagttcggggctggtgaaagaggaccaattacgaaaaaactacaagctgcatacgaagagagtattcgtttgtttaaagtgacaaattaatcatgaagaaaaaagctggtattcttccggctttttttcatgatataattcaagcataggacaagttttgaaaacgctgtaaaaaggggatttaatatatgaattatgaagattttaaagaagtaattcacggaagacgaagtgttagaaagtttacaaatcaagaagtatctactaatgatataaaagaaataattgattgtgctcgttacgcaccgagtgatacgaattcacaaacgtgggaattcttagttatcatgaatcgagagaagattaaagaaattgaacaaatgacatgggatgcattacataaacttgcggcaaaagcagcagaaaatggagaagagaaagcagggaaattacttacacgttctttcggaccatatgcaacagctttctcggaggcaccagtattaattgtatgtttggcaacaccatatgaatcaaagttccgtgaaaagatatttgatccaattgcttttgttccagattccgtttgggaagaagaaggcaataaaagtagct

SEQ ID NO: 492 - DNA, 1107 bp, Bacillus thuringiensis
gcacagcacatacattgcctcccgggatcaacaaataacaaaagaatttagagatgtacttgcattaggaatacgtaatattgtaatagctcctgtaactccgcaagcagtgttagaggaagtgaataagagtttgtatcaactttctttagtaaggcaagttagtttgcagcaggaattgcttcaaacgatgtttgattttcaaaatgatctattatttatagtagaagatgatgaaatagttgattgtaatacaaattttttagcttttttcggatatgaaaatttgtttgcctatcgtgagcaacatttggtatttgctgaacattttattagagaaaatggatactactcgacgacgcatgatataacatggctagacgatactttatctagtggtagaagaattaagatgttaaattatgaaggggcagtatctacttttctattacgtgcgacaccattgccagaagatttatcaagatttattgtaaagtgcacggaaattacagaattagatgaaatctatcaagaacaagaaagacttgctatgatagattcattgacagagatttataatcgtttaaagtttcaacaaatactagaggtagaatgggaaaaggtaatacgtagtgatgagaaaatagcaatcattttatttgatatagataattttaaaacagttaatgacacatatggtcatgattttggcgatttagcattaatacaacttgcagagcttatgaaatctaaagtggagcagcaacatgtatttgcaagatggggaggagaagaattcattatattagtgacaaatacagtagaaaaggaagcatttcaagttgcggagtcattacgattctttattgaaacaaagcaatttactggaatttcgaagttaacagctagctttggagttgcgttatatgaacaaggaactacaagagaagaattaatgcaacgagcggacattgcattatatgaagcgaaaaaaaatggaaagaatcaagtatgtgtgtatagaaaagaaaaaatgtaatttttcgcaacaaattgttgcgatttttttttattgtttgataatagaataggggggataatttttag

SEQ ID NO: 493 - DNA, 1229 bp, Bacillus thuringiensis
gcaacaagtaaaccttctgttccatttaattcttcgaagatgtgctcaatcgcttctaactcactgtaagataatgagctgatcgccatttgaacaacagctttactacgtgcttcctcttcgatttcttctgctttttcacgtaaaatttccatacctacaacagttgagctgtactcagcaaggattaaatcatcatctaagaactcttgaccaagacgagctaatactaatgtacctagacgctcaccgccaccaacgattggtacgattgtagttaaaccttgaccaaataattctctgttttctactgggaatgctgtgtaagcactgttcacatctaagtttgaagatgtttctgtaatgttgaataagctttgtgtatattcttctgggaattgacgttctgcaagcatttgcttcatgcgttcgttttcgatttgttggtgaattgcataacctagtaatttaccacgacggctaactacgaatacgtttgcttcgattacttcacacattgtgtcagacatttctctaaagtttacaggcttccctgctgcgctctgtaataacgcatttaattttctcgtttttgctaataattccatttcaaaagttcctcctacatgttactcacatattttttcatcacttggaaactagggcgagtcacctgatgacactattacaaaataaactggctcacatctttatttttagcaattgttgctaatttctcctcaacgtattgaggtgttatcgttattttctctaacgtaatttcagatgcttcaaacgataaatcttcaaggagcttctccataatcgtatgaagtcttcttgctccaatattatctgtatcctgattaacttgataagcaatctcagcaatcttacgaatagcttcgtctgaaaattcaatttctataccttcagtcgctaataatgccatatattgtttaattaacgcattgtcaggctcgattagtattttaacaaaatcgtctgtcgataattttgttaattctactcgaatcggaaatctcccttgcaattccggaattaaatccgacggtttagacatatggaacgctccagctgcaacgaataaaatataatccgtttttactgatccgtattttgtcgcaacattcgacccttctacaatcggcaaaatgtcacgttgcacaccttcacgtgatacatctacgctattcgtcagcttacca

SEQ ID NO: 494 - DNA, 1741 bp, Bacillus thuringiensis
aatgtccagtgtaccagtatatagagtattagatagtgggagatccaatatagcgaaataagtttaaatacagaaaaaagagcgaattctttataagaggattcgctctttttatattttaaaattaaatttccttccaccaagcggataaaggatagtctgtagattttaacgtaatagattcgccaatttgtggcgttgtaattttaactcctaaacggttagcttctttcgtaacacgttctatcgggtcactccattcgtgtaatgctaacgtaaaagcaccccaatgaatcggaagaagtaattctcctttaacatcaatatgagcttgtaccgtttcttcaggcaacatatgaatagcagaccacctcggatcatattgcccgcattccattaatgtaagatcgaatggaccgtatttatcaccaatttccttaaagtgaggggcataaccgctatcaccactaaagaaaattttagtctcttgaccaagaataagccatgaacaccataatgaacgatctctatctgtcataccacgtccagagaaatgccttgcaggcgcacatactaacttaatattatcaaacgtaatttcgtcccaccaattatgctcactaattttactaggtgaaacaccccatttaataagatattgtgcaactccagttggaacataaaagtgttttgcgcgattttttaactgcataatacttttgtaattcaaatgatcatagtgattatgagaaatgataatcgcatcaatttcttgaaggtcatcacgttctaaagaaaaagcaccactataacgcttactattaaacaagggaaatggggaagaggcatctccaaacatcgggtctaataacagttttttaccttctattttcaaaagagaagcagaatggccaaaccatgtaacactctctaacgcttcattatctttatttgataaaacaacaggcaaatcctttataggacgcagctttgatttcattttaaagtaatccgtcattaaacttataatatctttcggtttaaaactcatatcagtatgaatttggtttgtatatttcttattcattcgttctcctttttacgattaacaatatacgtatgttgatattggagctatttgcagcttaaacgaaatcattttacctttcaccttaaatgcagtacctttcataaatttgacaaattcattattcttatatgcaaaataaaaaccatgtagcagcagataaaatcaatattaagtagatgtaaacttttttaatttagtaaatttcttcttataagcaacaaagaacgtacgtttcgttatatgttatagaagaagataagtctcaaattattaaaaggaaggagaggatgtaagtgcacatagagcgaaaaaagaaatcaaaatgtaaactatcaaaatctgaaataacgcagctatatgcagaggggaaaagcacctcagagatcgctacacttgctaatgtgtctgcaaggtatattcgtatggttttatcagacagcaacgtcccaagggcgcgctatagggaattggaagagaaagtatgacataaaagaaaattattttaaaacttggtcaaataatatggcttatattttaggatttatagcagctgacggcgttatacaaaaagaaaatcaatgcgtcagtatatcacaaaaagaaagttatatattagaagatataaaaaaagaactaaaaacaatcacgaat

SEQ ID NO: 495 - DNA, 1817 bp, Bacillus thuringiensis
  unsure (1)...(1817): unsure at all n locations
atttgtaccgacaagtgaagcaactaatccggtggtaatcgcaactgcaccccatggaccaacaacgtgctctaatacatgccccattgaaggggtttctaacacagaaagttcgcctcttgtcatagctcccattgacaggacagaaattaaaatataaatggacattactaaaataagtcccaatactgttgcctttccaacatctcgactattcttcgctcttccagataatacaactgctccttcaactccaatgaaaacccaaagtgttacaagcattgtatttttcacttgaccaagtatagcggaaagtgagatcgttccttccccccaaaaatcatgtgtaaatgtgtcccagcgaaaggctgttacccattacaacaataaataaaacgattggaactaacttccctattgttgcgatcacattcataatagaagcttcacgaattccaaataaaattaaaaaatgaagtgtccataataaaagtgatgccccaacgatagacgcaacattatttcctcctttgaaaattggaaagaaataacctaatgtactaaacagtaacataattgttgcgacattacctaagattcctgctagccaatatccccaagcactattaaatccaatatattcaccgaaaccagcacgtgcataactataaattccaccttcaagttccggtttttgtcttgctaacgtttgatatacgagcgcaagtggaatcattcccatcgctgtaatacaccagccaattattattgcaccactgtttgctcctactgctaaatcatgcggtaaactaaaaacaccgccaccaaccattgttccaactactaatgcgattaatggaaaaaatcctaacttcttttctatttgtaccaccccatctgtcattctaggtgttatgttcgttcaactattaaagtcacctttttctctaatagacgtttctcttatattttttcaggaaaacattacttattctaaaagaaaatgagcaaaaatggaatacttttttgaaaaaatgtataagtatgcacaaaaaaaccgctcattttgtaatgaacggccatttcaaacatataaatttgtatatttcttgtaaatttaacgaagtaacttctctttttgtaaaaattgttttgcgacttcttcactacttttaccatttacgttaacttcataattcatttttcgcatttcttcatctgtaatctttccagataatttatttaataccttttcaagttcaggatatttctgtaacgtttcttttcttaataatggtgctccttgataaggtgggaataaccctttatcatcttttagcactttcagtccgtattgctccaattcactatctgttgaatatgcatcaattacgttaacatctccagattcaattgcgctataacgcagcttcggctccatcgttttaacattcgagaacttatagttatataatttttgcattcctttataaccatcttcacgatcagcaaattccaatgtaaatcctactttggcttcctgcgcaacattccctaaatcagaaattgtatttatattcttttgatctgctatttttttcggcatagctagtgcatatgtattgttatactccattggcttcaacataatcatattatatttcttttccattccaatgcgagcctgctcatatacttcatcacgatttgtactcttttggttcttctttcacngaaagtagataaagctgttcctgaaaatnctgggtatatatctacttctcctgatttcaacgcttcaatacagtgctgttttc

SEQ ID NO: 496 - DNA, 1298 bp, Bacillus thuringiensis
tttcatgattgttttcataataaaatttatctgctaagcgttccgtatactcttgaatacaatcaaataattcttctttttcaaaataagaaatcgcatctaaaataacattttcaaattcaccagtagtcgcattcattttatttaaaatcatgaatcggtattgatactcttgattttttaactgattacaaatacgtaaccctttatttattaacgactctgctttttctaattcatttagttttaggtattcgtctgattccaagtatagtgctcgaaaatgattaggagatttctttgttacttctgataagtgacggatagctaactcagataaattttgattcgcgtacaataaacctaaattatttctaaccattaatatatatttttcatgattaacttgttggaaaacattcaatgctgtattaaatgtttcttcagcgaactcgaattgttgtaaatcaatataacacaaccctaacatattctcgcacaacgcaagattaatctcataacctggttgttttaaaaaaaactcttttgctgtttttatttgatcaatcgctaacatttgttgatatgattggttatacagatatccataacgatactgaaactccgcatgttctatcggatcggcaatatatttcaataacttctcagcttgctcatactgttctttggcttcattataatttgaaaataatgcgcactgaacccctttacaaaagtgatagtaataagctagaacaccttctgccgggatttcaaaagaagctactatatcaaaactatcttctctaaccccaatccaatcaactaatgcaccatatctaaaattcaacaacgcatgataaagcaatacatcctgatccacgtccaacccactaatcttactttcaatctcctctttcatttccgtggccttctctatattttgctgcaacattacacgataccaatcatctaaagaatgtttcatttgctcccgcgttactacatctgctcccatacactcgcatccccttttctccaaaattacaaaattaggatttttatacaattattaaaattgtatattaccactccttttctatgcattgaaaaataattatcagaaaatttaatattttaattaattacaccaaagttttcctttttaataacttgagaaataattgtcagaaaacttactaggataaataaaaaagcaagtagttccagcactccgctaaaactacttgctctcctacttactatctctatttttactctttaataaattccttcgt

SEQ ID NO: 497 - DNA, 914 bp, Bacillus thuringiensis
gttcgtttcttgtttcggaatgtaaattgtcgcaccttttatatacttttgaatttcagtaattaaacgctccggtaaaacagcattagcttttacgtatttcatttctgctcgccccttattttttatggttcattccaataaggtgcaaagccaattataaaaaatgatacgagctcatataggcgactgtatatcacttgtctacctcacgcaaagtattgccatttccatacttggctttgcatgagacgttgcagtgtctggcaattgaattataatcgccatataaacacctcctaatataccttttgcattttattatatgataaattccttctccttgcatccacacccttcttaaagcacgaaattttatctaagaagggctatcagttcgtaacagtaaatgaattgcaaaaaagagcaaaataaaaaggtagcgtatctttgtatgatacgctacctttctttttatataatgccaagtacatttaagaatacgataataatcgcaattggtgcgatataacgaagtaagaataaccataatacgaatagtttataacctttatttttacttacacctagctctttcattaatacatctttcttcatttttaaaggaacaaagatagaaactaataatacaccaagtggcattaatacgttacttactgcatagtccgctaaatcaaagactgtcttcccgaaaatcttcagatcacttaatataccgaatgataatgctgatggtaccccaacaacgaagattaataaccctacgattaaggccattttttcacgtttccctttaccttttgatgttaacgatgcgacactaatttctaacatcgaaattgctgatgtaatcgtagcgaagaagaataataataagaaaacgatgaagaata

SEQ ID NO: 498 - DNA, 1679 bp, Bacillus thuringiensis
ctcggttttagactcgctaggtcaatttagtaggaacatgctacgaacaactaagaaaagagtatggagaaaatccgtactcttgccaacatagaaacgatttaacgtaaggagtgtttattatggcgcgtgttttatttattaacgctggatcagaaggacatataaatccaactttacaagttgtagaagaattgatttctcgtggtgaagaggtcgtttatttttcaatagaagctttcagggatcggattgagaagacaggtgctactgtacgaacgattgatgatcaaaaatttataaaagcgtttctatctggaggcagaaattatttacaggaaagaataaacggccttctacatacagcggatattgtaatatctagcgttctagaacaaattgaaggtgaacattttgattacatgattcatgattctatgtttggttgtggccatttaattgctcaaattcttaaacttccagccataaattcatgcacatcttttgcgcaggatgaaaaatcctttgagcaaatgttaggtcatctgtcaaaaaatatcccagtagaaattcatgataaaatacagaatgattttcaaaacttaacgaagggaattgctgaaaaatatggtgttgaaataaaatcatcgtatgaagttttctgtaatcctgcacctcttactattgtgtatacaattaaggagtttcagccttttggtgatacgtttgatgaaacatataaatttgtaggaccatctatctctgcacaaatgaaaaacagagacgttgattttacttcaattgaagaaaaaagtccgatttatatttcattaggtactgtttttaatgaagcgattgacttttataaactgtgtatgaaggcctttgagaatagtgagcatacaattgttatgtctattggtaataaaacaaaaataagtgatctaggcgaaatccctaaaaacttcattgtgaaaaactatgtgcctcaaaccgaactgcttacttatacgaaactatttattacacacggcgggatgaacagtacgcatgaaggattatataacggggttccgctcgttgtaataccgcaaagtgcagatcagccagcaattgcaaagcaagtggagagtcttggagcaggagttcaattacatatgaatgaattaaccgtggagaaattgcgtgaaagtgtggagttaattttaaataacccttcatataaagaggctgctttgaatttgaaggaatcattccgaacatcgggtggatataaagaagctgttgatgaaatctttacatttgtaggtcagtaataaatataaagttatacatgaaaaaagtgtctatattaaatgatatagacacttttctgttgtaagaagagaagaattgtttaaatggaaaaaatgaaaatactaaatgtgaattttgagaactaagtctacaatttctgctgcacacttttattttatcccgtattaaccgaccgtaaaaccccaactaattaaagttttactttatgatttcaggatgtggttttatatgttagtaataatttcactgtttctgcacaacttctgcacatgcttaggcgagttctatgtcatgatatattcataaagtgaaatatttcccaaggaaaaaatatattttcactgcggtgaaaacataattaa

SEQ ID NO: 499 - DNA, 1864 bp, Bacillus thuringiensis
tacaaaaaaaagattgtaaatcttataaaggcgtgttgattatctgtcaaattacagaattatctcaagtatacatcttcccaatttccaattcctccaggaattacatctcaacactttcccaaaatacctagcaacgtgtctgtttaaataatacaaaacaaattttccctgtgttcattcaatttcaatatctccaatattcccaatcctttttccatctgaaatatttataacatccttcatctgaaactctaaaattcgtatcaccatttttatcctctcccttatatgacaaattgaaaactgtttctcatatttacaggaagccacctacacgaaacaccatgctagtttcattatatgaacacaaatcccctactatgagcacaaaccatattacatataaaaaggtctcaccataattggtgagaccttatccttgaatcgttttattcatttgtttaatggctgacttctctaaacgtgatacttgcgcttgggaaatcccaatttcttctgcaacttccatctgtgtctttccttggaagaaacgttttctaataatcattttctctctatcatttaaacgcttcattccttctttcaatgctaattcttcaacccactgctcgtccttttgtttttcatcacttaactgatccataacaaagataggatctcccccatcattataaatcggttcaaataatgaaactggatcttgaattgcatctaaagcaaatactatctcttcatgagttacttctagcacttttgcaatatccattgctgttggttcttttgaattttctgcaatcaacttttctcttacttgcaaagctttatacgcaatatctcgcaatgagcgcgatacgcgaatcggattattatcacgcaaatatctgcgtatttccccaataatcatcggcacagcatacgttgaaaattttacattttggcctaaatcaaaattatcaattgatttcataagtccgatgcaaccaacttgaaataaatcgtcaacatattctcctctgttattaaatctttggatgacgctcagtacaagacgtaagtttccattcactaatttttctcttgcgcttatctctccactttgcatttcacgaaataatttacgcatctcttcattttttaatactggaagtttagctgtatcaacaccgcaaatttctactttgtttctcgtcaaagtgttccctcctatcgggagttgctgtacagtgtaaagtatttcctttgaaggggattttatgcatgtggttttttcacgatttgttatttaaattatctttcctaatacaactaaatagaataagaccagcctacataacggctggtcttattctttacaccattttattaaattcttttcgtaatctttttataattcttttttctaaacgcgaaatgtatgactgtgaaatcccaagcatatcagccacatctttttgcgtcttttcctctcctccagcaagcccaaaccgaagttccataatttgtttttcacgatcatttaattggtgtaatgctttcattaaaaggtgacgatctacagtagcttctaaatcttttgtaataatatcatcatctgtacctaacacgtcagacaataacagttcattcccatcccaatcaatgtttagtggttcatcaaaagaaacttccgaacgatttttgttatttcgacgtaaatgcattaaaatttcattttctatacaacgcgatgcatatgttgctaattttattttcttttctggattaaatgtatttaccgctttaaaaggccgaatgttcctatactaatcaaatcttaatattatccctgtattttaaactt

SEQ ID NO: 500 - DNA, 1260 bp, Bacillus thuringiensis
  unsure (1)...(1260): unsure at all n locations
tcgtaattgcacgtgtgcaagatggttcaaactatgtagatcctttatataaaaattatgtacaagcaatgaaagcaaggaatattccgtttggtaattatgcgttctgtcgtttcgtttcagtagaggatgcacggatagaagcaagagacttttggaaccgtggtgataaaaatgcaacagtttgggtagctgacgtagaagtaagaacaatgaacgatatgagagcgggtgcacaagcttttattgatgaattacgcagattaggagctaagaaagtcggtttatatattgctcatcatatgtatgctccatttggaatggaaaatgtcaattgtgattttgtatggattcctcgttatggtggtaacaaaccggcgtatccatgtgatatttggcaatacacagagacaggaaatgtggctggtatcggcaagtgtgatttaaataagctgattggaaataagccgttagcttggaatacaaatcaaattgttgagccgataaaaaaacaagaaggggttggaattatagtgaataaatatagcaaagtagttacttatgaatttggtgtaaatttaatttctgacatgattcaaatgatggataagcttggatatacttctaaaataatatctcgtggagataaccaagggcttgtgtatttcgaaacagattatcgtcaagggaacgaactggacaaagcaactgcttggttagatatgaaaggaattaaatatttttatacaaaagagtagtttgcaaaaataagagccgtcatgtgacggtttttatttttatttaatcttttaactctacttataatatggagaaaatagactaataaacaagcctttgtatactttcaaacatagaatatgatgaattctatcaaggaggaagcatatttatgagaaatacttgtcattgtggacattttcaagattgtaataaattttgggatgatttaatgtttgggagatgtatatgtaagcgcaatgattttcacgagtgttgttgcaaagagaaaccgaagtgtgagtgtgaaaaatgtcattgtaaaacaaaagcgaaatgccattgtaggcatgaagaggaagggtattaataataaaaaagagtacgattggtcatctccctgtcaagtagacagaaataaaaagagtattatgccacggccttttcccgatattctatcggngaatgggcgtgaacgttttcttggatctttctgtttataaaattgaatatattcttgaa

SEQ ID NO: 501 - DNA, 1468 bp, Bacillus thuringiensis
catctacttattggcaaacgtatgcaaatcattttgtgtaagaagaagcattgatttttgtaaatcagctattgataatttcgttgttaaatcatatattttttgattttgtttctctaaatcatctaaatatgctcgctgttctgctgttaatttatttacttcagcaaaaacgccaaatgttttcttaatcttttcggtatcaatggctttcatcaggtcatactcttgtgtttttgctgcggctgcggctgctatttcaccttgtttgcttttctcaattgcttcacgagctgctttttttgctgattcaatctctagagcagttttaccttgttctgtcgcttcttgcgccgcttttttctccgcttctagaatagagttgttaatttcttttcctttgttatacgctgccacccctgcttgagcagccggttcaataatttcttttgaaagactataaacttctttgaatatagcaaatccctgctcatttaaagctcctggtattaatgcaatttgctgtaaatcattttgaattgcttttttggtatttaatatttcattttttaactgatctatttttcctgttccatctgtacttagtatgccttgcgcagttgccacattagtatcaaaatcttttaattttttatcaagctgtaatttaagatctgttaattcattgatttgtcgttgcgcattttcttgattcgtcatagccatttcttgaagtacttcaagtctatccgaaaacccttctctatcttctttattgtctacaaacgattttaatgtcgggtaataactattaaattttgttacaaatcctttactttttgaatttaatagaattaactgtggatagagttccgatgaccattccttcatatcttgtttgattaggaattgattggtatttaaagctgggacttcctctagctgtacattaggactcattaaagattgatcaatatacgtttggactaatttagaatgcgcacctaattttcgtaatgatgaagaaatatccatgttttcttgttgagtttctgcttgaacgattggtgttgcgagagtattgataggaatagtcgccccggtaacaattgatgttattaaaaatcctgtcataattttattcttcattccttacacctcttcactattgttttttacaagttttagtcgtaaatgttgtacaacctaacgttaggatttcttcacacacacttgcggatagaagtttttttgaaagagtaattgcatctcgttttttatttatttttgatagaatataaggtccttacttcccccccattttaatcactatgcttttcataagtaaactagaaaatcgcatatcttatgtttgatttttccgacattaatattttgtttttttctaattatattaaaaaaatttccatactattatcacttcatgaagtgaaataattttactact

SEQ ID NO: 502 - DNA, 816 bp, Bacillus thuringiensis
agtagttatttcagaaatcctaaaagatgcagaagattttgcgaatggaaaagagagcaaaacgacagagcaaacttttgttgcgaacttgttctttgagaatagtacgagaacgagatttagctttgaagttgctgagaagagattaggacttgatgttttaaacttttcagctgatgcatctagcgtacaaaaaggagaaactttatacgatacgataagaacactagaatcaatcggaacaaaagcagtggtcatccgccacgagcaagatcgctacttcgatgaactaaaagatcaggtgaatattccaatcttaaacgctggagatggatgcggaaaccacccaacgcagtgcctactcgatcttcttacaattaaacaagagtttggaagatttgaaggtttgaagattgcaatagtaggagatgttcgtcatagccgagtagcacgttctaatgcagaagcattaacgaagcttggtgcaacaatttactttgcaagtccagaagagtggaaagatgaagacaacacatttggaacatacaaaccattagatgaacttgttccagaagttgatgtaatgatgttactccgtgtacaacatgagcgtcatgatcattatgaaacagacattatgaaagaatatcatgagaaacacggattaacagtagaaagagaaaagcgtatgaaagaaggaagcattattatgcatccagctcctgtaaaccgtgatgttgaaattgcaagtgaacttgttgagtgtgagcgttcacgcatatttaaacaaatgggaaatggagtttacgtaagaat

SEQ ID NO: 503 - DNA, 1421 bp, Bacillus thuringiensis
  unsure (1)...(1421): unsure at all n locations
aattcggatttcttactaaatttgtaataataatggatgataatgtcatattcatatagaacagcaatgggggtggatttaataacattatagctatgccccaaatggtaatcttaataccggataaaaagaaaacagctccaaaaattacaactgaaaaaataaaagttgatattggaacaaacattaaaaatataagagttcttattaagattaactcccctaaaaaatcttttattatgaaaacatgtattttttcctccttgtaattcttcacagtttcaactatttctttctcggataaaagaaaatacttcaatctattaaacataaaaaaactcctttatattaatttaaaaaagattgccctctgtatgctacagagggcaatctttcttgatgattaaaatatatacccaactgttagcaaatatattaaaagacattgtcatcaattcactttaaatttcacttctgggtatttggagtccaatttttcaagcgcagagctatcgtctacctgtttcacatatcgatcaaaaaaagcgagactgaattcgtttataatacggtgaacgtatcttggatcttcatctaagcttcgtaacaaaggagagaacaaatgaaaatcagtgaaactcgtatgattggtatggggaataaccattgacatgccaccacctgcaagtgcatggtcactacgaacttttccctctaaaaaatcttccgtggaatcatcactagtctctgcattcataatcaaaaacggttttccaactctagatttcggaacattttccccatataatgtaccatccatattgatggctgctttgacacgggagtcttccactaacacttgcgcagctgtagctccaccataagaatgtccaaacattccaattcgggatgtatccattcttcctgtaaagcgattatctttatcgctttggttaagcttctctatttgattaagtacaaaaacaacatcttccttccataatttgatatggcaatctcgttcggcaaaatcagttaaattgatcgactgtacaaaagcggttctgccatctggaaagacggtagctgcagcatcataggtatgatcaattccgtgccggatgtaaccgtggctggccatctcctccgcctcaaatgtgttttgattgcgaaatccgcttaaaccatgggaaaagagtaggaccggatcacgttcctctgaatctgacaattgagcttccatgaatgcattcgacttcatcaagcctagatgatgaaacgcggatgctggaatagacaatgatttttccnaaccccttggcaatctcatccgagttatggatataaggtgcgcgattcatctctcctttttccaatgccgcataccaaacctgaaccgtcagcccgaaacaaccgttcaa

SEQ ID NO: 504 - DNA, 775 bp, Bacillus thuringiensis
ttggaaaatcatttgcattttacggttgatttttttcagctctgcgcgtgattttttaccatgtacattttcaccatcgaataacacttcaccagcagttgcatcatataaacgaataatcgttcttccagttgtcgatttaccacaacctgattctcctacaagaccaaatgtttctccgcggtaaatatcaaatgaaatatcattaaccgctttgacaacaccaccactcacgtcgaagtgctgctttacattttttacttcaattaatttctcacgttgtttagtcatgttgttcacctgctttcatttgaagaatgcgtttttcaacgactgccggcggttttacttctggagcttgctcgtgaagtaaccaagttgccgcatagtgcgtatcacttactttaaataaaggtgggtccatttcaaaatcaattttcagtgcctgtgggttacgtggtgcaaaagcatctccctttggcggcttcaataaatccggaggtgttccagggattgcatataactcttcttctgaaccatctaaacttggcatagatgcgattaaaccccaagtatatggatgtttcggattgtagaaaatttcatctacagttccaatttcaacaactttaccagcgtacataactgccactcggtccgcaacgtttgctactacacctaagtcatgcgtaatgaaaatgattgctgcttctgttttttgctgaatgtctttcataagttctaaaatttgcgcctgaatcgtaacgtctagcgc

SEQ ID NO: 505 - DNA, 1037 bp, Bacillus thuringiensis
aactttcaaaacgggatatgattcaaatgagcaagttaaaaagttggagaagtttatcttttctattatggatagttattactattacaatggtcgtaacgatgcctaatatggatcaattagtgaaagaaaaagggaaaattacaatccctaatacaaagcaaagcagtattgctgacaagatgatgaaagagatggataaagaaggggttgaaaagtatgaaattatagccgtttttaatagtggcaataaggcagctttaacagatgaacaaaaaaaggaaataacaaaaacaatcaacgccctgcaaactgaaaaagagcaattaggaattaaggaagttgtttcacatttagacaataaagacttggagaaacaattagtttctaaagataatacgactattttaacgcaaatatcgatagataaaaaacatggtgaaatatcaaaagtttcaaataatcttcatgaaaaagtgcaaacgaaaggggtaaaaacgtatttaacaggaagtgacttaatagcgggtgattttcttaaatcctctcaagagggagtgaaaaagacagaagttatttcaatcattttcattcttgtagtattaatcctcgtattccgttcaccagttgttccaattgtttctcttcttacagttggtatatcgtatttagtttcaatggggattattgcccagcttgtagatcaatttaattttccattctcaaactttacacaagtgttcgtagtcgtcgtcctgtttggggtaggaacacatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggattacaaaccatatttctttagtagggtaaacaggcggattaaaacct

SEQ ID NO: 506 - DNA, 1020 bp, Bacillus thuringiensis
aattcgtgattattgaacaattgaacaagacatgtcatactttttataatacttttcaaaaatctccctcctctttatttgctgaccaaattgatacaacaacaataaaaaattattttaaatacccctccactcatcacaattaagactgatactttccttatttaaaaataaatctatttatttcagcaactaaaaatacatcttaataaaggatagattatcactatgattgcttcatttaaaaataaaactttccttattactggtggatacggttttattggttctcacttggcacgaagacttttaaatttacaagcaaaaattgttcttttcataagaacaccatcaaactcttggagactaaaggatattctaaaatatattgaaacctatgaagtagatatacgagataaaaaacaagtacaagatgcaataaagaaaattaatcccgattatatctttcatctggcagcctatggtgtaaattctgcccatacagattacatccatgctatagaaacaaatgttatagggacttgtaacattattcaagcagcaaaattggtgaattgtaaaaaaatcatcaattttgggagtagttctgaatacggtaacaagatggaacctattcatgaaaatatgttactaactcctgtggacatctatggaagtaccaaagctgctgctactatactcgcccatcaaattgctagcgaaaacaatattaatcttataacattaagaccttttggcatattcggagaaggcgaagagccgcataaaatttttagctatataatcttgcgagtattacaaaacaaagatgtaaatttaactttatgtaatcaattaagagattattgttatatagaaaatgtaatagatgcctgtatcctagccgtagaaaatactactgtacaaaatgaaatctttaatattgggagcggcactattcaccccttgaaacattatgtagaattattattcaaacatttgaaaaccaattccagacca

SEQ ID NO: 507 - DNA, 987 bp, Bacillus thuringiensis
ttttgctactttttcatacgtatcatcttttgcaccttctaatgttggaaggtcttgacgagttaatactaaagcagttggtttgtttgtagattctaaagcaagtctccaagctgcaacagattcgttaccatcagcaggacggataacagaaacgtttggcattgcacgaagcgctgctaattgctcgattggttcatgtgttggaccatcttcaccaacagcgatactgtcatgtgtgaatacatacgttactggcaattgcattaatgctgcaaggcgaattgctggacgtaagtaatcagagaatacgaagaacgtaccaccgtaagtttttaaaccaccatgtagtgcaataccgttcattgctgcacccattgcgaactcacgtacaccgtaccaaatgtttttaccgctgtaatcatctcttgtaaagtctttttcgttattcatgtatgttttgttagaaccagcaaggtcagcagatccaccgaagaatgatggtacagactctgcaattgcattaattacagcaccagaagaattacgagttgctgcttttgatcctaattcataagttggtaggttttgctcccaaccttctggaagttgaccgttcattgctgcttggaattcgtttgctaattctgggtatgcttgtgcatattcacctagcatcgtgttccactcagcttgcgcagtttcaccaacatcttgtactgttttacggaagttgtcatatacttcttctgctacgtggaagtcttgctcagcagtccaagcatatgcttctttcgttaatttcgtttcttctacaccaagtggagaaccatgtgaagctgattttcctgatttgtttggagaaccgaaaccaattgtcgttcttacttcaattagcgttgggcgtttttcgtcagctttcgcttctttaattgctttcgcgattgcttcaatatcgttttcatcctcaacacggattacttgcca

SEQ ID NO: 508 - DNA, 1294 bp, Bacillus thuringiensis
atatatacaaaaattcttttttttactatatacaagtagctacagaattaaggcttaaacaaaaacacgcgtacaaacttgttagaaacccttataaacgagctgtcagttctttcttatcactcctttcaccaccccatatagaacatccggaatggagacctattcgtcaatttctgtacagggatgagaattgtaataagaaaatctcctttaaactttatctatattatttaaaatcttttgattctaattcagacataataaacccgcactatgctccacaatatatacaaaatgaagaacgttttgtaactaattatatctacctagaaaactattctaaggaaatcgcgaaactagaagatcaatatggattaaaaaaatctcctttagatttattggaaaaatcatggcaccatcagaacgactatgctatttttaaaggggactacgcagacgctaacataatagaccccttatttccacggctcccaacatatgatagtttttatgacgccgaaactactcaattagttgaagacatatttaaaacagattttaccatatacaaatacccctttacgccactttaaaatatataatttcttgaatttatatattcagaatatacatgctaattaaatgggatggagcacatataaaaatgtgctcttttatcaaggatttattaaaatctcatattacaaccaacatagtgaatccgaatattatatatttaatgcagaatcttaaagcttttccttataatgagtaaactaaaagaatctcaatcggtcattctaactagccaaccatcagtcttaaatacaaacttatctctgcccttctcaataagtatattattggggtagagacacatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttggtattatacgggggtttctctgtatcgcttgatataacagggatagatgatcttgaatcatcccaattgctttatattcgcttagttctcttttgtgcttttgcacaagaagtggcgcatcttaaacatcggggagaacatataaaa

SEQ ID NO: 509 - DNA, 1298 bp, Bacillus thuringiensis
cggttattttcaacgaaaatattcgatgtctgaacatactaaattaagttttttacaaaatttctaatgagaaagttcttgttatggtgcgattttcgttagctgttagtacgaaaggaacaccggatactgctagaaatgtacgcggtttttctacaaaattttatacaaaagaaggcatttttgaccttttatgtaatcacattcctgttttttctgtccgtgatccgatgcgtttccctgaaacgattcaagcattattgccttcacctaaaaataacttaatagaccctaatagattttggagttttgtcgctaaagcacctgaatctattcattttgttgtccgtttatactctaataatggtacggccaaaagtcttcgccacattccaggacatagtgttaatacatatgtatggagaaatgcggaaggtaatcgaaagtatgtaaagtatcattggtacccgtttgaaggtgtacagtacattactagtaaagaagcaattaaactagctgccgaaaatcctgattatagcgggaaagatttatatgatgctattgaaaatggtaaaccagtggagtatggtttatacgtccagctcatggatccgaaagatgaagcgcacctttcttatgatcctttagatgacacaaaagtatgggatgaacaaacgtatcctctcataccagtcgggaaaatggtattaaataaaaatcctgaaaattttatggaacaagtagaaaaagtcgcattctccccttctaatttactggatggtgcagaactatcagatgataaaatgctgcaagggcgcgctaacatttacagtgattcacaaagaagaagaattggtcccgaatttcgtaaattaacgattaaccagcagcaagattggacacctgctaatcaaattacaaccggtgaagaaaggtacgttgaaggtaaacttgaaagaccttctataacgaaacaggataactttacgcaggctagtgaattttatacgaagttacagccaatagaaaaagaacatctcgctgaaaacttagctagtgatttgaaagttatatccgatgatattaggaagatcgttttggggtatttcaatcgagtatccactgatttgaaaacaaacattgagacaaaaatgaaagagcattaagaagattaaaacatgctttacgaatgagaattcaaatctatattaattattttcttatcaaaatccaatgagattatttaatttaaaaatgtaaagccaatatatccctgttctataataagaacagggata

SEQ ID NO: 510 - DNA, 1976 bp, Bacillus thuringiensis
  unsure (1)...(1976): unsure at all n locations
gtaagtagcttaagtaaacttggtattcattataagattacttatgcaataaatattgcactacgttatattcctgacatccagtctgagtatagaattattaaacacgcgcaagaagcgagaggagtggcttttgaaaaaggagaagcaagtttatgggttcgtatgaagaaccgtgttttaattttctggccactaatcattcattctctagaaagaatagatacggtttcaaatgcaatggatttaagaggatttggaaagaaggataaacgtacatggttttatacaagtaaggcgaaacgtgaagatttcatcgctttatttgccggtattttcatatttattgttgcggtatatttaaaattaaacgtatttcaaaacttttggtatccattttaaagcactctttaaacgagtgcttttacttatttttatgtagacatgctcaaaaaagggatatatacataatgtataatacgaaccagttaaaatgatcaactacctattagttttcaaaccaaaaggaggagaaaatatgagttacggtggttcttgtggttttggtggaggttttgctttactagttgtgttattcattctattaataattgtaggatgcagctgctggggcggaggatactaatttttaattagtcttcacaaatgtaaactaaaaaaacattgaagatacttatgtatcgaaacaaataaaaaaggagcgactatgctccttttttatttgttttaatgcgtattcttattatatttcgggaacgtaatcgttaaagtcgttcctttactaacgatacttcgaatttttaaacttccatgcatcgtctcaataatcttaacagcaaccatcgtacctaaaccggttccttttgtttttgtactaaaatacggttcaccgaatcgatgtatttgctcctgtgacattccaactccgctatcttcaattcgtatttcaactttactattattgatagatgaggaaatatttaaggtaccaccattaggcattgcttcaatactgttctttattaagtttaaaaaacattgttgaaagtgctgtttattaccaacaatggttgcctcagaaaaatcctgtgtaatatgtatcgtattcatattacacaatggcaatatcatattaataacccgatttaactcttgttttattgaaatttgatctaatttttctggagcaggtttggcaaacgttaaataatcatcgataatttcttgggcacgatttaactcttcaagtatatgtttaatatattcgtctcttgactcaggagttaaatttggtgtttttaaaagctgtgtaaatccttttacaaccgttaagggattccttacttcgtgcgatatacttgcagcgagttggctaacaatctccattttttccattttaattaattttgagcgcattaatacagcatcttttataacttcatttatataaacaataaataacatcaaagtagtcggtaataccatgaaataaataatatacaaattattcacttcaaaatctgataaagttaatacaattaaagttgtaaatatggctaggaaaaaggttaaaaacatggaaaaagctactttaagttttctattatatgtattaaattttgaagatgcgagtgctgtaacgatgaacattattccgtaaacaacaacggtcagcatgttaaagccataaaataaaaatcttgtaattaataaaattgtaaacaatatgataccgacagggaatccaccataaagcgtacctattatgaccggaatttgtcttaaatcatgaatacaactttcatccatatagatagggtatcgcatacataaaaatagcgggatactagaacaagggtaatcagtagtatttatatttcttaaatagcgcccgctatcantatgaaataaaaacanattactacataaatgtatgaagatatttatacgtttga

SEQ ID NO: 511 - DNA, 1426 bp, Bacillus thuringiensis
ctcttacagaagaaatgattgagacgtattggtttgatgagaaggatacgatgaagaagaattttttctttaatgctatatatttagtgattttagtgccaaatgcaaaaagttatgagtttcaggtagagaataaaaactttaagataacgagggaagaaatgttatcaattttgcatagaatattcgatgattttccaaaagaaaaagatatatgggataaaaataaagttataaagttctttaacggcaatgaagaaaaaattaaaatgcttgtggaagataaagattttcggaaatctttatttgctaaatatccagtgagccagttgaaataatggaggggagaagatggagttagtatacaaaatttcttatcatagaatgcaggatcattatttacctaagttagtacaggcaattaggctcgttagtgaagaagatttgtggaaacaagagaccgctgttaattcaattggtggaatcgtactacatatttgtgaacatttacagagaaatacaaggcgttataaggattccaatatagtttttgaaaatggaattgaagaatattttccaataaaacatttaagctccgaaactttgttaaaaactgttgaagaaatatttgatgagtggggaaaagtatatatacaagtatgggaagaaaaaaggcatattgatcttcatagtttattacatttagtggagcatacaagttatcatttagggcaaatagtagatcgtacaaagtcaataaagggacaacaatttaacttttgtcaaaatggtataaatgaaaagaatttgagaacaagagttgaaacttcgaaattttagaaagagagtcattcttaaacgaatgattctcttttttgtaaaagaaatttatggaaaaaaacatttttatgtgatatggttaattacataagtaatgaacctatgaacctaaggtggtgaaagtgtgaaacctactctggagcaaaataaattaatatacttacaaattgcagaaacgattgaatctgatattttaaaagacatattgcttgaagaagaacaagttccatcgacaaatcaatttgcgaagatgttacaaataaatccggctactgcagctaaaggggtgaatgtattagtagatgaggggattttatataaaaagagagggatcggaatgtttgttgcaaagggagcgaaagaagtcgtactaaaaaaaagacaaaatacttttatgactgaatatttacctaaagtgtgggaagaagcgaaagtactagaaatatcaaaaaatgaattgatggatatgattcaaaagattacgaaggaggggaaagagggatgattgcacttgaaacgaaagatgtaacgaaaaaatataaaaagaaaatagcttgtaatgaagtaacgatctcatgggaagagc

SEQ ID NO: 512 - DNA, 1216 bp, Bacillus thuringiensis
attaattatatgcttttaactagttcaacattttcttcagcagttgacatctttaatgctttttctgctaatgtttccatttctgcttttgacaacttgcttagctgcgttcttgcaggaagaatagatgttgcactcatactgaactcatctaaacctaatcctaataataatgggatagcaagtgaatcgcccgccatctcaccacacataccagcccatttgccttctttatgagcagcatcgataaccatttttacaagacgtaaaatagatgggttgtatggttggtataagtaagatacttgttcgttcatacggtctgcagccattgtgtattggattaaatcatttgttccgatagagaagaagtcaacttctttcgcgaattggtctgctaatactgctgaagctgggatttcaaccatcataccaacttcaatagaatcagaaacagttgtacccgcttctacaagtttcgctttctcttctaataaaatcgctttcgcttgacggaactcatcaagagttgcaatcattgggaacataatttttaagttaccgtatacgctagcacgaagtaatgcacgaagttgtgtacggaacacatcttgttcatcaagacataagcgaattgcacggtatcctaagaatggattcatttcttttggtaaatgtaagtatggaagctctttatctccaccgatgtcaagtgtacgaacaacgactggttgaccttcttttacaccttcaagaactgctttatacgcttcgaactgctcttcttctgttggaagattgtcacggcccatgtataagaattctgtacggtataagccaacgccttctccgccattatcgataataccttgtacatcatttggtgttccgatatttgcaacaagctcaacgtgatgtccgtcacttgttacagtagcttggtcttttaattttgcccattcagctttttgctcttcaaatttcgctttcttttcttcaaacgaacgaagagtttcttctgatgggtttacaattacttctccatctaaaccgtcaatgataacgatatcgccgttttggattttctccataacaactttcgtaccaacaacagttggaatttccatagaacgagccataattgcagagtgagatgaaagtccaccgatatcattagtgaaaccctttgcatacttacggtttaactgaactgtat

SEQ ID NO: 513 - DNA, 1085 bp, Bacillus thuringiensis
gttatgtgttatatcttattatcgttaatttcttttgtaatcttatttatgtctttgtctaatcgatctaaatagaaaaaccacagtaaactcatgaacacgtaatagatggccatcacgccaagattatcatatatattttcgaatgtggatttagtagtgaaaaaagctccccaaatgatagaaatagtgaggtaagaaagtggacctacgaggtgtacgaaagcatatcgtacctttttaacttttacagcgttcatatgaaaaacctcctttttctaatcatacattcaagttcttcacagaagtgttgtagttttgctggattatgtattaacaagcgtgcatcgtgtttcccgataaatcttcgaatccgaaagtttaataagaaagatcgaccataacgttctattaaatcgttgaacgctggttgtccacttagtagctgaatgttttctctaatttcgaactgtctttcgtgtggatcgcctagtaaaatatttagaatcatttgtagaagtagcaatgtagatctcctcctatgttagaataatctgtatattataattataacaaaactataaggacaatagtaggatgaaacaaaaaacaggagtttgtaggctcctgtttttgtcgatactattttaataagcgaagcgccttctccgtattagcgaaatgcagtttcacaaactcgggtaatcgttctttaccaagcttttgaattaatttagcagcagcgatatcaacttgtttaccagcacctttcggaagtggcataccagcttttttacttagttcgtcaaactgttttacgaatgagtagcgagctaaaatagaagcagcggctactgctaaatggacgctttcacctttcgtagcaaaataaacattttcacgctgtacctgtttttgttttgctaaatatttgtagtatgtatcaggttgtgtgaattggtcgattaagacgccttcaggttttgtaggtgccattttcgctaataagtttgtaatagctttattatgtagcaaggcttttaacttaccttggttgtttcctttatcaaatagctcgttatatt

SEQ ID NO: 514 - DNA, 1298 bp, Bacillus thuringiensis
ttgaagatattagtccgcaggaaataaggctgaatctatatataacacagttaattattatcggtattggctgtttactggcatatatattatttcaagatgtaaaagaagtctttaatttatggaaatgggaaccagtatctatacttattataggtggtttgttagcgattggtattgtgttattagattatgttgcaatgcgagtgtttccggagtcttggtttgatgatggtggtattaacgataagatgtttcgaggaatgtccgttctgcatttactcgttattacgttcttaattggttttgcagaagaatttttatttagaggtgtagtacagactcattttggaattgtaattgcgagcttcgtatttgcagtgttacatattcgttatataacaaagccatttttgttttgtttcgtctgtttcattagttttgtctttggttatgtatttgaatggacaggaaatttgtttataacaatctttgcacactttcttgttgattttataatgggactccaattaagaaaataaatggaaggtggtggtgaacaacatgaggaaacgaattcctgattttgaagaggaattagaagttgagcgagtggaagaaaaagaaagtttaccgccgcgtagtgaaattcatagaaataaagaaaaaaaacaaaagtttaaaataaatcacattttcgtccgggttttaacatttctattcattctgctgccaattagtattttgtggtacacggataaatatattcaggtgaagggtgatagtaataatgccggaaaaagtgcgtttgaagtaatcttctttgattcagctaaatctgagtcgcagaaacattctgaaaaagtaataacgcatactgtgaaagagggagaaactttagaaagtatagcgaagcaatatttttcagatggaaatggaattgaagtaattaaaaagtataataacttgcaagaagatgaagtgagtgcaggtcaagaattaaaaattccgataaaagataagtccgcaaagcaagaaagctagtgagttaagcgatcacagtttgttataaaagcctaggattatctttatgaggaggggagtcaaaaatatgatatggattatattattcagtactctcataggcatggggattttattgcttcttgtgatgtataaagaagcgatgcgtatacggtgttggaacatactttagtatttaaagaaatttccaaaagttttaaaagaaatggttttttatttctgatattatagaagagtcattcgaatttgtaatg

SEQ ID NO: 515 - DNA, 1277 bp, Bacillus thuringiensis
ctaatacttctaaagaagatgttatgaaagtaatcggggaagcaaaggaatataaattggcttctgtttgtattaacccaacatgggtaaaattagcggctgatgaactagctggacatgatgtagacgtttgtactgtaatcggtttcccattaggagcaagcacgactgaaacaaaagcatttgaaacaaaagatgctattgcaaaaggtgcaactgaagttgatatggtaatcaacgtaggcgctttaaaagatggtgacaacgaacttgttgaaaaagacatttatgaagtagtacaagcagcaaaaggaaaagctcttgtaaaagtaatcattgaaacttgcctattaacagatgaagagaaagtacgcgcttgtgaattatcagtaaaagctggtgctgacttcgtaaaaacttcaactggattctcaactggcggagcaactgctgaagatatcgcattaatgcgtaaaacagtaggaccaaacgttggtgtaaaagcatctggcggtgttcgtacacgtgaagatgcagacaaaatggtagctgctggagcttctcgcgttggagcaagtgctagtgttgcaatcgtattaaatgatgcaaaaggtgctacagataactactaatcattaatgaagtgaagagcaatagatacacaaagtaaagtgtatctattgctttaataattgaaaaaaatgtaagcggatacgaatgggaggagacggcttatgaaatacttaattggtatttttggcctcgtattgattttaggtatcgcttggcttgctagtaataatagaaagaaagtcaaatatcgcccaatcataacgatggttatattacaatttattttggggtttttattattaaatacaagtgtagggaatatattaattagcggaatagcagatggttttggagagttattaaaatatgccgctgatggtgtgaatttcgtatttggtggattagtaaatcaaaaagagttttcgttctttttaagtgtattaatgccaatcgtatttatatcagctttaataggtattttgcaacacattaaagtattacctattattgtgaaatctatcggtctagcattaagtaaagtaaatggaatggggaaactagaatcatataatgcagttgcttctgcgattttaggacaatctgaagtgtttatttcagttaagaaacaattagggttattgccagagaaaagaatgtatacattatgtgcatctgcaatgtctaccgtttcaatgtctatcgcc

SEQ ID NO: 516 - DNA, 1524 bp, Bacillus thuringiensis
cccaacaaacggtgtataaaatccccttttgaaacttccatcttaataatataatcggaaaatccatctttaaaagcttcatatactaaatcaatatttacttcactacaccttttatattgaatcatataaaattgccctccaattgcttgtattaacctcaacgtgtacccatataatatattccatctattataaatttcagctcttaatttgaaatgaacggacatttccctacatataactcacttttaatttgttttataacaaactatctattatttactacattaatctcataaacacgcaaaaaagcaattaaatgctcacatgctctttcgcatgctagcattttaaagattttttgttcttctttcgttttatcattagcctgatctgaagcagcttttaaacagagaaatggttttttatttatttgacacacataggcgaaagctgctacttcttgatcaactgccaatgctccatatacggtatggagtaaatatctcatttccgaactacgaatacgttgatctcctgataaaaatgtgccgaaatgtatcggatcatacgatcgtattttttttattcttcttacaagtgattttgttgtttcaataggtgctgttctaccgttatataaattaaaaacatcttcccctgaaccagcagcagtacattcgtgttgtattgcgcttagtgccactacaatatgaccgttttgcaccttgtttgataaacttccgcataattcctgtcataaacaactcatctggctgaaactcactaattaacaattgtacacaactagcgcagcttactttaccgacaccagtaacaactgatataatttccagctcattaatagtatgaaaatgaaattcccgagctgctcttttttcaacacgttcacttggataatgttgatgcaaatacgtcagttctggttcccatgcagatacaattgcaatacgtttcattacacgcttcacttcccctattgtcatttaaatgagttatctatactttctcattcataatctggaatccattctttgtatttcttatataaatctcgtattatttctttattcttcgcaattacttcacatcctctatcatcatacataaacatgacaatatctttcgttgcatttatgagaaatacatttggataagaaatttctttttttcgtccaaatcgaggatataaatcaaagaaatcctcatgattagcaacttgtataagcgattcatatttaatatgttccgcaaggcattttaaagaaaaatgatatgtacaatataaatctgcttcttcatcttcaaataaaaacggtaacgtttcttatcttatatgaaatcttaaatctcttctcttaatatatttattgtatacatttattgtctgtggagtttttatattttcctttttaaatctataaacatttgtcactaagaatataagtagggtactaatgtaactcctggaaatgtttgattcatatattcttttaattg

SEQ ID NO: 517 - DNA, 1588 bp, Bacillus thuringiensis
gcttctatttcttatcataaccaatggtggattccccacaatgaacaaggtgctttcgaagtgttaggtagttacggaccaaccactttacatcgatccgaaaagcaaatatggtaatcgcccacttctcttctaacgcaacgccaagtaatgaaatacattcggtttattcaaatatgtatattgatattgcacattatttagaaaagcttccacagtagtggaagctttttcttgttgggacattttatttatactcctacatattagaagatactgaaagaataactgcttaaaacacgcctatcaaaatttatataagcagtttacatgtttaattaagtgtttaactaatacatccacaccttttggagaattcgttaaaacacttcccttacaaagattgtctgttcatattggtcgaaaatttcttctatagatgaaaataaagtttcttccgggatgatgaactttattttttgaccattttttaacataaaggaaattgttccattatcattaaaacctgtatgaaacgttcctcgtttatttaatactacctcttcaattgtatttatttcaattgaaaagttattctttaattgcaagagttcatgtacatcgccagtatgtatttttgtatctatttcagtttctaagtttaattgttttttctcaatttttttgaaccagaacaaaaacaatagctctgaaataccaggtaattgttttttataagcatatcgactatgaaactgtccgccaatctttataaaatatatacagtcacctgtaataaaaactttataatacatatctgccgtaaacattttaggctttaaaagataaaaacttttgatcataattcccccatcaattttaaatgtatttgtataaacatttttagctagatttgtgctaaaacatatttctcatgtaatacaacactattgtattgaatctcctctccctttgcaacagttgctttgaagccagctagtaacctttctgtatactatccctataagtgctaccccatttccaaccgttttcttctagtatattaaaagcagaatctgatacaaggctctatatcaacctatcaataaattatcaccctataaatatctgaattttctttatattagaggttatctcctaaacaacctcgaataattgtactacatatacataaggagggtgatctattttgtttcgttcctttacaaatggttgcgtcgccttagtgcaacgcttcttgccagaaccgtttattttatcatgtttactaactgtttttgttatcttctttggtatgtttgcgactcaccaaacccctgtagaaatgattaatcactggggtaatggaatttggggactcctcgccttttctatgcaaatggcacttgtactcgtgactggatctgctttagcaaatgctcctcttattaaaaagggattaacgaaagctgccagactaccaaaaacgaatggacaaggcattattgccatttcaattgtaagtttacttggtgcatacataaactggggctttggaattgttgtataaattttatacgcaaaagaa

SEQ ID NO: 518 - DNA, 723 bp, Bacillus thuringiensis
cgttttgtaaattattatgtatatattcatttagaaacgacaaacggagcgtatgcatcacacataaatgaaaagatgatgacagttggtgctttcattcgaaatgcgattatccgttttgaacgcgggaagataactggaacaaatccataccgagttggtttgaaaatggatcacggttgggtatatgctgaaggtattacgcactgggaagtagacgatcaagagcgtttattattagctggacatgataatttaggtcgtctagcagttgcacttgagttaagcttaacaccatttaagtaagaaggagggaaacttatggagagacatgtacttgttgtatttccgcatccagatgatgaagcatatgctgcgggaggaacaattcgcttattaacagatcaaggagtacctgtaacgtatgcatgtggtactctaggacaaatgggacgtaacatgggtaagaacgtattcgctaaccgtgaaacgattccacatatccgtaagaaagaattgaaagatgcttgtgaagcgatgggtattaaagatttaagaatgcttggcttccatgataaaacgttagaatttgaagatgttgatttcgttgctgacaaaattgaagcaattattcaagaagtaaatccatctcgaattattacattttatccagagcacggtgtacatccagatcataatgcatttggccgcgctgtcgttcgc

SEQ ID NO: 519 - DNA, 1351 bp, Bacillus thuringiensis
taaaagatctcattgaagtgtaagcattacttactttcaactagacatatcagtttagttgacttttttgtattttcattcagatgcatttattttaaatcttcagaaattataccaaaaaacagaagacgttgtaaactacaacgtcttcttatctgttaaatacgtataaatcgtctccgcgacatttttcggcatacccgcttcgacaaattcctctatagaagcttctttcatcttctttaatgaaccaaaatgttttaacaatacctttttccgtttatcaccgattcctggaatatcatccaatgctgattgaataacagatttcccgtgtaattgacgatggaatgtaatcgcaaatcgatgcacctcatcttgaatacgctgcaataaataaaattcttggctatttctctcaagcatcacaggttccggtggatccccaataattaaatgggaggttttatgtttatcatcttttacaagacctgccatcggaatatataatccgagctcattctctaaaatatcacttgcagccgctagatggccttttcctccatcaataataatcaaatcaggtaaaggtgaattttctttaagcgcccttgtataacggcgcctcacaacttctctcatagactcataatcatctggtccttgaaccgttttaattttatattttcgatactctttcttcgccggtttcccatcgataaaagcaatcattgcagaaacgggatttgttccttgaatatttgagttatcaaacgcttcaatacgatatggcgtttcaatcccaagctgcttccctaaatgatctaccgctttaatcgttcgttcttcatcacgttcaattaagtaaaacttctcttcaagagcaatcttcgcatttttatttgccaattctacaaggtcttttttcttaccacgtttcggctgcgtcgcttccacttctaaaaagcgctctactaattccgagtctatacttcctggaacgacaatttccttcggcttaaaatgactactgttttcataaaattggccgataaacgttaaaaaaccctcttctggttcatcgtaaattggaaacatagaaacatcacgttcaattagctttccttttcgaacgaagaaaacttgaacacacatccatcctttatccactgcatatccaaacacatcacgatccactaagtcactcataatcatcttttgcttttccataatcgcatcaatatgagcaatttgatcacgcaactcttttgcacgttcaaactctagtttctctgaggcctcatacatttttatttctagttctgaacgaacttctttatgtccaccattt

SEQ ID NO: 520 - DNA, 705 bp, Bacillus thuringiensis
gtagcagttttattttttaaagtcaacttggcatcttgctttgtaaaagtaaggtcaatacgtgaaatatgtgttccatatttatctggttctgtaataattacgccatttacaacttctttttttacaagtttatgcatgtgagccgcaaaaatagcgcttagttccggacaagcatttgcaatatcttgaacaccagtaccagggataccattctcattttctaatcccatatgcataactcctaccattacatctactttaccttctaattccttaattgcctttttcgtctcttctaccggatttttcaccactaaaccctctaagtgatctgtccctttttcaaaatcactaatcattggtgtattcataccaataatcccaactttaattccacctttttctacaattgtatatgcaggaagaaagcgctctccattttccttataaatatttcctgctaacgtttttcccttatattgctcactaacttttttcaatgtatctaatccaaaattgaattcatgatttccaaatgcccaggcgtcatatcccattgtattcatcgctaccatcattggcgattgtggtttatcgttgaataattctactgagtttccttgaattgtatccccagcatctactaatatggtatttggattttcttgacggaccttctttataaccgtataaagctgcgtc

SEQ ID NO: 521 - DNA, 1127 bp, Bacillus thuringiensis
attttacatattaatagccgattcttatttagaatcggctattatatttaaatgataaatacatatatactatttataagtgtttctcttgtaatgggattaagcctcaaccttggatactcgtttgaaaccagtctttattgcttgtactatttcgttcacagcataaatagatacatcggcatttggatttaacccttcaaaccagtgataggcatttggatataaatgaaactccacatcaacaccagcttgtgctagtttgcttacataggttaatgtttcgctgcggaatggatctaattgaccaacaaatgtgtaagtatacggtaagtcactataatcctcagctcgagaaggtgctgcataggcagggatttgatccgttccatacatttctcctaaatacattttccagccagcttcatttgccttttggttccaaacaaatccctctttaatttcattcgctgaaggtgtatcatttctgtcatcaatcattggatatagtggcatttgtaaacaaattgaaggatattttcgatctcgtgctaataatgataatgctgctgttagtccaccgccagcgcttactcctgcaaccccaattcgattcgaatcaatgtttaatgactttgcattatcagcaatccattttaaagctgaataacaatcctcaattggtgctgggtaagggtgttcaggtgctaagcggtagtctacagacacgaccacacagctagcttcttttgcaaacctcatacaagtatcatcgttatcatctatagaccctaagatataacctccaccatgtatccataataagacaggtaaagattcatgatttgattttggacgataaattcgtaatggtaacggattatcatcaggcccaacaatgactttatctgttaaagaaagagagtcatcaacaacggtaggtggtctcatttgagctattccttctctgattgattgcaaattttctgggcgtaaatcgagatccggaaacatctctaatcccttgtaataattctggatttactctagttttcattttagcacctctatttgtaattgtttcaaataaatgaagtgtattctaagtagtttaattgtgaaagaac

SEQ ID NO: 522 - DNA, 825 bp, Bacillus thuringiensis
tcctataatccaattataaaaagtataccgactaagctcatcttacatcccctccttctaagaagaagaatgaattaaatgaataagtttacattcccatccgaagcatctgctaaataagctcctactcctgcaaactctaccccttccataatctcttcctcttttaaccctaataaatctactgtcatttgacaagcgacaagtttaatcccctgttctttcgccaaatcgattaaatctggtaaaggcatcgcattatgttttttcataatacctttaatcatctttggtcccatacctgcaaaattcatttttgataatcccatcttatccgcaccgcgtggcatcatttttccaaacactttttctataaaagttttctttaccttcacatgctcatctttccttaaagcatttaatccccaaaaagtatgaaaaatagttacctcttgatcatacgccgctgcaccatttgcaataatataagcagccattgctttatcataatctccgctaaataaaacgattgttgttttcttctgttgttccatgttgttctccctccgattacctataggggtattttatcatttataaaaaggctcaaatcatgtatccctgtactatacgactttaccttcccatgctaacataccacctaccatattaattgcttgaaaaccgtagctctctaaaaactgaactgctcgtgcacttcttccgccagaacgacaaacgataatatactccttctttttatccaactcatgcatacgaaactctaatagtcctagtggaatattacacgcttctggaattttc

SEQ ID NO: 523 - DNA, 1737 bp, Bacillus thuringiensis
ggtaccacgggttaaaactcgtctcttttttagagacgagttttttgtgttttaaaaaataaggaggttgtatcatggattataaaatgcagtttgcggaaagtttatctaatattttcacgaatgaattaacgcaaaaacaaattttagatttaattgaaacaccgaaacaagatgaatttggagatgcagcgttcccatgcttttcattagcgaagcaatataaaaaagcaccagctcttatcgcaaaggaagttgctgagaaattaaataatccgttttttacgaaagtagaagccgttggtccttatgtaaatgtatttttcaatcgtgaaactgtaagtgatgcagtattaaaaacagttttagcggagaaagaagagttcggtcaaaaccactttggctgtgaaaaaacagtagtaattgattattcctctcctaatatcgcgaaacctttttcgatggggcatttacgttctacaatgataggaaattcgctgaaacatatcgctgaaaaatgtggctatgaagttgtagggattacttatatacgagattggggaacacagtttggaaagttaattacggcttataaaaaatggggaaatgaagcagtagttaaagaagatccaatacgtgagctatttaagttatatgtccaattccatgaagaggtaaaagacgacgaagaactagaagaagaaggacgtgcttggtttaagaaattagaagaaggtgatgaagaagcggtagagctttggaattggttccgtcatgagtcccttaaagaattttctcgcatctatgaacttctcggcgtataatttactaattttcagggagaagcattttataataatttaatggaggattttattgggattttagctgaacatgagttgcttgaagaatcagagggggcattagtcgttaatttagaagaagaaggaatgccgccttgcttaattagaaaatcagagggggcgacgatttatgcaacgcgtgacttaacggcagctttatatcgtcaaaacacttatgggtttgataaagcgctatatgttgttggtccagaacaaagcttacatttcaatcaatttttcaccgtattaaaaaaacttggctatacttgggttgatggtatggaacacgtaccgtttggcttcattttaaaagatggtaagaaaatgtcgacacgtaaaggaagagttattttacttgaagaagtactcgaagaagcaatcgaacttgcaaaacaaaatattgaagagaaaaatccaaacttaaaacagaaagaagaagtagcaaagcaagtcggtgttggtgcagtcatcttccacgatttaaaaaatgagcgtatgcataatatcgaattctcattagaaaatatgctgaaatttgaaggagaaacaggaccttacgtacagtacacacatgcacgtgcttgttctattttaagaaaagaaagtgtagaatttgaaacatgtacatttgctttaaaagacgatcatagctggagtgtcgtaaaattactaaataaattcccgcaaataattgaagcagctttcaataaaaatgagccatcgattatttcgaaatatatattagatgtagcacaatcattcaataaatattacggtaatgttcgtatattagaagagagcgaagaaaaagacagcagactcgcattggtttatgctgtgacggttgtattaaaagaaggattacgtttacttg

SEQ ID NO: 524 - DNA, 1685 bp, Bacillus thuringiensis
agtagcagctgttttcatttagcagttttttgcttcccacgttttaatatatctagctattcatgataaccgtaggtgtttgctataagcctgtagagtttataagctcatcgttgcttatcccgatttcctaccgtcagattcgtacttctcggtaccctaccacactcttgtgtgctatacctttcggtatagtgcaattttagacccgtaccttcgcatattcgacagacccataagggacattctcaccatagctatgttttcagccatccgacctatcctacaccatatgattaaaaatcacttaggctcgttcagccgacttcacctagcttcatacacaatctgtctactaacaaatcatgcatgtaggagtattaatggagttgtttcaattcaacatgacgattttcattccaactctcgatatattagttattgttgcttaagataaatttcagcaacactctcacttcacgtctaaacgcttatagagaaacgtgtcgcgcccaaagattgcatcgggtttgctaagcgctcataaaaagaacgatgtgtaaaataacgaaacactaaataacttcccataaagaaagcccctagaaacattgcatataacgccgttgtaatatgattatgcccatcaaaccaatatacgagaaatatagctagtagttgaattatagtaaagcaaataagtggtatatgatcacgtataaacaaccttatcatttttctataccagtatcccaagtaatatgcaatctatatccaacactacgaatcgtttcaatcgcaccttctatatgtaacgtttgtaactttttacgcacacgtgttgtatttacacttaatgtattatcatcaacataagattcactatcccataatttattaagtaacacttctctactcacaacacgcggataatttttcattaatgtctctaataaaatagcttcgtttctcgttatatcaatctcttcatttctaagtttcaatacaagtctttcaggatataaacaaaggccttgttgctcaatcattcgctcttctagtttcggtgcataatctccatatgcacgtcttaaatgactacgaattttcgccactacaacttcataatgaaaaggcttcggaataaaatcatcgccaccattttctaacgccataacttgatccatcgtgccttcacgggccgaaatgaatagtatcggacatgtagaaactccgcgaatttgacgacaccaaaagtacccatcaaaactcggtaaattaatatctaataaaactaactctggtttgttcttctaaaaaaatgtttaatacattttgaaagtccgatacaataactccttgataaccatatttcccaacatgtgtcgataatagttctgcaattttcatatcgtcttctacaatcataattttgaccattattgaactcctttttaatccacaatctcaaatatacttatataaaataaatactacctcttttcacaaaatccgtaaattaaaaaaggatgcttttatacaaaagtatcctttttcgtcccttatctatttaatatgaaatttactaaaagtaaatcctaagttcttcacataatccatccctaattccatacgcgccgttttcaacggatccacaacttggcaaacttttaaattacctgctg

SEQ ID NO: 525 - DNA, 1931 bp, Bacillus thuringiensis
  unsure (1)...(1931): unsure at all n locations
gaaactattacagcatctgcttacaggttcatataaaataatagagctaaacgaatttgaatctactcgtgcaggtgtccaattcatattaaaagtagaaatacacactatatacaattttattttaaccaatatcggtacaggtacttctatccattatgtttataatgaacaatatattcgcgctggtggaaccggagttggcggtgggactattatgggactttcaaaattgttaacaaatacaaatcattttgaagatgtaatccctctaacaaaagtaggatctagaaaagaactagatattacggttggagatatttatagtggtattctttcccctatcgataataacttaactgctagcaattttggtaaagccgctatttcagaatcgaaatataatagctcagacatacttgctactatacaaggacttgtcggtgaagtcgttactgcattaagccttcaattcgctgaaacaaaaaacattaaacatattatttatattggttcgactttatgtaataacgtacaacttcaacatattataagtagctacaccgaatatcaaaataaaacaccaatctttttacaagatggtggtaatagcggtgcaattggtgcattacttcatgctacgaaataaaaagctgacttttgtcagctttttaaaaatggcacttcaaattcaataattgattccccgttctctccaattcgctccacgcttattctatcaatcacacaatttaacttcccatgaaaactaggaatctccttcactacttcagcagctaatttggcactttcttttcttccgactgttacatgcgggatgtacggaatgtcttctttcaaaaattgtaataaaggtcctgtatacagcctatcatgtagttcttctatttgttttcttcctctatcaacttctaaaaacaaatagtttcctacgctaatgatacgatttgcaaactcaatttcaattttgcctcccccttttgatacattaaaaatatgagattttaattcatcatttgaaatattactcttaaacgggaatacgattgttatatgcggtggaattaatccaaataaaggatcatgtttatgtctaatgttctctattttatcgatggacatgttgtttagaaaaagtaaaattgtacgcatttttatcccctcaacttttcctcattataatatgtatcatattctatgacagcctgcccttcaacaacttgttttgcttacctataaaaataaaaaaacttctcaaatgagaagttttcatatagcatgattattattttcccgccaaactttcctaaactttatataacaagcaattctccatggaataatatacgagacagcaacaacgtaaaataataaaccaatcgtttgttgatctaaatcaacgataaattgtcttgaaccatatttttaaaacgacaagtgcaataaaagtaattaaaaaagctgcactttttttcgtataaatattcccatcatctcttcgctcataatttgttagtgctataagtggtacagagaaaagaatcccaataaatgctgctatagccacttgtagtacagctggatgtacgggacctaaaaaccatacaatacctggtgttaaaaatagtaatggccataaaatacgttttcccgatccctttattggcttatacatggagcgataacgacgccaaaatattagtagtgcaatgcataaaaaaacggttattaatgaagaagtatctnccattcactcttccttctcccctaaaataattgtatttaaattgtatcttcaaacgaaaccttacgaataaatagagcgctaattacaatatatatgccaataagaactattgaaactaatatgaaattaggtatttctagtaacattttactattaataaaca

SEQ ID NO: 526 - DNA, 1307 bp, Bacillus thuringiensis
tggttcttcttcaaatgaacgcacaatttctggctggtttttataatcttttttcgcttgattttcacgtactaaatccattgttttctctggatcaattgcacccacaacaaataataacatattgctcggatgataaaatgtttcataacattcatataataaatctttcgtaattttactaatagattcgattgtccccgcaatatcaattttaattgggtgttttacaaataagctatcaattaacccaaagtacaaacgccaatctgggttatcttgatacatttgaatttcttgcccaataatccccttctctttttcaaccgttttttcagagaaatagggctcttgtacgaagtttagcaatgtatttaaattttgttctacgtttgaagtacctgaaaaaaggtaagctgttcgtgtgaaggatgtaaaagcatttgccgatgctccttgtttactaaacaattggaaagcatcatgatcttctttttcaaataatttatgctcaagaaaatgtgcaatcccatctggcacacgaatcatttcttctttccctaatggtacaaatgtattatctacagaaccatatttcgtcgtaaacgttgcaaatgttttattaaatccttgtttcggtaaaacatatacatctaatccattaggaagtttttcataatagagtgtttcttttaattgctcataaacaattttctccacttactctccctccgttccttgtaaaaagtaaattgtatctagttcaatatttttagcaacttttacaatttcttcttttgtcacactttctatacctgtaagccattcttcaactggacgtgtacgatctgaaataataccatgatatagcatttctacaaagccacgtggtgtatcaattgcctctaatatttgattttggatgacactttttgtttgatgtatttcttcttcagaaaactctccgttttgcatcgcaagcatttgttctttaataatctcaactgctttttcataatttttcgcttcaattcctgacataacaaataataaacctttatgactttcaaagcgcgatgctgcatagtacgctaaactatttttttcacgcacatttacgaataacttcgaatgagaaaagccaccaaacaatccattgaacaattgcaatgcaaaataatcttcatctttatatgtgacaaatgtacgataaccgatgtgtaatttactttgttttaattcttgtttttcaacaacttctttttcttcattatttcgtctatgaaaaaaaacatttctttctctca

SEQ ID NO: 527 - DNA, 1314 bp, Bacillus thuringiensis
attggttatatccccctttaaagcgttttcattttttttttattataacagacttccgcaaatggttacgacatttttctgttttttctgaattatttctttggaaataattcagaacgataaaaaacatgttttgaatacattgattcgaaacatgttttttatcttttataaactatctaccttttttcttactttctttttcagtttaaaaataaaacgattactgtattccttattttctactaaaattcgatatatctcccatactcctaacacacgaacaaaaagataaactccgatagcaataagtacaacacagtacggataatactgaactaattcccctgaagtgatatgctttttctcaaacaaaaacgggatcgcgcctgctgctataaaacaaaatccaacgatcattaccgcggcatacttcttcttaataatcacatatctttttgtcaattcttttagaaagttttgatcaaatagtagttcttcctttttcaatacattgtatcgactctcttctatcgttacaggtgccatcattgctccaattccaagaacagcaatgataatgacaagaaatgtcgacattgttgcattttctttaaataatagatacggtattgtagacaaaataagcaaactaaaccttaacgctatatattttgaaatcttttgtccgtacactatatacccttctgccatttcctgacttacgtaatagccatccacattttcattactttgctctgcagtttcttttaataaatagtcgagtgatacttcaaaaacatttccaatcattattaacttttcagtttcaggaaaaccttgaccgttttcccatttactaaccgcttgccttgttgtgtttaatttttcagctaatgcttcttgagaaaggcccttttcctttcttaatttaaaaagcttttcaccaaatcccatatgtgtgcccccctttgttttcttacctaaattgtatgtagacattgcccttatctctatcttcccggggttgcactttgtcaacttacggttgcgattgtgttatttagtggttttatagacgatttagctattttccttctatgattatggcgttaataaaccaagaccccttaacaaccaattataacaattaaaggtaattattgttatgaaaaataaaaaaactcctttattcatttaaaggagttttttatatgaaatatttcatttatccatatatctttctcgagatatacaatatcttttcgtgtcacgatacttacctttaatgaacatatccttttgaatcgtgca

SEQ ID NO: 528 - DNA, 1178 bp, Bacillus thuringiensis
ccatttaggaggcgactgtggtaaaggtgcagatgatgttctcgtagggggggaatgcttacgtacattggtggacttccgctaccaacgtcattttaaagctgatcgtggtcagcacggtatgagtaaaggtcagtacggacgtaaatctgaagatttacttgtaaaggttccaccaggaacagtagttaaagatgaaaaaactggtcaaattcttgccgatttagtaacgcatggacaaactgctgtaattgcaaaaggtggccgcggtggccgtggtaactcacgttttgcaacagctacgaacccagcgccagaaatcgctgagaacggggaaccaggtcaagagcgtgatgttattctagaacttaaagtactagcagacgttggacttgttggattcccaagtgtaggtaaatctacattattatctgttgtatcatcagcgcgtccgaaaattgcagagtatcacttcacaacaatcgttccaaatcttggtgttgttgaaactggtgataaccgcagcttcgttatggctgaccttccaggactaattgaaggcgcacatgctggcgtcggacttggacaccaattcttacgtcatattgagcgtacacgtgtaatcgtgcatgttattgatatgtctggtttagaaggccgtgatccatatgaagattacgtaacgattaataatgaattaaaagaatacaatcttcgcttaactgagcgtccacaagttgttgttgcaaacaaaatggatatgccagatgcagaagaaaacttacaagcatttaaagagaaagtgggagacgaagtaaaaatcttcccaatctcagctgtaacaagacaaggtgttcgtgacttattgtttgaagtagcgaacttaatagaaacaacaccagaattcccaatacatgaagttgcggatgagtctgatacaagtgtaatgtacaaatttgatactgaaggtgttaaatttgaaattacacgtgaaagtgatggcacgtttgttatctctggttacgatattgagaaaacattcaagatgacagacttctcacgtgatgaatctgtacgtcgtttcgctcgtcaaatgcgcggaatgggtattgatgaagcgcttcgtgcacgtggtgcaaaagacggagatattgtaaaaatttcttgatatgaatttg

SEQ ID NO: 529 - DNA, 1083 bp, Bacillus thuringiensis
gcgaaacaagacattaacttaatggaaacacaagaaattccaacgatggatccagcgtcatcagctgacgcagtttcctcaagagtaacgactaatacgatggaaggctcatacagtttaggaaaagatgataagctagatcctggcgtagcgaaggaattcaaaaaagcagaagatggtaaaaaatatacatttaaattacgagaagacgcaaaatggtcaaatggtgagcctgtgacggcaaaagatttcgtatatgcatggcaaagagcgattaacccagatacagctgcgaaatcagcgtacattatgtatgatataaaaaatgcagagaaaattaataaaaaagagatgagtccggatcaattaggggtaaaggcgattgatgattatatattagaagtggaattagataattcaattccataccttgtagatttaatggtatatccaatcttctatcctgtgaatgaaaagtttgtgaaagagcaaggtacgaagtttggtttggaagcgaatacaactctttataacgggccatttacattaagtgattggcaacatgaacgtagctttaaaatgacaaagagcgcgtcatattgggacaataaagaagtgaagattgaagaagtaaactttaatattgtaaaagatacatctacgccaattaacttatatgaaacaaatgcaattgatcgagcgtcgttattagcggagtttattgataaatataaaggaaaaccagatttccaaacagtagaagatacatctgtattcttccttcgtttaaatcaaaaagatccagctttagcaaataaaaatattcgtaaagcaatttcacttgcttttgaccgtaagccattcgtggatacattattaaataacggttctaagccagcgacaggattaattcctgataacttcattaaaggaccagataaaaaagatttccgtgctgtaaacggggatattgtaaaaccaaacgtgaaagaagcgaagaaatattgggaagctggtaaaaaagaacttggtaaaaatgaaatcgaattagaattattaaatgaagatgtagagttatcaaag

SEQ ID NO: 530 - DNA, 1913 bp, Bacillus thuringiensis
aaaatttaatttctatgcgataaaatatacagcaaatcaaaacataataattacattagaagatagaaataaaagtatatatttccaaataaaaaatggcattcctacggataaaattaaggatatcgagaaaatttgggagcctttttacgtactagaatcttctcgtagtaaagaaaaatcaggtacaggattaggtctagcgatagtgaaaagtattttagaaaggcatggttttgaatatggagtttcctctatagatggagaaattcaattttatataaatgtgaaaaaggactaatgaaaatattagtcctttttgcagctttagagattagcgatacaggatgaatcaccataattttcaaaattgatgtattaaatggagaattagcaaatgttctactttcattaaattcacgtgaagttcacaggaaaacgttatatttacatagttatatttgaatttaatgaagtgaggtattcagatttgaaaagaaagaaattagtaattggtagcattttaatggggatgacgttatctttatctgcatgtggttcatcagataatattgtaacgacaaaatcaggaagcatttcagaaagtgattttaacaaaaaattaaaagaaaactacggtaaacagaatttatctgaaatggtagtagaaaaagtattaaatgataaatataaagttacggatgaagaggtaacgaaacaactaaaagaattaaaagacaagatgggcgataattttaatacatatatggaatctaatggtgtgaaaaatgaagatcagttgaaagagaaattaaagcttacttttgcttttgaaaaagctattaaagcaaccgtaccggaaaaagatattaaagatcattataagccaaagcttcaagttagccatattttagtaaaagatgaaaagacagcaaaagaaattaaagaaaaattaaatagtggcgaagatttcgcggcagtggctaaacaatattcagaggatccaggttctaaagaaaaaggtggggaactatctgaatttggacctggtatgatggtgaaagaatttgaggatgctgcgtataagttagaagttggtcaattgagtgaacctgttaaatcttctttcggatatcatattattaagctaacggataaaaaagagcttaaaccgtatgaggaagagaaagagaatattcgtaaagaattagaacagcaacgtatacaagatcctcaattccatcaacaagttactagagaactgcttaaaaatgcagatataaaggtatctgataaagacttgaaagatacctttaaagagttagaaaaataataaatggaatgtaaggcaagcgatagaaatatcggttgtctttttctctatttatcccgctatttgccgggcagtaagaccccacctcaaaattcagcgaaagcaaagaagtggccctgctgatcgtaaacgcccaattggtgagggctgattaaagtttcactttataaagaaggcggaagtgggaaaatactttcatacctgcattaaattttacttaataagaaatctttgagtttctcaacttttatataaaataaaactgaattttcagttattttgttatatagtaaaagagaacgaataaggggagggaacattttgagtaaactgaaaatggcacttacactgtcagcaatgctatctgcaacaattatacctagctttactatggatgtgcatgcacagaagaaggaagagactaaaagtacaaaaattgaattagacaatgggatgacaaaaccgatttattctctcgatgaagctattatcgaaaatttatatgtagagacagaagctgatagtgatcgagacggtaagaaagacagagtatcgataaaagttatgcgtacaaagacag

SEQ ID NO: 531 - DNA, 1362 bp, Bacillus thuringiensis
gaaactacattagcagttgtaatagttaattttgtcgatacagcgagtaatttgtaagggattttttttatcatttcattttcctccaatttaggttttaaatttcagttctactcctgtttaaaagcaatatcttttgaaatgaattctgcatctttatgaatatcattccaactttctttagccgcttttaaatcatctggtattaaagagaatttgtggtcttgcatagaatcgatattatccaataaatctgtataatttgcgcccattgtattccattgcttttgaatatttgttagagacaatatcgcttgatctacagtctggtataaatatgccaatgtttctttcgcgttagtaagcgaaagaactgcttgattagcacgatctgctttcatacttaattctccgattttgttagaaatttcattataggaatccatatgcttagatgctgtgacaccagccgcagttcctagaccgataccagctgcgccaagagccgagagtccaccaacaacagccggtgttgctgtaccgccagttacaacaataactaccgctcctccaatagctgcaataactaaaatagctgctcccaatccaccaccaattgaccatgctaatacatcatcaaaatgttttttctgagtagaacgaagttgctcaatttcagcttgaagttgtggaatcgttgcctgttgacctgctaatattgcagttaatccacctttcccatctggaccaccaacattatttttaaaatctgtagaattttgatataatttccctttgaagtcttgtagcatcttaatcacatctgtaacttcttttgaatttgtattgattgtagtaattaaatcatttataccctcttttagacctgccttatctttcttttgtacagtttctactaatgtgtcgtaataattttgaaattgttcatcgtaatttacaatattacgagcagttttttgaatctgtggcttcgctgtatctaaccagtaattcgcattgattcgtgacagctcttgattaaggtgaatatttttgagcaactctcccccctctgagcctaaatcgatattagataaatttacatttggttgcttaatcattgtttttgcgtataaatccattactagaatatgagaccctgtttcagctaatgctttcttcagtccttcggggcctaatgcataattgcctactttttgttcttgagcggtcgtttcttgtgcaaatgcatgaatagtgttaccggtagtagcagttataacagttgctaatgtagctaaagttagtactttgaatggaaattttttcatgactattctccttctttcgctaaaaactaaa

SEQ ID NO: 532 - DNA, 1581 bp, Bacillus thuringiensis
aagttacaaaatcgttgtatctgccgtttcattttttaaacccagttgcaattgagtatgctaagaaattagtggattgctcattaaaaaacggaaaggtcttttttacaaactcaggtacggaagcgacagaaacgacgttgaaattaattgataaatatagagctaatatgaatgaagaatgtgaaggaattgtattgctaaagaatagtgtccatgggcgtacgttaggggcactacattttacgagacatgaaagtgtatatcaaaatttccctgaaacatcgattcctgtatacgaagtagagcgcgaaaatatagaccaattagaagagactattattaaagaaaacccaattgcgattatgctagagcctgtattaggaagtggggggatttatcctttatcaagtgaatatttgcatggtattcaatatttatgtgaaaaatataatgtacttcttgtcgttgatgaagttcaaagtggtatggggagaaccgggaaactgtttgcgtatcaaaattttaatattacaccggacattattcaaattggtaaaggagcaggaggcgggataccgctagggggaattattgtaggtgaaaagttatgtgatgtattttcaccaggagatcacgggacaacatttgctcattcatcaatgggaacagctttaggtttaactgtattaaatacattacttgatgaggggttaatgcaagaagcttatgaaacgtcactatatttgaatgacaaactgcaagacattcagaaagaaaattcttattatattcaggaagtgcgtcatgctggcatgatgtttggaattagtctgaatgatacgaatgaaaatgtgaagaaattacaggttgagctaatgaataaaggaatgttagtcgatgtaacacaagggaatattattcgattacttccgccgtatattattacaaaagaggaaattgatgcatttattaatcagtttatttcttgtctggttaaagtagctgttttaacaattgtttaaaaataaatttcaagttctactcttcagaatacattcttttttgaattgtaatttatgaaaaaaaaactatcttttatacagatagtttttttttcataaatatatcagtagctatgaaatattcttaattatttcttcagttgtgattggtaaaatagtatgtcttcatctaccaaaaaaatgtgtctaaaaggggaataatttgagttattgatttgaattttaaaagttttatttcagaagcattattttatttagtaatttatatattactagacgacatttgtctggtaaaaagccaaaaaataagaatgctagaacattttcaaaaaaataacatacgaatataaatataatgagaatgaggtgatatgttggaatacaaggatattcaattcacgtccttacaaatgagaactgatagatttgggtgggccggtattcaatatacaaataaaaagcaagctattttatttactcgaaatggaggggaagaatgggatattgtcaatcctcttaattctataatattatccatatatccgataaactctcg

SEQ ID NO: 533 - DNA, 1345 bp, Bacillus thuringiensis
aagttgtgagccgggttgcatatgtaaaatcacccctttaaatttgaatattaaataatagggcattttgtttcagggcgtaaattttaaatattacatataaaggtgtatttcccataaaataataaaagaggtatcaccctgtagtgatgcctctttctcattgataactatgttctgtcttgttattcaattttgcttgctctatttgcaattcacgctctaccaatcgatctaattgctgaattgctttaagtgctttttcataagaaattgttcgataatgatgcgctccgcccggttcttcatctgcttcgtctgcccatttaataatattttgaagagatgttctttcaatttcttgttccactaagaaagaatctgtatgaagaagaattgcaatagaaatttcttttgctagttttggatgttctcctaatctaataagtaatttatgtgctctttcagcgcctttaattgcgtgtatatcattctttttatataagtcataatcccattcaccgcctgtgtaccacgtatgatgtccgatatcatgaaggaagccagcttttgtggcagcatcgactgaggcgtgatgctttttggctaggtgaaacgcatggtaagcgacagcgatcgcgtggaccattccagaacggtttacgtatttttgcgtaatgtggtgtttaaaaatttgttcaagcgtaatacggtgcataaaacattcactccttttatcttatggtgtatatgaagaataattgatcggtttaaatgtattttgaacattgtactccatcatagttcgttagtaaagtagaaatgtttaggagaagaaaaaatttttctgcaaaaaaatcaccttagcttatgcaaaggtgattttcaaattgcttatttttttaatccttgctctagtgtttctaacatttcgtgcttttcattttcatcagcgtttttccaaatgacttcaaataaaacgccaagacctggaagcattttttcttcaccgctttgaattgcatcgacgattgtttcttgtaattgatcttgtgaatttccagatacattcgctaatacagcaccgcgtaaattaaaactcattgctttcacctcttcttcagaattgaaactgacgttagtttttgttcttttttatgtaaatatgtatgaaaaataggctataatgataagacaagaagagagggaaatacatattatgaaaaacattgattcagtacaaaatccgcgtgtaaagcagtggaaaaagctgcaaacgaaaaaagaacgcgataaaaaaagtttattttttgtagaaagattccacttagtcgaggaagctttg

SEQ ID NO: 534 - DNA, 1855 bp, Bacillus thuringiensis
cggaattaccatcatataaaggacataccattattttaatggatggtacaacacttctaggagcagatgataaagctggtcttacagaaattatggttgcaatgaaccatttaatacataatccgcaaattaagcacgggaaaataagagtagcatttacaccggatgaagaaattggtcgtgggccagcgcattttgatgtagaagcgtttggtgcatcattcgcttatacgatggatggaggtccattaggtggtttagagtatgaaagttttaatgctgcaggtgctaagttaacgtttaacggaacgaatacacatcctggaacagcgaaaaataaaatgcgcaatgctactaaactggctatggagtttaacgggtatttaccagtagaagaggcgccagaatatacagaaggctatgaaagattctatcatttactttctttaaatggtgatgttgagcaaagtaaagcgtattatattattcgagactttgatcgtgaaaattttgaggcgcgtaaaaataacgttaaaaatattgtgaagactatgcaagaaaagtatggcgaagatgcagtcgttttagaaatgaatgatcaatactataacatgcttgaaaaaattgaaccggtgagagaaattgttgatattgcatatgaagcaatgaaaagtttagacattgaaccaaatattcatccgattcgcggaggcacagatggatcacaattatcatatatgggattaccgacgccgaatattttcactggtggtgaaaactatcacggtaaatttgaatatgtttcggtagatactatggaaaaagccgctcaagttattgcggaaattgcaagacgttttgaggagcaagcttaaaaaagaaccaagtagcacgaatgtgctacttggtttttttaatatagtactcgccacaaataaaaagtcgcataagactcccaattagcccagtttgccgcgaaaccttttatttcatttttagtcggtttattttcggaacctgttataaatttaattgcattatgcagaccaacatcatcaattggaaaagctgaaggaaatcttaaacaacgcattaaaacatagttggcagtccatggtcctataccatggatagcggttaattgtttctcagcaacctttacatcttgtgtttgcagtaaatcctcttttgatagttttctctctgtaataagcttcgcaataccgattaaatattcacattttctagtcgtcatttttaattgttggagatcttctacatgtagatttgcaattgtttcaggtgatgggaatatccaatgctttctaccgtcccattctacataactgccaaattgctcaactaatcttctttttagcgtataagcatatgttaagttaatttgttgaccgataattccccaggaaagtgcctcaaataagtctggaatacctaaattacgaaggccataatattgttcaattggtccttgaaggagtaaatcatgtttagctaatgtataaaagggagctaaatcagtagttaaatcaaaccattcttttacatagttagctacagcttcacgtatcgatttttcagatgtatatgattcttctaaacaacgtatttgaatattgccatctgtattcacactaatttcaactaaaggatttacatcttgaacagggataactttataaattttgttatcttcaatatgaaacatacattcattgttagaacgtgatagataacgtaaattttcttggaaacaaaattcttttggaactgctatagataatgcgctattatattccgctgtcatatgaattccacctgtaactaaacaaatgta

SEQ ID NO: 535 - DNA, 1605 bp, Bacillus thuringiensis
tcggatccgaactcgtgatcagctggcattgcgtttttcagctcttgaacgtgtgagttgacaccgataaatcggcctgatttttgtaagtcaattaaggcatctactgctttcgttaatgattcttcatctaatgaaccgaacccttcatcgatgaacatcgtttcgatagtaataccaccttcatatgcttgaatgacatctgccattcctagcgctaggcaaagtgatgcgttaaatttctctccaccggatagtgtttttacatcgcgtgtttggccagtgtatgcatcgtacacatctaaacctaatccactttgacggtttcttttttcaactcgctcacttcgttttaaataaaattgtccatttgataatttacgtagtcgttcgtttgcgatttgaacaatttgttctaaatactcaattaagatgtaacgttcaaatgatatacgactttcgttatcacctttcattacttcatataaatcaacaagttcttggaaggctttttcttcctcgtgaatttgttcgtcaatacgtctaatgttttcatgtaaatcagaaatatatgttaccgcattttgcgcacgttgacgtttttctttaattatatcaagattaatttctagatcttttatgtgttcacctaaagatgtaatatccatatactctttatcttttaattctgcgtttaactcttcaatttgttttgcaagtacttcaagcgatgaataataaccttgaatttctttttgtaacatctccatctcggcatcgcttaatttggcttctttatacgtgaattgatctgtaaacccactttgttctagctctttcataaagcgtgcaaaagtctcttctttctttaattttgcactttcaaattgattagaagcacctttttgttcagcttgaatacgtatattttcattttgccaatgctgatacgcttcctgcactttcttccattcgtcctccattaacctaagttcctgcatagcttgattaaactgcgcttcccaagcttgtactgtttgtaagctttctggaatatttcgtttatcatgttcatatgacgtacgaagttgcatacactccatttctgtacggtgctgcattgtttccacttctcgtttttgtttctgaagttcttctattttttcttctacgcttttcatgttcgcagcaatctgcttacgtgtttcttcacttgcttttaacgtattaacgtctgctgctaattgttttcctttttgaacaagtgcactatatgtttcaactaatttttcggagttgtagccgcgcttcacaacttcttctatcacttgttcatattgtagttgatagaaattccatttctcctctacttgcacatgtaatttttcagcaatgttcttcttatctcttaaatcgtttaactctttttcatcgatcgcattactttgctctgtagctttttgtggatgattcgtactaccacataccggacaagattcaccgtcatgtaaatgaagagcttatataccaggttgttcacttaaccaggggcgcttcatgtttttcatatgcacgaactgtccatttgcatttttatttatttac

SEQ ID NO: 536 - DNA, 1634 bp, Bacillus thuringiensis
ttatgtttattttctttggcttaaatccgaaaaaagagatggtgtcacataaaacgctggatccagctagaaagattgatcctgagaatgtattagggaaacaaggtattaaatttcagcagtttttagcagatgtctatcggatgtacgtttcgtttagatgacaaatatatgaaaaatgaatacaataaagataggtgcctactgctgtaagtaggttttttcttgtttttataaatagtgcattggtagaagactaggagtggacgagtatgcagaaagaaacagttattataatcggaggcggtccgtgcggattagcggctgcaatttcgttgcaaaaggtagggataaatccgttagtaattgaaaaaggaaacattgtaaatgccatttataattatccaactcatcaaacatttttctcttctagtgaaaaattagaaattggtgatgtagcttttattacagaaaatcgtaagccatttcgaaatcaagcgcttgcgtattatcgtgaagtagtaaaacgtaaatctgtacgtgtaaatgcttttgagcgagtggagaaagttcaaaaagatggagaagtttttcaggttgagacgacaaagcgtgatggaagtaaggaaatgtatatagggaaatatattgttgtagcaactggatattatgataatccaaattatatgaatgttccaggtgaggaattgaaaaaagtagctcactattttaaagaggggcatccttattttgatcgagatgtagtagttataggtgggaaaaactcgagtgtagatgccgcgttagaacttgttaaatctggtgcacgtgtaacggtactgtatcgtggaagtgagtattcaccaagcataaagccttggattttgccggaatttgaggcgttagtacgaaacggtacaattcaaatgcattttggagctcatgtgaaagagattactgagcatacattaacgtttacagttgatggtgaagcttttacaatcaaaaacgattttgtatttgcgatgactggttatcatcctgatcatagcttcttaacgaagatgggtgttcagattgatgaagaaacaggacgtccaatttatacagaggatagaatggaaacgaatgctgaaaatattttcattgcaggtgtcattgctgctggaaataatgcaaatgaaatatttatcgagaacggtagatttcatggagatgcgattgcgcaaaccattgcatcaagagaaaaataaaaaggagctgtcgggaaaatctcgacagctcctttttattcgtgcataaacatattttgaatggattcatgagaatttgtattctctaatgcaacaagtaatttaatgcgtgctttttgtgcatttaagccgtatgtgaatacaatgcccatatcttttaagtgtttaccgccaccttcatacgaatatacgtcttgaacgataccgttgaaacagcgagaaactaatacgacaggaatacctttatttaataatctttctaggctaggtagtgttcttggagggagattaccttgtccaagagcttcgataacaatgccgtctacaggaagattttcgattgctgctaataatgtatcatccatgccagcatatgctttt

SEQ ID NO: 537 - DNA, 914 bp, Bacillus thuringiensis
tccaacgctcattgctgttaaatacttgtgcatattctttcttgaacagttcagatgtaacaacactttgaactacatcttcaatttctttagctgatggccaaatatcgctgaagtaaacagcattggcatttgcatctttaccgatttcatcatttttcaggtcaatatcaacagtacctgcaagtgcatatgccacaactagtggtgtgatgctaagtagtttgcttttacaagtgggggatacgcctctcaaagttacggttaccagataaaacagatgttactaataagtcgtttgctgcgattgcttcttctaattctggcgctaatggaccagagttaccgatacaagtcgtacaaccgtaaccaactgtttggaaacctaattgatctaaatatgttgttaaaccagacttatctaagtactcagtaacaactttagatcctggtgctaatgatgtttttacatactcaggtactacaagtcctttttcaattgctttcttcgcaactagacctgctccaattaatacgtatgggtttgatgtatttgtacagcttgtaattgcagcgattgcaattgcacctgttttcatcgttacttctttatcttctaatgtaaccttcacttctttatcgaactcttgctcattaaatccaagtccttgtgttccaactggtgctaaaacagctttgtggaacgcatctttcatatctgaaagtggaattaaatcttgtgggcgtttcggtccagaaaggttagattcgattgtatttaaatcaatttctacaagatcagtgtagattggatctttactgtctgctgtatagaataaaccgttcgctttacagtattcttcaacaacgcgaatttgttcttcatctctacctgttaaacgctaagtattcat

SEQ ID NO: 538 - DNA, 853 bp, Bacillus thuringiensis
ctttgtcatgttagacatttcttttgccatatcagcatcttcaatttgagaagcagaagctgccatattagtagcttggctcgttacgttgtttaagttatggtctaaacggtttaattgagaaccgaaagttgctctagcgtcagcaatttcttgaatagcagtgtccagagccgtgatttcagttgctgcagttgtagcatctaatttctttgatccatcagttgaaactgctaaagtaccagttgttttaccttttgtatcgatagctgtgattttcattgtatcatttgaagcgtcagaaagctgaattgtgatatctttcccaccagcaccacctaaaaatgcgttaccattgaaatttgttttatcagcaatatgatcaatttcttgtgctaatgcttgatactctttgtccatagatgcgatatctttatcgttgttagtaccgcttgatgcttgtgttgcaagatcacgcatacgaagtaagatgtttgaaacagaacctaatgcagcgtcaccagtacgtaaagcagacatagcgtcttgtgtgttacgagccccaacatttaatccgccttcttttgcacgcatacgagtagcaatagctaaaccagccgcatcgtcagctgcactgttgattgatttaccgctagataaacggttcatagaagtgttcattttgtcttggttttgtcgcatgtactcttgagtacgcatgctattaatatttgtattaattctcatgttaagaacccccatttttttatattgatttttctgttaattgttaaacgtaaatatgcaaaaaaatcaatttcgagattaattgtaatccatggtgtatatcgtg

SEQ ID NO: 539 - DNA, 1829 bp, Bacillus thuringiensis
tacgtttagtgattggttgtaattcccttgataatataacaattaactttaaagataagctctcatcgttaatcacgctcacaattaccaatcctttacaaattaccttgaattcgagatttattatattatcgtcaaaatattatgtcaatcattcattttagctttatcaagccacttataatttatttctcaacataagacatatggaatcgttagaaaataactgttaatatatagatatctcaattacgttattttttagagggcttgttgtctagcgcaagctctcttttttcatagtctaaatggaattcggacacattttatatggtgagttttgccctcttttagcgatagagacaaaaaatctggttgtgatgtaaaaacttcaaaataaccgcaaataatctataaaactcagacatatcaatgaatacgcattcaagcgattccgatccacaatgctacactccatccacctcaagcgtatgcccatcctccgacaaagggtccaacagcaccacccaaaaagaaaatagacatgaataatccatttaagcgactacgcacttctggttgcaaagagaaaatcaaacgttgacttaaaactggcggaagaatatcgtactcgatgtttccgccccgtcgactgcaagcaaagcaacttctagagaggggaattcaaagaggagaattgaaagaaaaccttgatattgaattatccatcgatctcatttacggaccaattttttatcggttgctagtaaccggtgataagttggatgattcctatgtacatcacttggtaacaagcgcattcgatggaatacgattaacatgaataacattcgaaaaaagaattaaatgcgccttcctcatatacgaataaaatttcgcttaacttaataaataaaatatctaattatttaagcagatgtatatgaatcggtcccccacatacatctgcttaagagttgagaattaccctaaatgaatgaacatgcaaaaaaatttattctgaggattttacgatattttatttaatcgaaatgtgacataactcctaatattagttttattaagacgcaagctccctctcttctattttttaattgaatattttaggtttataatgatttatttttagagataattacctaatttattaacttattttagagtaaaaattaggagaagcctatcgtgccagacttcttcttaaaaaacaacccgttatatacatatggaaaataattttttttaataaataatgaatattcaccagtgtaatcatcaattttatacacattcaaataatatttccctggtttcgctacgaattttccctttatagcatttccttcatcttcaccacaaactacgtaattttgcatgtctgattcatgataaagtacccatgtcatcccaatgttttgttcatttaccacagaaatatctacttcttttggaactgtaacatcaaacgtataaacatctgtttgatcaggagcaatcagatttccttttacaagcttattaaatgggagtaccttttcctcttcaagggattcacctgtttgcggatcttgttttacagtaacttttgtttgttctttactttcttttcctctactatcttacacagattgttccacaagatatgttcctttttccccatatacatgggtagggttggcttcaggacttgttgtaccatctccaaagttccatagataagaaataatttttccattttcactttctgtaccatcactatggaattgaattccttcatttactatcccgctatatggtccattcatatt

SEQ ID NO: 540 - DNA, 1092 bp, Bacillus thuringiensis
tttacagtgctaacatcaacatgtaattgattattttctctgttaggtgaggctcctgtatagagaaacgctgctgcccaaaaatgtcgagagacgccaatgggtcaacaggaaaggtcggaatgaaggccttttttaacgtagctggtttcagtacctatgctatacagtgctaaaactcaacgagggagaggtgcatgtattttgtcatacacaaaaactgtttttatttatgtttactaacagtctttgttgtagactcttttaactgcgaattcagacctttactcgttttgagtaaaggtctttttacgtatatatgcaccttactatgaaacaaacatagcatattcagaaactactaaattgtacggaggtgaggaacagttggcaattgatgattcggcccagatacccatacgttttacattcatatttcatcatgtaggtaggaaagaaactgttcctcaccatttcaaatagttaggtaacagattgtttcctctttcatgacagaggaggaactactgatgtttaatttacaaagacaagaaacaaagcatgcttatgagcaagatagcatgcaaacaaataacgaattattagtggaggttgcaacacatgatgtaagctctgcgttaaaacttctagaaacaacacaagatggattatctaaacaagaagcgtctcgtagactttctttatacggtccgaacgaaatagctcataataaaatggcgccgtggtacattcaatttctgctggcatttaaaaatccatttattttcgttttattagctcttggagccctttcctttttcacagatgacatacaaggaacaattgtcgtatctgcaatggtcctacttagtgcaacaattcggttttcccaagaatttcgttctcaaaaagctgccgataagttaaaagctatggttcgaacaactgcgagcgtatttagaataaatggatttgtacatgaaacaaaaaatgtaacgaatttaaatcgaaattacacaacagaaattccaattgaggaacttgtacctggcgatattatttccctttcagccggtgatatcgcaccagctg

SEQ ID NO: 541 - DNA, 1059 bp, Bacillus thuringiensis
tgtagtgcatcttcgtattgtttttcgatgtatcttttaccaatacggtcgtttcgattataatcacgaactaaataataatctaattgttctcttggcaacccttcattttcattagaaacgctacctagtatagagcgcagtattttatcatttgggtattcacgttcccaatctactgttgtatctacccccggtaaacttgccaacctttcactaacgacagcatattcattttgacttacatcttttttaacgatttgcggcgtcattttatatcccgcattcattttgcttttaatggctagtacttctaggtcttcttttgaaagttcacttaattcttcttgtgtaattctttccctacgtaactcttcaacttttttatctaattctttcccttctatctcctgctttctaaatttactctcatcttctttcgttactttcgctgctgcccgcttttcatttaactgcatccaaaaatcctttttatctgtttctgttaacttgtctatgtcctcttgcgacatttcaattagcttagctaaacctcttgctacttgtaaaacttctttcgagtctactcctctcattttcgtatatgtaacggttcgcaatggtttattatttacaataacgtgaccttgccgatcaaacattttccctctaggaacgggagtgcttaccgttacatcttcctttttatttacttcatttctatacgtttctccatcaatgatttgtactttacctaattgaattataatagctgaaaataaaagaaagacaataaaaaatagtacatttaaccgaaatggaatatgagtctttttctttttcgatagttttttctgctcctttttctgtctcatttcgctccctcgcttcattctattaacatttctacgcaaagtcattatgtatcaaatttatttatatgatatatatagaattttatattaattataaaagaaataaaagatttaattttcagttttttatttttataccctatttattaccattggggttatgcacaattaaatgaatattatt

SEQ ID NO: 542 - DNA, 1303 bp, Bacillus thuringiensis
aaaatggtcaaaaatcgctttcgttacactcgttttacctgatcccgaaccaccagcaattccaattacaacaggcttattcgtccccattcgactatcactctttcttattgaagtatgcttttgcgcatcatattattcacatacactcgttgatccactttgaatttcacgatttgcaacggatgtctcgctgcatctaattcgtttccatcctcatcccaaattttctccaccgtttgcgtaaagttttctatttctggtccaaagaactccacttcatgtcctggtttgaaatgattacgttgctcaatcgttacgatgcccgtttcttcattataatctaacactaaaccagcaaaatcatacgttgttttcttactatgatttccaaacatttgctcttgatgtcctggaaccccttcaaagaaggcaggagctgtatcacgatttgcacatttatcaagctcatctaaccattcttgtttaaactcaaagttatctggatccgcacaatacgcatcaattactttacgatatacagttgctacagtcgctacgtaatggattgatttcatacgtccttctacctttaagctatcgattccgatttcaatcatttttggaattgataaaattaaatttaaatcttttggactcatcgcaaagtgagcatctccttcttggaatagaggaagctcttttgcatctttatgttgtgatactgtttgaactaaatcataatcccagcggcaagattggcaacaaccaccacgattagaatcacgcgctgtcatatggttacttaatgtacatcttcctgaatatgcgatacacattgcaccatggacgaacgcttcaatttcaatatccactttttctttaatttctttcatttcttcatagcttgcttcacgagctaatacaagacgatgtaaaccttcttctttccaatactgtgctgctttccagttggatagtgattgctgtgtgcttaaatgcacctcaacagaaggcgctacgcgtttacaagtctcaatgataagcggatcagcaacgataattcccgttacgccagctttttcaatcccttttaaatattcctctagcccgtccatattttcattatgtgcaaagatatttgttgctacgcatattttcgctccatacttctttgcaaactcaacgccttttgccattttttctagcgtaaagttacctgcattcgaccgaagaccaaattcttgtccacctaaatatacaggatctgccccgtaatggattgctacttttaatttttcta

SEQ ID NO: 543 - DNA, 1164 bp, Bacillus thuringiensis
tccgtgatcgcttgtaattgttgcattttagcagatgccttccaatgattagagcggaaagactcacgctcatatcgctttacaccgataatagatgtttcatcattgtaaaaagaaaaattcgttcgataaaatccattcaaaagttgctgaagttcttgcaaacctgctacttctttaggagaaggatacacaataatttcagtccttaatttatcaaaaacaggtaaatgtacagttaatagatgaaatggatcttttaatacacattcaaactgttcaatttgaaacacaccacgcttcgttgcggttaatgttaaaccccatttttgtgccgaatgtgcgggttgtgaaaatgggaaagagaataatgtttttgatatttgttcaatgccttgctctttatgcggtataagggacgaatttaaatgaaagtaacaaacaccattaacgagcggtatgctggctccattttttaaatgaataaaaaactgtccagattcctcaggaaaaagccgtgtagtttgtttctcatttatgatttgaaacttcttctctatgaaagcgacatatttataaataaaaatcgcaaatatataatagaagaaaaagagaaacataagcattcgttgcgggaaaaagaatgtgaaaagtaacgcgattggaacggttagttgaataatatggagttgaaaaaataaaggcacagttacaacacgctgtccattcatgcttgctcaatctccacaggtacgtcaacttcttttaaaatactttgcattatatcatttttagtcgtgcgcagggcaccttccattgataagacgatacggtgattccaaacagaaggaactaacaattgtatatcttctggtgtgcaatattctctcccgcgtaaaaaggctaaagcttgaacagcacgtactaaagctaatgtggcacgtgggcttacaccgttagcgatataatcatgatttcttgtagcatgagcaagtttaataatgtaatgttctaacggttccgaaacaaatatttcttttactcgtttttgagattctaaaatatcttctaatgagatgacagatgtgacactttctaatggtaaatcgttccgaaaacgtcgcatcatttgtagctcatcttcaggagtaggataaccgattg

SEQ ID NO: 544 - DNA, 1042 bp, Bacillus thuringiensis
gtttgttatgtgttttaatatgaaagagtatctatatttcatatgatgtatataggcgttgtgaggacgttaaaagtgagttgtgagagaggtgtagaactatgaagtggttactattcttgtttattttaataccggcgattgagattacggtcttaattggatcaagtcatgtaataggtttatggtctacgttcgctatgattgtatttacaggtgttgtaggtgtgtatttggcgaaaagacaagggtttaaagtgcttggagagattcaatctaagttgaatagaggggaaatgccaggtgaggcggtactagatggtatttttgtttttgtaggaggtattctcttagtgcttcctgggtatgtgacagatgtgctagggtttatctgcgtgatccctattacgagagctttattgaagccgtttgttatgaagtggatggaatggaaatttagaaagaactctactattattattcagaaatagcacttagattgtagaaatctaagtgctattttttgtgttgtaagaggagaggaactttctggttgaagctttgctttgccgcgctatttgtggggtggaatttctatctcaaagctgggctgctcgtaagtgtctggtgtggggcgaatgatgagtggggatgaacaaaacgttcgcttattatatgtgctatataattttcgtttgaattcttgtgtgtacttcgattaaacttgtgattttttagtgctattaatttagatgaataagatggagggaacgctgctgaattaaatttttgctttctcatataaaggaacgattggtgtaaaaaattcatataaaaaggcggagattgttagttgaagtcttgttttatgctattttgtatatttattcatttacataaaaagtaataaatgtaaatgataattataaaataaatagaataaatatgtaaaaacaccacgaaatatgcgtttttcatgcaaaaaaacaagagacttatcttttttgagtgcaattctcttgtcttatgtcatgagtatgaa

SEQ ID NO: 545 - DNA, 1963 bp, Bacillus thuringiensis
ttcgggtgcagtattaatccgtaaccacggtattactgtatggggccgagatagctttgatgcaaagaagagattagaagcttatgagtttttattccaatttcatataaaactattatcaattcaaggaggcgtttctaatggcgcaaattcgtattcatgaagtaaatactcgtattgaaaatgaagtggaagtatctaaatttctacaagaggaaggcgttttatatgagaaatggaatatttctaaacttcctactcatttaaatgaaaattattcgttaacagatgaaaacaaagctgaaatattagctgtgttttcaaaagaaatcgctgatgtttcagcacgccgtggttataaagcacatgatgtaatttcactttcaaatagcacccctaaccttgacgaattattaattaatttccaaaaggaacaccatcatacagatgacgaagttcgctttatcgtcagtggtcatggcattttcgctattgaaggtaaagatgggaaattctttgatgttgaacttgagccaggcgatttaatatctgttcctgaaaatgcaagacattattttaccttgcaagatgatcgccaagttgtagctattcgtatttttgtgacaactgaaggctgggttccaatctattaaggtagttagttgaataaaaggacttggacccccttttccaaacttttattcactctacatatatacatcctcctatggaacaggcttatttcattttgaaataagcctgattttttatttacttgaaagtactatttcatcacaaatttaacatcttgatttttcaagtgcatttttcgaacattttttgaacatttattaaattttttctgaaaattctgttttatatgtgatatactacaattaactaagaaggaaaataatatcgcaaacagagggggataatcatgagcttacttatcgcacttatacttggagttacatgtggagcatttcctgttattttaggagctattatggaagagttagaaattggtgttttaggatttgtcgcatcttgtgtaagcgctttattatttggtttattcggcgctattcctgtttcaattctgtgtgctttttatataatacgccatgctcgtacaaaacaatttggccctaatcacatcgcacaaattatcccgttcccggttgaacgatgccgccgggcttctaacttataattataaaaattaaagatgactaaataaataaaagtcctcatttgaggacttttatttattttcttctagaaattgaaacaattcttgtagatgtagggcatcttcaccatagctaatagatacataaaatatgccgtcaatctcagcttgcatataaagatccactccatcacgatcatatttcaatgctaaataaaactccatttcttctaacatcttttttgaggttcgaattacataatgccccttctcatctcttccatattcaaattctggttcaaaatcatatttttgtttaaaagcttctttttgtctttcattaatttgcatacaagtagctcgctgtacagtatcaatcatctcatcaaacttttgaaggtccacctcgtttacccccttatatattttttatataatacttgtgttccactattttcttcgccatccttaattaactcttcatacaattctttcgccaaacttaagcctgggactgttaattgtaatttttctgcttcctctaaagcaattttcatatctttcataaaatgctttacataaaatcctggctcaaagtctccttttaacattcgaggagctaaattacttaatgaccagctacctgctgcccctgttgaaatactctctaacactttatctggattcagaccagccttcttcgcgtagcaacagcttcacatactccaatatattggaagcatggaatttgatggccattttgtatgt

SEQ ID NO: 546 - DNA, 848 bp, Bacillus thuringiensis
taattcattattaatgctaaaatcgactacgtcacctaaatgttgtgccatttgttttaattttaaatactctaggtttgttgttaattgttgatagctattcttcatttctatatacctcaccaattactgataaattttgtttcgccaaattgtcaatgttcggatatttaggtagtgacttagccaatgcttttttataatgttcttctttataattgagcttagattggctgattttatgttgtacaattaacttcatgttatgataaacatatatttgattatcatatacttgtaaaccgacggttttaccttgatattcagctggaactgagtattgattcgatttgtaagatatcatgcctgatgtattaacttttacaagtttatgcttaatcatataggaatctcttatcgcgctcttcgggagtggttgtaggagattcttttcctgttttagggcaaacactcatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgagtccagaaggactcaataaacgctttgataaaaaagcggttgcatttttgaa

SEQ ID NO: 547 - DNA, 951 bp, Bacillus thuringiensis
gtatggcataaagttaccatctggcataccgttaattacatttctctctactaaataataaattgcgtcttttgaccacgcactatctgaaacatcaggaaatttcttcgtttctgctaaactactaattggatgtgctagtaaatttgctgctaataaacctgcggctattgctttgtacttcatgaaaaataaatctcctctcaaaacttcatattcatacaatttttttaatcaagctaactaaaaaatattaactattaattaatccctttcatagtgtataacattatatatctatagtaaatacgtttccggccgtataacaaaaatcgcatatatataacttataatgaatgtatataaaaactttaatcagccctcaccaatcgggcttttacgggcagcccgcccccatctaacttttttgctttcgctgaattttgaggtaggagtcttactgcccggcaaatagcgggataaaaaagcgattaggacatgtctcctaatcgctttgccaaataaaaagctgattaaaaataatatctttaatcagctctctattatctatgaaattattcttcaattaaattagacattacatatgcatacactaatgcttctgtatgcgcaatagaactttcatgcgtacgttcaaatgcgtgggaagaatcaatacccgctccaattaacgcatgtttcacatcaaatcccgcgcgaatcgcagctgatgcatcagatgccgtagtacggataaatatctactttatattcaatatgattcgttttcgcaagctctactaaatgtttgcgcagtgcataatgatacgggccgctagagtcttttgcacaaatagatactgtatattcatcagatgcttgtccatcacctaacgctcccatatcaactgctaagtattcaacagtttcttctggaatgtagagttacca

SEQ ID NO: 548 - DNA, 1514 bp, Bacillus thuringiensis
agatttttgtatgtaatattgcatatacagggaccactggtgaaaatgctgagcaatgtttttccatatggtaaattagttccttagttatttattttatttcattttcaatcgtgtaaggcttggggctaagatttacaaaggtgactagtaaaaaatataacaatataagtataagattttgtacttagtaatctcacaatttaaggcatgacattggataagtgtgaggagttcaatcgattttgaataaaatcaatagtatcagttgcaatttttttacgtttaagaacgatcccggcatgcccacatttataaatatatcgtgtaggtctttcccaagattcccacaagtagtctgtatcctcagaatgcacatatagatcatgcttacctgaaattaataaaatattttctttttttacttttggcaatgcttgactcggttcagtgattttccaataatctattaaatcatcatacgtaacaccatgatgttccaagtcttctctaataaatttacctggagttgtattccaaatagaataagaaagtcgatttgcatagaaaatggatgctaacacatcaatttcttcttcaacaagagaggttaagttagtaataaatccgcctaaactaattcctattagaatcagggtcccctttttatttgctttaatccatttaatcaaagctcgtaaatcagctaccgcttgtctagttgcttgtaatgttcgttcaatatttgcacttaccatatactctccactgaataaggattgatcgggttttctttcaaaatgatagggtagagtgaaataatacatattccacttcaggctggtcatatgatcgtggaatatttttttcacacgttcgttagaatccattctccaaccgtgaacaaagataacatgaggtgcattttcattttcatgtaagaataattccccagttacagagtcgttgcgtgaatcaccggattgaaccgaacttttatagttgaattgcccaaccatgtattcattttcctgctttgaatgcttaatgtcaaaatgaaaatgtgatggttttactttataaaaagattctatgttctttatatttaatgaagtgttagaaagggaagtaaactgaaatgctacacttctttttttgtgtaaatcatataaggcgtaccgatcaatgagttttgaaaaaatcaaattaacctcctccaaaatacatattgtttaaaacatagacaaaatttatgttttaaattaattaggaaatattctcttttcctaatagtaggtgcttgaattataaaaataggtgataaatttgtatattatattataaatcgtgcaataaaataaaactataaataatttatattaaaatttaagaagaatgttaacttgtttcttttcttattaaaagatgtaatttctatgaggaacttaacaattcccatctagatattcacaaatagcttctctatatttattgtatagaaattatacaataaa

SEQ ID NO: 549 - DNA, 1625 bp, Bacillus thuringiensis
cgattctagcattccaaatgatgatgttggtaactttttctgctttccatttattcatgcagatgatgtattcaaagcaccatcttggattaaagacaccatttggtatcagattttccctgagcgattcgctaatggcgatagtacgctgaatccagaaaatacccttccttggggaagtgcgaatccaactccaactaattttttcggcggagatttttctggtgttattcaaaaccttgattaccttgttaagcttggcatttccggaatatatttcacacctattttcaaagctcattcaaaccataaatatgacacaattgactatatggaaattgacccacaatttgggacgaaagaaacttttaaagagctcgttgaagaatgtcataagcacggtataaaagtaatgctcgatgctgtgtttaatcatagtggatactttttcgagaaatttcaagacgtactagagaatggtgagaagtccgcatataaagagtggttccacattcatgaatttccgattataaccgaaccacttccaaattatgatactttcgcctttacaccgtatatgcctaaattaaatacagctcatccagatgtaaaagaatacttacttgaagtaggacgttattgggtacgagaattcaatatagatggctggcgccttgatgtcgccaatgaagtcgatcacaacttttggagagaattccgaactgaaataaagacactaaatcctgaagtatatattttgggagaaatttggcacgatgcccttccgtggctacaaggcgatcaatttgatgctgtcatgagctatcctgttacaaatgctctactttcttactttgctaacgattccattaaagcaagtgaattcatgaagcaaattacagaatctgtacattcctactctatgaatgtaaatgaagcagcatttcatttattagacagccatgatactccaagaattttaacaacatgcaacggagataaaaataagttgaaattgctctatgtattccatctttctttcatcggctctccttgtatttattacggggatgaaattggtatggatggcggcatggaccctgattgccgtaaatgtatgatttgggatactaaagaacaagatcatgcattatttacccatatacaaacattgattttattacgtaaacaacataaagcatttggaggacatggtacttttcaattcatcgaagcaaatgatgaacataattatatttcttatacgaaaacatatgaggatgaaactatctttttcgttttaaaccctactaatagtgaagttacagtttcactccctcttcatgttactggtaagaaaataattaacatttatacatacgaagaattttcagcggaagcatgtgtattacaagctacacttgctccatatggattctccatattaaaatggtaatccaaaaaagcctttatgccaagttcgaaatggtataaggctttttcttatttcaatttgaacactattcggttaatacggacgttatggaatgttatctattgatccgatttctacatcgtaattgggtataaataaactctggttcactataaactaatttccttag

SEQ ID NO: 550 - DNA, 1193 bp, Bacillus thuringiensis
atttgcgttattgtttattaatattttattgctaacaaaaatatcatttgtttttacaccgtttatcgtatttttaaaaacaattttcttcccagtactattagcaggcgtactattctatattttacatccattcgtttcgcttttagaaaagaaaggtgtttcaagaatcgtatcgatagcttccatatatttaatcgtactaggattatttgtatttttagttgtaacggttatccctattattaaagatcaaattgatgcattaattgataacttaccgtattttggccatgagattgaacaagcagcacgtagattcggggaaagtaatttactcggtaaaattcaagagaatttaaatattaatgttgcgaatatggtaaaagaatacacagttgattttacaaagtcattatcatcagtaactgggaatgtaactggatttttgagtactgttacagaggttgttttaacatttgtaatggttccatttatattgttctatcttttaaaagatggtgagcaattgccgaatcactttttaaagtttatttcagagcaaagacaaccagcagcaatgagaatactagatgatatgcattatgcgattagctcgtatattagaggtcaaattatcgtgagcttatttatcggtattatgttattaatcggttaccttattatcggtattaaatatgctgtactgcttgctattttagcgatgattgtaaatatcgttccgtacgtaggaccaattatcgccattacaccagcgttaattatcgcatttatcgactcgccagcaatggtgttaaaagtaatcatcgttatgatggttgtacaattagcagaaggtaaatttatttctccgcaagtcatgggtaaaaagttagatattcacccgattactatcatttttatcattttaactgccggaaacttattcgggattatggggattattttagcgattccagggtatgcgatattaaaagtgttagttacacacggttatagatttgttaagttgaatacgtgaaaaaaagcgctaaaacagtgggaactgttttagcgcttttttattaacaattcatttgcatattggcgcgcccattgatccgctttaatatagcatctagtgaaggatcttttacgttatgatgagcttcaactgttttgaaattgttttt

SEQ ID NO: 551 - DNA, 1398 bp, Bacillus thuringiensis
tcaattaggtttaagaagttaagacctgtaaggtccatatttaatgtatctacaagctgatcccttccatccatgttaggcttcgtaccaagtgattcagttcccccttcaccatcattatatcaaaagtttttaccgatagcaaatacatcgtagtcactgtctgttgattcattcattgctgtacggcggaatggttttaatgcatagtcatgacggtttggtgtacgtgtaaagtttccaggttcaccaacgaatggacgagcaataacacgacctaccatgtatttctcatctaatgttaattcacgtgcgattttacagattttatatgactcatcaagtggcactacttcttcgtgtgctgcaatttgcaatacgctatcagcagaagtataagcgattaaagagcctgtttccatttgctcttgaccaagttcatcaagaatctcagttccagaagctggcttattaccgataattttacggcctgttttttcttctaattcatcaagtaattctttcgggaatccttccgggaacacttggaatggtgtatcaatgtaaaggcccatgatttcccagtgacctgtcattgtatctttaccagtagatttctcttgcatttttgtgtaatatccaagtggtttctctactttagagatacctttcatttctcgaatgttaccaagacctaatttcaccatgttaggcatttgtaacccattcatatgttcagcaatgtgaccaattgtgtcagatcctaaatcaccaaattgctcagcatctggtgcttcaccgattcccacagagtccattacgactaggaatatacgtttatatttattcataactgcgccctcctataagttcagttctacttcttgtagtatgttcaaaacgctataaagtgaaactgttatcaaaaagaattctcattgtcaaacagtacttctttaaatcattttctaacctatttcgtttacttgaaacgattcaaaaacatttctagttttttctaagtcagatgtcagacatctgatactgatatcataacatgtttacgctttctttttaatacattttcgtagaatttctcattttcttcacacttctattgtaatccattctgcaacgaagtgctaatttttttatgatttatttcttcatattaaaaataaaaagtagctctaaagagctactttttattttacttctattggttcttctttatgttcatgcaattcgccttttcttacatgtactttcactttgtaagcaccgttctctttgaaagtatgtttcgtttcatactctcctttattcccttctttcgctggaataaattcgtggtttttcaacaccatctttccaaatctctagttgtacttcagcacc

SEQ ID NO: 552 - DNA, 1462 bp, Bacillus thuringiensis
atgaatttttatacgtcactatttgatcaatcagattttgtaagtatttctcgctacgatgaaaatggacctggtaaagagggaactgtaattcatgcaacttttacgctaaatggccaagagtttatgtgtattgatagttatgtaaatcataattttacattcactccagctatgtctctttatgtaacttgtgagacagaagaagaaattgaaacggtctttcataaactagcgcaggatggagcgattcttatgcctttaggttcttatccgtttagtaaaaagtttggctggttaaatgataagtatggtgtatcttggcagttaactcttgctgaataaaaaaagaaaaagcgtagcttatttgtttaatggatttagttaaaagcttgaaaaatgaaataacataaaaaagcgttccaactgtcaacagatttggaatgctatttttatgtggaagtgagttgtttaaaacttaccaattctacgattattttaaatgaatggaatagatgtataattttttgtctttttagaatttttagcgattattagcatttatctgttaatataaatatagacaactatgtatgaactatcaggcgggttaatagaaaaaggaaagcataaatagttaataagtttacacttaaaatgcaactagattgttaggaggaataattgtaatggatactacacaacaaaacagtaatgcatgggataagaaggtggaagaaggttctagatacacgcagtctgtaagtagcgagattattgagaaaagcaaatcaggtgaatgggagattacagtcactacggaaaaatcagttcctagagaatggtttccaaagtcattagatggattaaagatactttgcttagcatcaggtggcggacaacaagcaccagttctatctgctgctggagcagatgtaacagttactgatatatctaagaagcaattggaacaagatgaaaaggtagcaaaacgggatggtttaactttaaaaaccgtacaaggagatatgtcagaccttagtgattttgaggaagaatattttgatattgttgtaaatcctgtgtctaatttgtttgtcaaagatgttcatcttgtatggaatgaagtttctagggttttaaagaataaaggtgttcttattgctggatttacaaatccgttactatggatttttgatgataaccaagagcaaaaaggtattctggatgttaaacattcaattccttcatcaacattggattatttaccagaggatgaagttcaagattacatcgattcaaatcaaacaatagaatatgcgcatactttagaagaccaaatccacggccaaattgatgctggttttgctataacaggttcctatgaggatgatcttggtggaacaaggctattagatttagcatactacaacatttattgcgacaataggtataaattcta

SEQ ID NO: 553 - DNA, 1587 bp, Bacillus thuringiensis
cacttggcattttctttattatttcaatgttttactttgcaggtacaaccatagttcctacctttaaaatagttgcaatcttttcgtcttcaattgaaacaggaatgaatttttcaataaaaatatttgagttacttgcaattaaagtaattccagattgatctgcagttatttttataccagataatataggaattaaagattttgttgatattgctttgttgacttctgaaagtgcttgagtgaattgtttgtgattaacgataaactccatgtttcccccgccttacatgagataatatttttatgaagattgatgaacgattgttccgttaaaaaaataaggtactgtttctttcttttgtaataaatatagtaaatgttctggtatgcgtaaatacggtgctgctatatgtaattccatccaagtaatctcttcgatttcttttggccttgatatatatgtctccccgccgattatttcgcctagaaaattaaagaaaattgcatgatgatctctttcctcgaaaaaggcttcactgatagaacaaatcccgtttacgtttatgtgtaaccctgtttcttcttttacttctcgaattactgcttcttctaatggttctcctagtttaactgcgccacctggtaatgtataataagaaccattttcccctttgttttttaccattaagatcttttcattagttttatcgtacttaatcgcgtatgtaacattaacttttttcatatgtacctcctctattttaaataaaaggaattttctgtcttctattcattctaccattaactccttttaatatatataagttagttaagtcttgcctttaccgctattgttggagttaataagaataggctactgatataaaaaaagaacgtaccttaggaagattatccaaagtacgttcttgcagttttagtataaaaattgattcaattaatactgaaattaataataacctcgcccttattgcatttgtatttcaaatactaacgttaacaaattctatatactttttaaccgtttttctaaataataatgattatgtcctttcggatgatcttcacttactccaattactttatatccatgtttcttataaaaatcaggtgcttggaaactaaaagtatctaaattaattaacctacaccctttttcaattgcaaattcttcaataagctttattaacttgcttccgtaacctttatgcctatattcttcagaaacccatagaaactcaacgtgtacatggtgccaaaaagttattgctgttaccccacctactatttcttctttttcatttcttactatgaaactaaccttttctgaaggtgttttttcttcatctgcaagatatttttgattgtattcaattactttctctcttatgtaatcactatcttcttgtacccactgctgtactattttcattttaagtgtcacgctcctttttacttatctattcaattttataatgaaattgtcctgtctttaataagttcgtaaagaagcaaagttaatggaataaaaaagagccctaacatgaggactctttataaaattaa

SEQ ID NO: 554 - DNA, 972 bp, Bacillus thuringiensis
tcgggagatcgaattgcagatttacaattgatgcaagatgaattgcgtgaattaaatcaatcacagctaatcgatccacaagactatcaaacagctttatttttattgaagcaagaaattcaaaaagagctaaataagaattagataaaggtaggtaagcaacatggaagagaaatggttagttggtgttgaccttggtggtacaacgattaaattagcatttattaatgtgtacggtgaaattttacataagtgggaaatccctacgaatacaggtgagcaaggaaaacatattacacttgatgttgcgaaagcaattgataaaaagctagaagaattaggcgaattgaagagcaagttaattggtattggtatgggagctcctggtcctgtacatgtggcgtctggaatgatttatgaagcggttaatttaggatggaaaaactatccgctaaaagatttattagaagtagaaacaggattacctgttgttattgataatgatgcaaacttagcagcgcttggtgaaatgtggaaaggtgctggtgaaggtgcaaaagatttaatctgtatgacacttggtacgggcgttggtggtggtgtaatcgccaatggtgagattgtacacggcgtgagtggtgctgctggtgagattggacatattacagtcgttacagaaaatgctttcccatgtaattgcgggaagtctggttgcttagaaacagtagcatctgcgacaggtattgtacgtgttgctatgcaaaaaatacaagagactaataaagagagcatgttgcgttctatgttagctgaagaaggacgtattacatcaaaagatgtctttgaagcacttggacaaggtgatgaattagcaggtgaagtagtagaaaaagtagcctcttatttaggattacctgtagcgaacctttctagtacattgacacagagaaaattgttattggtggaggcgtg

SEQ ID NO: 555 - DNA, 1083 bp, Bacillus thuringiensis
gaaccgttgatttattaactggagaaatgacaaaataggtaaattgagtggcagttgcataatgctattgtgaaatataataaaaaatcattttgaaaatagttagtaaaaataggcttgctttttaaaaatttgataactataataagttaacaaatagacatgaacgaaaaagtaatgataaggacacgaaatcatttttacggtttacagagagggaagccaagggtgtgagcttcctaacacgagaaatgattttaccacctttgaacttcaatagtgaacgagtaatctagtaattattggcggtatcagccgttatctgaacttgagcaatctagaaggagatacgtctagattggaacaagggtggaaccactaaaacacattcatccctttcctagggatgagtgtgttttttatggtataagagattgaaaatttaaaataattaaaaaatagtattgattttgttttttatgcgagtataatgagttaacaaataaacatgaacgaaaaagtaacgataaggacacgaaatcatttttacggtttacagagagggaagccaagggtgtgagcttcctaacacgagaaatgattttaccacctttgaacttcaatagtgaacgagtaatctagtaattattggcggtatcagccgttatctgaacttgagcaatctaggaggaaatacgtctagattggaacaagggtggaaccacgaaaacacattcgtccctttcctagggatgggtgtgtttttttactttgaaagaccaactatgagaagtcaaggggagttttttatataaatagggggtgtttttctaaaaaagggcgtgccaaataaacctaaggattttcaaaaaaaatgaaaaggtcatgtttctgttgtgtgaggtggtacttcataaggcttattgcttttaagaatggcatacataatgtaacacagctttctagctaccgcccctatacaaacatagtagtgctttccttgctttcgtttcttttcataaaaagcttttaatacagggccatgtttctgcgctgtaatacccccttggaataaggctctac

SEQ ID NO: 556 - DNA, 1929 bp, Bacillus thuringiensis
agatgatatagaggttatgtcactcgcctctgtcctttcttctatgaaggtagctattatactagtcgagtatcaaacatcatcattattttatagaacaaataagacatcttgctaattcatgctctaattaaaaaagagatctaatacatatctctttataaaacatatttaaaaataaaaaccaaaggacaacaagcatatctcttttgttgtcctttagtttttatcgttgcctattccatattgtactaaattttttattttactctattatagaatgagaataaagtttgattaaaacatcaatctgacttaatttttttcctaccaaactaaattatgctgtaaattccttatccatttagaatatagtatttagtaattcttgttctggactgaattttttagtattatagccatcgattaaacttccttatgtatattctctttataaattgagtaactaaagcatacattgttaaaattcccaataaccacagaaaataataaaatggaagtggggttaaaccaatttgagtacttaaactggtaaatggaagggaaatccctataaacataaccaagcctgtaagcatcaaaactggcctagcagccgtactttgtaggaaagggatatgttgagtacgaatcatatgcacaattaataattgtgttaataaccctactacgaaccaacccgtttgaaataaggattgcatctcaggaatatttgcaccaaatacattccacattacgataaaaatgattatatcaaaaacactacttaccggcccaataaaaataataaaacgaaataaatcttttgtatcccaacttcttggttttattaaaaattcattgtctactttatcccacggaattgaaagttgggatagattatatagtaagttttgacataatatttgaattggtagcattggaagaaaaggaagaaatgcactagcaattaataaacttaatacatttccaaaatttgaacttgctgtcatcttaatatacttcagtatatttccaaacgttgtccgtccttccactatagcatcttctaaaacatgtaagtctttttctataagtataatatctgaactctctttaacaatatcatctgctgtatggatagatacaccaacgtcagactgttttaaggcaaacacatcgataattccatcccctataaacccgactgtatgaccattcatttgaagtgcctttataatacggaatttttgactaggatttaattttgcaaacacacttgttttacttgcaagttttcctaataccttatcaggaagactatcaatttcataacccagtactggttctcctatatacaagcccattttcctacatacatttcttgtcacggactcgttatcacctgttaaaattttcacttgtactcctttcttttgtagagtatgaagtgcagcgatagccgattgtttgggtggatttaaaaaacctacatatccaacgagtatcatatctgattcatcatttatagaataacttcccactttatcactatttaattgtttatatgcaactgcaacaactcgcatcccctgctcttgccagagttcaattaggtgtttatttctacgctggatttcatctgtaataggaattatcttattattttcttttataaaactacaaattgatacaacttctctaactgcacctttacaaagcattattcgttcgttagcatttttttctataacaactgaaactcttcttctatcaaaatcaaatagacattcatctattttggagtattgagacaaatcatatttactactatcttttacataacgtataactgataaatcaatttcatttttattatttgtatggaagtaactatttatatacgctaatcttaaaacctcatccgac

SEQ ID NO: 557 - DNA, 1639 bp, Bacillus thuringiensis
tgttcgcttttgatgtgacgctaaatattcttttgcggagaacccaacgatagaaccatcatctaaagcaattttcatttggattgcttctggataaattcgtactccattttcatttactacatacgtaaatacaccaacattatcatattgagagctatcataaagctccatattattaaacttatggtcctttaaaaatttcaaacctttactacctgcatcgtttaaactaactttctgttctttaatttcgcggatattcataacccaaattggatatccgccttttccggtaatatccatatagaactcattattcgttgcttcatctttaattttcacactatagaaggattctttcgcaccttttccgcttttctctacatctactttttcatttccttttaaattcagaaacgattttgcgattttcgccgcttcatctttagaaattgcctttccttccgcttcaaatccgccttttttatttttttgcgcacttgtaaaggtcggtccgaagtttgtagaagaatatgatgttacgtttttctctacagttttcaatccatcaataattgtgttatctgctggatcgcgatttgatgcaagtgccatttctacatccatccagcgtaaattatttttcaaaacaagatgttgtacttttcttagttcatcttgtatatttcctgcatttgaatataaagtttgtagcgttttatattcttgctcatttaacggctctttttctaaatcacgaatggctgcacggtaactgaaatcaccgatattcgctaaaaattcttccgttttattaaatggcattaatgttaaaggaagttgccctacatccgagcgagcttcagatgttaaacgccatacatccgctaatgcaggtgataaagatgatcgtgaattcatcgcaagtgttgtgccaattttatcgtgtaataaatcgacttcgtatgctaaatcatggaatgcacgttgatagctattttccgctcgaattaaaactgcatttttctcttggtgctctttatagccccaatagcctgttcctactacaccgactgttaataatacaatgataatacctcgtaacattgtcccacctccgctctatttacagaaaatatgtttaccgatttttttaatttgtggacgagtccaaatccatttactagtcgcagtatctggattgaaataatataaagcatttcctgttggatcccatccgttaatcgcatctaaaactgctttttttgctgtttcatttggcgttaaatatatttgtccatcggctaccgctgtaaatgctctaggttcaaagattacacctgaaacagtatttgggaatgacgcactcgcaacacgattcaaaataacggcagctactgcaacttgtcctaaatacggttcaccacgcgattctccgtatgctgcgtttgccataagctgcatatcattttgagaataaccgttcggaacatttgtccctttattttgtagtggtttattctcttgtgcagtgccgccgctatttccttgattcgttgtcgtccctttatcagcagttgacttgtcgttcttcgttgcctacacgagcatgtgattcgttttagctccagctaag

SEQ ID NO: 558 - DNA, 1308 bp, Bacillus thuringiensis
  unsure (1)...(1308): unsure at all n locations
ttacctttaaacacttttaagtttacaaacaggagaagagaatatgcatacaaaaaaattagttttcgtcgctttatttagttctattatgggagtgttagggttaatacctccgattgctctttctattacaccagttccgattacattgcaatcactcggtgttatgcttgcgggtggattgttagggtcacgccttggtgcattaagtcagcttattttcttacttattgtaggagttggagcaccattacttgctggtggacgcggtggccttggtgtatttgttgggccaagtgcaggatatttacttggttacatcattggagcgtttgttattggttatttaattgagcgtttacgtgaagtttctattataaaagtattatgtattaatataattggtggtattttcgtagtttatgtatttggtattactgtacaagcgtttttaatggatgtttctgtatgggagacaatgaaagtgagtgctgtgtttttaccaggggattgtataaaagcaattatcgcggcgattctcgtaacaaaattacatcgttcattgaaacatattattacgcccgctttaaagaatggaaaatatacaaatgcgggatgataaagggaagaaacacgttaattccgtgtttctttttattatttttgtaaagaaaggacgtctcatatgggtattacaaaagaatacaaaaagcatgcctctttacaaccaaataaaatagcgataaaggaaaatgatagagttttaacatataaagagtggttcgaatcagtttgtaaagtagcaaactggttgcacgcaacagaatcaaagaataaaacaatagcaatcctattagaaaatcgtatagagtttttacaactattcgctggtgccgctatggccgggtgggtttgtgttccgttagatataaagtggaaacaagatgagctcagagaaagaattgagatcagtaatctggatatgattgtgacagaacgatataaggtaaatgatctacctgatgaagaaggaagagtaattgaaattgatgagtggaaaagaatgatagagaaatatcttcctacacattccactgtagaaagtttacgaaatgctcccttttatatgggatttacatcaggatcaactggaaaagcaaaagcattttttacgtgcacagcaatcgtgggttcattagttttgattgtaatgtacatgactttcatatgaaatggaggattcaatttaatagctgggacgctcgttcattctcttttcttatacggngaataagtgcattatatgta

SEQ ID NO: 559 - DNA, 1162 bp, Bacillus thuringiensis
tgatccgttttgtggaatacaattatttgccaaaaaggctatgttaactatgttttaaattatttcgggtgaatcaaaattttcatttgtattatagttgatttaaaacccagtttgttgcatcttcaaagttatctgcaatgtagtttggttcaatatgtgcccatttgtctcggtacgtatgtaaagcatcgtatccagcgcctgtgcgcaccaatatcgttatcgcatgcactgttgctcctgcaacgatatcggtccagcgatcaccaattacagcgcattttgttaaatcaagcccgtgtttttcagctgcttgtagcagcatacctgtacttggtttacgacattcacaaccatcaccgtgtttgtgaggacatacataaatatcatcaaaaccgaagccttctaattcttgtacaaaatcggctacagttgcaattccatctgcgataccaggttgatttgtgaaagagaaaatttttatattttgagcttttagtttttgcaaagctgcttttgtaaacggaaataatgtaaaagatcccggataatgtattgtagtgtcaccaccaattgtaccgtcacgatcaatgaaaattgctttaatgtttgtcatagttatagtcccttcaatatataagtagtttaaaaatgttttacaaatctgtagccatttacttcatatcctaattttttgtaaaaaggatgagcttctactctttttgttccactaactagccatgtgccaatgcaattatgtttctttgctaattgctcggcataatccatcaacacttgtccaatgcctttccgtcgtatgttagaatcaacgctaataattgaaatctctccataacgtgttacatcttctaaattttcacgtatacgaaatccaagtaacccaaatatagcttcttcttcctcgtaaacatataaaaaatcaaacggactcatttgtacgaattgtaatcggttgttcatatcttcataggaaatagaggaaccttttaattctttcgttaaagaacaaagtgcgtctatatcatctatcgttgcttcacgaatttgaaaagacatattatccactccaataaaatgtaatcaaacatttaatattctgttaaaaaatgttttttcctgctatgaaaattaatatttt

SEQ ID NO: 560 - DNA, 1152 bp, Bacillus thuringiensis
tgcgaacacgttcttgaaattccgcgacagaaattgaatcttccggattttttatatcgatcatataatgtggaattccgtccatctctgcttttgttacctttgcagttccaatatccatcgttcgatagatctgcatggaatcaccactaataatttcaccgttcaacgctttggcaagatcgatacttaacttcgtctttccaacagcagttggtccaatgatgacagcaactttttcacgttgcacttctcccatattattcaactctctttatgtaatatactccatctattgattatacccaatcttaccaattttaacggcatgattgcaagttctttcatttcggtacatgaaattacacagaaaaaagaacatagtttgtccaattctgcatatacatgataaaaatagtttcgagaggatgagttaactatgaaacaatccaccatcaatttttcatctttgacaaaagacctcattttagctacttctataaaagaacaaaattgttcacaagaggaattatacttcgccctaaattgtttactacgggcttttcattctaccctccatgaaacaacattacatccagaaaataaaaatacagaatatatacaaacgcaattttgcagtgcatataaaattattacaggtaaaactatttatccatttcaataatccataaaaagcggctgcttacataatttcaagcaaccgctttttatattaatatcgataacctattgtataactttcacttttacagatttacgcccccagctattagcactaccatctgaaccgactaatacatcaatacgatttcctttaatcgcaccaccagtgtctccagcaatcgcttctccatatccttctacccatacttttgatccaagcggaattactttcggatcaacagcaattactttcatatttggatttgctgttaaatcatgccccattgcagttaatacacgaccaccatacgaaccattctcactcggatctgctgtatatgccgtcgcttctactgtaatttcacgaccaccagtaggcgcacttgtttcagtagattttgcaactggttttgcagccggtttttcttttaccacaggtttacttgattctacattcttaatagaatc

SEQ ID NO: 561 - DNA, 1246 bp, Bacillus thuringiensis
gcgttatttccgttatatcctcagcatctgaaggctataattatgtcggctggaagttatttgttgggcaagtgtatgcgatacctattttcttcattactacgataatcacattttatataaacaagaaaaaatcttacgaataaacgattataaggatagctaacgctatccttattttaagttcgtaatcaaaactttatatcctttcttctaaaaagttaaacgcaacatctgtatttcagcgtttaaacgcagttcctccgaaatccagctctctaattttgaaacagatgcaatattttttcaaaaagcccctgtaatttacttttcaatacttccatatcattaagcatacacaatgcgactgtttaaaagttaaaaatttctgcttattataaataaaaaaggacaaatagccaatctgactacttgtccttactgttcatctgtacgcaatacgattaagcttggaatgcttctgttaatactggtacgatttgttttttacgagatacaacaccttttaaagtagctgtattgttttctagtgatacgttgtatgctttctcaacaacgtttgctgctttaccgatcgcaagaccgacagaatcgttagttaagatatcagttacaacgaataagaataggtctaaacctttttcttctactactgcagaaattactttttcaagttccgcttggtgtacaagaacgtcgtttgtatcaacagcgtttacttgtgcgatttcaactttcgcattacccatttggaattctttagcatcaagagagattaattgctccattgtttttccgcttaagtcagcaccagcttttaacatttctaagccgtagttatctgcatctacaccagcgatttccgctaattcacgagcagctgctacatcttgttctgtgcaagttggagatttgaatagtaaagaatctgaaatgattgcagataacattaaacctgcaacttctttacgaattgttacgccattttctttgtacattttgtttaagattgtagctgtacagccaactggctcacaacgatagtatataggatcgcttgtttcaaagttagcaatacggtgatggtcaataacttctaacacacgaactgattcgatatcgttagcactttgttgacgctcgttatggtcaactaaaataacgttgtccacttcgcttgctactgtctcaacaaaacgcggtccttctactttaaaatagtcta

SEQ ID NO: 562 - DNA, 1106 bp, Bacillus thuringiensis
gaaaaaactatttttaaattctttaacacaaacatttttctcctttaccatataaaacgaaaagcgaatatacactataatttatttatcattacattaaaattttatcattataaataataaggaacgacaaaataggtaataagattccacctattttgtctatatagcagaacaacgaaattacaatcaattacttcaatgcaatgggttgttgttgtgtcacacaatgaatcataccgccgtttttatacaactctctcacatcaataccgactactttatgacctgggtataacttctgaatcgtatcgtttgcgattttatcattcggatcattataattaggcactaatacaactgtatttccgatataataattgatatatgaccctttataatcgagagtttttccattttctaaagcaaccttttctttactaagcggcaagtattcatacttatatttctgtcctgaagcattttttgcatctaacaatgtatccatatctttattagataaaccccattcggctaggtcatcttctttcatcgttacaatggtagatttattatggaatttagcaaatccatcaatatgaaagtccgtaatatctaaattaggtactccgtctaaccaaataaagtttgataccccaaggtcacttatatatttttcaatttccttttctgataaatcaggatttctatttttattcgtcaccgcacttcgagttaataaagcagtcccattgctgtctaattcaattgcgccgccttcaaggacaaattttccccaatcaactctttcaattcctgattgcttactaacatttttacgtatttgagcatcatttttatacggtgttttcttcccccaaccattaaatgctggatctaatattttgagatttttattgctgtcataaataaaaattggtccactgtcccttgcccatacatcatcagtaggcgcgataaagaaatcaatcttctccatatttaacccttcatctgtaaaaggttattgattctttcttttcttcctggtcatatgcaacaatgtggactttcttaccctcagttaaagcacttgccatcttaac

SEQ ID NO: 563 - DNA, 1027 bp, Bacillus thuringiensis
accccgcagattttaatggattattatccttatacgaatctttaggatggaattctcttaaattaacggttaacgagttagaacgaatgtgtaagcaaagttggtatgcaatttatgtttttgatgataagaggttagtagggatggggcgtgtcatatcagatggagtcataacaggcattatttgtggagttggtgtattgccaaaatatcagtctagtggcatcggaaaagaaatagtgaaacgattaatccagcactgtgaacaaaacaaggttattccacaacttatgtgtgtagaaaaattgcaatcttactatgaatctatagggtttgaagcattctctattgggatgacaaaacatattataagatagaggtgctttatcctgctatttgtcgggtagtaaaaccccacggattaaagtttcactttatattttcagtttacttgtacatattttcaaacttcaacataaaggagaatggctgtatggagattgctaaaggagtagaaatgttacaacttgaatttcaagaatttgttattcatccaattcttttatggaatgatgaaatggcagtattaatagatacgggtttcccaggacaaattgaagatatacaagtaaagatggaaaaggttggggtatcatttgataagttaaaagtcgtgattttgacgcatcaggatattgatcatataggtagtctgccagaattgttgcagcgctgtcgaagtaatattaaagtttatgcgcacgaactagataagccatatatcgagggggatttacctttattgaaggacggaaatgtatagaaccgcccaaaaggaaaagtgagtgatactgtgattgacgggcaagaacttccgtattgtggtggaatactaattctttatactccagggcatactccgggtcatattaggttatatttgaaacaaagcataattcttattgcacgagactctatgtatagtgtgaatgggatgttagtaggttttctcgccctaacaacaata

SEQ ID NO: 564 - DNA, 1391 bp, Bacillus thuringiensis
cagcattaattgggtcagcaatatttttgctcatagcactactattttctttacgtatttccgataaagaggtaatgtcaaagaagaaagaaaaaacattatctgtatcagaaaaagagaaagtacttgtcaatgaataacaatatacgtatgcttttttatgaaaattgatattcgttgaataaaggagagtttacatgatagaaagtaaagttgtagattctattccaactttgaatgagaatgattgtcaaatatggtgggcaagaatttcggatttacaatcatggcattacaatttactaaatgatatagagcgagagaaagcaaattcgtatcatcattcggcagatcgagctcgttttataataggttgcgtaataagtagattagttctcggcaagatactttctatgtcaccagtccaagtaccaattgatcgaatgtgctcagtatgtaaattgcagcatggaagaccacaattaccagaaggtatgccgcaattatccgtttcgcattcaggtgagtgggttgtcgatgcatttacaaaatctgcacctgttggcatagatgtagaacaaatgaatccaagtatagatgttatgaaaatggcagaaggtgtattaacagacattgaaatagcgcaagttatgaaactgccaaatgaacagaaaatagaaggttttttaacatattggactcgaaaagaagcggtgctgaaagcgacaggtgaaggactaatgattccaccagtacatattacagtatcagctccaaatgatcctccaaacttgttggtttttaaggatagacaagagttagcaagtaatacaatgatggaagatgtaaggcctagtttagattatagggcttctgttgcaatattcagtaaggaagtgactgaaattacgcaattagacgcggcagcacttttaaatcttaaataaaaaaattacagaagaggtgttcctcatgttagtagcggaaaatagaaagaatgaattcacttataatgtacaagcaattaaaaatattttattttctggagatacatcatccattcatgctttagaaaagcttttaaatgatacagttcagtttgatgttcttgaacaagaggcacttggtagacagtacattccgaaagaagcaaagaatttttttgataaagatggaacatttctttaccgtgtatctaatgttagttataaaggaaaggtgttatctgaaaatctaatttttgcagacacttcgtttttaccggacgcaataaagagtgaattagagagtggaaatattcctttgaaaagcttatagaaaagatggaagtaagaagaaacgtattatatgaaggatatcagccatctggaaatattattgaattgtttgat

SEQ ID NO: 565 - DNA, 1632 bp, Bacillus thuringiensis
ttccgggtggttcattcatataataaagtccatctagtttatactgggctgggtagaatgtatagcacttttcaaaggccttttcacctgaagactcatatcgtctaatccactcacgaagtacgctagggttaactcctatagatttagcaattgtttttccactttctgtaccatctaaatatcgtttcaccgcttggattttttcttttgaagaaaatttagccataaaaaatgcacctccaattgttagactgtgtctaacaattggggtgcacttcagtgctgagatgcactttgaacggctttttttatgagaattgtttaagtgctctttcggctagtaaagcaaagtattctgcacttataggcagtgcctcttcattaattgtaaaagcaggatgatgccattcatgtgtaccgctcgttcccataaagacgaatgaacctggtatttcctgttggtaaaatgagaaatcttctccagccattgacggactaggcgagatgatattaagattcatctttgtggcaacttgagtagataagtctgtaagagctttatcgttgtgaacagcaggaggacctgaataaaaacggaatttcgtttttacacctaatgcatcagatacacctttaataatacgctccatgagtgctggaatcttttcacgtgtttcagcttggaatgtgcgaatcgttccttctaacgtagctttttcaggaatcacgttccacgtatttcctgcatgaatatttgtaacactaacaactgcattatgagatgaacttatatttcggcttacaattgtttgcagtgccatcacaatttgagaggatgcgacaataggatctactccagcatctggtacagccgcgtgtgtaccaactccgtgaatttcaatttcaaatcgatcaactccggccatcagtggaccatctttaatgccaattgtacctattggtaaatcaggtttattatgcatgccgaaaatcgcttgcacattacgtaaatgtccagcatcaataactttgcaagcgccattactactttcttcagctggttggaatatgaagcgaaccgttccatttagggaagattctctttcttttaataagaaagcagtacctaaaatagcagctgtatgaaaatcgtgtccacaagcatgcattttccctcgtactttagatgcataggacaaatgtgtttcttcttgaataggaagggcatcaatatcagcacgaactgctacaattggtccgtttttattaccagacacttcagcgataattcctgtttctaaattggaatcaatgatagtaatgtttttttcttctaaccaattttttattgcttttgttgtttcgaactcttcatatgatagttctggatactcatgtaaatgtcgacggatggaaataagtttttcttttagttgatttgaaatagataccatgtagtatgccttctttcttcagcaaaatatttatcataagtatacaacaataaaagagaggattctcaaatgaaaatcctctctcgtttatcccataaaagcccgattggttcaactaattaaagtttcactttatgctgcgacttttttatgcgtatgatgtttacgataacgt

SEQ ID NO: 566 - DNA, 1371 bp, Bacillus thuringiensis
gttttgaacataatcaagtttctatatgtgttgtcgttcaaaaaatggttttccctgaggcttcgggtattttatttacggctgatccgattacttcaaataggaaggtgttgtcaatcgatgccagctttggacttggcgaggcgctagtatctggattagtttctgccgataattataaggtaaaagaagatgaaatcgtcgaaaaggtcatcgcaatgaaaaaattagccatctatggacgaaaagaaggcggaacagagagaaagaaaattgctcctaatcagcaaaaagttcaaacacttactgaacaacagattttacaactagtacgcatcggaagacaaatcgaagcttattttggttgtccgcaagatattgaatggtgcttagttgatgatacaatttatatagtccaaagtcgccccattacgactttatatccaattcctgaagaaaatgatgagggaaatcatgtgtatatatccggttggccatcaacaaatgatgaccgatgcgatgaaaccattaggtttatcttttttgctgataacgactagtgcccctatgcgtaaagcgggaggcaggttatttgtcgatgctacgcaacaattagctttacctgctagcagagattacttaataaacactttaggaaaatcggatctactcgtaagagatgcattaacgactatagttaagcgagataattttattaaattattaccagatgatgaaaaagggaagagtgttggtaaaagtgtgccacctgcaaattctcaaccggaaattgaaaatgatccggcaatcgttacaaatttaatacagaatagtcaagcatcacttgaagagttaaaacaaaatatgcaactgaaatcaggagtggacgtacttgattttattttggaagatattcagcaattaaagaaagtattgtttaacccgcaaagtatcgctgtcattatggctggtatgaatgcttcaacatggataaatgaaaagatggagcaatggttaggtgaaaaaaatgcagcagacacgctttctcaatccgtacaaaataatattacatctgaaatgggtttagcattaatggatgtcgctgatgtgattcggccgtacaaagaagttattacgtatttacaacatgtagaagatgatagctttttaaatgaactagttcagtttaagggtggagaagaagctcgagatgctattctaacttttctaaataaatacggaatgagatgtagcggagaaatagatattacgaaaacgcgctggagtgaaaagccaactacaattatcccgatgattttaaataatataagacattttgaatatggtacgagtacgcccaaatttgaagaa

SEQ ID NO: 567 - DNA, 416 bp, Bacillus thuringiensis
ctgtagaggtcttataacctattcaattaaatccgcttaatgggaatgtttggcatgcatgggatgggaatggaccagcaaatcgtagtaggatgggtatagagatttgttattctttgtcaggaggggaaagatatcgttaagctgaattgaaggccgatgaagtaataggtgagttaatggatatgttaagcattccaatttatacatgataaaacgcaccaagaaagaaacggcaaatattgtcctcatagaatgattaatgaagggcgtgtacagtggtttaaacaacaattagtgtttggtgcggataatcaaattccagaaacgccactgattacacaaccaccaattacaagtggctcaggaattggatatcttactggtcaaaacgtgaacttacgtaagggaccagg

SEQ ID NO: 568 - DNA, 1333 bp, Bacillus thuringiensis
cggtcgtgtatcggttctggtaacggtaaaactggtggttaaggtcataaaggacaaaacgcacgttctggcggcggtgttcgtcttggcttcgaaggtggtcaaactccattattccgtcgtttacccaaacgcggcttcacaaacattaaccgtaaagagtttgctattgtaaacttatcaacgttaaatcgttttgaagatggtacagaagtaacacctgaattattgctggaaactggcgttatcagcaagttaaacgacggtgttaaagttcttgcaagcggagcagtagagaaaaaactaactgttaaagcgcacaagttctcttcaagtgctaaagaagcaattgaagcagctggcggatcagttgaggtgatctaatgtttcgtacaatctccaactttatgcgcgttgctgagataagacgtaaaatattattcactttagcgatgttaatcgtattcaggattggcacgtttatccccgtgccatttacaaatggagacgtactgaaggcacaagatcaattaaatgctttaggtattctaaatacatttggcggtggagccttgaaaaacttctccatctttgcgatgggaatcatgccgtatattacagcatccatcatcgtgcaattattgcagatggatgttgttcctaaattttcggaatggtcgaagcaaggtgaaatgggccgtcgtaaattaacgcaattcacgcgttactttacaattgttcttgcgtttattcaggggtttggtatgtcaatcggttttaacggtatggtaggtggacaattaattttgaatccaggttggagcacttatttatacattgctacggtactgactgctggtactgcatttttaatgtggttaggtgaacagattacagctaaaggtgtaggtaatggtatttccatccttatctttggcggtattgccgcagcgatcccaagtgttatatctcaagtgtatcagcaacagtttcaaaatatcggagatcaattgttcatgagtatcgttaaagttgcattgattttactagctgtgctagcagttattgtgggtgttattttcattcaacaggctgttagaaagatcccaattcaatatgcgaagcgtgtaacaggaggaaatggtggttatgctggagcacaaaacacacatttaccgcttaaggtgaatagtgctggtgttattccagtaatttttgctgtttcattcttaattacgcctccgactattgcacagttcttcccgaaacatgatgtatcgcagtggattactgcacactttaactattctcacccagtaggaaaaatcatata

SEQ ID NO: 569 - DNA, 1079 bp, Bacillus thuringiensis
aattaaggtcatatactctctttccttggcaattttgattaattctttcattaatgaagacccaatgccattttttctatatgccttatctacatacacagaatgttcaactgaatatttataagcaggccacgctctaaatgggccgaatgtcgcaaatcctactactttattatctaattcatatacgataattggatactcttcagcctttttttgttcataccaatctattctattttcaagggttacaggtttatacgcatatacagctgttgtataaagtatcgcatcgttataaatatctaaaatgtatgctaaatcttttttcgttgcttcccttatcattattttcttcctttcatcatgttcaccttattttactatctttttaatagttttattttatcgaaatttccgatttttatctacatacgaatactagcttttcggaaaccatcaaatatatttattgcagcagataacatgtagaagaaaattcctcccccaatgagccacgttttaaactcctctgaggaaatagtaaatgcatttgccaaatacgtaataaaccctgcgttaaatacatgtggatttactacaattacaatgaatactatcgtcccagctatttgaagaatagcattcccaatcgccaatctttgcgtccattgtccctgcactaatttataaagggatatacatatttcaaaaacgatcataattacaacgattggccagtactgcaataaaacatcttgattaaaagttggcgagacaaacttcagtccatttgccgtaccgttatatacgccaacaagataattcgcataaaagtaaagtgtagcccaaactgctgtccacattaaacctccaaaaacttcaaacttcgagattgcttttttctttgggatatacgagatgtttttcaaatcatctggtgtccatttttttaaacttgtcgtcaacggctcgatacctttgtctttatctggtctttctaaaataacaaacacaactgtcaaccagaaaaatacatggaggctcacttcaaaaattttcccaatgcctttacctat

SEQ ID NO: 570 - DNA, 1156 bp, Bacillus thuringiensis
ttaatgttcgtagaacgtaatttaaatccatcacgatttttattaatagaagatgaacatcctattggtacagtagaatgtattaagtatacgatacctgaacaatcaaattctgagtttttctatccgttttctaaaaatgatttagtaaaagatttgaagaatgtatatgaaataggcaagttaagtatttcgaaaacgtctcgtgggagaggacatttcaaaaggctaacagctattttatttatacatgcgttagaaacaaaagctgaatggtacattgcagcagtaacaaaaagaatgtatatgtatttacttacacttggttttccaattgagccaatagataatccatttcagtttcatgatactttacaaggtgtaccagtaagaattcatgctcgaaaaggggttacgcatttgtattctttaaaagaatttcgtgatgtgattcaagggaatgctcatgcacaggcattaattgcagaatacagtaaaaatattatgttaacgaaataaagcgaagtgaatatgtataataaagagaataatatttgtataggatataactcttcattaaaaaagacccttattattttaataagggtctaaaaattataatccaaatatactaaaaatcattttgcggcgcttcggtttcttttctcgttcatatgttggttttgaatcaggagtaatataaatgggttcttctttcgttagggcagcttctaatttttgaattcgctctaacatttcctccatttcacgacggtgttgtaaaagttggtacgtgacgacatcatttgccttatcttgcatttgttcttccattcgatcaagtcttctcgtaatagtgtttaattgatcagctaattgctcaaaatcattgggtaatatgttttgaacacttgtattaacttgagtttttaattcctcatcttcatttgaggaagccttttgagtagattgagaattttgagattgctttatttgaaatcgatggtgttccaacatttgatcgacatcctcttgtgtgaaaataaagcggccatatttgtttttctctatcgtaagatttaattgctgtgcgattccggcatcaatccttgggctaacacctaatttctttgcgataaatgctggctttcttctt

SEQ ID NO: 571 - DNA, 1299 bp, Bacillus thuringiensis
aatatttatttattgtttcaaacacaaaattatgtgaatcttggcttgtataatttagccagcgtggtattacagcctctcacatttcttgtaggggggaaattagcgaaacgtatcgatcgctcgattttattacgaataggggtaggaacgctcgcaattttttttatcgttgtcttagtagcagggaaaagtgcttctcagtatattctattaatgggggctcttttaggagtaggatacggtttttactggttggcttttaacttattgacatttgaaattacagaaccagaaacaagagatttctttaatgggtttcttggacttcttacatccttctctgggatgattggaccaatagcagcaggatacacaatttcacgtatggagaaatggagtggctatactgttatattctttctttcattagttctatttgcaattgctgtcgtcttaagcttctttttatctaaaagagaatgtgaagggcgttatgaaatcgtgcaagtattgaaagaacgacggattgataaaaattggggaaagattacacgagctcattttttccaaggattgagagaagggacgtttatttttgtcatttcagtatatgtttatttagcaactaatagtgagttcgcattagggaaatacagtttagtgaactctgctgtatcctttgtatgttattacttagttgctcgtatgttaaagaaggagtggcgaaaaaaagcaattttacttgggggcattattttatatgctgtcgtctttttagttattttcaatgttacatacacgaaattacttatttatgcggcatgtattgcgattgcatatcctattttacttgttccgtacggatcaatgacatatgatgtaattggtagagcgaaaaatgcgagagaatggcgtgtggaatatgtcgttgttcgggagttatggttaaacgccggaagaatctgttccattttaagttttttatgtgctgtactattctttccacctgaaaaaagtttaccttacttattatgtattttaggtgctggacattttcttatttattttgcagttaaaaatgtcaaatatgatgagggaaatgcgagtaaaacaagtgttgtaacgcaagaaaacgcgcaaaaccaaactgaaccagaaggttaacttctcgtttgttttatgctagaatagaaaaagatgtaagacagcagtgaggacacctgtatgagggtgtccctttcacattacatagctgttggtagagggggtttgtatgagcaagaagcagaagcaaat

SEQ ID NO: 572 - DNA, 1562 bp, Bacillus thuringiensis
ttgggttgctttttcaacaaataaacgaggtttctaaatgctaccgcatttccaaatcggcttatggggtactcatgccttcatatactttggtttaatctatgagtgtccacaaaaagttgagacggctcatgccttcttagaacatttaaatgatttaaaaacaaatattccaaatgacttcgtttggtccattgaccatactaaaccaagtgtgaaattacataaaacacttgaaaccgaagacttacaaaagatgattgaacgattagctactgtaaaaaaagcagaattattagttggtattcatatatcaccagaggagttttcagcaatgaccaacgaacaattccttgctaagattgaatctacgatgcaatcactccttcctttatatgcactgtgtaatcgatagtagaaaacggacaatttatattgtccgtttttagttgttatcacattatatcacttcagtttttatttttcaaaatattttttacatttttacgagcttttgttcttcgacttcttttgccctttgaatagcacgatatatagagtatccacttacttcttgaaattctttatcaattttcttttcttctgctttcgatggaacaatctctttaaaacgacgatataaacccattaactcttctcttataatccctttttcataagctttctcaatcgcttcataaaacttaacaattgtaaccatttcctcatttgaccaatcataatctaacggatattgatattccatttcgcacctcatttatcatttcttcttgtttcattatgctatcttaaagagaatattttattcttcattatagccactctgcattatacactatttattcattttaatggaattgtcttcctctattcattagttgaggctaactattaaacatactcaccttaaaaacatttttttctatacatctataattattggtgatataatgcttttgttttatagaaaataaagtgaagctaccatctcaaaaacgattttttgaatggcagaaaaacaagccttattctaaaaaaggctacacttttttagagcaggattatataaaacaaattacactaaatattatgaagaagaaggggtgtatagattgtcccaatacgaaacaccattgtttaccgctttagttgagcacagtaagcgaaatccaattcaattccatattcctggtcataaaaaaggacagggcatggatcctacatttcgcgaatttattgggcataatgcattagcaattgatttaattaatattgcgccactcgatgatttacatcatccaaaaggtatgattaaagaagcacaggatttagcagccgctgcattcggtgcagatcatactttcttttctattcaaggtacaagtggcgctattatgacaatggtgatgagcgtttgcggtcctggtgacaaaatcctagtaccacgaaacgtgcataaacagggatggtcgctattaatttctcaagtgcaaaaccgatttttatgcgttctgaaatcgatccaagctcggtatttttat

SEQ ID NO: 573 - DNA, 1678 bp, Bacillus thuringiensis
ccatcttgcacacgtgcaattactaaatctaattgtggtgctgcgatatcccagttaatgtcgccattccatttcgaaatatctacaatataacccattatttaacatctcctttttcattattatattcaaagcttgtttttttgttattatcaactaataaatagtatgagaggtattatattattgggtaataatttaaaattcggcttatgtattgagaaaacaaatattattccgggtttaataagtaaagatttacaaaactctaaactatataaagtgaaacgataattagtaggaggctacgagcagtgtaattcccacctaatttcttagcttcatccgaattttgaggtgagaattttacttcccgcaaatagcttgataaataaaaccacctttctgacaggtggttttgtgtactaatttacatataaattgtccatatttttatagttacttaatatacttgttaactaaaaataagacaatttttagtttttaatcaaaccaattttcgttttatctcacgtactcatagtaccatttacgtgcatctaaccaagctgtaaatttatcgatattcccggacggatagccattcgttatagcataaccaatgccatctttttgaacgacaatttgtccatcaatacccgcatcaaccatagcttgagccaaatcttgtaaattactaaatgctacaccaccagtttttactttgagcaaattcgctgcacctcctccagtttgtcctgtaagagcaaatacaatagaattagcgattttatcaacattccattttgccatgtcggattcattatcaataaaccctaattcaataagaatagccggtgccttcgttccatttaatactgctaaatctgtacgttgtttcgcacctcgatcacgccatccaatatcttttgctagttgagctgagattttagccgccaaatctttctgatcataatataaaacctcaacaccctgtccatttccatcacttgcattaagatgaaaagaaataactaaatccacagcatgggaattgctattccgaatgatattatttaaattttgtgattgagttgcccctacctcgtccgtatcgtcataaaccgtgtgtcctagggctcttaacttagccgccacggcatctttaacttgcctatctagaacgtgttctttccgattcccgaaattagcaccttgaacaatactattgtgtcccccgtgcaaactatatctagccattattcatcaacatctcctttcttaatatcttattcaaaacttgtcttattgctattcccaccttacaatcttaactgtgcccatacgtcctatattttctaaaggctatgcagtgtgggtacgatataaaaaagctatcgcttcataaatcgaatgatttattctctaaattactcatacatgaatgacgacacgaacaaagaagcatcaccctttccgcgatgcctagaaactctatggtactgttcagctccctaaagtaatagaggttgagactcactgaaactacacctatatttcctgcccttgcttgacagcttctatcgacctctgcagcatatacccaattccttggcgcccctctagcggatatggaaacatgtgttctggatatcactttgacactacttttgtatgc

SEQ ID NO: 574 - DNA, 1477 bp, Bacillus thuringiensis
atgtgtatgagtgcaaagtataaacaaattgcagatgttttagagcaaaacattcgagatgggcttggtgatgaaacgaaaaaactacctacagaagaagcgttgatgaatcgatttgaagtaagccgtaatacgatacgtaaagtaattagtcagcttgtgaatagaggttatatttttcaagtgcaaggtagtggcatgtttttacgcgaaacttctgtaacagattacattaatttaggaagtttacgtggattaacgaaaaatcttgtttcacaaaatattgaaacgaaagtgttagagcttgaagtaatagatgcggacgaagagatagcaaagcagatgcaatgcgaagctggaactaggttgtattttttgaagcgcttaagaattgtagatgctaaaccattctctattgaagtaagttatttcaaaaaggatattattccatatttgaacgaagaaatagcattaagctctgtatacagttatttcattgaagatttacgattaaatattggttttgctgataaagttattagttgtgaaaaagtaaataaagaaaatgcacagtttttagaattaaatgaaggtgatccggcgcttcttattgaaaatacagtgtatcttgtaaatggaacaatttttgagttatctcagtcgatgtttcattatgaaaaggcgaaacttttaaatcgaattaattttaaatgaaaaattattgtgtgaaaaaagcaactggtcctaagtgatcagttgctttttattttttaagtggatgagcaaaaaaacacgaaagtggttggtccgctttttgcaaacatctattatgataagagaagaaaggtagtatgttatcaacgttttaaagaggaaggtttttatgtaagttctttaattaaaatagatgggtcttagagaggtgaaaagacaatgagttttgcaatttcactagtcgttattattgtaattgtatcgctatttgggactgtactagttgcaagaaacgtggaggagaattacggtaagtctacaaaaagaaatgtgaaaaacttatctgcaatctatattcttcttctttttgttctactagttggggtaacatggtatgcggtcatgatctgatagtttgtaaaagaactgaaatgagagtatgaagttggaattttagaagctatcgagtaatcagaaagagaaccattttggatatatccatttacggataagaaaatgtgactaattaatactatttttacggtgaatactgttagtaaaaaatgaggatagttcgttttgaaaggagggaactatatggaatggaaaccaaatcgtgcagataagacacctgtatataaacaaattgctgattatattgaaagaggtatttcttcaggcgaatttccttctgatagtaagttaccttctgagcgtatgttagcaaaggaattacaggtgaaccggaatacaatagtagctg

SEQ ID NO: 575 - DNA, 2038 bp, Bacillus thuringiensis
cgtgatcgcttttaattgttgaaagtcggtgagcgataatatatgtcgttcttccttttttcacaacttctagcgcttgttgaatcatcgcctctgtttctgtatcgatactagatgtcgcttcatctaaaattaaaatggctgggtcaaaagcgagcgccctagcaaacgatataagctgacgttctccggttgaaagagtacttcctttctccgtaatttcttcatttatattgttcgcaaatctttcagcaccaacatcacgcaatgcttttacgatgcgctcttttgaaattttttcattttctaaacttacattagatgctactgttccgctaaataaaaacggatcttgcagtacaattcccatatgttcacgagttgcttgtttcggcatctcttttacatcatgaccatcaatcgtaagctttcctttttcaaactcgtaaaactgaaagagtacgttcataatagaactttttcctgatccagtatgaccgacaagtgccacggtctccccttgtttcgcttcaaaagaaatattttttaacacttcatctttcccattataagaaaacgatacattatcaaacttcacatttccttgtaagcgaggcatacgctcttcttctactgcttctcctttttcctctaacaattcaaaaacacgctctgatgcaacacgcgattgttctaagttagcaagctggttcaccatattcgtaatcggtgagaacaatcgtgttaaataatcaacgaacgcatacagtatccctagagaaatgacgcctgtagcacttaatgaagcgccaccgaaataccaaatcacacctgtgaaagcgatatttcttaatacggatactaaattatgagaagttgctgcatttaaattcaaaattttattttgatacttaaaataatcgccatttaattcttcaaactcttttttcgtttcacgctcttgacggaacgcttgaataattggcatcccttgaatggattcatttactgttccgttaatatcagataaacgagagcgcattttatgattgtatacagacgcgtattttctataaagaattgcccaagcgattaaaatcgggataatgagtaaacataacgtcgccaattttacatcaagtaaaaatagcgcagcgaatatcccaataatatagatgatactcgaaacgaatgtcgcaagtaccgttacgtatagatcacgaatggcttccgtatcattcgtcacacgcgacacaattttccctgctggtaaatgatcgaaataacgaattggcaacgtttgaatatgagaaaaaacatcttccctcataatttgaataattttgttcgctgccttttgcaagaagaactgctttccgtatgcaaataatgatacgactactaataaagcaaaatagccaccaccaagtaggagtaaacggcttatttctggtttataaaacgcaaacacttcttctttcgtcaatgctttcgctttatacacttgcaccgccttaccattttgaacggtaatcatatccccttttacagtacgtgatccttccgcatttactttattcggtacaaaataatattgaaaaccgacttgcatcacgcgtacttctttcccttttttctcgccttgttcaaagcgatcacttcgcttataaaaagccccattatacgaaacagcatcttcactctgttctgtttcataccaaggtttctctatcccgacgatatgatcgtcaatcatcgttttagcgacgaaaggaccagcaagctctgcgatgacgaaaataaataacattaacatcgcagcaaaaatcgtccctttcactttcatcgcgtattgaaacaatcgttttgaaacgctcatattttcaccccactatccgcactttcactttcaccttgttgtctttcaaactgttcagcataccagcctcccttttggataagctgagcatgcgtaccttcttctataactgcgccttcatccataacgagaatccaatccgcatattgcactgcagat

SEQ ID NO: 576 - DNA, 1537 bp, Bacillus thuringiensis
gttacttgcgtgtgcgtattctactacttgtttagtagtttcaacgttttcttcgaatgggtggtgagaagcgtcgatcattacagatgtgaaacctgcatcgattgcttctttacatttttcgaagcttgaaccatgatcaaggtgaatcgctacaggaacagtgatgttcatttcttcgattaaagctttaaccatagctacaactgttttgaaaccagtcatatgacgagctgcaccctcagatacacctaggattacaggagatttttcttcttccgcagcagctaagatagcttgagtccactctaagttgttcatgttgaattgaccaactgcgtattttccttctagtgctttgtttagcatttctttcatagaaactaaaggcatggtgaatcctcctaaaaaacgttttttgtatccgataagttcttatcgctggtagtatgaccagaataaggtaaaatatgtatatctacataccggacttttttctacactcaataggataacaacttgtactcaaaaactcaaccgtattcacctgcacaatagtccatgtaaacgcttttttccatattttttataaaaaattcatttttacgcctctacagcgagctcatttctcacagcttgacgaatttcatcaatatcaaatggtttagcaaaatgcattaaagcacctaaatcttttgcttcttggatcatatcaagctctccataagcagtcattaaaattactttaatactctcatcaatttcttttacatgctttaaaatctctataccatccatgcctggaattttcatatctaacactactaaatctggattatcttttttcacgatatctaaagcttgaaatccatttgctgcttggaatgtctgataaccttctttttggaacacttcatgtaatagcacacgaatcccatattgatcatcaacgattaaaattttaccttccataattcccaacctttctgtgtaagtacaagatttaaagcttcttatatcttaacgatttattttcgctattctttggcaaattccttcctattctttcttattttaccgtttcctattttgttatgctaccctacgatttcacctttctaaaaaaataaactataatgaaagccggcaaacacgtacgaagggagtaacattatgttaaaaattttttcaactcaattaagtggttatttctccagagtttctcaaaaagaagaaatgaatatagaagatagtgctcgtttacttgctcaagcactagttggcgatggtttcatttatttacatggtacaaatgaaatggaagggcgttgttgccgaggcactattcggtgctgaaccaatgaagcaagcaaaacgcttatttgaaaatggtaaagaagcagaagtaacctctgcggatcgtgtactttttattagccgtttttcaacagatgaagcggttgtagaaattgcaaaaaaactacaagaagagggacactctattgtcggcatttctgctcttcaagaaggtaccgaa

SEQ ID NO: 577 - DNA, 1589 bp, Bacillus thuringiensis
caaaaccaacagagaatgttattagatttggattcatttctcttgcgatagaagcgatgatagatgaatcgataccaccaagtaagaatgaacctactggtacatcactacgcatatgcacttttactgaatcatataacacatcacgaattgcttggatatgctcctctttcgttgcacttgaagcattgaaataaggtttccagtagcgatggatttccatctctttaccgatttcttttacgaaataatgaccaggctcgattttattaacatcaattgttaaagtttctggctctggaccatattggtacgtaaagtaatgttgtagtgacgttggattaacgcctttatcttccatcacatgcataatacttttcttctcagatgcgaagaatgtagtatcaccttgttgtgcgatgtataaaggtttaataccgaagtggtcacgtgcaccgaaaagtttcttttcttcacgatcccaaatcataaatgcaaacataccacgaaggtagtctacacatttttctttcatatgtgcatacaatgcaatgataacttctgtatcagattgcgttgcaaacgttgcacctttttcaagtaacatttcacgtaattctacatagttgtaaatttcaccattaaaaataattacatatcgatcattttcataagttagcggctgatgtcctgcctctaagtcaatgatgcttaaacggcggaagccaaattgtacatgttcatcacgaaaatatccttcgtcatctggaccacggtggaaaatcatcgtgttcatattttcaaattgatgtttttctgtttctgaaaactctctagggttttcacataaacatcctacaaaaccacacatacttcttaccctctttcagttttcattctgtctctatactactatatcaaccctatttatactagcataatcaactgaatatggcgaccaaaaactataaaaaaatcactccatttcacatttttaacaattttttatgaaaacatgaaaactaggcactcacctttctccgcttttgtcatatgatattgcaaattgatttctaggagggaataccatgagtgaagaaaaaaaagattcttctcgcccaccggttcgtaattacttaaagcaaattgatgatttcttcgagcaaacacctcttcgcaatgtaatcgctgatttaaatcattttttccaaaaaggaaaccgtttattaacattccctgtagatttatatgaagttggtgaagaactcgttgttacagctgaactaccaggtatacaaaaagaacaaatccaaattgaaatacaaagtgaatacttaaaagtctctgtaaaagaagagatacttgaagaggaagaagaacaaacattccataactattatcgccgagaacgttccatttcagaagcatcaagattgattaaattgccgtattcaattaataaaaaagcggcaaaagcttcttatcaaaatggcgtattagaaattcgggcgccgaaacttccccagcaacatgacattttatcgatagactaatgcaaaaaaataaggggtgctatgcacccttatttt

SEQ ID NO: 578 - DNA, 1486 bp, Bacillus thuringiensis
ttcccccttcaatatgtcagtagccacaacagccgtcgggatatctaactcttctaaatttttattatatgtaaacattttaatcatatctttgacacgttttccagcaataaatcccattttcggtaccgtgaaatctaaataatacttccgcttaaaaacagatgccaatttatacaatctttcaacgttactacttgccgcataaaacgtacctattagcgcccccatactacttcctgcaatcatgtgaatagggatacccgcttcccttaaaacctttattacaccaatatgagcaaaccctttcgctcctccagacccaagcgctaaaccaatctttggttctttcatttttctcaccctttaatttttttcattcctttttcatacttatggtctaaattcactacgtatccacgtatactgaaatgaacgttttttgggacaaagggggatttacttacatgtatgaaaaatggaaaaccgctttccttaccatatcaacgctatttttaaccttttctcttgtactccacccccaagccgctttgcaagcttctattcgcgggttaaatatatggtgggaagttgtattcccttcactactaccgtttttcatcattgcggaacttctaattagtatcggtgttgtaaaatttattggcgttatattagaaccactcatgcgcccactttttcgcgttccagggataggcggatttgtttgggcgatgggaatggcttctggtttccctgcaggcgccaaattaagcgctagactacgaaaaagcaatcttttaacttagattgaagcggagcgcctcgtttctttcacaaattcttccaatccactttttattttcggtgctgtgtctatcggcttttttaataatccgaaattaggaattatattagccgctgcccattatttcagtaactttgctgtcggattaattatgcgtttttacggcgataataccgcttacaaaaataatacacacactacaaaaaaacgtcgctttcaaaacccttttttaattcttcacgagacacgcttacaagaaaaaagaccaattggtaaattacttggggatgccattgtttcttctattcaaacattacttatgattggcggatttattattttattctctgtgttaaataaaatgattactgtattccacattacagcagctctttcttttattatgcaacatattttatcattcttccaactaagtacagattttagtatacctatattatcaggtattttcgaaatgacactcggaagccaaatgattagtcaaataaatgaaacaccgctcttacaacaagctatggtaacaagcttcattttagcatttagcggcctttctattcaggcacaagttgctagtatattagctgaaacagatatccgatttaaaccctattttttcgcacgaattattcaaagtattcttgcccctatttttacaca

SEQ ID NO: 579 - DNA, 1802 bp, Bacillus thuringiensis
aattattaactgaaccttgaggcactgtaaacggtttgctagtaaaatttacactaaatttacaaagagaagaaaagtttacaatcccttaaagaaacagctgtgttttattggtttttatcttgtataaatcttaattttgtaaagaaatcacactttttagaataatattgttcagtcgaatattaaggaaagcgtctgcgagttcatcgtatattttttgatgaatgctaaaaaaatatgtaggaaaatgcatgtagttttataacagcaaaacgaggggaaataattcttttaacacgataaaaaagccactgaattatccagcagctttttccgtgtttttatcgccatgctttcgttttcttatgcttgtaatgtaaatgaagagaaaagcaataagtaatagagaggagtaacgatatacagttgcatagtttgtaaaatgagcaataaatccaaatataatcgctccagcgccgattccaaggtcaaatgcggagaagaatgtagccgttgctacgccgcgtcgatgcggtgctacgcggtcaatcatccatgcttgtagtgcaggttggatcgctccaaaaccacttccgtaacatgctgcagcaataattaagctcggaattgtcgtcgtatacgacaataaaataatgcctgtaaaagttataataactcccggaatgatgacgaatgtatggcctttcgcatcatatagctttccagagaatggacgagttacagcgattgctagtgcgttacataaaaagaagagactaatatcagctatgccgacttctgtagcaaatagagtgataaaacttccgattcctccgtacattaatgtaatacataatattaataatgaaggaagtaaagctttacgctcaataaatccatcgagaaaagtactagatgattgttggggaggctgcttagatttttggatttgaagtagtttcgttaatattaatgaaacaattgtgcacgataatgcacataaaaaaagaattgtgaagttatatgtttgcataagccatagtccgataagtggaccgagggccattgcaattgttccagaaaggccaaaatatcccatgccttctccgcggcgagctgagggaattaaatcagaaacgacagttccatatgtagtcgttgtaataccgaaaccagctccgtgtaaaatacgaacagcaagcaagagaaagatagttgaggcgaaaaggtaactgcccatagcgagtaaacagatagcagtgccgatcattaaaatgatttttttattgaatttttgcaaggcgttcccagttagcggtctaacaaaaagtgccgcaacggtaaacatgccgacaacaaatccgatattggaacttgtgccaccaatttctttcacataaacaggtaaggttggaattaacatttgaaaccctaaaaacatacataagtttgcaaaaattaaagcaacaaactctttcgtccataacggttctcgttttacgagtattgcttctcccatatattcatcccctatataaagttttctcttttctttcgagtatatgtattggccaatgcaacagtcaaggaaggtgtcttgaaaacggataacaatttttaagatgaaaaactgacaaatttgtgtaaaagctacacaactatgaaaaaaagatgtaaagtatagatgtatagacttgtaggtgttaagaatgatagaaattgttttttctttaaagaaagcggattcaaaagagtagtgaacaagaaggggatatatactttttcactacatatatttg

SEQ ID NO: 580 - DNA, 1269 bp, Bacillus thuringiensis
agggcccttagactctctttgtatgttagcttcgtttttgcttctatttgattaaaaacctttttaagaccctgtttcatgtgttgtcgttccttgtccttcaacttctggagaaccagggcccgatcttgaatgttcttttttcacttttttactcatttatattcaccccttcgcgttactttttgctcgaggggaataaactatacaatatgtaaaataaaaagcgagaggaaatcctctcgccttttttcatattttagaattcagaagaacctggagttcttgggaatggaattacgtcacggatgttagccataccagtgatgtacattaggaagcgctcgaaacctagaccgaatcaagtctatcatgcacccccgtattttctaagttctaagtaccaccagtagtcctcttcgttcatacctaattctttaattctgtctactaaaacgtccattctttcttcacgttggcttccgccgattaattcgccgatgccaggaactagaaggtcagtagcagctactgttttaccgtcttcatttaaacgcatgtagaatgctttaatgtctttcggatagtcagttacgaatacagggcgtttgaagatttcttctgataagtatctttcgtgctctgtttgtaagtcaattccccattctactgggtatttgaagtcagcacctgattcttgaagcactttaattgcttctgtataagtgatgcgaccgaagtcagagttaattacgttgttcatgcgctcaagaactgttttatcaacgaagctgttgaagaattccatttcttctggtgcatgctctaatacgtatttcattgcatatttcagcatatcttctgtaaggttcattacgtcccctagttcagcgaatgcaatctcaggctcaaccatccagaactcagcagcgtggcgagttgtgtttgagttttctgcacggaatgtaggtccgaatgtgtatacgtcacggaatgctaatgcataagcttcagcgttcagctgtccacttactgttaagtttgattctttaccgaagaagtcttttgactcatcaacttttccgtcttcaccttttggtaggttatttaaatcttgcgttgttacgcggaacatttggccagcaccttttggatcactaccagagatgattggtgtgggaacatgcacgaatccacgctcttggaagaactggcgaatcgcaaatgctgcgatagaaacgacgcggaacggtgcagagaacgcatttg

SEQ ID NO: 581 - DNA, 1434 bp, Bacillus thuringiensis
cgcttgtaaccactcaaacgtttctgttgaagatggcattccaacgcagctcgcacaaattactttcgtcccatacacttgaacattaaccatttcttctgccccacttcttgtcccaacagtatattcaaatgtcatataacgtaaacacatcatgtgccaaacttatagcgtaccccaatactgtatatacacgatacataatggcaccagtaaaacaaggagagagccctttgacgatgctatctcatatgattgtagcatcacagcgtattggtactcaaattgtagaagaaacaaaagaggaaagatatgattatttaatatatgataatcattctccagtaggacgtattataacgaatattatacaattaccaagcgtttcatcctgtacaacgtttgctgctaatcagtacattaattttcatgatgagcaagaagcgagacaagttgatgaaatggatccattatatcaatcttgtttagcgggaatggaaagatggaataagccgtatggaatgaaatgtaatagtatgtatgatattatgaaccatcctggtgatattacgattgtatatacttcaaaagaatatcagccacgttcagaggtatttgatgaatcgtataaatttgtaggtccatcaattgctactcgaaaagaagtggggagttttcctaccgaagatttaaaaaatgaaaaagtgattttcatttctatgggaacagtttttaatgaacaacctgctttgtatgaaaaatgttttgaagcgtttaaagatgttgatgcgacagtcgtattagtcgttggtaagaagataaatataagtcaatttgaaaatatcccgaaaaactttaagttgtataattatgtcccgcaattagaagttttacagcatgctgatgtattcgtgacacatggtggtatgaatagttcgagtgaagcgttatattacggtgttccattagttgtaattccggtaacaggagatcagccattcgttgcaaaacgattgactgaagtaggggcaggaataagacttaatcgcaacgagttaacttctgaattgttacgtgagactgtaaagaaagtaatggatgatgtgacgtttaaggagaatagtcgtaaagtgggagagtcgcttagaaatgccggtggatatcaaagggcagttgaggaaatattcaaattaaaaatgaagccgtacgtaaagattaaatagatgttaaaaacacacttacttttaatttgtaagtgtgtttttagtattacgcgttacatgtgttacataaaaatagcgataaaggagaaacttttgtgtatataaatcgatacctttgaattagtagtaaaattacgttaaaataatactaagaaaatatataagttttgggggtaatgaatgaagaaagtatttgaatacgtattattaa

SEQ ID NO: 582 - DNA, 1490 bp, Bacillus thuringiensis
tttttaattattctccggatgtaataaggagaattcagtaacactaataaaaaagcttctactttataatgattataaattaataactctatttgtacgttaccaaaaaaagccctcataatcaagtgatggaaactattccatataaattatagcatcgtcttccctatcttctttcatcatgaaggaaaatatgtatgattgttccaaaatgcaacaaagactttctcaatacaatgtatttgacattgtatttctttttcgttatattggttttacaaaattaaattgtgcacaacttaattggaagggagttatttatgacagaggactctttgcatctagataaccaactttgtttttctatttacacctgctctagagaggttactcgtttttatcgaccttatttagaagaaatgggtattacgtatccccagtacattactttactcgtactatgggagcaagatggactaacagtaaaagaaattggagaacgtctatttttagattctggtacgttaacacctatgttaaaacgcatggaaatcattaaaacttgtaaaacgtgttcgttccaaagaagacgagcgaaaagtttgtattgaattaacagaacaaggcaacgatttaaaggaaaaggcttgttcattaccgacaacgatggctacaaacttaggaattacagagcaagaatatcgctctttattaattcaactaaataaactaattgacacaatgaaaacaattaatgatggaaaaggggaataaatatggataaattatatactgcttcagtaacagcaacaggtggaagaaatgggaaagtagtttcagatgatggcatattaaatcttgatgtaaaaatgccgaaagcactaggtggtgcaggcggagaagcaacaaatccagaacaactatttgcagctggttatgcagcttgtttcgatagtgcattacaacttgtcattcgtacaaaacgtgtgaaagtagaaagtacagaagtaactgctcacgtttctatcggaaaagatacagatggtggtttcggtctatctgctgtacttgatgtacatgtggctggcgtttcacatagcgaagcacaagaacttgtagaagcggctcacggtgtatgtccttactcgaaagcaacacgaggaaatattgaagttacattaaacgtacgctaaaaaatttagcaaaacaaaaacgcgcgacattcgtcacgcgttttttgtttttgtaaatttatgaattgctttccacgcttcttcttttccaagtcctgtttcagaagagaatagaacaatttcatcgccaatttcaacagtaagcgtttctttttacaacttttaaatgcttttgccatttcccttttggaatttttattgggttttgtcgcaatattcattgtgggattttcttatgctttaggaaatcaatcatcatttcgtcattacttgttggttggggaccttctattaaaa

SEQ ID NO: 583 - DNA, 1456 bp, Bacillus thuringiensis
gcaggcaattggtcgctcttgccactgatggtgaggaatcgcaacgacggccgcttcaaatatagcatcatgtgccattaaagcattttcaagatcgaccgaagaaatccattctcccccgcttttaataacatccttcgtacggtcaacaattttcacgcagccttcctcatcaaccgtaacgacatctcctgtatataaccaaccatcacgaaaaccttcgacagtacgattatcgttataatagctttcagcgatccatggcgctcgtaaacatagttctcccatctccgtaccatcccacttcacttcaccatttgtaccgactactttcatctctacaccagggacaagatacccttgttttgatctaatttctaattgctcttcatacgataattctgtttcataactttttaaacgtgcaagtgttacgagtgggctcgtttcagtcataccatatgcatgtatgaatggaacattatgtttctgttcaaatgctttaataacgcttttcggcgcagctgcacctccgcatagtattctcgtcatactagataaatcgtaactattattttctaactcttgtaatacgccgagccaaattgtcggcacacccgcagctaacgtcactttttctgattgaatcatctctaataaaattttcggggtaaacatcggtccaggaagaacttgttttgatccaaaccaagtagccgcaaaaggaagtccccaagcgttcacatgaaacatcgggacgattgccattgctgcgtcactttccgataaagcagctgtatcagctaaaccgagtgccatacaatgcaatacagtactacgatgcgtatatacaacaccttttgggtttcctgtagtcgctgacgtataacacataccagcaggtgtattttcatcaatatcttttacaaattggaaattgggatcgccttcttctaatagcttttcataatgatatacaggctccagcatagtatttggaagttcatctttatcagtcataataatgtaagcttgtacagttgataattgtgattgaatattttcaacgagcggtacgagatcttcatctataagtagaattcggtcttctgcgtgctgaataatgtatgaaatatgttgaggagataaacgaatattaatcgtgtgcaaaacagaagcaatacctggaatagcaaaatacgcttctacatgtcgatgatggttccacgctaatgttcctacaggttcaccttctttaattccaagctttttcaacgcactggaaagtcttctcgtcctttcccctaactgcttatatgttaacgttgtaactgtatcatgtgtccgtgaaacaatttctttcttcgaaaacagtttctctgctctttccatcatagaactaattgttagcggtacattcatcattatattggttatattccccttttaagcgttt

SEQ ID NO: 584 - DNA, 1486 bp, Bacillus thuringiensis
aaatagaggcgatttccatttcaggtaatgtttcaaatttttttttcccaaagtaagcccagccagtagtacgcataaagtcttgcacttctttggatgtttccattttagctaatgcaggcatattatacgggccgcaaaatagcaatatacctttaattgtagaaggagcaacaacagcgtcaatcccggttaatttcgcataatctggagatgtttgaatagtaacaaattgtccagatatttgcgctcccgcagaatctcctgcaaaatataggtcatctagttttacattatatttctttgcatttgcttttatatattcataagcctcaccaagttgtagtactggtgtaggatactttcttttaggagcaagagcataatttatatttatcactgtataaccacgagcagctaattctactgcataaccagtaatgtctgatttatctccacctacaaatccacccccgtgcacccaaaaaataacaggtgttttccctataaaatttttgggataaataatgtctaatgtaccatcaggaaatttagaattataattgatatctttaacaattcgtgtctctttagagcgtttttataattattagatggaacaaactttccactttaaaatgttttttttatgaaaaacgctttcggaatgggtgaaactttccaaaaaacaccccccgcaataatcaatccgaaaccattaaaaagagttggcaccattttttttttccatatcactttaggttttaactgttttattctcataattaaagaatctccattctttttagtaataatcttaaaataaagtgaaactttaatcagccctcaccaatagggctgcccgttaatgcgggatcaatcacaatatacacttctattttacgattaactttattatcacctgctaatccgtccttaaaattttatgcaaaaagttatatatttttattatgtacatattaggtatctcctataaaacacattaaaaattcaaacaaaaagagcaaaagatccccatttatagaagatttcttttgctctttgtaaaggacacaagtccaaataaaagttgcttatctatcgataacttacacataagaatgcatttgtttcagtactttattagcaaaaactttaacaaccgtttctttttcacccgttctatcaattatgaaaccatgaacttcaatatcagaaggtactaatggatgatgacggatcatatctatactcttttcaatattttcactaacatttttttgtgcactcagccattgattaaggctaccacttgaaaattcaggcatgcaatttttaaagagatagtctaattctatattatcttttatgaaatcacgttgagtttgtagattaactgaagaagtttctttatcctctattccgacaacaaaaatttctttaacattttcttgataaatagcaatataatagatctcattatatc

SEQ ID NO: 585 - DNA, 968 bp, Bacillus thuringiensis
aagctagtgaaagtaacaagtggtggagcatacccagtaaaaattggatttgcagatccagcgtatgcaaacgtattatgtattccaacgctacaaacaggggtatttggtggtattatcgtcggtatagtagcggcatattgctataataaatacttcaacattgaattaccatcatacttaggtttctttgcaggtaagcgtttcgtaccgatcgcaactgcaacattctctttaatagtaggtattatcatgtgcttcgtttggccatacattcaaggtggcttaaacacgttctcacatcaaatgattgatgcaaatagaacaattgcagcatttatattcggtttaattgaacgttcattaattccatttggattacatcacattttctattcaccgttctggttcgaattcggtcagtatacgaatgcagctggcgaattaatccgtggtgaccaaaaaatctttatggcacagttaaaagacggtgtagaattaacagcaggtacatttacaactggtaagtatccgttcatgatgttcggtcttccagcagcagctttagcaatgtaccatgaagcacgtccagaaaataaaaaattagcagcaggtattttaggttctgcagcattaacatctttcttaacaggtattacagagccacttgaattttcattcttattcgtagcgccagtattattcggaattcacgctgtatttgctggtctatcatttatgacaatgcaaattttaggtgttaaaattggtatgacattctctggtggtttaattgacttcctattattcggtgtactaccaggccgtacagcatggtggtgggtaatatttgttggttcttgtactagcagttatttactacttcggattccgctttgcaattcgcaaatggaatctaaaaacacctggtcgagaagtggcaaatgcaaatgacggcgcaggaaaag

SEQ ID NO: 586 - DNA, 1485 bp, Bacillus thuringiensis
cggattatcatctcatattattcaaaaaagaatagcagagcttattagctttttaggatttcaagatttattgcatcaatctgttcacacgttatctggtgggcaaaagcaacttgttaatttagctgcggtattagttatgcagccgaaattgctattattagatgaaccgacagcgcagttagatccaatcgctgcaaaagagtttttaggattattaaaacggattaatgaagaacttggaattacgattattttaagtgaacatcgtttagatgaagttatcccgcttgcaacacgcgttgtttgtatggataatggccgtattatgtatgatggtagtcctaaaattgttattacggatatgtggggagtagaaacattccgtccatttattccgcaaattccaaggctatttttagagtggaatgtgagagatattccgtttacagtgcgagaggcgcaaatgaaaatgaatgattttgcagcgatatcatatgtaaatgagccaatagcacaaagtgaaaagcaagaggtaattttaagcgcagagcatatttcgttccaatatgaaaaaaatagtccgcttattttacgtgatttatcagtttcgattgaaaaaggaaaatgggtagcactcgttgggaagaatggtacaggtaagtctacactgttaacgattttagcaggattacaaaaagcgagaagagggaaagtaaagtggaacggaaaagtaatacataaaattgattcgaaagaacgttttaaaagtattgggtatgtatcgcagcatccgtattaccattttacatttgatacagtatgggacgaggtttatgaacgtgcgcgtgaattatatggagaacaaggaaaagaaatagcagaagatacgctaaaacagttttggttgtactcgcttaaagaacgccatccgcacgattgtagcgggggagagcaacaacttcttgcattatgtacaacgttattatcaaagccgactttattattacttgatgaaccgacaaagggattagatccatggaagaaagaaagagtaggagagctatttaggaagctacaaaaagaaggtacaacaattgtaatggcaacgcatgatattgagtttgcagcgaaatacgttgatcaatgtatgatgttatttgatggaacagtcattatgaatgatgcaccgaaagaattttttagcggcaacttcttttatacaacatctattaaccgattcattcgaaaagaattgccatatgcattaacgtgggaggatgtgtacgaagcttgtccaaaagatatgttgcattcataatatgtatctttgcagtaataatcggcacattactccttacgacacttgtcatggacggatattacatgttaagtagtttgtttatattagcggttattatgttacctttctatattccgtttgaagagaggcgtttgttcacgtgaaattgttcttcgtgctga

SEQ ID NO: 587 - DNA, 1414 bp, Bacillus thuringiensis
taaataaggcgtttgagtgttttaatgataaggaacctcctattctacactcggatcaaggttggcattatcaaatgcgacaatatcatcagtcgcttaaaaaacataacgttatccaaagtatgtcccgtaagggaaattgcttagataatgcagtcatggaaaatttctttggcttattaaagtctgaattactttatcttaaagagtttgaaagtatggaacaatttaagcaagaactagaaacttatattcattactacaatcacaaaagaattaaaacaaaactaaaaggattgtcccctgtgcaatacagagttcaatccttagtagctgcttaatatatttgtctaattttttgggttcagttcattttgatagtctttttttgttgtatggattgaattatataatgtattgcaaatagaaataatagaagtaatgcggaaaggcggtggggggaaatgaaatatccagaccatttagtaaaacaagtgcaagagcgcagtgctccttatcaactagaaggttttttaagtggacaaggtcctgaaaatcccaaatttatgttgttaggagaggcgcctggtgaaacagaaattcataatgggattccgtttagcgggagggcgggaaaacaattaatggattttttagagcgtattgatgttacaagggaagaagtatatattacgagcgctgttcgaagtagaccttataaatggcgagagaaaaaagaacgaaatggtgaaatcatacaaaaaaagtataatagaacgccaaatcagggagaaatagttgcccatgcgcctttgttagattatgaattagagaaaatacatccgaagcttatcgtcacgcttggaaatatcggtcttcaacgtttaacaggaaaaaaaaaaacaatcacagatgtacacgggcaattattaaaacagcccattcaaaaattaaaggatatgcaaagtgcagagtttacatggtcagagaaagaatatcatgtttttccgacttttcatccagcttccattttttataatcggagtttattggagcttattcatgaggattttgagaagcttaaaagacttgtaataaaaaactagaaaagctaaggcgcttttctagttacatttaattatgtaaagggtttttattttcatctaacgtaaatccttcaccaactacatcatgtacatcacttacagcgacaaaagcatgaggatctacagaagtaatgatattctttaatttcacgatttcatttttagcaacaacgcaatacaatacgttacgttccacttttgtatacgatccaacagcttttaaaaaggttgctccgcgctccatttcagataaaattttggcagcaatttcatcgtttttctctgagataatagtcgctcctttggca

SEQ ID NO: 588 - DNA, 2128 bp, Bacillus thuringiensis
tttcttttaatttccctatttgaatttcggcattttgtaaattcagctttctctcagctaatgattcaatgatcgcttgtaactcttctaatctttgaacaagttttttagcctcttctcgttcagcttctttattctttactacttcatacttctcctgagcaagttcaaagctattcattatctgttcttgtttgacgattatctgttttaacaaactttcagctttctgctcattttccatcgcttcttcataccattgttcaaatggtaataagcgctttgcttgttccgcacgtttaaagaatttttctttcctttcaattgctgcacggttctcttgtaaagtgttatatttctcattcttttgttgtaaatctataaatttctcatttacagattttgctgcatgaaaacgtgtttctgcatcctttaattgcttcgtttgaacatcttgttctacttgtaattgctcaacctctgccttatacacggttgtttcttgttctaacgcttctactacttgatgcgtatttacatgttcttgtgccactaatgtctctaataatgctccatcacggattggtaatttaaaaacattacggaaatagagctctctctctttttgtttttcttgtaagacgtctttccattgttttctcttttgatcaagtaactcacgcattaatttataacgatccgttttaaaaatacgacgtaaaattttttctttgttttccgtctcagatgttaatagttttcggaattccccttggggtaacataacaatttggctaaattgatgtttacttaacccaattaaatcttccacttttttgtttacgtctgttacatgaaaacgatcgacggctggaacgttttctccatcaataacttcatataattctactgcatgtcctgtaatagtcttattcccttgttttttatgtccaagttgtcgttttatttcatagcgtttcccttttaactgaaaggttaattcaacacttgtataaacattatcatcagcaaattgacttcgaagcatgctcgtatcactacgttcttctccactagcctcaccatataacacataacaaatcgcatcaaaaatcgttgtttttccagctcctgtattcccagaaatagcgaaaatacgatgttctccaagatcttcaaaatcgattatttctttctgtttatatggcccgaatgctgtcataataagctgaatcggtctcatcctcgttcaccttcccattcttgcactgtttgtaatacatctataaataggcgttctttctcttctgataaatctaaccccttcatttctttatagaaagcctttaaaagagataaatcatccgttttatgtcttgaaacagttacttcatttgtatctgtgagttctcgtctttgcatcgctctttcaacgtgcattgcatttggatatacagatcgtattttctccattggctgtaagacagggttttcgtctaataattttacaaatacgtaatcttcacttgctgggtgctgtaataattcatctatttttgcttctactgttcgcattttacgacgtggtgaaagtaaccttttttcaattgctacttcaccagtttcattcagttctacaatgtaataaccttttttatgtttctcttcagaaattgaataggcaagtggtgaacctgaatatcgaatcgtctcattacgtacgaaatgcgcttgatgtaaatgtccaagcgctgtgtaatgaaacttatcaaaataatgactatttacatattcagcaccaccaattgaaagtggtctttctgcatcacttgtattctcctccgcttctcctgaagaagttacaaatgcatgtccaacaaatacatgtctagcttctttatccatcgtttcagagagctcattcataaaaatgcgcatcgcatcatcatgagaacgtacgtcttcatttttcaacacgtgccttactatgcttgggtctgcatacggtattagatggaagtgaacctctccatattcatcatttagtacgacaggttcatacgggaattgaaattgacctgcaatatgtaatccttgttttttcattaaactacttccaaaatggata

SEQ ID NO: 589 - DNA, 1531 bp, Bacillus thuringiensis
gccccgaatccttctttgttcattaaataacctgcaagtcgttttgcattttctaaagctttattgtaatcaccatcttggttaaccgcgatctcgataccgatagactccctgtttcctgatccatctccatctcctgcatgccaaccattttcgtttgttggtaagtgttgataaatttgtttatcgtctacagtaaaatgccatgaagctgttcggaaagtgccttcagttgcttgcttgtataaatatttcgcatgattttcagcattagcaccagcggctgtatttgcggtctcatgaattgtaatgtaacgtgctttcatcggatttgcaggacgaatatcaggatttcctgctggaacaatccactccacaaatggaactcctgcaagtgttccatatttcttcgtactctgtgcactatattgaatacctcttggctttgcaacaggtttcatttgacgatcagatccatcatttcgaccatctacagattcaaatgccttttcaatgtttgaaatagcttccttttctgctacttgtcccttcttagcattttgcattttgtttaattcttctgtttcatcatgtttatgcttatattcttctaaaagcattttttcattttcagatacttctgcttcgttaatttgtacatgatcaggaacttccaacttgaaattagaataatttaatccgctcgttccgtgttctccttgggcaatattaagttgatcagtttgagatttgtttatctcttctgctgatgctgataaaggtacgctccctaaaatcactagacttgttgatagtgcgattacttgttgtttgattgtcttattcattattataataaatacatacacactcccaccgtgtatgtatctcaacctccctttattgttacattaatttttaaaaatatgaatctactatgtacttccaatacattttcttttttatttatatatttaaattatcatattttatactcattaagaaaatatttatatgtcatccctacagatgaatttcatctaacatactttttataaaattcgtcaacaaacattattttacaactaattacaaataccgtcaaaataatcaatttaaacttagacaaataactggcatacaatttcataataagagatcctatactatcgaaatacatctattacaaattccctttaacgttttcaacaatctcatttatcgtattccgatcaaacttatcactaatttcatatgactcacgatctcctacgaattgcacgcctacgatatcattgcgatccttaccgtattgcacttcaataatagatccacgctctatttgcttccaaatgagacctgcttcatctttattatctaaaataatgcagtcttcaatattttcgtcaatcccaattaacttattatcatccatatatccaatctcgtattggtgccgttctttcgctttgccacttactaatatacctttgctaccatatgagtaatccatatagtccttttttcttcg

SEQ ID NO: 590 - DNA, 1656 bp, Bacillus thuringiensis
aatagattgaccgagtaaacttaatgcgatcgtaatagaagcaccaaggacggagaaacttatattgttaaaaagaacagtgaatactccaatcgctccagcgctatataaaaaaagtggaatacttttatcgaaacgaattttatttttgtttatgattaaaatgaagataactgcaattaaaccgacaaggtgaatgacaacgcttgctgtatacttcccaattaactcggataaaattccattcaatggaagcataacggcgatgagcacaccaataaagacagaaagaaagttatacaatgtaatatcccctttatatttcatatttgtaatgactgtatcatgctgaaattgtgtattgttatgacatatgtcatagtggaagaagaaaattttgattacaatggggatgagttgtaaaggtggggaactatgaagaaagtatgtaattctattaaattagcggagtatataaagcaaaataatattgattcattttttagtcatgatatgaagccatatatggaccttatattttttaaaaagaatgagtttatttgtagagaaaatgaagagatagattatttatatttctttgttgaaggaaaagcgaaagcgtttaacacattaagtaatgggaaatccgtattactgtgtttttatgatagtttgcagttacttggagatgtggagttaattcattctcaaagaatcacttcaaacgtacaagtgatggcagattcgtattgtgtgggtttacctttaggaaaggtgagaaataagctatttcatgatgcgaaatttttaagatgtatttgcggatcattggcacataaattaaaccgactttccaaaaacagtacaattaatttattgtatccgcttgaaaatagacttgcgagttacatgttagcagcaggagaacgagcagttcagcatgaaaatagaattgtgtttagtgggaatttaacggaaatagcggagttgttaggaacgagttatcggcatttattacgtactttgaatctcttttgtgataaaaatataattaacaaaaacaatggttgttttgaagtagtgaatgtagaagttttgcgggaattggctgcggatgtttataaataatatattaaagtagggattaagatgaaaatagctataatttcagatatccacggaaatagtcacgctttaaaatcggtattaaaagatattacacgtcgcaaggtcgaaatgataataaatttaggagatagtgtgtatgggccgttagatcctttagagacaatcgatatattaatgagtagcgagatgatacatattaaaggtaattgtgatcgcatgctttgggagacaatacaagagcagtctgctacactaacttttgtccaaaatcaattaacaaaagatcatatagattggttaaaacaacatccttcacaatttattgtagacgatatgttatgttgtcacggtacgccaacttcagatgaagtgtatttgttagaagagataaatgagaatggtgcaatattaaagaatgaaaaaaatataatggatcaactccaaaatatagaacaaaaaataatagtcaaggtcatatacatatacccagccctgtttatttagcgaacggaaagaacataaaaaatc

SEQ ID NO: 591 - DNA, 1705 bp, Bacillus thuringiensis
gcaatttttgcaaattctatactacaaagatgtagataaatcattatcaacgcctatattatacgattctcctttataattcaatatttttaaggaaattgttactctgaaaatgtgaaaatctgatgaaacttgacaatttacaacaatgtattagataatgactgtttatttttctattttataatcaaaaaaacaaaaaatccctctacaatgagagggattttttcttatagtataatcgcaattaatccgccagatccttcattaataattctttctagcgtttcttttaatttatatctagcattttctggcattaaagataatttcgcctgaattccttctcgaacaatcgagctaagtgaacgtccaaatatatcagaattccaaattgataacgggtcatcttcaaaatcttgcattaaataacgaactaattcttcactttgcttttcagtaccaatgatcggctcaaacgttgactctacatctactttaatcatatgaatagatggcgctaccgcttttaacttcacaccaaaccttgaaccgtgacgaataatttctggctcatctaagctcatatccgctaatgcaggcgctgctacaccatatcctgtttgcttaaccatacgcagtgcatccgccacttgatcgtactctattttcgcatgagataaatcgagcataagctttaataaatgatctttcccccgaatttctactcctactacttcttttaaaatttgatcatacaattcatctggcgcatataaatcaatctcagccacaccttgccccatatcaatgccagctaggctcgctcgatcaataaattcatattgactaaactgccaaacaacgcgatccacatcacgaagacgttttatatccttcacagtttcttgaactgcttcttgataactttgacgcaaccaatgcccttcatttagcaccattacccagctcggaaggttcacattcacttctaatacagggaattcaaatagtgcttcacgaagtacattatatacatctgtttctcttaaactctccacactcattgcaataaccgggatatcatattcttctgataaactttggcgtaattgctctgtatctggatgatacggctgtaccgtattaattatcataatgaaaggttttcctacttctttcaactcatttacaacgcgttcttctgcctctatataatctcttcttggaatttcaccaattgttccatctgttgtaattacaacaccaattgttgaatgttcttgaattactttacgcgtgccgatttctgcagcttcatggaatggaataggttcttcataccaaggggtattaatcatgcgtgggccattctcatcttcatagcccttcgctccaggaaccgtatatccaacacaatctactaatcgaatattcacttcaagtccttcatctacttcgatagaaaccgcttggtttggaacaaacttcggttccgtcgtcataattgtacgaccagcagcactttgaggcaattcatcctgcgctctttgacggtcagactcattctcaatgtttggaataactacaagttccataaattttttaatgaatgttgatttccctgttcgaacagctcctacaactccaaaataaatatcaccgcctggtcgttctgcaatatctttaaaaatatctacctttt

SEQ ID NO: 592 - DNA, 1804 bp, Bacillus thuringiensis
ggcatcattagcagttacttcggtagcaacatggaattttactcgttctagtgaggttaatgcagatgagaacggatgcaatgcactgatgaaaattgtgatcgtactaattgaggatggtatgggtgctctatatgtgacggttcaccgctatatgaaagataatccaaatgcctttgagatggaatctacacactttgataggcatcttgtgtgaacacacattacatacccagaagatgaacatgtgaatattacagactctgcatctgcagcaacacctatgtcagcaggaattaaaacatataatgctgcactagcagttgataatgataaagcggaagtgaaaacagttcttgagcaagcgaaagaaaaagggaaatcaacgggactcgttgcaacttctgaaattacacatgcaacaccagctgctttcggtgcgcatgacattagccgtaaaaatatggacgcaattgcaaatgattattttgatgagaaaattaaagggaagcataaggtagatgttatgcttggcggcggcgtaaagaactttgttagaaaagatcgtaatcttacagaagagtttaagaaatctggttatagctatgtaacggatcgagatcaattgttaaatgataaaaatgatcaaattcttggtttatttgcaccaggtggattagataaaatgattgaccgcaatgagaaaacaccttcattagaagaaatgactaatgcagcaattgagcgtttgaacaaaaataaaaatggtttcttcttaatggtggaaggaagtcaaatcgactgggctggacatgataatgatattgttggtgcaatgagtgaaatggaagacttcgaaaaagctttcaaagcagcgattgagtttgcgaaaaaagataaaaatacgttagttgttgcaacggcagatcacgctactggtggcttatctttaggtgccaatggcgagtataactttaaagtagatccaattaaagctgcaaaacgcacaccagactttatggcaaatgagattgcaaaaggtgcaaatgtagaagaaacattgaaaaagtatattgatttacaattaactccagaagaaattcaagctgtaaatgatatagctccgtcaaaagatgtaacaaagattgataatgcaattgaagatattttcaataagcgctcggttacaggctggacaacaggtggacatacaggggaagatgtgaacgtgtatgcatttggtccaggtaaatacttgttctctggcgttcaagagaatacaaatatagcgaaacgtgtctttgatattgttggcgggcggtgatccgaataaaggaagacgctaattaagagcgaaagtgaggcgaactggctcgcttttcttttaggagttggaaatatgaaaaaaatatttgcgaaattaagattccttctagcatttgtagtattactagttggatgtcaacaagaagagaataatgtagcacaaaaatctactactaaaaaaactgaggaaaaggtacaaataacaaaagaagaagagaaatctattcaagatgttattcatacatttgtgcgaacgaccaatgaaaaaaatcttgcagaacatatggagttattttcaaagaagatgcctagtgctgaagacttaaaaacacaaaaagaagccgcatttcaaaagggaaataagaaaattgaattggaacatatagatatgaaagttagtaaagtagggtatgtttctgttgaaacgaaagaaaaggaagtagacgacagtattactcttcaaaagaagtacagtatg

SEQ ID NO: 593 - DNA, 2285 bp, Bacillus thuringiensis
agaacattaataataactgtctcgtcgcaactttttttaactcgccttagcttaatcccattttggaaatcattttatattgctgctgatcgcgatccaaatctgtatataatcgcaaataaatacaactagcagcgaatgtaaagaagtcgattccgactaaaatacttaccataagtaataaaccattcttttgctttgcttccaacaagttgaatgttaaagcttcaaagtagaaatctctgtccataagatctatatcgaatatactctttaattgattggaaatctctttcgtttttatccaatcatctacaacaaatccgtaagtacgatatggaatttctttattaactgggtcactagtaagaggcattccatcatatacctgatcttgaacagcgatataaatagttctagaatcgtgtggtaaaactaaattttctacagcttttttcacatgaaatgtctttgtccagtcaccttgaatgacttctatattctttttatactcgccatttttaaattcttgtttttgtgatacgactccaggaattaataaaatttcatcttctttttcaattttttcttgttgatagcctagtgctttagcaagatcgttgtattcacttaacttcattacatttacgccattttctgtgtatatatatgaagatgaagccattcgatacggaatattagcatcagaaaggtgcttttttataatagaaagatttttattcaatactttgtcattttcaagacttccatacaaaaatgtatagggatttgtcatccttactaaatccctatttccaattgcggctgttgtaccaattgctgtaaatgcaactgctgaaacaatagatactataaaaaacatcgttgcattatctttcatacggtaaattaattcagaaaatgttaatatatttgttctctttaaaaagaaagattctctccttttagcaaggcgcaatatatacacgctacactgtgtatataaaaagtacgttcctataattactaggagcacacctattccaagcgtaataaaattggtacttggtatgaagcgaaatactgaaaaatatccataccctatactaattaaagaaagtagcgataataaaactgaagatttcggttcaggttttggcttttcctctgctcgaataagttccacaagttccgttacttttatcattttaaatgtaaataatgaaacaattaaaaacaagaaaagaaatgtgataacagttaataatacagcccgcactggtatataaaaaggtaaaccattattaatcattaatacacttgcacttatcaataagactagtttagaaaatatgagtccaatgaaaatccctatacaaattgaaccaagtccaatcaacatattttcaattaataataatttcttaagctgtctcattgacataccttgcatcattaaaatgccaaattctttcttacgcgtttttaaaaacgaactaactgaatataaaatgaagaaaaatgaaaatacaaaaatcaatccttgcgaaactgaaaatcccaatgtaccaaatgcacttattgttgcacttgtcgatttcaactcaccttgtaaatcaggatgaaataataaaagagcatacgtaaagaaaatcataatagaaaatgcactacttaaaaaatgggcagcatatgtacgcttattgcgaaaaatattattaaatgcgaactgacgaaaagtcatgccttttccctcctaacaaagaaaggacatccataatcttttgataaattgtttgcctactttcaccacaataaatttcgttatatagttgaccatctttaataaagattactcggctgcaaaagctcgctgcatacggatcatgtgtaactaacatcatcgttgctttttcttctttatttagagtatccagcatctccattacatcatttgaagatttagagtccaagttccctgttggttcatctgcaagtaataattgcggcttatgaacaattgcacgagcgattgctgttctttgagcttgtccccctgatatttcaaacgttcttttattcaatatatctgtaatatttaacttctctgcaatctcttccaatcgcttgttcatttcttgcacggaaacaccatctaaagtcatcggcaatacgatgttttcttttacagtaagtgtgctaagaagattaaatgattgaaaaacaaatcctaattgtttctgcggaataacgctaattccttctgatgataatttgaaaaggga

SEQ ID NO: 594 - DNA, 1865 bp, Bacillus thuringiensis
tgaaaaaagtataagtccttgagggattttatttctttagtaaatatacgaatatgaccgattccttagtatacttggaatcggtcaattttggattctaaatgtaaatatagtaaagtggaatataattgaaatcgaaaaccacttagaaataacaattacggtgtgagctattgtatagtatagatatgtttaaaaataaagggggaatacatatgtggaagcgatttgtagcaattggtgatagttttacagaggggataggggatgaagttgagggaattgcattaaaaagctgggtagatcattttgttcaactgtgtgaaaaagatatagaatatgccaattttgcaaagcgtgggttagtaactgaagaaattcgcttgcagcaattggaaaaggcgttaacttttaatccagatttggttagtctcattgcaggggcaaacgatgttttaaaaggacgttggaatcatgatgcatataagaacgatatggaatttatgatagatacattaagtaaagcaggggctgatattattatagcaaaccttcctgattttacagttaggcttccttttgcttctgaaaaaaaacaagaaataaaagaacaattattagaggcaaatgaagttatacattcactgagcagagagtataagcttcatcatgttgatttttggaatcatcatttagttaatgacaatacgctttggtctaaggatttaattcatccaaactcaaaaggatatgtaaaagttgctgaattgatttttagtagtttgcctgtacagaagacaaaataatagtttgcaatgtaacgaatatgatattaagtgtatgaagctatgttttttagtaaatggaaagaactaaacatttagcaaacaaagcgtttctacgatatatttctacagtagtgcacaaatacagaatcacaaagaaagatcacttatggaaataggtggtctttaaatgtttttataactaaattagtatatgctgtattactaacaatttcgtactacataaaaattaagttctcttatagaaaaactgattttatattatcttaaaatataataacatgttcaaatgatattttgggtatgtatcctaattgtgaatgatgtgtaattttttttgaagtataaatatccaataaataaaataggtagtaggtgcagaagtattaatactatattattcaattcttgttatgagtacattagtgattggtaatattatatttttattatcaactttagttattggaattaatttgcatagaaaatatgtaggataagaaaaaataaatatactttattgtatatttatttttttgtttagtaggatttatagtctctataaactattatgttaataaaattaaaaaacttaattcttgatatccttatggctaaagctatctataaaatgacaatataactaaataattgtttggtatgatttgtggatttagttttttatccgaattttctgattcaaatatttcaactttatgaatatagtaggtgaaatatttgtgtgatagtatttgagatagaaaaaagccaactttaaaaaggatgtgaattgaatgtgcaaacgactgtaaagggttatattaaggaaacgtttagctgttattagtgtaaggtaaagatatattttgtaacagttgatataaaaatgaagaaataggtacgctttcgtttgtctgactattttaaatatatgaaaaacaagagtagtttgagttttgacgaagttaaattctaggtgagatgtcaataatgattaattaagtttaataaagaggtaccttatacgcaaaagcgtttatattagtaacctaaggagct

SEQ ID NO: 595 - DNA, 1376 bp, Bacillus thuringiensis
aaagatatatgatcttaaattcgataactgacacaatgtaagtagtgtatattattttttgaaaaatatttcgatatacaatttggaggatatacaatgacaaacgacaacttttgtgatgttctatatgaacgcacatctacacgtgcatttaacccaaataaagaaatctcatctacagaattacatgagattttaaaagccgcagcacaagcaccttccgcttggaacttacaacactggaaattccttgtttttcaaggtgaagatgtacaaaaacgattacacccaatagcttataaccaacaacaaattcttgatgcttctgcagtagtcgctattttaggtgatttagaagcttataaaaatgttgagccagtatatggtccaattgtagaacaaggatttatgaaagaagaagcaaaagaacgcttagctaaaaatattgaatctgcatatgctcgtgaacaattcccaagagatgctgccttttcaaatgcatctttagcagcaatgcaacttatgcttgcagctaaagcaactggttgggatacttgtgctattggtggcttcaacccacaagcactgacagacgaatttaacgtttcatctcgttacgttccaattatgcttattacaattggtgaatcaactttaaaaggccaccctgcacctcgcatgagcgtagagcaagtgagcgagtgggcaaaataataaaaaacgaaggcaactacattgccttcgtttttttattccctgtcatacttttgtaatattactacaaatcattcgacatttatacttatggaaaagtatattctattcccttatcataaataaacgtgacgtttcgtgtcgaattttgttaaggcattgaaatatacccgtgtatttttgttacaattgtgatacaatgataacaaatagataacaagagagggattttcattgagttcatacggaagctttatcgcacttttatgttacatagtaactgtactgcttctatattttattggtgatgccgcaaacatctccattttacaatttccaaaagaagaagcattccaattagaatcagaaaaacacactgcacgatccattgtaccattactcctagctcttcccgtatatatcatcgttttatataaaagtaaaaaagtgtaaaggctacccatttcatttatttcggtggtttttacattttttgttatatctcccctattttaaacatcattccatactaaacacccagctagtcatttaaaatgagaaaatcccctagaaaaaattccactctctgtccagtcactaactaccgaacttacatagattataagtgtgaagggggatgatcaggtattatgtttcggatc

SEQ ID NO: 596 - DNA, 1340 bp, Bacillus thuringiensis
ctctagcacttcagaaggatgctctacacgtaggtgtcaaatttgtaaaatgtaaattaaaccgtccactccaccaacattaacgaatgcgccaaagtcagttaatcgttgtactgttccttcaacaacgtccccttcttttaatgaagaaattgcttcttttttcttagaatctagttctaattctactaccgctttatgcgaaaggattacacgatttttttcacggtctaattcaacaattttcaccgctaatgttttacctttatagtcagtaaagtcttctacataatgtacttctacaagtgaagctggaataaaaccgcgaacaccaaggtccacaactaatccgccattcacaatatcttttacagtaacatcaaatacatgaccagaagtaaatttctcttgtagttctacccatgctttttctgcatcaacagcacgtttagataagacaagatcatcttcttctaatttaataattttcaactctagtgtttgatctaattctacaacatcgcttgctttttcaatatgaacgttagctaattcactaattggaattacgccatctgttttgtatccaacatttacaagcacttgtttctcttcaaccttcgttacagaacctgtaacaacgtcaccaacttgtaattcttttgaatccataacttcttcattcattttctctaccatggaaatacctccctacagaattgacaaagcattttttatgtatatacgaaatgaaaacaaagttttcatttgcatgtttaagaatttctcatcacatactctttttcaataacattcacaagaaaatatattaaacctatataaatagtatacagcaaaaccagcttgaaaaaagtatgttttgaaatataatagcgaatatattctgacagttttattcctctttaactaacttcttacaaatcagctcatttgtcaaggaaagagactcataattcacgtatcctttacatttctatttaaacaaaaaaagaaagaggattatcccctttctttatttcgcaaacactccagaaacaatgctcataattttttggacaacttcttcaattgataaagaagtcgtatctaattccaatgcatcatcagccttttttagtggagaaacttcgcgttctgaatctaatttatcacgctgagcaatttcttcttttagctgctctaaattagaatcgaaacctttatttaaattttctaaatgccttctttccgctctttcttcaacagaagcaagcataaagattttcacttcagcatccggtaatacatgtgtaccaatatcacggccgtccattacaacg

SEQ ID NO: 597 - DNA, 1097 bp, Bacillus thuringiensis
ataaaaagctcctggcaatacatcataattgtttttttcaattgccactaaatggcgatcttgaatttttgcaatctcatgcagctgatcaatagacacgccttacgcttctgttgtttctttcagctattgtcccaattccgacactactaacacctaagtatttctttaaaagtcaaacatagagaaattattttgcgtaccttgctcaatttcatctactacattatattgtatttcttcatcataatcgttacccaactcgataatataatcaaaatcatccaatgtgtattctgactgactcacaaatacatcaggatgttccacaactttcgttgcaggcaatctcataatttcacgaacgagctgccaatgtctttcgttagcacgcttcgttgacacaattccatctaggatgaaaatattgtcatcgctatactcatcttcaattaattgactgcgaacagtttgcttaataagagtagatgatacaaataaccaccttttatttgcacaaacacttgcagcaacaatggattctgtttttccgacacgaggcattccgcgtatcccaattagtttatggccttcttttttcatgatttctgccataaagtctacaagtaagcctaattcatcacgcacaaatcgaaatgttttcttatcatctgcatctcgttgtatgtacctaccatgcctaaccgctagcttatctcttagcttgggcggacgatatttcgttaccgttatgttatccatcgtatttaaaattgattcaagtctagagatttgctcttgattatcacacataagaagtaacccacgtcgtgcattatctacaccattaattgtgacaatattaatgccgagcataccgattaacgaagaaacgtcaccaagcaagccaggtcggtttttatgtatttcatattcaaaataccattcaatcatccaagatcactccccttgcttactttacacctacgtactatattatatgatttcaccctaatagggaagctaaatgtataatctatcctgtgtaattattatacaaaaaaagtagagaggagaatctcctctctacttttact

SEQ ID NO: 598 - DNA, 1003 bp, Bacillus thuringiensis
aaaaagagaatttttgcatatatcatactcgtagatatgaataaacggatcgtaattaatcgcttcttcatataatccaatttgataaaagaaccaatttgctagtgaagtgcagccacttttttggctccagaataaaattaacggaaattcatcgtggaagtgtggcatacgtccatgtttaatcataaagttataaatatccgtcattgtcatatacaaccaccctctgttttcttttatcattatttattactgtatgaagtaggcatttaatatatgaaaattggcaatgatgcggattatacgtttttttatttaaacgttaattgaaaataaaaaaagagtgtacaaatgaggaggttctgagaaaaaaataggttttattagtgtttaattaatatatagtgtagctctgtattgcgtaagtgtataaatatgaatattcataaatccttgtcacctccagggatattgggattttaattcacatttacatgaaaatgaatacacagattaaataattgtcacatacctcacaaatgtttcgtcacatttatgattactaaatgaggaggaacatatatgaaaatatttgtagcaggtgcaactggtgtaataggacgttctttattaccactgttaataaaaaatgggcacacggtgtttgcgatgatccgtaatacttcgcaagtagaagcaatgaaaaaggttggtgccataccagtaatagctgatgtatttaatagagaggctgtattttctgtattagaagaaacaaatcccgatgtagttattcatcaattaacgtcattgtcatcatggaattttgaggataatgcaaaaattagaacaaaaggcactcgtaaccttgtcgatgcagctaaaaatgtaggggtacagaaaataatcgctcaaagtatttcatgggcgtatgaaccaggggatacatttacgactgaaaaagattcactacatattactgcttccgcgcctcggcaag

SEQ ID NO: 599 - DNA, 1231 bp, Bacillus thuringiensis
  unsure (1)...(1231): unsure at all n locations
tcatgcggcaatgttacatcgtgatgatcatgaaaatgcagtcaagttaattgtagaagttattaaacggcttgataaagaggctgttcataacattacatttaattaatagaaaaagcgaaggacattctccttcacttttttatgttttaaaaaggccgctctaatcccgctgcagtatgagcacctaaaataattaaacgagttaattgcatcgccataaaatgcggggtatatatcatccctctttttagccatgacataatcatccctagatgggcaccagtaacataactaatgagaatatcgcgtggaaccattagtttttcatcgttaggttgtgaaatagagaggcttaatgttaaatgcgtttgaattgctttcatcatcttatacgtatagtttccggccgctttatcaccaagcatgacgttatagaagttagtgttttctgcaatatgttcgaacaaggccaaaaaacttggatgtggcgaatcaaatgttagttggaaatcttctttatttctatttcttggtttaattacttcagttagcttttctaacatttcttcaatgcttttgtctagtaagtcatatttatcgtggtaatggctataaaatgtagcgcggtttacaggagcgcgttctgcaatatgttgaacagttacattttcaaaacctttttcgcctactaaagcgacaaaagcatcctgtatgagttgtctcgtccgttttacacgtggatcatttgtatttttaatagacatttttatttcccctcgtttaattttctatacttaaacaacatattggtattatattgttgtttaaccgacatttcatacataaattgtcggttgtagattcaaaataattatttataattataaacgatagtccttcagaaatcagcaccgctcgcaggtagataaatttcgatttacgctgcaaatggtgtgatttttttgttaaaaggttaatataattaacaattaaacaatctaaacaataaggacataaatagtttagaaaaaaattatatgcgatataaggagaggaatgcaatgaatcagtttcgaagaatggtaattatcaacattatcacattaattgtactagttggcggcggtattggcggttattcctattacaattcaaaagggcccttgcttannnncagncnatgcgnaggagaatggaaaggtaaaaccggaagcttcaccagtatcac

SEQ ID NO: 600 - DNA, 1155 bp, Bacillus thuringiensis
acgtcttcgttgaaattaaatctccttgattttttttatcagcaccagcaataattccaagtattgaggagtttttaactaaattgagaaactggtttcctaaagggggaattacaattttcactgcttggggtaagacaacataatacatcgcctgcacatacgttagccctgaagagcgggcagcttccatttgccctttcgcaactgataaaataccagcgcgaattacttctgcaataaaagctgccgtatataccgtaagcgtaactgttcctgctacaaaaccatttaaagtaattcctattacaggtaaagcaaaatagaatataaatgcaattaatacgagtggaatatttcttacaaactccacaaaagctgatcctatccaatttaaaatacgaataggtgcaatacgcattactgccaaaattactcctaaaataaaactgcctatcaatgcaattacactagacataactgtatatttaaatccttctaaatacatatcaatgttattcgttaatatagaaaaatcaggcacatattctcccctctttctttacaagaagaggatgagcactctcatcctctcacttttactatctacttttctggtttttgtccaatccacttctcatataatttgtcatactccccgcttgctttcatgtctttaattaaagtattaatctctttcgttaaatcatctgcccctttttgcactgcaattccgtatggttcatctgtgaaaatttttcctactacttcataattagaatcttgttttgccattccgtaaaggatcgcattatctgtcgttaacacatcacctttacctgcctttaacgctgtaaatgcctcactataattttcaaactctaatacagtcgcttctggtgacttttgacgaatgttatttgtagatgttgatccttttacagctaatactttaacgccttgttttatatcatcgacactcttaatattgcttccttttttcacaagtaacgattgtcctgctttaaaatatacatctgaaaaatccacttcttttttgcgttcttccgtaattgtcattggtgcaataattgcatcaatatcaccatttttcagcattggaatacgtgttttagacgttacttctttcagctc

SEQ ID NO: 601 - DNA, 587 bp, Bacillus thuringiensis
ctgcgttgtccgtagctctcttcattgctgttattttcgctgcgggtacacttgctttaccgtctagtaatgcaccgtacactaagctttctgcgtattgtggcaatagaactccaaaaacttcttcttcagaaggtacgaattcataagctgtcgtgggtttgtcagacgccacatcagtaagcggttaaattttattctccggtacctctcgtgaaattttacttacgtaatggttgaagtagatgtacagatcatgataagcaccatctgcgaacatcgcaattgctcgagaagcaaggtctttaatatcaattaatgatgggtggtcagataatccaactacttcatcaataatgctaaagccgcgacgttttaaatcatcacattctagtcgtccaagcacaatagtagaatattggcttgaatccatattatgacgttcacgaattacgttacttactgtacgtaatacttttctgttataaccacctgcttgtccgcgatcagacgtaataacgatgtattctgaacgctctacaggacgcgcatttagcatgggatgcacaatccctctggtttcttgc

SEQ ID NO: 602 - DNA, 1672 bp, Bacillus thuringiensis
aaaaaagtgaaacattaaacagggggcattccgcccctgattatcagccctcaccaatcaacctttacggggcagcagggtccccacttaactttttgctttcgttgaattttaagatgggggtcttactgtccacaaatagcgggataaattcgaaatgaactttgtgttctcattaacaatttatcgtatttaataaaagggttctttcccctttatatggaaaaatcaataaggggaaagaacaataccgaaagataagggtggttgtcgtgataaaaacaaaagatgaaattgataaaattgtaaaagaaatacaaaagaaaatagatttctctggagtagttttagtaaaaaaagaaaaagacttagtctatgaaaaagctttgggttacgcaaaccaaagtgaatgtataaacaatacgatacaaacaagatttggcattgcctcaggatgtaaaattttcactgcaattggcatctgtcaacttgttgaaaaaggttttatttcttttcatacaaaattaaaagattgtctagagataaaattttcaaacttcgatgaagatattacaatacatcaactactaacgcatagcgctggtataccagattattttgatgaaagtattatggataacttcgaagatctttggaaacaaacacctatgtatctattaaagagtttaaaagactttttaccattattccaaaaaagtaatatgatgtttgcacctggaactaagtttcactacaacaatgcaggttttatcatacttggattaataatagaagaacagacgggacttaaatttacggagtatatagaaaagaacatttttaatccgattggcatgaatgattctggctatttttcgttagatagattaccaagacatacagctctaggatatataaaggacgaaaccaaccaaaattggagaacaaacgcctactctataccgataaaaggaggagctgatggaggtgcatatgttactgcaccagacatgctgaaattttgggcggccctatttaataatgaaattttaggaaaggaatatacaaaattacttttaactcctcacattcaagtaaatgataaacagtcctacggctatggaatatggattgaaacacgagaaaacaaggtattcaaatatcatgtaatgggatatgatccaggcgtcagttttcgctcggctatatatccagaattaggaataactttagttattacgtcgaataaaggggcaggacctgaaaaattaatgatagaaatagaaagagctttttaattatatggatttaaaagaagagatacgaaaataatttaaacgggttcatgattgtttctgttttgaaaaatattttagttaacgaggaaccctttatttattaaataaggtttttttgtaattctgtacaattatatataattatatggatttttaaattagaaaacattactatatagttgtaaatttttattattaattcatatgaaaggatgtgttaacaatttgtatatgattaacggtagtgtgtttattattttaggagttatttgttatttaattgtacgtggaatattaattagtaccaaaaatacaaaacatgtaatttggtggaaagaaataataagttttttatttgtgatctacatttgtat

SEQ ID NO: 603 - DNA, 1314 bp, Bacillus thuringiensis
tctgtgtccaattggacaattgaagctcaggtacgtctaatccaaacgtggttcttctcatttgcgtagagcctattccaagcggctattacagcgcataaacatgaccctgtattaaaagctttttatgaaaagaaacgaaagcaaggaaagcactactatgtttgtataggggcggtagctagaaagctgtgttacattatctatgccattcttaaaagcaataagccttatgaagtaccacctcacacaacagaaacatgaccttttcattttttttgaaaatccttaggtttatttggcacgcccttttttagaaaaacaccccctatttatataaaaaactccccttgacttctcatagttggtcttttaaacagagggtatatggattcattttcataacacttaaatatgtaaggcaagatattcaagcgttccatctaagactatgctttataagtctaatatttttttctatagcctagaacgttttttatgactgtaattccataaactgttcgacgcgaaatattattttacctatataaaatagccacattatttatttttcaaattgtgtaaaacccactcaatcaagaaaattgctgcagaggtacgttctgtcgtatcacctaaaaacagtttattgataaaacctttaaaatgagttggtactttagataatgtttcaatatacttcaaaacagatcccgctggtggtataggcttattattaacagcccatatcccatctaacaatgtccaagttgaaatttgaactatgtatgaagcttttaactcatcatttgctttcaaggcagattgaattttaattaatgaactatgcaaccaatgagaaatgcccttcattttgtcgctagaaacacgatagttttcaaattcatatgtagctatttcctttaactttttcaactcaccgcttttatcaaacaaaatttccccttctagaaatgagtaaaattccatcggattgtttttaaagtttacttgaatttgattaaaatctgcactcttatattcaactaaaatatcatcactcgtttcaaaatgaaattttttcttttgcccttcttctaaaagaatatagaaatctaaatccgaatcaggatatgcgtcacctcttgcgacagatccaattagcatgaatccatttactttatctctaaataaatattcatttaaaattgtttgtaccaattttttatgtttttcatttgtaatgaatgaaaaactctccatcatttccatcccccattactacacaaagaggatacatgtttgcatcttcaa

SEQ ID NO: 604 - DNA, 880 bp, Bacillus thuringiensis
tcttcgaccgccaataggccgtattgactattttttttaattccagttaatgtagcaatttttcctttttctttatggaatgctattagttgatcaatatctatattggctaatccgtcaccataagttaataaaaaggtttcaccctgtacaaaggattcaagtttttttagtcttgccccggtcattgtatcaattcctgtatctataaagtgtatattccaattttctaatttctgaagtagcgtatattgactggttttaaaattcaaactaaagtcattctctttccagctaaagtccataaaatattccttaattttctcacctttatatcctaagggcaaaatgaaatcagaatgtccatattttctataccaattcattatatgcaagaggagaggctttccttgaactcgaactaatggtttgggaatgtcctctaaaattccttgcatccgaagcccttttccgccacacaaaattatgactttcatagatttatttccttcctctcaatatattttactaatttaaactatgtagtttgtttggtaaatgtatacacggttgtaccataatgatgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatccctcggatcaataggcaagtacccaat

SEQ ID NO: 605 - DNA, 1250 bp, Bacillus thuringiensis
taaccatattctgtctgctctcactagttttgacggtcctaagtgtcgaccatgtccatacgccggcataaaccataataattccatacctttacacaccccttatttattttgaatcgtatactaacacattctatataaattacccctaataatttatatgttaattccctgtctcacctttaaagttatctcgccatcttaaaaacttcacttttagtaaacgtactagagagtcagaaaacttcccaacaaatgcaaatataattatgccgacaaatacgatatctgtatttgaaaattgccttgcatccataatcatatagccaataccttctgtagaccccataagttctgctactactaaactcacccacgcaacacctaacgataaccttgctcctagtaaaaggttaggcaatgcagctggtaaaattagtttcgtgattaattttcttttactaaactctaacactctcgcaacatcaaataactttgaatccacacctctaatacctaaaaatgcgtttacgtataaaggaaaaaatgcaccatctgcaattaataacacttttgatgtttcaccaaaaccgaaccataatacaaaaagcggcgcaacagctaaatgaggtacagttcttaacatttgcacagatgggtctaaatattgctcacttctcgttgaaaatccaacaatcgttcctaaaatgattcctaagcccccaccaataaagaaaccagccgcagccctgaatacactaatacttaaatgtccgaataactctcctgttttaataagctcttggaaagctagaaaaatatctaatggtgttggtaaaactgttttagaaacaagaccgaatacgccagccaactgccaaattattaatataataaccggtatagtaatcgcccttactaaaacttttacatttaactttcgtaccttctttatgccatttttcttaatcgttatactcgctggtttcataacagctttcgtattttccactttacaaaacctcttttcacttcgctttcaatgctttttctacgaaagaattatctacaactttttccgtcttaatttctttctttatagaaccgagcttatattgaaaatccgcagtcttttgttgttctgctattatttccttagttaccggaactaaaattggtttgtcgtgattaaacacttcttttacgatcttcgcatctatcttttttacagaagtgtatacttttattgc

SEQ ID NO: 606 - DNA, 1396 bp, Bacillus thuringiensis
atattccaatcccttccgtaaaaacaaaaaacgtataggaaatttcttactatctcataatatacataaccatttttgaacgaagggagatgtttcatttgcataccgtctggaaaggcgcactttcacttggactattaaatataggaattaaactatacagtgccgtagaagaaaacgacataaaatttttaagtctccataaagaatgcttaacacctattaaatataaaaagttcgctcccgattgtacggatgaagaaattgatgataacgatattgtaaaagcctatgaatacgcacctcataaatatattattatggatgaaaaagaattagctcaattacaacaagctcatgaaccacgatccattcgtattatatcttttgtccaaaataacgaaattgattctgttctttatgatcgctcttattttataggacctaccccaggacatgaaaaatcctatttattattaaaagaagctcttgaacgtacaaataaacttgggcttattcatatttctattagaaaaaaacaacatttagctattatccgtaactttgaagatggactaatgttacaaaccatccactaccctaatgaaattcgcgctataacaaatacacctaacttaccaagtaacgaaaattatcctatacaaaaacaagaactcaccgcagcaattaatttaatccaccaccttacaaatcctttttgacaagatatgtatacagatgaatataaagaagcccttaccgaattaatcgagaataaaattgaacacaggaaaaaactgaaactatctctccaactccgaacatcattaatattatggagacattacaggcaagcattgaacaagcaaaaataaaaagagacaataaaacagaaaaagaggccaaataaaattgacctctttttctttaaagcggattacatttcggcatttcaagtccagacgattgagctagttttaataagtagtaacattcctctcttgccatatgatctgccattctagccgataatacacttaatacttcattcgataactcgagctcttccacttcatgtaaaaaatgcgaaaataatttcaattcaagtgaaacatctttcgtaaacttctttaatgctggaaaatgatgaagctccgttcgtaaataccctgtcatttcaactgcctttaagtaaaattgttcaaaatgcttcgtaaattcttcgcttttctcttttaatcttttttcaacaagatctaatccaccagaaatagagcctgcgtgaccagccgcatccgttaaccaaacgagatgataatgtaattcatgaaaaacaggcggaacttcccctttctttaaaaactctaaaactgctatatactcttccacttcgttt

SEQ ID NO: 607 - DNA, 2083 bp, Bacillus thuringiensis
ttcgaagcgcaaactactttgtatagctgggcttggatggctatttgatgcaatggatgttggaatgctttcatttgtaatggtagccttgcaaaaggattggggattaagtacgcaagaaatgggctggataggcagtattaactcaatcggtatggcagtcggagcgcttatttttgggatactatcagataaaatagggcgaaaatcagtctttattattacattattattattttctatcggtagtggtttaactgcattaacaacaacacttgcgatgtttctcgttttacgctttttaattggtatggggcttggcggagagcttccggttgcctctacactagtatcagagagtgttgaagcgcatgaacgtgggaaaattgttgtgttattagaaagtttttgggcaggtggatggctaattgcagctcttatctcgtattttgttattcctaaatatggttgggaagttgcgatggtattgagtgcagttccagcattatatgctttatatttaagatggaatttaccggattccccaaggttccaaaaagttgaaaaaaggccatctgttattgaaaatataaaatcagtttggtctggggaatatcgtaaagcaacaattatgctatggattctatggttttgtgttgtcttttcctattatggaatgttcctttggttaccgagtgtaatggtgctaaaaggatttagtttaataaaaagtttccaatacgtacttattatgacattagctcaacttccaggatatttcaccgctgcttggtttattgaacgtctcggtcgtaaatttgttttggttacgtatttaattgggacagcttgcagtgcttatttgtttggggttgcggattcattaacagtattaatcgtggcaggtatgttactatccttctttaacttaggtgcttggggagcattatacgcctatacacctgagcagtatccaacggttattcgtggtacaggtgcaggaatggcagcagcatttggtcgtattggtggtattcttgggccactattagtgggatatttagttgcttcagaagcttcactatcattaatatttacgattttctgtggatcaattttaattggtgtattcgctgtaataatacttggacaggaaacgaagcaacgagaattagtataaagggaaaatttgaacgtatccctgaccgtttattatcctacactactcggctctttataggcagttagtgcgggataaaaggggagaggaaaccgaagtggtttccttttttctgtttttttagataaataatggtatagtaagaaaaagggattatttcttataaaagcgaatgtatacaacaggacatatggacaaagaattaggtggttgaagaaatgaaaattttactgatcatggaagaggcagaagagagaagagagttagctgaaaatttcactgaaaatatgagaaatgtagaatgttttgaagcaaagacaggaacagaatctttatttatgatgaaaaaacatataccagactttgtttttttaagttccaaattactagatggtactggttttgaatatgcaagtttattacgagaaataaattgctatacaaaatttatttttgtaggtgaaaacatagaagaatctattacagcttttcgtttccaagcattttattatttattgcgggatttctagaagaagattggctttttcttttatataaaataggtaaagaacaaggtgagaaagcaaagagttatttgcgaaaactaccgatagaaagtcaagagggtatacgatatattctcccagaagatattgtatatgtaagtaaaaataaagaaaataaaactgtttcaatttacacaacgaataatcagtatatttcaacatatacacttcaggaattagaaaataagctaaatgcatatgattttttacgtgtacataaaagctatttaattaatatgtcatatgtaaaagaactgaaaccttattataatggcacgtataatttgtatttagataggattgatgagcaacccattcagtcagtcgaattttgtaa

SEQ ID NO: 608 - DNA, 1041 bp, Bacillus thuringiensis
aaaaaatgttagagattcgtaagtttgaagataaggtacatgaattgttcgcgcaaggcgttttgccaggtttcgttcatttatacgcaggtgaagaagcggtagcagttggtgtatgtgcccacttaacggatagtgacagtattacaagtacacatagaggtcatggacattgtatcgcaaaaggttgtgatttaaatggtatgatggctgaacttttcgggaaagcgacaggattatgtaaaggtaaaggcggttccatgcatattgcggatttagataaaggaatgcttggtgctaatggcattgtaggcgggggtttcccacttgcttgcggttcagcattgacagctaaatataaaggaacaaaagatgtaagtgtttgtttcttcggtgacggagcaaataatgaaggaacattccatgaaggggttaatttagcggcgatttggaagttaccagttatttttattgcagaaaataacggttacggtgaagcaactacatttgaatatgcttcaagttgtgattctattgcggatcgtgcaaaagcttataatattccaggcgttcaagtagatggaaaagatcttctagctgtatataaagctgctgcagaagcagtggaacgtgcgcgtaatggtgatggtccaacaattattgaatgtatgacatatcgtaattacggtcattttgaaggtgaagcgcaaacatataaaacatcagaagaaaaagaagaacatttaaatgaaaaagatgcgattgtgaatttccgtaagcatttaattcatgaaggtttattaacggaatctgaacttgttgatatggaaaaagcagtagatgatgcagtacaaagatccattgaatttagtgaaaatagtccatacccagacgatgaagaattattaaaagatgtatacgtttcttacaaataagaggagggtgaaaaattatgactagaacagtaagtatgtcaactgcaattaatgaagcgatgaaaatctaaatgagtcgtgatgaaaatgtaattttaataggtga

SEQ ID NO: 609 - DNA, 1132 bp, Bacillus thuringiensis
actctagaggaaagattgagagcctgtcgtgaaaaaagcggctatacacaaacgtatataactgaaaaactagaaatacaccgtgggactctttctagttacgaatccgggagacgaaaaccagattatgatactttatctaaactagctgatatttataaagtatctgtagattttctattaggaagatccactgacgaaagattaaccgcagaacaggataaacaagcaaccgcaatggggaaaaagattgaacaactgatctctaaattatcagaagaagaacagaaaaaagcttgggaacaattagaaatgtatgtacaatatcaacaaaacaaagaacaaaaataaaaaaagctaacctctgtggttagtctttttttattttaaataaaccgtctagtaagtgttctaattgttcctcagtattgggagtgtttccctctaataacaacttaattgccgcttcttttgctacttgctcttttaccattataatttccccctacaccctctgtatattttgtttgtaatttaataatttttagagtttctctttatagcaaattataataaccgttagttctttataaaaatgacgtttggaaaaaaataggtgtcggtttttttgccgtcaataaaaaacctacagtccctaaaaagtacgaaagacgctgcgatttacgcaacgtctcttttttcattgttattttaatttttaagaaccacctggttcaaccatcatatattgtacttcatgtttagataattggcttttactatcctttgttgctccactaacatttaaagttaaagtcattacagtcagaatagataatactaccatactagcttttttcatattcatcccactctttcaactatactagctaacgttcgtctcaccgcgttagcataatgataattaccaacacgctcaaaacgtctcaaagattcccttaatcccagtatatcattgttaattctggaaatatagtacattgtgaatggagaatccatttttctttctgcagctaactgtttaaatatttttaatgctttatttttgtcgccatataatccttcgaaatatcctatttcagatgtatcaaggtattcaaattttatttta

SEQ ID NO: 610 - DNA, 1549 bp, Bacillus thuringiensis
atcatttactattatagctggtttaattagcatatctcttatcgttgttcctatcatttgtataggttatggaatagacttagaggggatgattccaatttcaggaactttatattggggtctcttctctttagctggactattagctatagtaaacggaagacacatatcgagtattcgttctatggggacgattttatttataacaggattatgctctgtaagtggttattaccttttatatcttactctttaaaaagacaaaaaaagcagggaaattaattccctgcttttctatttggtttattgcctgatggtaagaagaacgataacacccaagcgatacctgctagtatcgttgcgattaagaaggcatcgttaataccgttaattgcagatagctttgaaatttgtccatataatagttgtgtgctcatcgcgtctcctgcttgagctgatccagctaaggccgctaaactttgccccatgccatgtattttatcaactaaaattgggtttgatgttgttaacatgttgccgtaatctgctacgtgagcagtcgtttgttgcgtcataagtgtaattaaaatcgctgttccgattgaacccgctacttgtcttgacgtattttgcgttgctgtaccgtgagaaattaatttcatcggcagcgcgttcataccagccgtcataattggcatcataatgaatgacataccaattgaacgtataatataatccgtcataataacgctatacggtgtatccatcgataattttgtaaattcatatgtcgcatacgtcgtaattgccaatccaattatcgctaatggacgaatgccatatttatcgaataatttacccgctactggtcccatgatccccataattaatgatcctggaagaagtagtaaaccagattcaattggcgtaaagccacgaatgttttgcagatatactggaagcaataacatacctccgaataatgccatcgtaacgattgcgttaattactaaagtgaaagtaaatactggatatttaaatacttgtaaatcacccatcctattgtccgttgttaactctctccaaataaataacgctaaaccaattacaccaatgataagtgaaataacaacttctgcactagtccaactattatttccagcctcactaaatccgtacagcaagcttcctagcccaatacttgaactaacaacaccaaatacatctaattttgttttacacactggctgagctagtgtaaagaattttaaagataggaacgtaataattaaaccgataataaacatcgcatagaacattaagttccagctgtaattttcaattacccaacctgttacagtcggtccgatagctggagctaaaatcatcgctacacctagtaaccccatcgctgctccgcgcttatgaggcgggaacaatgtcataaagatattcataccaaccggcgttaaaataccctcaccaactgcttgaattacgcggaccgtcatcatcatcgtaaagtttccggaagtatcacaaatgatag

SEQ ID NO: 611 - DNA, 991 bp, Bacillus thuringiensis
aaaagaaagtgtttatccgatggtagaagtatggaaagatgaagcagcagttgcgagccataatacgagtgaacacttcacatctttcgttagtaaagcagcacaatttttaactgctccgcttaatataaaagcttataatggagaattagtaaaataataaggtagaaaaagatgactttagcatatggctgaagtcatcttttttgtataagtagaatccattttggactcagttatgttgatagataagcgttgctcgcatcctcagtaagagtgctgaattgtatgttaaattcgaacattcggtttattgggatatttttccgtggtataattttcttgtaaataaaaggtagaggggagtaagtaatgggagaatttcaaagtaatttgcatacggcaacgcaacttgcaacgaaaatgagaaatgcttcagatagaatgcaaagtgctactagtcgctctataaataaggcaacgcgtacgacactatctgtgaacttccaagcacaagaggcaaatcaacaaaatttacagatcacgaaacaattttgtactgcttttcaacaaacaattgataatatccattccgtagcaaatgaatttgagaaaatggatacaggacttcaaaagacttttcaataatgtaacaacctacgtaaaggggaaaaggtagggagaaaagatgagtcaagaaattgaaacgagaatcagtcaatgtaatcaaaaattacgaattatatttgaagaacaaaatgaaaaccgaattgcgctgcaaaatcaagaacgagctgaggttagttttcatgaatggaaaaatagaagtaatcgtttatttaaccgaatactagaaacttggcacggcgacaaagaagtgtttcacctttttacgaatatgcggcaagaaatcggacagtatgaaagaaaacttacattcgaattagaaaatgaaaaagagacgttgcttaaagaaaaacggcatctcagt

SEQ ID NO: 612 - DNA, 1144 bp, Bacillus thuringiensis
tagattccaactcgaacagtctatagctgcaagaattaaaaagaccatttatcaggtaaactattataaaaacgttcaatggccgctactaaaactaaatcttctaaatgagcagttttaaggttgtttatttttaaaaacatcaaaaatgccaaatcccttatatcacaaaggatttggcatttttaagtatctagaacacgcgctaaatttaaggagaaattaacagacatgagtccggtataatgccgtgtccacacccaaggatcggttacataaaatagcgtatctaacctgggaagtctattggcctttttcccttatagtaacgctctcttctactaagaccttttctttctagggcctacaattaatttaatcgctgttctttcttcattattgatagaaatctcttgaaacgctggaacaaaagctaagtcaataccacttggagcgacgaaccctcttgcaatcgcaattgctttaatcgcttgatttatagctccagccccaatcgcttgaatttccacattaccacttgttcttagtactcctgctattgcacctgcgactgaatttgggcttgattttgaagatacctttaatatattttccatgtaagttgctccctctattatttaatctctctttcgttacaattttaaatattttagcgtatctttaattactattcacaccaaaaacaaacgatgcttcatatgtatattattctatattttctgactttttcctgctcagctacgcaaataaaaaataaactgaataacctaatataaatatagctaaatattataacttcaccaaatgataacatccatacagctaaaggtaatatttctgttttgtcagactaaataaatatagtaaagtgaaattttaatgagtgggggtttaattcatcccccacctaacttctttgctttcgctgaattttgagatgggagtcttactgctcggaaaatagcgggataaacgtttcctcgttacttcaatctatttagaaattccatttatttttctatcaaattataaaccttatcatcttcaaaaggtgttacaggtaatacccaaatactacacttcatcatttgaccactttatattccaaatctatttcctttta

SEQ ID NO: 613 - DNA, 2173 bp, Bacillus thuringiensis
tttccatcaatgctctcggcttcaacccatgaacaagttgaattttctgttactagcatgggaaaagaagtaatacttggagcaattgctgcaactctaattatcttaatctttttacgtaacttccgaacaacactcatcgctgttgtcagtattccattatctattttattaacactctttttactacatcaatctaacattacgcttaacattttaaccctcggtggtttagctgttgcggttggacgtctcgtcgatgatagtatcgttgtcatcgagaatattttccgccgtttacaaaaagattctttctctaaagatatcattctcgatgcaacgaaagaagtcgcagtcgcaattacttcttctactttaacaacggtcgctgtttttttacctatcggcctcgtagcgggagcaatcggaaaattaatgttacctatggtattagcagttgtatattctatactatcatccttaatcgttgcactaacagttgttccacttatggcttttttactactcaaaaaaacaaagcatcgaaagccaaattcttcatcacgatatgtcgctacattaaagtgggctctttctcataaattcattattctacttactgcatttttattatttgtaggatcaattgcagcttatatattactaccgaaagcaaacataaaatctgaagacgacacaatgttatctattaacatgacatttccagccgattataatgctgaatctcaaaaacaaaaagcatttgattttgaaaagaaattactttctaattcagatataacagacgttattttacgaatgggatctagcgcagaagatgcacaatgggggcaaacaactaaaaataacctcgctagtatattcgtagtctttaaaaaaggttctgatattgatcaatatattaaagagttaaaaaaggaaaataaaacttttgagcctgctgaacttgattatataaaaacaagttattcaagctctggcggcggcaataacttacaatttaacgtaacagctactaacgaagcggatttaaaagaggcggctactatcgttgaaacaaaactaaaaagcatggatgatctttctaaagtaaaaacaaatttagaagactctaaaaaagaatggcaaattcatattgatcaaacaaaggctgaacaactaggtttaacaccagaaatagctgcgcaacaagtagcattccttatgaagaaatcacctattggcgaaattacaattaataatgaaaaagctactattatgatagaacacaaaaaagaaaacattaataaacaagaagatattttaaatacaaacatactatcacctattaatggaccaatacctttaaaagacatcgcaactatttcagaaaaacaaacgcaaacagaaattttccataaagacggaaaagaatcaatccaaattacagcagaagcttcaaatgaagatttgagtaaagtaaacacagcagtaaataaagcgatgactgacttagatttacctagtggtgcaaaagtaaatatcgcaggagctactgaatctatgcaagagaattttacagatttattcaaaattatggggattgcaatcgggattgtatatttaattatggttatcaccttcgggcaagcacgtgctccttttgcaatcctattctccttaccgttagctgctgtcggtggtattttaggattaatcatttcacgaacacctgttgatgtaaattccttgatcggcgcattaatgttaatcgggattgttgttacaaacgctattgtattaatagaaagagtccaacaaaatcgggaacacggaatggaaactagagaagccttacttgaagcaggttctactagactacgcccaattattatgacagctattacaacaatcgttgctatgctcccactcctatttggccaatcccaagcaggaagtatggtatcaaaaagtttagccgtcgtcgtcatcggcggtttggcagtctcaactgctcttacattagtagtcgttccaggtatgtatgaactattagataaaatcgggagaaaaagacgctcctgtaggaaaataagcacttctacagaaacacctgatatttaaaaacataaaggcgttaccttcacaaatgaagataacgtcttttctttaa

SEQ ID NO: 614 - DNA, 1623 bp, Bacillus thuringiensis
aaatgaaacttataatctttatatcctttcataccttccgtactaggaatcacaacaaacctgggagtaatccagcaaaaaattagcaaatcaattataagtaaatctactaaattgaaaatcattaaaataccaaaagtgtgtaaataggcatccatatacattaacttttcatgcttatgtagtatatatgtagaaacgaaaggactaccgaaaagaatagtattatatacaatattaaaataaatgctttgctttttttcatgaatcgattttggaaaaactactttttgaatatctttcggataatcagttaacgatagtcgaggattataatataaggaccctaaaatcattacagatagtacaatagacatgatgacaccaacgtacatcatttgctcaaattgattcatatgctgtattcacccttttctgtaattactatgatggtcattcacttaattacatattgtatgtacgtacataatcaaaaattaacaactagctttaatagcgaagcaaacagatgtaaacgtactaaaagcaattatcgatccgaataatatcccttctcgcaaaattttactaagtgtaggttttacatcggagaaagtttgtgagattgatggattacctggggaaattttgagcacatacatataattccaaaaaggcagcgctacttatgtagcactgcctttttctttattggaataatccttttcctttattcatttacttataaagtattgtcagttcttctttatgttctgtatttccacattataaatatttcacgtcaaggagagatgactgaaatgaataatcaaaaaattgaacttactggtcgtatcgttacacctaatgatcctgattataattcagcgcgtgaagaattcaatacattcttcaacaaatttccgttaatcattgtttttgctcaaaatacgcaggatgtagtaaacgctgttcgctggtcaaggctacataacgttcctatacgcatgcgctctggacgtcataattatgaggcattatccgtcagtaatgctggtcttgtaattgatgtaagtgaaatgaaacaattagaaatagatcacaataatggaactgtaactatcgggactggatggagaaatatttctttaattgaaacacttgcagctgaagggttagttgtgccgagtggtgtttgtcctactcccgggattgcaggtgttactttaggtggcggacatagtattctctctcgtccgtttggattaactctcgatcatttacttgaattagaaatggtagacgcgaatggttgtataatacgcgctaacgccaagtgtaactacgatctctattgggcttcgcgcggtgctggtggtggtaactttggaatatgtacttcgtttaagtttcgaacacataaaattaatacggtaggatttgcagaaataagctgggggatatcagatttaaaacctgtattaacctcttggcaagaatatacgctaccttgcgctaataaacgatttacaactactctttttatgtatgcagaactagaaccatcattattaatgcaaggtgaaattctcggttctgtacaagaattgcagtcgctactat

SEQ ID NO: 615 - DNA, 1344 bp, Bacillus thuringiensis
ccgcctaatatatcaaggttgagaaacagatataagatgtttaggcgatgtgtttatttcctctgctaatgcttttatgttcatcatgatttgaagtatttcttcttttgttgttcttgggttaatagagcaaagtcgaattactactttttcttttaatttagtcgtacttagcatagcaaatcctctttgattaatttcttccaccaattttttgtttatttcatgaattgtatctgtagatgttagctcacatggaatataacgaaaagtaacaattcctaattgggcaggtgttactacttcccaatctttttctttccttaaaaactcttcaacttgttcagctagcataatgccatgatcaattgcctcacgaaaagctgtaactccgaatgctttaaaagaaagccatacctttaatgctctaaatctacgagaaagttcaattccacgctccccaaaattcactttttcttctatattagtttctgtatccttaatatactctgggatcatacggaatgtttcacttaaatattggctatttcgaataagtacacaaccaacatcataaggctgaaaaagccatttatgcgggtctaacgttaaagaatcggcacgatgaattccacttaataactcccttcctttttcactgagaattgctgcagccccataagccccatccacgtgtagccatatatcttcatcaccacatacatcagccaattcatcgagggagtccaccgctccgcaattcgttgtccctgcattagcaataacacagaatggttttttcccttttaatcgatcttcttttatttgttttcttaaagtactaactgaaatttttaagtcttcatctgtctcaattcggcaaatttgatgctgtttaaaacctaatactttaagtgctcgatctacagaaaaatgagtttggttagaaaaataaacaatcgcattttctatgtcattattcagcttgacctgtctcgctacagtaagtgcagtcaaattagccatggaaccaccactgacaaatagtccttcagctgaatcagggaatcctagcattgattttaaccagttaattgtcgttaattcaatttgttcggcacctgcacctactatccaagctgtagaaaatacattaaacccacttgctaaaaaatctgctaatacaccaacataattattaggacctggcacaaaagccataaaatgaggatgatccacatgagtaatttgattaaacacattgttattaagaaaatgaagtaattcttttggattagatccgttttccggaatcgtttcaattagcttaactaaaaaaatatt

SEQ ID NO: 616 - DNA, 1058 bp, Bacillus thuringiensis
tctgtgaaaaggctcttatcaattttacattcttcctctttactttccattaaattagacttaattttatcgaggacaacatcttgcataacagtttgaccgttatatactccttttatcgcatcacgaatacgctccggatcgttattttttaataaataacctttcgctccgttttttactgcatccaaaatatattcatcatcatcaaacgtcgttaaaataagcggttttgttttcgtctcttcacaaatgaacttcgtcgcctctacaccgttcatatttggcatacgaacatctaaaagagcaatatcaacttcatgctttttacaatacgctacagcttcttccccatcatttacagtatctactacttcaaactcttcgtatgtatttaaaataattttcataccttctctaataaaagagttatcatctgctattaatattttaattttcatgtttgttagtatggacctttccctactaacattcacatcctttctccgtgtaacatttcctacttgctcattatatacttctctttaccattttttcacaccttttttcatctagctctcccgcaaaaaatatattattctttttttacaaaatgtgtagggtgacttatcattctttacgtctatataatagaatgcgtcaaaaaggagggagagaccgattgaggaaaaacaattaattgaaaaagcacagcaaggaagcgagcatgcttttcgtatccttgtacaaacatatcgtcattatatttttcaagttatcttttctattttaagacatgaagaagattcgaaagatgttacacaagaagtattcgtaaaaattcacacctctctcccaaattatcaatttcgcggattaaaaacgtggatggcacgtattgccaccaatcacgctattgattataagagaaagaaagctagagaaagtgaagaactctccttatgtaaagaagctgaagaaaatagacagtcctctcataatattgaggctttattcctgacgaaagagcaaaaattactcattgcacaaaaactgcg

SEQ ID NO: 617 - DNA, 1306 bp, Bacillus thuringiensis
agttcgaatctctcctgggacgctaaaaaaaccttgttatcttttgataacaaggttttttgtttgtctaaaatttgatgtttgggttataggtgtagttcattcttgatatttgcgacctttcctttgatattaagtagttgcatatgtacttctttttcttaaataaaaagagcgccatttatgcgccctattcctcttatttaatttaaagaatcaataggtttatgatggaactcaaatccatatccagattctcttaattgtttacttacaatattataaaactctttaccattctagtacaattcagcagcagttatcggaacttattcccggtagtgtgttacaattaatagaagcggaaaacgagaatctccaattgactggacctgtgattggttagatggtttaagaaggtcgtataaaaaagggagatggcgcaaagatggcgagatcaaatgagaatgatttaacggagaaattggcggaaggtcaccggaaatatggtgatggcaattttacagtacagaacatcggtgatgaaactaacccgaattggactgtcgtaaaaaatgtgaggaaaggatcggcaggcattcgcgaaggagaagatatattaagactgcgatcaaaatatataaaatagtacggaaatgggcggagcgggagttcgaatctctcctggggcgccaagaaaaccttgttatcttttgataacaaggttttttgtttgttttaaattagttgttaataaacttgtcaaagacaaaaccataatctttcacattatattgtttcttcgtatcaacgagccagttaaaggcaatctcgttcatctctttaaattgctctgctaagtttacttgtgcgtttgaaatacggctgaaagcgttagatgccatatctaaacttttgtgtgcatattgtaatgtaatatcgttgtcgtatgaaatttcttcaattttaagtaaagctttatataaatcttttaattcttcaatatgttttttatggacatcaattgaatagtgttcatcgcccatttggaacttaatttctacatctaaatcaatcgttcccgcagtttcaagcgctacgtttttaatttgatatttactatagctaaagcggcgtagtgtacgttttttacttgttgcgcttgtaccgtctaagtgaattaaccctttgtttgtgaagcaatattcatctgatttcgatttaattagaaagtaaattttctccccatcttcatgcattacataatcatcggcatcgaccttatcatagtctttaggtgtaataa

SEQ ID NO: 618 - DNA, 1244 bp, Bacillus thuringiensis
gatccttctttctaaaatttctactgcgcgcacttatcagtcaagtctacattatatcgaaatctacaagtaaaatccatctttagtttaggttttcacttcaaaaactaaccttcttcccttttattgcatattgtatgtgtatatacctaactgaagaaaggaggatttctcacatgtttccgaaatcccctacaaggcaaatgtatccgaatccagggcaacaaccttatacaccatatccaattccacaactaccaccaatggcacaaaaaaagaaaggttttcttgctaagctttttaaaaaacacgatccaaccgagccttttatgcaaatggttccaccttaccgacaaatggaagggcaaccgatgatgcatcagcaaccaccaccgccacaatatcaacagcaatatcagcagcaataccaccaacaatatcagcagcaacatccacaatatcaaccatacatgcagcaacatcctgagcaaatgataccgcctcaaatgtatgaatcaaatgaaacgcgcggcggcgcaactacagctgccgcaacagcaagcagtggcatcggcagtttcttttcgaacttaatttcgaatcctactaatatgataaacaacatcgaaaaagtatcccaagtcgttcaatctgtaggtcctgtcgtcgaacagtatggtcctattatgcgtagtctaccaagcattgttaaaatcctcacctctggaaaaagtacggaagaaaatcaaacggaaaatgtaacagagccagttgaggtagaaagtccgcctcctgcacctcaaaaaaagaaacgaaaacgaaagaaaatagtgattgaacctgtaatagaaaaagagttaccgaaagaaccagttcaacaaacagcaacaaaaccaaaactatatgtgtaacaatcctttgttttctatccactcctcctttataatgtaaaagactatgcacaaaagtatcccttgtttagaaggagaggattactcatatgaaaattgttaaaatttcccctcgtggttattgctacggttgttgtcgatgcaatggtaattgcacgtaacgctgcattagataaatcattgccgagacccatttatattttaggtatgattgttcacaataaacatgttacagacgcttttgaagaagatggaatcatcacattaaacggtccaagtcgcttagaaattttagataaaattgattctggtactgttattttcacagcacac

SEQ ID NO: 619 - DNA, 1318 bp, Bacillus thuringiensis
tgatctgtagaatacccataaggatttgataaagcttcaagaagtttctccattacgctatagtcgtcatttgtaacagctgcttctagtgcttcttctacacggtggttcctcgggatgattgatgggttattatttttcatcatctcgtaggcgttttctttcgattcttcttgtttttctaatcgagattgccacagtttgtaccattctttaaattcaggactatcgaatagagggatattttctaacgtatcaagagttaatgaacggaatgtattagtgtaatctgctttatatttctccatcatttttaaaagttgctcaataagtgattgatcttgttcttcgttgctaaatagtcctaatttctttttcattccaaggaaccaattgttttcatactgtacgctaaatttcgaaatttcgtcttgagcgatttttagtgcttcttcatcatcttcgtgcagaatcggtattaaagattctgctagtcgtgcgagatcccatgcggccatatatggttgatttccatatgcataacgaccttgtgtgtcaatagagctaaatacggttccttggtcgtaattgtccataaatgcacaaggaccgtaatcaattgtttcgccactgatcgttatattgtcagtgttcattacaccgtgaataaatccaacaagttgccattttgcgataagactagcttgtcttttaatgattgcttgtagtaatgcagtatatcggttttcatgggattcaatttctgggtaatgcctttttatcgtatagtcagctagtgatttcaggtcctctattgaaccacgagctgcagcatattgaaatgtaccgacgcgtatatggctactagctactctagttaaaattgctccaggtaactttgtttcacgatatgttggttcaccggttgtgacaactgctaaactgcgggtagttggaatatcgagtgcatacattgcttcgctaataatatattcacgtagcatcggaccgagtgcagcacgaccatctcctcggcgtgaatagggagtagggccagaacctttcagttgaatatcgaaacgcttacctgaaggagtaatttgttcgccaattaaaagagcacgaccgtcgcctaacatattaaaatgtccgaattgatggccagcatatgcttgagctaatggatgagctccttctgggagtgcattaccagcgaaaatagcaatttcagcttcctttttcagttcttcaggggtcaagccaagagatatcgctaatgaatggtttagtttaactaactccggttaacttacgggag

SEQ ID NO: 620 - DNA, 1412 bp, Bacillus thuringiensis
gtatcattatagggtgcgttaccacctagaattaccttatcgatttcataatacggcagaataaactccttataatgataaacaattgaacttgctgtaaaccttgtgacagtcgtcaatatattttctttactatgcttttcaaaccgctttaataactcactgacaaattcttctccaaactgttctctaccagttgatttcggtggattcattttcagaaatggatgattcatacaatatgtcaaaacctcttctacaattacccctgcaacatacataacatgcatgacctcctatttactaaaaaacaatcatgtaagtaaccaacgtacaaccaatcgaaaacaatataaatctaaaaaacaactgagctttcgatgcaaacgatccatcaatgaaagaaacaactaccgtaagcaaaacgcttgccgcaatacttgtaacgagccaaatactatgcatttgtgataaatttagcatgcctaataaagggacaaaaagtaaatttgcacaaatcactccaaatagtaataaaaacacacctttataactaaattttatattcattctatttccccctttctagttttaatgtgaaagaagtgatagacaaaaagtctatcactcaaaataacagcatgcagattaaggattaaccgactctccgtcaccattcttttcgatttcaagcatatttttgtcgtacattttaaagaatggtaaataaataagaaacgatattgctatatttataaaaactaatacaatcgcacgccaatctccacctgttgctaaatatgcaccaattggagcaggtaatgtccatggcggcataatatgcgttggtgttacaaatcccattgcggttgcagcatacgctatagtagctgttactaacggggtaatgacgaaaggaataattaaaattggatttaatacaatcggcaaaccgaatataaccggttcatttatattaaaaatccccggaacaatacacgttctcgataatgctttcgaatattttgatcgaccaaatacaatcatagctaacacaagccctaacgttgcgcccgaaccaccaatccaaataaaccattgataaaacggttctggtgcaataaacggaaaatgactcgctccacttgctacagcttcaccgttctttcctaaatacacatcccaaagtggccttgccacagtacctacaactgatactccgtgtatcccgaaagaccagaaaaacgtaattaaaaatacaggtataataacgccaaagtaactatcaccagcttttactaacggtgcggctagtttatctacaacgtaatgtaaatcaactttaaaaacgactgtaataagactcatcataataataacgaatgctgcaggtataagtgcttcaaatgaac

SEQ ID NO: 621 - DNA, 1405 bp, Bacillus thuringiensis
taatctttgtagccgaagctctgtctaaggagtcatttgtaccaaaagttccatctggataaccatttaatacctgtttatcaactaaatagttaacggatttatcagcccatgtaggaacatcaggaaatttatgagtatccgctaaaatattagaagaataggataatatagctcctgcaaggatacctgttgcaattaatttgtgcttcattaaaataaacacctctaccattgtatttatcaaattgaaattttctatttttatatttacatgtttgtaataataataaaattgtattatcacgcattcaattcgatgtaacgagtatagttacttatatacataagtgtcaatgaatgtcttttacaaaattgaataatatttacatataatcaagtttccgtgatcttataattgacttatgtatatggtagatttaatagtgaaattcccttttggtagtttaagtttcttgaatttaatgcagtgaatacttaacctatctactcttaatagtttagatttttgtcacaggcaattattaaataaattttttattttccttaagcttaattattaaatgctattactataattttcagtgcagaatcagtagaaaacacagatatactaaaaacatgttaatgtattcttaataataaaatatttttataaatatatgcatatattatagtttttaatataattggttcgtctgttatttcttttaatccgtttcattaggcaattcctctatacagagaattgcctatctttttaattgtagtcctcctactatctttacaggagtagcaccacgtcaccatcaacttaagaggttttaatacccccaaggagcaaaaatttgtttctttaaaactcattaatttttgttcaaaaaactccaaaggtgatttctttccatccatgcccacatccgttcccccatattgggataatttctaaactcaaatactccagcattgctaatctttttttgcataagtgattcgataatctaagtaatcaacagcaattacacgcttagcatttttcatccaagcaaatttttgtggcatcaatccaacaggtccacaattaagcacgataacagtatcccctgactttacatttgcatttatgacactccaataggggttctgtaaaacatcggataaaaaagagggactcatcctccagttcacaaaattacggtataacaaatagagtaaagtttccaaatggaacttttaaatactcagcttgcccacctgggtgattaccaaatttgctgaatcagatgccatatttcatgacccagcacataatagtttttgggatgactgacacaccacgtcattcaattttagagacattacgctgctaaataaagcgaaatag

SEQ ID NO: 622 - DNA, 1625 bp, Bacillus thuringiensis
gtcgccttacaaaatggttctcttgtaattctagctgctttgcttgcggcaatagcttggaacttaattacttggtactacggtattccaagtagttcttcgcatgcaattatcggctcaatcgcaggtgcagcaattgcggccgctgggattagctcgctaaatcttaaaggatttattaaaattattgaagctttaatcatttcaccgattatcgctttcgttattggttataccgtatacagtatttttaaagtagtatttaaaaactttaacttaacaaaaacgaataagaacttccgtatattccagattttcactgcagcattacaagcctacacacacggtacgaatgatgcacaaaaagcaatgggaatcattacgatggctcttatggctaataactatcatacttctagcgatatcccgttctgggtacaattatcttgtgctatcgcaatggggcttggtacttctgtcggcggatggaaaattattaaaactgtcggtggacaaattatgaaaattcgtcctgtaaatggtgtagctgccgatttatcatcatcacttgttattttcggtgcaacattcattcacttaccggttagtacgacgcacgttatctcttcttctattttaggggttggtgcttctcaccgtgtgaaaggggtaaaatggggaactgcaaaacgcatgttaattacatgggttattacacttcctatttcagcttctttagctgctctgttttactacctattacattttgttttctaatcaaaagtcgtcttccttatttttctaggaagacgacttttttgtgaacaagcctatttctctttaaaaagcgtgtataataattggtggataagttatttagaggagttggcaattttggaatacatcatgttacttttcatcggactaatcgccggaacagtcggcagcctagttgggcttggaggcggaattattattgttccgttattaattggattacacagtttatcaccacaacttgcagtagggacttctatggtaacagtcgttttcacaggactatcttccacccttacttacatgaagcataagcgagtagattataaaagtggacttattttatttatcggaagcggccctggtggtattatcggatcatgggcaaataaatttttaaaccaagacacattttctttatactttgggattttccttatattcgtctcaattctacttatgcttcgagacaaattaaaacctctttccctctcaaatacgtctgtaattaagcgttcttttacagataatgatggaaatactgtacactaccaattcccaccggttcttgctatctttatcgcctttatagttgggtttatatctggattatttggaattggtggcggtgccttacttgttccagcaatgatgcttctttttgcattcccagcacatattgcagtagcaacttcaatggtcatcgtatttctattcagcaattgtaagttctgtaactcacatcttacttggaaatgtcagctgggtttatgcattaatcctgattccgggtgcatggattggcggaaaaatcggggcttacattattaccaaactaagtgggaacg

SEQ ID NO: 623 - DNA, 1676 bp, Bacillus thuringiensis
ttctcccttacaggtatgcggtaaaagttaaataaacatatattcctttttcataagtagacacggaaaagcctttatcaataaaaaatataaataaaagttataaacttctaagaataataccataatttaacatgaatagcacatattatttgaatatacaggtaatagttttggacagtaacgtaaaatatgaatcgtcacacttatttgttggttattacttatatgtattaaaaaatgattaagattggattttaaatagggataggaagtgagatatgaatagattgacagtaagtgactagtcgaaattagcagtgaaagctattatgtaacaaatgtaatgattcttgaaatagggatatacgtgtaatttaggggagaaaattacatatatcatgtggagagacaacgtaataatagaagataagaaaagtgaataagtgattgtaaacaatggattgttggacgactatgttttatgttattcgtttaaatctgatacttggcacactattgcttttaagaaggtaatagtaataaagaaatttttaaaatgatagaagtagtaaaggggataagagaaatgaaaaaaatatttagtgtgcttttagtgttattcttaacaatttctacatggtctagtgtattagtaaaggcagattcaccatctaaaggtgctttaacgattcataagtatgtacaagaactagatggagcgcagggactagaaggtgtcggttctgcaaatcaagaggtgccaaaagatgtgaaaccattaaaaggtgtaacgtttgaagtgaaaagggttgcttcttttgaaaaaatttcaaacgatgggaaaatcgtaaaagaagacgtgaaacctgtaatgggagccactccaaatcaagtagtaacagatgataacggacaagctgtattaaaagatcttccgctaggacgttatgaggtgaaagaagtggcaggacctccacatgttaatctaaatcccaatacgtatacagtggatatcccattaacgaataaagagggtaaggtgctaaactatgatgttcacatgtatcccaaaaatgagattaaacgtggtgcagtggatttaataaaaactggtgtaaatgaaaaagcattagcaggtgcagtattctctttatttaaaaaagatggtacagaagtgaaaaaagagttagtaacagatgctaatggtcatattcgcgtgcaaggattggagtatggtgaatactatttccaagaaacaaaagctccgaaaggctacgtaatagatccaactaaacgtgagttttttgttaagaactccggaacaattaatgaagatggaactattacttctggtacagtagttaaaatagaagtgaaaaacaatgaagaaccaacaattgataaaaaaattaacggaaaattggaagcgttaccgataaatccgttaactaattataattatgatattaaaacattaattccagaagacattaaggaatacaaaaaatatgtggtaacagatactttggataatcgtttagtgattcaaggaaagccaatcgtgaaaattgatggagcagaagtaaatgcaaacgttgttgaggtagctatagaaggtcaaaaagtaacagctacagtaaaagatttcacaaaattagatggtaaaaaagatt

SEQ ID NO: 624 - DNA, 1481 bp, Bacillus thuringiensis
taatcctgtgccttcttctccgtttatatgtgagattgtatcgtagtgttgtttaatttcaatttgagcaatgtcttgcaatttcacttggggtgccacagtgatgtttttaatgtcatttacattttttatgtccccaatgacgcggaggttgtattcttcctgattaacagtaattgccccagctggagtagaagtttcttttccttgtaaaacagttagtacctgctgtgatgttacgtttttgttttttaattggttcggatcaagtacgatagataattcagaggtggattttccgaaaaacataacgttggcaacaccatcaatgttttcgagttgtggtacgatttctttttcaatttgtttttcatctgcttttgaaaaaccgttttgtttctggatagtaatttgagcgagtggaatcatagaagtgtttaattgactaactacgggcttggttacatctttaggtaatttaattgtattgacggctttttcgacttcgcgtgctgcatctttcatgtttgcttttgatgtatacgcaatgtcgatacgtgataatccctcgtatgtagaagaagtaatggtgtcgacgtgttctaaattgcgaaattgtttttcgagaggatcagttacatcctttgtcatcgtttcagcgtcgagtccttgagataaggttgtgacggtaattgccggattgtcgatacttggtaaaaattccataggtaatttagagccggaataaacaccgagtatggaaatgagaaagatcatgatgataatggcagctcggttttttaatgaaaactttgttaacctatccataaaataattcctcattggtttatttatagttgagtgcgtcctttcttactatataacaaaaaatggatatttttcattaattaaatgtaaaaaaattctaacaatatccttaagttaatattaggattggaatgttgttaatttgtaggggggaattttcgaatgagaaggaaggggataatgcgcgcgagtggctgtttaatgtagatgggattttttcttacggcataatttgtatagttattttatagaaggataattattataaaccttaatatagaagagaatgaaaatttgggaaggtattgtgaaattcaatttggttgaatgaagtgtagtactatacaatcagaataactatttttagtagagaggataatagttatttctatagaagaaagtagggtagataatttttttatatttttataaaaaaacacttgttatttaaaaagtgtgatggtatattaataaacgtcgctgatgctgaaacgcataaaacgacaaaaaagaaattttaaaacttagttgacatcgaaaaatgaagatgttaatatgttgaagtcgcttttgaagcggccgacaaactctttgaacactgaacgaaacaaacaacgtgaaacgtcaatttttattctaaatgctagacaaac

SEQ ID NO: 625 - DNA, 1356 bp, Bacillus thuringiensis
ttagttatttgaaccctgtgcagtagtagtgttcaagtagatgcatcattttcaaaactgggggactgttttcccaatatggtagatctattgaaagagatggtgccacctgattggagttattttcaagttattacaacagcgatgttagatacaatacgtatggccattattgggacgaccttaggagcgattttagctattccacttgcactgtttgcagcaagtaatgtgtttactaacacatttttatacagtctagctcgaatgattttaaatttgatacgaacgataccagatttattattagcggcaattttcgtagcgatttttggaattgggccacttccaggtattttggctcttacttttttttcaattggacttgtagcgaaattgttgtatgagtcaattgaatcaattgatccaggtccgttagaggcgatgacagcggtaggagctaataaggtgcaatggattgtttatggggtaattccgcaagtgaaagcacattttgtctcctatgttctttatacatttgaggtgaacgtacgtgcagcagctgttttaggtttagtaggagcaggtggtattggactatattatgatcgtacacttggatttttacaatataaacaaactgcttctataattatttatacccttattgttgttttgttaattgactacattagtacattgttacgggagaaactataatgaatagaacgacgatgattgtgccaaaaccgaagaaaccgagtatatatcgctggattattttaatagcacttacagttgtatatgtatgggccttttcaggagtaccattagaagggataaaggacacagcaggggaaatcacgaaagcaattatgacagggatattaaatccagactggtcgtatgtatctttgccagatggtgaagatttattacatggattaattgatacgttggcaattgcgatattaggtacatttatttctgcatttttatctgttccgtttgccttttgggcggcaacgaatatgagtattggaaaattaacttcaggatctgggaaatttgtgcttagttttgttcgtacgtttcctgaattagttatggctcttttatttataaaagctgttggtccaggctcttttgcaggagtattagccttaggattacattctattggaatgttaggaaaactatattcagaaggaattgaaaacatagataaaggaccgacggaagcgttactagcaacaggagcaaaccgttttcaaatactttggtatgcggtgttaccacaagtgttaccagattttctatcgtatacgttatacagatttgaaattaatgtacgat

SEQ ID NO: 626 - DNA, 1942 bp, Bacillus thuringiensis
agctactacaccaagacccgcaaacagttattgtctttttgcaaaaaagaatgagtcccccattttataagaggcccaaactgcactcgcactataaaccataatcattccgattgtcaacaatgaaagtgttacgatgatgagaataaaatcaggcgttttcttcattacccacaaacaccacctctttaggcagaaacttttgccctatgtaacaaaacatcagtaggtgttagcctactgatgttttgatttactttatataagtttatgcacagcttgtataaaaatgtctcctctttcttcaaatgttttaaattgatcccagcttgcacacgctggagaaagaagaacgacatcgccatctttagaatgagcataagctttcaccactgcttcatctaaagtatcgacactttcaattatatctaatcccgctttttctgccgctcttactagtttaggagctgaatgaccaaatgttacaatcgcttttacatttttgaaatacggaattaaatcatcgaattcatttccgcgatcaagcccacctgctagtaacacaatcggttgtgtaaacgcagatagtgctttctcaggcgctaacatattcgatgcttttgaatcattataaaacttacggacgttaatcgttgttacatattctaaacgatgttttacacccgtaaaacgttttaacacgaccgtaattgcttcattagaagcacctaataatttcgcaatactcattgcaggtaaaatattttctaaattatgttgaccaggtaaaacgatatcgcttacttcaacaactttttcacctttgaaataaagagcgtgatgttttatacacgcgccatcttcaatttctgtcgttgtcgaaaacaggattttttgacctttagaatacgcagacaaagccatcacatctgcatcatctgcatttattacactataatcattttctgtttggcttttaaaaatatttgctttcgctaaaccatattctttcttcgtcccatgataatctaagtgggcctcaaataaatttaaaaacgcagcaattttaggttggaacaattctactcccatcaattgaaatgatgaaagttctgtaactacaacttcattttcttttgcatcctgtgctacttcacacgctacagtgccaatgttccctgcaattacaggatgcttttgtccttcttttagcatttcaaatgtcagcattgtcgtcgtcgttttaccgttagaccccgtaatcccaacaaatggtgcttctgaaatacgatatgctaattcaacttccgtaacaatcggaatttgcttttctttcgcagcaactaatattggattagaatacgggattcctggattttttactacaagagaaatatttctctctaataattctaaaggatgaccaccgcatacaacgtccattccttttgcttgtaattctgcagcaagtacattctctgctaaaggctttccgtcatttacaataacatttgcccctaacttttgtaacaatgtagctgctgcataaccactttttgcaatgcctaatacaagaatattcttattttgaaattcagttacagttttcaattacatccacaccccgatataaattcctaacacagctaataaaaatcctgcagaccaaaacgtcacaacaacacgccactctgaccaaccacataattcataatgatggtgtaatggactcattttaaagacacgttttcctgttgttttaaatgaaatgacctgaatgataaccgataaagtttccattacgaatactccgccgataattacaagtagcaattcttgttttaataaaatcgctacagctgcaatggctccacctaaagctaatgaacctgtatctcccataaacacttttgctggattcgcattgaatactaaaaatcca

SEQ ID NO: 627 - DNA, 1801 bp, Bacillus thuringiensis
cgtgatcgccattacaagcagcaatttttaccatattttttttaacctatcacatttatccttgttacgcttcattttaaagtatttgtgttagttaaatttacaaacgctagtttagcaatggcattgttacattctctattcatttcttgcttgattgccgtactatgctatttagttatgctgggaacaagaagtaaagtgaatgccaaagaagccgaatcaacttctaaacaaacaaaataatttaaaactaaaatcccttgccaattcggcaagggattttttgcaataagaaaagagctgtatttacacagctcttttcttattttagtgatctaattcaataagtaaatcacccgtttgaatcgcatcaccatcgttaacatatactttcttcactttaccattgaacggcgcttgaactgtcgtttccattttcatcgcttctgtaattgccatagaatcgccttttttcacttcgtcgccttcttttacaactactttaattaccgttcctggcatcgttgcactaatatgatttggattctcacggtttcctttcacacgttgtgcaactgttgcttttacactctcgtctttcacgataatttcacgtggttgaccgttaaattccaagtaaagaacacggtttccatccgactgaggttctccaattgatactagtttaaccatcaatgttttaccctgttcaatttctacatcaatttcttcacctagtctcataccatagaagaacgtcggtgtatcaagtacagatacatttccataaagctcagcaactttttcataatccataaatacttttggatataaagcatatgctactacatcaaaaatcgttacttcgcgtccaagtttatggaataattcttcttttaacgcttcgaaatctactggctctagtaattcacctggtcttactgttaatggctctttcccttttaaaataatcttttgtaattctttcgggaaaccaccgtacggttgacctaaatcaccagagaacatttcaacaacagaccctgggaagtccatcgcatgtccacgctctaaaacatcttgttctgttagatggttttgaaccataaataatgccatatcaccaacaacttttgatgatggtgttacttttacaatatctccaaacatgtcattcacacggcggtacattactttcacttcatcgaagcgatctcctaaaccaaccgccttcgcttgttgctgaagattactatactgcccacccggcatttcatgcatatatacctctgtatgaggcgcattcataccactttcaaacggtgcatagtatttgcgtacatcttcccaatagtgagatagtttttctaaagaatctatattaacatctggttgtctttcgtttccgcctaacgcatagtatagcgtgttcgcacttggttgtgacgtttgaccagccatagaactcactgctacatcgacgatatcaacacctgcttcaattgccttcgtatacgttaatataccatttccactcgtatcgtgcgtgtgcagatgaattggaatcgacactgtctcttttaatgcagaaactaaatcatatgctgcatttggttttagtaagcccgccatatctttaatacctaaaatgtgagctcctgatgcttctaactcttttgctaaatttttataataatttaaatcatatttactacgcagtggatcatgaatatcccctgtgtagcacattgttgcttctgcaattttaccagtgtctcgtacagaaacatttgccacg

SEQ ID NO: 628 - DNA, 1583 bp, Bacillus thuringiensis
acattagacttcactttcaatgcttctgcatcacaaggtaaagaagtagtagtatttgaagaactgtatcaagataatatattagtagctattcacgctgaaattgaagataagggacaaacagtgaaatttaaagaggcaaaatcggatcagccaaatccagaacacccaaattcaggtaaaaatacgccaacaccagagcaacctatcgagcaagtaaaagaacaaccacaacttaagaaagaaattcaatctaaaattggatggttaccgcaaacaggtactaatcttacaagttggatctctatggctgcaggagcattactgttaattgttggtggagtgattttcttaaaacgtaaaaatgcatagaaattaaaaaataagcacatctgtttttataacaagatgtgcttatttttatcattttagccaagaagactcctatatttaagcgtgaatggcatttaaaatagcaaccatattttataggtaattttgaacagttaaaagaaatattacaggagggtgaaaagcaaggagtttttcatttcttctccataaatcatacaatacattggatcacttctattgttttatttccaaagtttaaaaagtttattgattttttaggaccaaatgaaacgaatgatacaaatcatgaatggatgccagaaaacttagtggacaggattgttactgcattaacagataaacctaatgtgtaaattattcagtgtttatgaattctattattactatttaaagcctaatttctcaatgtattgtagagaaattaggctttttttatcaattcattaaagtttttataattcaaggactcaagttaatgattatattttcaagtattcgttttgagctacatagatatagttttcgttgcaactgtttgttgaaatattttatcatgctcaacaataaccattgtgggattaaattgttgaataagttcttcaatctgcatgcgggaatagatatctataaaatttagtggttcgtcccatatatatatatgagctttttcacataaacttttagcgataagcagttttttcttttgtccaccagaataatgagatatatctttttcaaattgaattcggtcaaagtccatcttacttaggatggacttaaataaggtttcatcaatcttgtgctcttcaataaagcctgatagtgatcccttcaaatgagaagtatcttgttggacataggaaatgatgagtcctgtacctaaagtaactaagcctgtatgctgtatcggatgtcctagaattagttttaggatactactttttccgctaccattcgatccatcaagtacaattcggtcaccttgttcaactatgaagctaatcggctcattcacaatttgatcattgtacttaacggacacgtcaactaaaggaaccaattcatttgattcaaattgcaattgttccaaatttaatgactcagtgttctccgcattcactagttatagtgatttttcctcaatagctttttggtgcctcgattcacggcttaatgctcttatcatcatcttggctgctgtatgtcct

SEQ ID NO: 629 - DNA, 1657 bp, Bacillus thuringiensis
agttgttcctcttattctatcttttatttactttggtcgtattgctggttggattacgttaattagcataattgtaatgcgtatcttttacacaggagggtactgggaacctcctgtgattgcttatttaggtatggggattctattttctacctttaaaacttattttaaaaaactacatccttttaaaagtgcatcgttatatttttctgtttttattggaataaagtggttagttggcgtattatttaatactacattactttacacaggaggcttattatatatagcgttaggacttttaattgggctatttcttatggaagcctaccagagattgtattatttaacacaggacttatctaaaatgaatcgagaattaaaaaaatcgaagcaagaacttgcagataccgtacatgagcttcaaggaggaatttttaaatttaaaaaagtgggtaagcactttatacacactttatgtgatggacagttttattatcaaaacggattttattctgaacaggtggtaggaaaaagcttacgtactattgatgcttctattgttcctccacatttagttccacaattgatgaagtactatcttcaggcatgggaaggaaaagaaattatatttgaattaccttggccaaatgataaaactattattcttattgcgcttaggccgattaaacgaaatggacaagttattgaagttgttggttctacagttgatataaccgaaaggaaaaaggtagaatcagaattaagcgctactaaagaattattggaatcatttataaagcacaatctagatgctattaccatttctgatcgagaagggcatattttacaagcgaataaagcttatgaaaagatatttgggtggtcatcacaagaaatcataggtaaaagattaccttgtgtaccagattttttaatggaagaatcgcttaaaaatattcagaaaattctaacaggagaatctgtggttactagattagaaaccgttagacaaaggagtgatgggagtcttcttgatgttagtctgacagtttctcctatactagatgtaagaggaaatgtgatagctttatcagcaatatgtagagacatctctgaaagaaaacaagcagaaagagaacgacatcgattacaccagcaattaagagatagtgaaatgaagtaccgtgcactaatcgaacaagcaactgatgcggtatatgtagtagagctgaatgaagaaaatgctccaagtcgatttattgaggtaaaccctgttgggtgtagaaggtttggatatagtagagaagagttgctctcattatcattttcaaatatagtaccacaagattctcaaatgatcgtaaggttattagaaaaaattaaaaagggacaaacttccttcactttgcaagatgaatatctttttccaacaggaaaagtaataacaactgagtttagtgttcgtgtttttaacttaaatgggaaaaaagttttcctaagtatttctcgtgatatcactgaacggctaaaaacagaagaattattacgaaaatctgaaaaacttgctgttgtaggacaattagcgactgtaatggctcatgagattaataatccattaactgcaatgaaagggttcatgcaattactaaaatca

SEQ ID NO: 630 - DNA, 1361 bp, Bacillus thuringiensis
cacgagatggggagtgcttaaagtctcttgcaataacatacggggctcattctcatataacaccacagtaattttactaacattactgcgcttactggattactgatagtaccattaaaaagcgacattaaaatttttttgcaaaacctagaagtaacagtttgtccaaaacaaaaacaaccataagtttgccggtccggaaaacttatgattcatatcacacttattcttaaaattattcattcaaatcttctacttatattattttttcaagctctattacttttaaacaaattagaattccattttcatgtagaaacatataattttctttctgcttttttgtagaattgaaagtctaataatccttgaatctacggatattttttctaatatttatgattttctacgctctaacattaaatcttcccttttgagggtaagtctatttcctatttttgataacctataaaagttttatctttatttctttttaatatatacgatatatatttataatagattttatcgattctggaacgtgattgattttgtcctaatcaagttaaacttttttactgaaacaagatataaatcgtcagttttaactatatagttgagaaggaatggcataaaaaaggaggaaaataataatgaaatatcaaacaatattttcatcgttaaaaaaatcctgttttatcttaatactctctttcattatattaattcttgcacttccagcaccaacttttgcacaatccaataacaatgttacatctggaacagattactatgtatctccggcaggaagtgacctcaacactggcacattagatcaacctttcgctaccattcaaaaagctgctgacgtcgccacagaaggaagcacaatctacataagaagcggagtttataaccaaaaagtacatgtaactcattcaggaatctcagaagcaccgattacttttcaaaattaccagaatgaaaaggtaattctagatggctctaaagtcaagttagaggatgatggattatttaccatagaagataaaaattatattcaggtaaacgggttagaatttcgcaatttaaaatcaacgaaagttagcgaaacccctattggtatttatattaccggaacagggagtaatatcgagattagaaataattatatccatcacattgaaacgaatgtaaagaatggaaacgcacacggtattgctgtctatggtacttcatctagtgcacaaaataatttaaatcatattgtcatcgataataacgaagtagcaaatttgaaattaggactaagtgaagcaattgctgtgaatgggaatgttgattcaaatgaaagttaccaa

SEQ ID NO: 631 - DNA, 1824 bp, Bacillus thuringiensis
aatactttatcagcttgtttcgcggcttgtaaatcagtaatagaatctccaattacaatatgaaagtcatttgtatcacttaatttacggattaatgatgatttacataatccgcaatgattttgacaatgatcatcacaagaatgaggccatttaactgtaataaactctgctgaaaagtctgtttcattacaataaatttgctcttttggaatgattccttgtaagagtggatagacgaagaaatccattccacctgatatcacgtaaaaagaaatgttattttcctttacgaattgtataaactcatgaaaaccactacggatttcagcagtttctattaaaaattgaataatatcatcgtgcagattagtaggtattaattgaaataatcgagaaacaccttcttgaatggatagttcttgtgataaaattttattctttacttcttcggcttctggtggtgcgaatttttccataatggacataatgttatcattatttgtaatcgtgccatcgaaatcacaaaatacttgaatactcataatttcacctcataagagggatttccccatatttgtagtgcactatgcaaatttatgtcgtctacttcatggagtggtttattttgcaaagtagcatcaattgcagtacggaaagctttaccgccgccttgcgctccatttggatgttcgtgtatcccgccgccagcattaataacaacatctttaccgatatctcgtacaataaagggaacgaaaccaggatgaataccagcagacggaacagaaaagctcttcttgaaaaatgcatcgtcttcagttaaatattttgagatagcaagagcctcctctttttctagcgcaacacttccgtatggagatgggaataatgaaaagtcagccccagcataacgtagtagctttccaagtaataatggtgatgaaactccatataacttggatgctgaataagcaccacttacagcaggatgtgccataataggaactgggatttcatcatcttctgcaagtgattgtagtacatctagtccgtaagcaaatacgttaaataatagaatatcagctccagcttgcactgcacgtttagcattttcttttaaatcaaaagttcgtcctgttaaatttaaggcatataacgttttatgaccgtatgtttcgtagacagattgtaaaacttcttttccagatacaatgcgtttcgtaagtggtgttaatgcattttcaaataatatttcatcatcttttactatatctacaccaccaattgcttgatcgcgtaattgtgtttttaaatacccaatgtttcgtccaatcattcctttaaaaatactcattaaaaggggacgatcatgcacttgtaaaagatttcgaataccatctatcccgaattttggaccaggaaaatgtttttttaactcgtctgaaaaagttaagtcaattagttttacttcgccatcaagtgatagctttccaaatgtagtcgttaaaatcgctggtaaatctggactgaagtttaatagcggatattcgattttaataattccgcgttttacttttttacgtaaatacgaattggtatattcatgttcagctaattcctcaacatgaatgacgttgcctttatgctgctttaattgttcttgcaataagtgtggcaaatgagtccaagagccaattgttaaaccgagtgcaatttgctcagcttttttttctaagttatgtgaatcatcatggattaaatacgtcgctataattccgctcattgttataacctcctagttaaataaaaaagcctctcagc

SEQ ID NO: 632 - DNA, 1901 bp, Bacillus thuringiensis
gttagcggatttatttttattatttttatgggcaaccgacacacagggtacatttaatcggaattacaggttcaaatggaaagacaacaacatcgcatattatggatgagattatgcgagcacatgggcataaaacagggctaattggaacgattaatatgaaaatcggtgatgaaacatttgaggtgaaaaatacaacaccagatgcactaacacttcaacagacgttttcaaaaatggttgaacaaggtgtggacagcacggtaatggaagtttcgtcacatgcgttagatcttggtcgtgtacacggatgtgattactatgtatcggggtttacgaatttaacacaagatcatttatactatcataaaacgatggaagaatataaacatgcaaaagggttactataagcacagcttggcaatagttataatcataatcgtgaaaagtacgctgtgctgaatagcgatgataatgtaacagaagagtatatgagaagtactgcagcaacagttgtaacatatggtattgatacaacaagtgacattatggcaaaaaatatcgttatgacgagtggcgggactacatttacgcttgtcacaccatatgaaagtgtaaatgttacgatgaaattaataggtaaatttaatgtatataacgtacttgcagcaacagcagcaggacttgtttcgggtgtgaaattagaaacaatcattgctgttataaaagaactagctggggttccagggcgttttgaagttgttgatggaggacaaaattatacagttattgttgattacgcacatacgccggatagtttagaaaatgtattaaaaactgcaaaacaatttgcaaaaggtgatgtgtattgtatcgttggttgtggcggcgatagggaccgaacgaagagaccgataatggcaagtgttgcaacaaaatatgcaactcatgcaatttacacatcagataatccaagaagtgaagatccagcggctattttagatgatatggtacatggtgcaagtgggaaaaattatgaagtgattattgatagaaaagaagcgatacaccatgcaatcactaaagcgaaagcagatgatatcattattattgctggtaagggtcatgaaacgtatcaaattattggtaaagaagttcatcattttgatgatcgtgaagttgctaaagaagcaattaaagggcgtttaagcaacgaagagtaacaacgtgagaggaggactacatgtgcttgagcaaggtttattagtaacggctggggtagcattcttaatttctgttgccctttcgccattgtttattccatttttaagaaaattaaagttcggacagagtattcgtgatgagggaccaaagtcacatcaaaaaaaatcagggacaccgacaatgggtggtatcgtcatatacgtatctatgatggtaacttcacttattatggcgattaagtttaattatttaggtgcagaggtttcgttattactattagtgacgtttggttacggcttgattggatttttagatgactacataaaggtggttaagaagagaaatcttggtttaacatcaaagcaaaaattagtaggtcagcttgttattgctattgcattctttttaattggaaaagggcaagcgttccacacatacatcatgattccgggaacggatgttaagtttgaattaggttgggcgtatttcgtacttgtactatttatgcttattggtggatcaaatgcagttaacttaactgacggtttagatggtttattatcaggaacagctgctattgcatttggagcatttagtattattgctaaagcacccgagcaatttggagtggcgatattctgtaaggcagttgtaggaactgtacatggatatttagt

SEQ ID NO: 633 - DNA, 1245 bp, Bacillus thuringiensis
ttcactacaaccggtggcaatcgccattaatgtaacgaccatggctagtaaacctaatttctttttcaaagcctactcctccttgtatcggtatgtatatagtgtaattcatttccttacgctacttttttattcttttcataccagagcgtttaaagacatgaattaagcttttctttacttcttcatatgtcatctctgcacaaggcttccttgctattataacaaaatctttcccagaatctatctcatcttttaactctgtaatagcctgacggaccatgcgcttaattcgattacgaactactgcatttccaattttcttgctaacagaaaggccgatgcgaaagtttggctgttcttctttatctaattggtatacaacaaactgacgattcgcatttgattttcctttttgaaaaaccgcctggaattcatcattcttctttatacgatgttttttcttcatatcaattgacactcctgtatttcatcagcggaaattcactattattagaaaaaaagaccactgaacgatcagtggtctacgcagataatacttttcttcctttacgacgacgagctgctagcactttacgtccgttcgctgtgctcatacggctgcggaaaccatgtactttgctgcgcttacgtttatttggttggtaagttcttttcattatatgacacctccctgaggaatatctgttaaagacagtcctataaattatagttaatcaactaggaaaatgtcaatggttctagaaattttcatcaaatattcattttgaacctattcacatacttttacacagcacctatatttccttgtggataaatgttttttcacgttttttatatccacaaacttttttcgcacttttacacagtatatcgtgttgtggacaagtttattccacacggtattgattttgtggataactttcttaaattcattgctatagccacttttttttgatattatagctgtgtttccactttgaataagtttttcacacctttattttatccacagatttgtgtataacatgtggacagttttaatcacaatgtgggtaaatagttgcccacatttgctttttttgtcgaaaaccctatctcatatacaaacgacgtttttaggttttaaatacgtttcgtataaatatacatttatatttattgggttgacatttggtgggcaccttattctttaccatttagtaaaggagggacactttgaaa

SEQ ID NO: 634 - DNA, 1523 bp, Bacillus thuringiensis
cttgatttattttttatatccttcatttctattttattttatatacatatattgtatattattaaaataaaaaaacctactacatgaatattcaagagtaagttttctatctcattatttcattatagacaaatgcattattatttgttggcctattggtcccattcttctaaaacctttatcttggaagccgacttttgcatataaattttgtgcaggaatatttctttcattcacagcaagtacaacttcattttttattggaaaataacgttgtacaaactcttctaataataacaatgactttttagcgaatccttttctttgtctattgtgattaatagaaaatgatgttaaaagtaaagcatcctcattatctgtgaactcctttactctatctcccgtttccaatgcgaaaagacccaccggtaccccattgtaatctaaaataacaatcacattttttgtacgatcactttttgctttctccagtaatgcgcttggatctgatgtaaactgaacttgttcacttggtaaagtaaatgtttgtataacttctttatatttctccttatacggaactaattgaatttcccctgtgtgtatgttcatgctaaactctcccattttttagcttattaacttataccttgctgtgcttttgaatgcactcttccatctaaaaaggtaatttcaacaaatgaatttggattgtttcctttccaagcaaaaatttgtttaatttgtgtagaatgttctaccccttcttctataagtaaatctccttcaaaaccaattaaatctttcacttctgtataagtcatcccttcatttatactcgaaaaatgatttatattgatagactctttctgttgcctttccatcacagtagaagaagttgctgtttgatttttcacttcttttctctgttcacacgctgtcatactgaaacctaagcataaaccaaacaatatacatgcgctttttttcatcataacagttgtccctcccatcataattaaaccatatttttccttaaaaataaactgaatatttaatattatatttaaaaacctcgtacaattaagtacgaggctaatttcatttattcaaatgattatttgattgatcattctgttcttttcttaactcttgttcttcatcttttggtaattgtttatcattatccttaattggattcgtttctctattttctatcatatcatttggaacttgtggcattactcggcccacaatagcggctaattcatctagtataccttcacctgtttttccttttttaatttgctttccaatttgtttgagccgttcatacgtatcaacatctgctacaacaactgcattagcaccgtcagggtcattttttaaactttctgcaacagagtatttaattgattcaactcgagttcgatcaagttttgcttttacatcaatacctacaatagcatcttttccaacaacgaccgcggttgcatcattcacgcctggcacacttgccgata

SEQ ID NO: 635 - DNA, 1521 bp, Bacillus thuringiensis
ccgttatattctaatttctctcctgctttatcctttgcacacccagcacctactaggcatatcaatataaaaaataagaaatacgataaacgcttcatttagcaccctctccttctttttagtcaagtgacaaaaacgtaaggttaattcaagaaaatgtaagtaaaatcgatagcccaattcacgtttctatattataatcaattgaatttacttacattactaaacataggagatcaacatgaagaaatttaaactttcatcttttcttccgttaagttatatacttctactcgtgctcgtaagtcccctttacgacgtattaaataaatcgactgttcacgcagtagacgttacaactgtagtagatgattggattccatttgtaaaagcatttattattccttatttactttggtttccatacttatacggcgcacttatttattactgctttgctgaccgaaagcaatattatgtcactttaagtagtgttatttttggaaagcttgcttgtttttctatttattatttttggcaaacaactgtaccgcgtccgactgtcgttggaacagatgtattttctgaactagttcgctatatttatagtatcgatcaacctgtaaactgtttccctagcattcacgttcttactacattcgtaattatgttagctgcctttaagcgtagagaacagcatgcttttgaatattacatccttactttcttcggtacacttattattttatcaacgctatttacgaagcagcatgcctttgtagatgccgtttctggaatgacgcttgcaagcatactttacttcggcgttcagctcttattggccaaagaaccgataagagttccagtaaaacaaaatcatagaatgtagcatgacaaaaaagcagactgtggcttctcagtctgcttttatctattagtaaggagattttcaacttaagattgcggtacagtcatatcaccagagtgaatacgacctgcttttttaagagcaatgtaaagtatataagaaacagctactggaatgacgatataagtaattaccatcgccgggagaacttcccatccttggctggaaattaaattaattggtgcgataagagaacttaatccaagacctgcaatttcctttcctgcttccagttggaaaattaatgcggatactggaccgactatagcactggcaacgacagttgggacgagaatcattggatttttagtgatatttggtaactgtactttcggagtacaaagtgcttgagctaatatgccacctaaattattttctttcgctgagatgacagagaatccgataaactgagcgacgcatccggcaagagcagcaccacctgcaacaccgtctaagctaagtgcaattgctaacgcaactgatgaagctggagagataagtaatagtccccaaacgactgccatgacgatagaagcgatgaatgggctaccagctgagctatctttaataaacgctccaactgtatttaaaac

SEQ ID NO: 636 - DNA, 1548 bp, Bacillus thuringiensis
gtaatttattttatgaaggaggatacatagatgaaaagctcaaaaggctctattgaatcagagataagcaaagcaattactcactgggaaaaggactacctaggacgcgggtctatatccgttaagacagatatattacgggatatgattatcgtaaatttacaaggtgttttaacgccggctgaatatagtgtttgcgaaacaaaagacgggatgctaacgataaagaagaatcgttcggagctagttgaatctggaattgatgatctgaaagagattatactagaattaactggagagaaagtgaaaagctttcatacggatataagctcccgtacaggtgaacgagtaatgatttttaaattgcttcataatcttgaggagaaattttaaaaataccttaaggttagtggaaggattaagaaacctacaagttttacactttattaacaggctaataattaaaaacttgaagttatttaggtataataaatcttaattctgataactcttaaaaaacggataaagaaattgacaaactgcttaatatggtttatcttataattgttttaaaaaattgatagatgctcattttaacagtttgctataattaaggctttagcatttttttaatatgtaatattgactaaatgaaaaagtttcttaattaaaagatagcgtataacataaattgatatattgattgcataatctaggagatcagaaatatacatttctttttaataggagtaatacatacattattatcctctataaaatgggagctcttcaaaaaactttattgaagttagttgaagggaaaccgacaatctccataattcaatgatgatataaaatcattgaattatggaagttgtcggttttttttatgggaaaaaacgatgcactaaaaagagtgaatgaaaattgaaatttaaaaaactatcgtaattaaaaggaatttttataggttattttcgcttagaagggagtatttaacatgttaatttcgctgagttcatcaacactgttaactttattttttatggcgcttagtgcttcttggctaagtggattattgtttttacatgcaaggatacctttacgttttgttcatatccatattggtatcgctgctttaccttcattggtttctttgctcgcacttgttaataacaatggagatagagttgtggggccttggcatctagatactttagcttggttaatggctttctttgttcttacaattggtttaatcattcagcgtttttctgtacgttacttaatgggagatcgctcatatcgaaaatactttgtactttttacatttactacaggtgtatcttcggttgcatggttaagtgatgatcttcgtttcatgattatttgttggggagcaacgcttataggattggttctactcatagggctaaataaagggtggaaagtagttagtgaagcaactaaaatctctggctatttatttacaataagttggattgcattgctatcagctatcatttggctttttcaagtaactggaca

SEQ ID NO: 637 - DNA, 1274 bp, Bacillus thuringiensis
agcgattttgtctaaccttggttttcatagtgatttaactaccaatgattctatggtatttccagataacgtagaaaaaaatgaaggaaaagaaaattcaactttcgtatttccaggtgaagaaacaaaaaaaacaggggataaaaattcaactgtaacattcccagaagaagatttaaaacagcaagaaaaagaagagggattaattgtttttcctgattaataaaaaaatactaccttccatttggaggtagtattttttatttcttgtcattaacaagcaggcatgaaatttgtatttgtttatctttcataatgaacttaaccacaaagtcgaatgtttgactgttaattaactttttcgtctcaatcaattacatgaatcaatctagaaatgcttgctgcaatgctttcagtccatcgctgtatataccatgaaccagatttattgcctcttcatcactaactgcaacaggagtgaacgtaccagaccactctactaacgatgtgttactttcagtaccttctttaacttggattgtagataaataattagtgaccgggaacggtgcattcatgattgaatacgtgtagtagcgttccttatcattgaatacttctaagcgttctataattgtttcaccatctggattagctagatgacgtacacgaccgccttcagttaatttactgctaggtatataaggtaaccagtctggaagggagttgaaacctccgattaattgccatacttgttcagttgatccgaaaatttccatagatatagtagtatatgccatgttcattacgctccttttcatctcggtatttacgggtaaataatcagtagagaataaatcgccccactgattaaagtttcactttataggtccataacttatagtgagaacgaattttatcgtggattttttatttaatatataattataaatttaaaactatatacttttaataattaaattatataataaatatagaaacgaaaatttatgagcaaggaagttgaaaaatatgacattaacaatgggctttattggatttggaaagtcagctaaccgctatcacttaccttatgtaaacacgcgtaataatataaaaataaaaacgatttttgtacgtcaaataaatgaaaaattagcggctccatataaggaaaaaggtgtttacttcactactgatttggacgaattgttgaatgacaaggaaattcaagtggtgacggtctgtacgccagcacatactcattacgaatt

SEQ ID NO: 638 - DNA, 2664 bp, Bacillus thuringiensis
tatcatctgcaaagaataaatgatacgtttgaatatcatcttggtttcctgttttcttaactaaacgcattcctaaaacgtgagtgaaaaactcatagttcttttctgcactacttgtaatcgctgtaacgtggtgaattccttttaattggttcattttatattcctccaatgttttttaatttatattttctctcctattacttctcttcaataggtgctaaattcgcttcaatctctgcacgctgatcttctaagaacggtggtaaatcaagtttttctcctaaatgttccacatctccatcaactgtaaatcctggtccatctgtcgcaatttcaaaaaggattccgtttgattcacggaaatataagcttttaaagtagaaacggtcgatgattcttgaagaatggaagcctctttgtttcacctgttcttcccaataagcaagctctgcatcgtttttcacgcgaattgctaaatggtgaatgctaccgcggcccggtttttcagtaggaccatctaaatatttcacaacgatttctccaaaagcctctcctttaatggactggaaaattgcttcttgatcatttcggctaacctctgtataaccgaacatctctgtaagtgtactcgccattttatcaagtctacgaactgtcatttctacagaacccattccttgaatttgatgctttgtaggaacttctgatttctcccaagtttcccagtgctctactttttctccgtttgaaacgagtaatactaagcgaagaccttcagcatcctcaaattgcaaagcaggacgatttgcatatgttgttatttcactatgtttcacatcaaatttctcaaatcgttctttccagtaatgtaagctatcctctgaaggaacgagcaatccaattcgagtaattgcatttgtaccgcgatatgttcttcctactaaaggaatttcaaaaaatgataattccgtacctggacttcctgttttatctccataaaataagtggtacattgacggatcatcttgatttactgtcattttcacacgacgtaagccaagcacatttttataaaagtgattattttcatttgcatttttcgtaaccattgaaatgtgatgatgccctttaattttatacatttgtaattcctccacttcgttttactagtcaagtgatgataaaaaaataatatgttttttagctgttcaatttattctcattatgtttttgtaaattcatcttggtttttactgcataagttactttcgtttttaactcgaaaacaactgagtgtatgtttttcatatgactcaatcgctttcgttactatcactttacaactcaagtgattaaaaagcaagtaatttatctcaaattcgagatatttttttattaaataacattttggactaaaaacacgagaaattcttggtttgaggacattataaaattcataagttgatggatgtgagatatcgccagcatttttgaaaaaaacacgctaagagtatgcgagattttatacagttttttcgttaatccaataacagacaagaaccctaaaaccgcaccagaataggaatgtataaaaaattgcatagattgatagaacaaaaaaaggaggttcccttgtgagagtagggttcctcctttttccttgctaccgataataggacgttatgttaactgatcatgtataggatattcatataggaattgtttctatcaatgctgaattatacaaagaaggaggcatgataatgaaaaaagaacaattaatattaattgctagtcttactcttttatttcctgtccttgaatttttcttccagaaatatgattacttcaatttttacgcacatataggtattatagccattgctgtatcaactgtcgtattcacactccattatataaaacaaatttattggaaattatcgatcgtatgaggaaattatgaaagaatagaatttaattgaatatgttttctattacccgtttcaagcttttccccataccttttactgcccatactagtttaaggaacactttaaagatagcatcccatacgtgttcattaataaaaaattcgtatactttctttaaccactctttcggggatttactcttacgtttaaacctttgccaatgcgtttcttcactagttttcataactaccccttctttcttaatcgaatatgctttctattagaagttttaacacctcgctataatgatgaaaagaacgaggtttatcatatctggcaatttaatcactcctaattttaaattaaattcattatataacgatttctaaatttttagttaattactagtgagaattaagcaaaatttaaacaaaaacacctatgttaggctttagttagaggttttccccctataaaatcaactatttgcgccaccaactatggggtacgcgaattactttgatattatctttgaacgaacaaaataactcctttcgaaaaacaaatgaactgatattaatcaacttccaatatcgagaattatgtaaataagctgcccatatggacagcttattgtattttttgcttaacatattttttctgaaatgctggcggtactcaatttaaaagttgatatgcccccattctagtggcaagatatggtttatta

SEQ ID NO: 639 - DNA, 1720 bp, Bacillus thuringiensis
  unsure (1)...(1720): unsure at all n locations
gcattgcccatttcgtaagcacagtaacaatgaaatacttcgcaccatttgtaagaccaccaccaccgcccattacaattccatctaaacaagcaataatcggttttgtatattgataaatatatgtatcaatttcatactcttcttcaaaaaaacgttctgcatgttgcaatgccacttcattggaacgcgcttcataaagagttttaatgtcgccgcctgcacaaaaaccttttgtgccagctccttttaacacgataagtgcaatacgctcatcgtgttcccactctttaagtttttgtccgataggttgtaacatgtcataagataaagaattaagtgcttttggacggtttaaagtaattgtcgcaacgccgttttcactaacagaaaataaaacttgttcagtcataatgcatcctcccttacatatcttcttattcttaattcttgatatgtactgaaatgtcctttataaattttgtcaaaagttgacggtaaatattaatttggtcactgcatattttgacgagttatctttgcaggatttcagagactgagggggaatattacaacattactgtaagtgtaattatttgaagttataatgataaaagcgctattatataggtgtgaaatgttcattatcaattctaaaagtgtgtttgaagaaaaaataaatcgtacaattgtaataaaaaattttacactgaattagaaatagagaaaggagaaatcggaatgccaggacctttactattgtcggttattattttgtcttttttaatgataggaataacgcagtattttcatcatacagatacgacagaagaagtgaaggataaagtacgtctcgtatttccgatttttataatatctatttcattctgtattttattaaataaagatggctacattgtcgcagtgttctcatttttcgtcgcaatcgttttaattaccgttttatattatgtaatgaaagactttatacaaaaataaaggtgtcataataggcatttttattttggagaaaatataaaatttcacataccgtattttatataaaatacataaagtatataacaatagaaaagtgtgtactttcctgtgtatggtacttgtcaatcttgcatagccactatactattaaaatgtagagattataaaaaggggttgtatctatcatgaaatttgaagatgcacacaaaaattatttcaaatgaaaaagaagtaagattacatattgaagaaaatatatttcaattaatattggatggttatcactaatttacagttcaagaaatattgcctttatataaatcaaatgaagaaagaattggaagtgcaacgatattaaagctagagtgggagaacggaaaaactacaataaactatcaactcgtttcactaaaatcagtaaattaaaaggagtagaaaaatatgaagttatttcatacagcggattggcatttaggtaagcttgttcatggcgtgtatatgactgaagaccaaaagattgtattagatcagtttgtacaggctgttgaagaagaaaaaccagatgctgtaattattgcaggggatttatatgaccgagcaattccacctacagaagcagtagacttattaaatgatgtgctgcaaaaaatagttattgatttacaaacaccagttattacgatngctggtaatcatgatagtccggatcgtatccattttg

SEQ ID NO: 640 - DNA, 1833 bp, Bacillus thuringiensis
taacaataaaagtttatttttaaacattttcttttctcctcccttaatttgatctataataaccaacaacgtgttgtttatttatattttgaattatatgttcgagttgaaccttatacaataatcaaaaatcgtgaatgtgttggttataagacacattttctaaatgtgttgagtaaaattaaggagggatatgctttgcgcgataataatttagatttgcgtgttgttcgtacaaaaactgccatacgaaatgcattggtggagctaattgaagaaaaaggttttgacgccattacagtgaaagatattacaacgaaagcaaacattaatcgcggtactttctatgcgcactatcaagataaatttgatttaatgacaaaatgccaagaagacattatgtacgagttttctaacattgctaaacagaaattcccagaagttattgctgaccttggatcaaatccttctccaacatgccatttatacttatcacttctattcgtgcatttatgaatgagtatagtgattatataaaagctgtattaagtccgaatggagatttatctttccacacaaaactgatagactttatgtggaaaacattatttgaagatacgaatggtcctctcattaataaggagaatttacttgttccaagcgaatacttaacttcttatatggcatctgcgcatataggtgtcatccaacaatggttaaataatggacaaaaagaaacacctgaggagattgctcgctttttatcaacaatcgcagttcatggacctttttatgcggctggcttaaagaaataagtcagctatataataaaagaacatccactataatagcggatgttcttttatttcattacaacacttcaatatacccttctgttccatgtacccgaattcgttgtccgtcttttattaatttcgtagcattctctactccaacgactgccggtaatccatattcacgtgcaattactgctccgtgcgtcataagtccgccaacttcagtgactaacccttttatagacacaaacaatggtgtccagcccggatcagtaaaagctgtaactaatatatcgccctcttctaaattcgcttcttccatgtttaaaataacgcgagctctcccctcaatcactcctgaagaaacaggcaaacctacaatcgcatcatctgggaggttttctcgtttatatttacctgtaatgatttctccatcagacgtcattatacgaggaggcgttagtttttcatataatttgtaatcatttttttgtttttgtatcagttcgtaatctagtttattcgtgcagactacttcgtgaagttcttcaaaagttaaatagtatatatcatccacttcacgaatgacaccgctctgcacaagttgctcagcttctttcagtaacgcttgcttatatatgaaataacgattaatcataccgtattttggatattcacgatagccgataaaattacggatattacgaatcattcgcttcgtttcttctactttttgttttccatccgataagtgctgtcatcgatctactaactcttcttctttactcaaagcttcttgcagtccttcttcaaatttccgcttactcgcaccatattcaaaatctctcatattatgtactattatcgtgatattggaggggatgttcgctcctaccgtcatggaagcactgaatagaacggtcacataattccccgtaattcggcaacgcaaagaatcgaatctcttgcgtaattactgccctcgcacggtaatcacttagctaataagcatcgtttttcaataaggcggatgatg

SEQ ID NO: 641 - DNA, 1939 bp, Bacillus thuringiensis
agtcggaaaaattcctggcggtttcatttaacgtgaaggtcgtccaagtgaaaaagcaattttggcaagtcgtttaatcgaccgtccaatccgtccacttttcgcagatggtttccgtaacgaagtacaagttgtcagcatcgtaatgagtgttgatcaagattgttcttctgaaatggcagctatgcttggttcttcattagcgttatcgatttcagatattccatttgaaggtccaatcgcgggtgcaacagttggtcgtattaacggcgaattcgttatcaacccatcagtagaacagcaagaacaaagtgatattcaccttgttgtagctggtacgaaagatgcaattaacatggttgaagcaggagcagatcaagtgcctgaggaaacaatgttagaagtaattatgtttggtcatgacgaaattaaacgtctaattgcattccaagaagagattgtacaagctgtaggtaaagagaaatcagaagtgaaactttatgaagttgacgctgatcttaaccaagctgtacgtgaaatggctgaagcagatatgcattcagcaattcaagttcatgagaaacatgcacgtgaagatgcaattaacgaagtgaaaaagcgtgttattgagcattactaagcgcaggaagctgacgctgatacattaggacaagtaaatgagattttatataaaattgtaaaagaagaagtacgtcgtcttattacagttgaaaaaatccgcccagatggccgtaaaggtgacgaaatccgtccattagcatcagaggttggcattttatctcgtacacacggttctggtttgttcactcgtggacaaacacaagcattaagtatttgtacattaggtgcattaggcgatgtgcaaattttagatggtcttggtgtagaagaatcaaaacgctttatgcaccattacaatttcccatcatttagtgttggtgaaactagaccaatgcgtggaccaggtcgtcgtgaaatcggtcacggtgcactaggagaacgcgcacttgagcctgtaattccatctgaaaaagatttcccatacacagtacgtcttgtatctgaagttttagaatcaaatggttctacttcacaagcaagtatttgtggtagtactttagcaatgatggatgctggtgttccacttaaagctccagttgcaggtattgcaatgggtctagttaaaactggtgagcattacacaattttatctgatattcaaggtatggaagatcatttaggtgatatggactttaaagtagcaggtacagcacaaggtgtaactgcactacaaatggacattaaaatcgatggtctatctcgtgaaattttagaagaggcattacaacaagcgaaagttggtcgtgtgcacattctaaatcatatgttatctgttattccagagccacgcactgaattatcagcgtacgctccaaagattattacaatgacaattaatccagataaaatccgtgacgttatcggaccgagcggtaaacaaatcaataaaattattgaagaaactggcgttaaaattgacatcgagcaagatggcacagtattcatttcttcaataaaccaagaaatgaacgacaaagctaagaaaattatcgaagatatcgttcgcgaagtacaagtaggtgaaatctacgaaggaaaagtgaaacgtgttgagaaattcggtgctttcgttgaattattcagcggtaaagatggattagttcacatttctgaacttgcacttgagcgtgtaggtaaagtagaagacgttgtaaaaatcggtgacgtaattacggttaaagttatcgagattgacaagcaaggtcgtgttaatctatctagaaaagtattgctaaaagaagagcaagaaaaagaagctgctaaagaagaaaacaaacaagagcagcaataagcgaaa

SEQ ID NO: 642 - DNA, 1774 bp, Bacillus thuringiensis
agttttatgaaaaatttacccctaaaaaaattgatacgaaatttttagagagagtaagggtagaagaaacagcgtattgttggagagatttaaatttgttacaaaagcaaacagctatatagaattatacatataataatattatgtaaacatattatagggaaaggtatacctcatttggtgtacctttttattaatccatcaaaaaatggattaataaaaaatagtaggtaattagtttgaaagcaagaaattttctagtgtacttttaactagattaaagaaaagaaagaaaaaaataaaaatttaatttgataaaaaaattctgaaatatactcttgaattgaatatcattatcaattataatatgaaattccgatagcgttaatataaagaggaggaactaacagtaagtgaaaacataagtaaacgtggatatgcgtaatgaaaaatataagctcgatgactgcatggagagaaatgtttcaaccatcaccatcgcacacaaagatagggttttccgttttgattatgattggtttgatggatttcttcataagttgggagtcaaagttatcattgttactaatgaaaggttgtctccacaagaagagtttgcttagtatttgatatctgttattcacatatttagttgtaggatatacagattgaggaaatacaaaaagagaatgtcggaggatgaagatctatgaaaaaagcatatctaatagagattaagccgacaaatgaacaaataaccaagatccatcaaacgattggagtgtgcaggtatgtttacaatctatatctttcaaaaaacaaagagatatatgaatccgaggggaaatttcttagtggctatgaattttctaaatggctaaacaacattcatacaaaagaatgtgaccagtggataaaagaaatatcaagtaaagctgtaaaacaagcgattatgaacggagataaagcttttaagcgattttttaaaggtttatctaagtttccacgctacaagaaaaagaaaaatgaagatgtaaaatgttatttccctaaaaacaacaaaacagattggatagttgaaagacatagagtaaaaatccctacgattggatggatgagattaaaagagtatggatatatttcaaaagatgcggttgtaaaaagcggaacgatagctaaaagagcaggaaaatattttgtatctgtgctttgtgaattggaagaaacaaaagcgaagccaacactccattcaacgggtgtaggcattgatttaggcgtgaaagatttcgctgtacgtagcgatgggaaaattcacaaaaatataaacaaaacaggaaaagtaaaaaagatagaaaagcggttaaaacgtgaacaacgctctttatcacgtaaatttgaaaatctaaaaaagagaggtgaacactctgttactaataaaagagcgaatatagataaaaacattcttagggtgcaaaaactacatgccaagttagcaaacattcgattagcgtatgtaaagtctgttgtaaatggtgtggtgaaaaccaagccaacgtttattacagtagaagatttgaatgtgaaaggtatgatgaagaataaacatctatctaaagcagttgctaagcagtacttttatacatttaaaacatggttattgacgaagtgtgaggaatatggaattgaactgcgtcaagtagacaggttctattcatcttcaaagctatgttcatgttgtggtcaaaagaaagtagacttaaagctatccgccgag

SEQ ID NO: 643 - DNA, 1193 bp, Bacillus thuringiensis
caattttttttggatatggtttcttgtcagaaaggattcaattcgctaaacgttgtgaagaagaaggaattatctttatcggtccgaaaagtaagcatttagatatgtttggagataaagtgaaagcaagaacacaagcgcagctagcacaaattccagttatacctggtagtgatggtccagtaaattcattagaagaagtcgaaaaatttgctgaaaagtatgattacccgattattattaaagcatcccttgggggtggcggtcgtggtatgcgtattgtgcgtactagtgaggaattaggagaatcatataatcgagcgaaatcagaagcgaaagcagcttttggtaatgatgaagtttacgtcgaaaaattcgttgaaaaacctaaacatatagaagtacaaattttagcagatgaagaaggcaatgttgttcatttatacgagcgtgactgttctgtacaacgtcgtcatcaaaaagttgtagaaattgcaccgagtgtatcactttcagatgatctgcgtcagcgtatttgtgatgctgctgtgaagttaacgaaaaatgtaaactatttaaatgcaggaacagtagaattccttgtaaaagatgatgagttttactttattgaagtaaatccacgtgttcaagtagaacatacgattacagaaatgattacgggagtagatattgttcaatcacaaattttaatagcggatggacattcattacatagcaaaatggtaggtgttccgaagcaagaggaagtagttgtacatggatttgcaattcaatctcgtgtaacaactgaagatccgctaaataattttatgccggatacaggaaaaattatggcgtatcgatcaggtggtggttttggtgtgcgtcttgatacaggaaatagcttccaaggtgcagttattacaccgtactacgattctttacttgtaaaagttacaacttgggcacttacttttgagcaagctgctgcaaaaatggaacgtaacttaaaagaattccgtattcgtggtattaaaacaaatattccattcctagagaatgtagtaaagcataaaaacttcttatcaggagaatatgatacttcatttatcgatgcgtcacctgaattgttcttgttcccgaaacgtaaagaccgtggaacgaaaatgttaaattacattggtacagtaact

SEQ ID NO: 644 - DNA, 1273 bp, Bacillus thuringiensis
cggtatcatgaaatcggaatttctgtatcgaaaagaatttgtatgtataacacatttcaaacaagaattagcaaagtatatagaatactataatcataaaagaattaaggcaaaattaaagggtatgagcccagtacaataccgggctcataccctagaggctgcctaatgaaacgacctgtctaactttcgggggtcacttcaatttagggggcttttttattgttatcaataaaattgaggggccgtagttggttcaatggaatacgaattaccttgtgaatagtctgactattttttagaaaaaactattcatttacattttttggtttcgtgttatatttttaatgttaacatagttgtattgaaaattctgattttaaaattaggaaaactttagaaaatgaaatactcttacttgaattgaaaatcatataaacatagtttgaaagtaaagtatgaaaatgaatcagattttcaaattaaatttgtcaattcaatagaggttcgtgggggaaatgtagctaagaacaaatctcttatactccatgttttttatttgtaaatcggtaattctaatagctctgacgaaaagtaaaggagtaaaaaagaagtggatagtttgtttaatgaagatagggtgtaaaaaataaaacaacggaggttttataatgaataaaggaatactgcagattacagaaattgaagaaattactattccgaatctattgaaggataaaatgaagaatctgatagaaaatgaattaaaaactcataatccttatacttgtgatcaagaaatagcagcatatttttcaaaagagtggcttaattgtttgattgactattcaaagaaaaatccgaattcagatatgaaaaacctactacatatgataaaaatagcgaattgtggcgggaacgtaccgcctatccttattaaaaatactccatgtgatcctatagaaacactattacctggggaaaatcgcagaggttttaattatggtgaagacgaacacgatagaatgaaaaaatatttttatgcagaatgggtcacatggctttttgccacactttttaattatgatgctttaattcacccatccgaacatgctgggaaaaatagatttcatcttatttcgcctttaaataacgatgaagttttgcgaaatgtcggtgcaagcaccggtggcgggaacttttatcaacataacgatgccacagtgtatacagatatgaaagaccaatcagatattgaagcaagattgacaat

SEQ ID NO: 645 - DNA, 2421 bp, Bacillus thuringiensis
atggtatgacctaaataaaatggtaattccgggaactgctctggtgttaacacaacatttagctcttcattaaacgtaattgcataaccatcaaaattttcatgaatatgtggtttgacgtttttccctgtaaagtctgttgctgtatctaaatgggctaaaaatccaattacaggaacatccttgtccgtattagctggaagtgttgccattacataaccattatcatccatcgttacttctgttaaaccaatttcttttagctcttccactaataacttaccaaactcaatttgtcctggtgttgttggtactgtatggctttcttcatttgattgcgtatcaatttttacatatctcgtaaatctttcaataagttcttgtttcaagttcattcactcccttttatgtttctccctccattataatccttaaaacgaaatattttaacttttttgaatgtgaagatgtatatttcatttacattgttaacacttttacatactttacataacaaaaagaaaattagtgaacatatttaaagtgcagattaatacaaataaatccaccctatttacgactctcaccgtaaatagggtgtttctgtttttatctcgcaatttaagaatatatactactcatttacaataaaagtatatacatcatcataaatacagccatttactttaatcacatacttcccaggtttattaaaactaattgtgtatttatttaactgaattgcttctttatctccagaaagaatatcaatacttctgccacttaatacatacaattcatttagattcatcgttacatcaattgtattgaaattttccactctcacttgctgtgcttccgcaacgcttacacttggttctaaaaacagtagtccacttaatccaatcgtccccgctaaagcaactcccgcaaactttttaatctgtttcattacaatgacctccttatagattttgtgtaaaggcaatgtcccccttacaccacaaagcctatatgtaatgaaatgaaaagtaaacggggactgtaagacaaaattctacatctttttctcctattgaatataaatccaacgtttggagttttgacacatttaaaattgtttccctaaaccaatttctccataatttattcaaagactgaataattacttatttatttaacattctaaaaatagttgataaagatgctttctattcaaaaaaaagactttgctataaaagtaacttttacaacaaaatccatgcaactaattttattcctctttccataatctctctacattcattaattgttcttctttaaactccatcttatatatatccggttttgacgtattcattaaaaattcaaaaccatattgtttatcaaaatagttcatcattaatgtcatgacaagcccatgtgtaccaattacaattttccatccttgaaaatccattaagatttcttttaatactttcactactcttctctggcaatctgcatatgactctccttccgttcgtgcaaagtccggattagagaacatcttctgaacaagtggatacacctctttgtctgatataacctgatcctcacttgaaaacatacactctttaagattttcatatactactatttctttttcatggaaattagctgactcctctatcgttagcacagcccgattataaggacttgaaataaaagtatcaatcctctccgcttttaatatgtcagttactctacgggcatccatatgtcccctctcagttaacccgcgcattctttcatttccttctagttttggtgattcaccatgtctaaccatataaatatatgtgctcataatttctccttaaaattttttataaagtgaaactttaattagcccttactaatcgggcttttacaggaaaatagcgagataagttaataaatcacgttcatttatcccatttcaacacttaggcgtaatactacaatactttataaactgtgctgatttgttcgtctaatccattctcctactaaactctcaaataattcaggctgctcaatttgcaaattatgtcctgccatatctaacactgctaatgttgcccttggatattcttcaataatttctataatattttgataacctactgatatatcttggcttccagtcagtaaaagaacgggattcgcatattttttacgctgaaaatccatagtgagagagtaatacttttgcaacctttcaataaattcagcatgagcaacatctaacccaggcttaatttcttctttgaaaggcttatatgtatattcatttgctattacagctaactcacaaaatgcctctctttctgtggaagtgagcgtatttaaaaattcctcatcttgtacaattacctgaatatctgggagaatcctttt

SEQ ID NO: 646 - DNA, 963 bp, Bacillus thuringiensis
agttatttctgataactgacgcatagctctagccaaaagcccctggctagcatataaccatcctatattgtttctaagacgtaatatcagctctgtgttatcaccctttttaacaatatctatcgctttatttaagtgttcttcagcctgttcaaattgtcttatctgtatacatgttaatcctagtacgttttcacataatgctacgtttatctcatagccttcattattatggaaagctgtttttgctttgtttatatacgctatagagggaaggggcttatatgtttgatagtagaatgttgctaaacggtaattaaattctgcttgttctagttcgtcagggacatattttagaagtgattctgcttcttcaaattgttccccagcctctgcataattagacaaaaatgtattatgtattgctttataaaagtgatagtaatacgctaaataattgtctactggtttattgaagttctcaatttcatcaaattcacttggtgaaatattaataccttcagttagaaccttatacctaaaatctagtagagagtaatataataataagttttggtcttgtaattctgtgtctttttcatgctgtaaattattaattaaatgatcaattttttctttcaagtttgacgcctttacatactgttgtgttaacattgcttgataccagtcattaagtaatttcgtaacttgttcattccccttcactggagcattcataaaatcacttccttctttctgaatagtcttacattaaagggtaacaaaaaaatgtagaaaaaagaataaaaaagaatatttctacataattttcagaattttaaagatacatattagcaaaaaaagtcggttcctatcataaggaccgacttctctcttacttcacatgcacataggttgcatttgcttttacataatatgttttatctttcaaatttcacatat

SEQ ID NO: 647 - DNA, 1282 bp, Bacillus thuringiensis
gttgataaaaatattgatataggcatcacgttttttgctcaaattccagacacattaacaagtacccttttgtatagcgaagagcttgtccttgtcattcccaaaaaccatcctttgaatgaaacatcatttgtttcttttagagaattagtagggctcagtagaataatggtttcatgtagttgtcgtgaaactattaaaatatattgtgagagtttagggctatctttatctgaagtaaatatagaaacaaaatcttccatttctctattgagccttgtatgcaatggacatggggttgctataatacctctttcactagttgactttgttaataatgatactttgagcatagttcgtattattgatccaacaccaaggcaagatattaatcttattcactttgatgataaatttttaagttttgcagcacgtatctttatgcagaagttacatgatcctgaaaaagtattagtataatagaaataataatgattatagtgtgagaattaaaaatgatacataatccttggggtaagagctaaattacagtcaaagggcattgactttatatgtgtggtgtgatcgattcaaatgggaatatcattgacttttacttaaggaaaaaagggcagactttgcaaggggagaaggctgttaaaaataagtcaagttaattaattaactcttcggttttatcacatagtaatagattccattagggagatactgctatttctttttacatatccttattgcataaagaaaaccaccggcattataccggtggttttgatttagaaagcaaagcaagtacaaccaataccccatttagttccatcttttcctattacggtatgagtgtgttgatggagagggttactgcaactatgtaacttgttatcatgggcatcgtgagaaagtatagtgttggctaggttagcaccgccataaccataaacgcccgtcggtgaccagtcaggtgatgctggcggcaattcaggtgataaatttttaaattcatcatttccatacacaacctgtccgcccataattgtgagtaatgattcaaggttcttgatttcttcttctggcacagtaaagtagtcagcagacaatacagcaagatcagcaaactgacctactgcaagggttccttttttaccttcatcaccagagaaccacgcacttccttttgaatataattccagggctacttttctatccagtttatttttttcatcgtatatcgaaagtccaccaatggtttttccggcaacca

SEQ ID NO: 648 - DNA, 701 bp, Bacillus thuringiensis
tcgtgatttggaatgcttttgccgataaagcctttcgtagttttaatgctttccgtgcacttaaaaaggcgatatgtatgcatggtgatgcgatgcccaccataattaaagcaattgtccaaatgtaggaaacgatgaacatagaagcaagtacaccaaccgctctttcacgtccaacgagaattgctaacgttttacgaccgttttctttatcgccatctaagtcacgaatattattagctagtaaaatggcaccaattaaaatggagcttggaatagatagtaaaatgacttctgatgttacagttccagtttgaataaagaatgaaattccaataatgataacacccataaataatccggctgttaactctccaaatggtgtataggcaatgggaagtgggccacccgtgtaaaggtaagcaacggccatacaaacaagaccgattgcagcaagccaccagctagaattcatacaaatataaacacctaatagtattgcgatgccgaaaaatccaaatgctaagttaagcactgtttttggctgaatgccatcgcgaacgatagcgccgccgataccaactgaaccttcgtgatcgagtcctcttttataatcaaagtattcattaaacatgtttgttgctgcctgaatgagaagacaagcaagaagcattataaggaaaagagggagatggattttg

SEQ ID NO: 649 - DNA, 2329 bp, Bacillus thuringiensis
atttctaaataatctgtataactacctaggttttcacgcacttcgcctccgccagtaaagatgaacagttcatctactactttatctaagaagtaacggtcatgcgatacagttaaaacgacacctgggaaatcttctaaataatcttctagtactgttaatgtttgtgtatctagatcattcgtaggttcatcaagtaaaagtacgtttggttctcccattaaaatacgtaataaatataaacgtcttctttcaccaccagatagtttaccaagccggtgtaccatgtgaatgcgtcgggaataagaaacgttctaacatttgagatgcaccaattacttttccatctgtcgtatgaataacttctgcaatctctttaatgtattcaatcatacgctgatttaaattcatctcttcattttcttgcgtataataagcaacttttacagtttgcccaacttcaatttcaccaatatcaggagataacttacctgcaagcatatttaatagcgaagatttcccgcttccattcgctccaataattccgatgcgatcgcctggtttcacaatatgattaaagttgtttaataccgttttatcaccaaattttttcgttacatcttttaactcaagtacttttttcccaagacggctaccgctaagtgcaatatcaactgactgttttgcagctggtccttctagttcctttagctcatcaaaacgctgaatacgcgccttttgtttcgtagaacgggcttttgcaccacgacgaatccaagcaagttcacgacgatataaattttggcgtttcgattcttgtgccaattcttgctcttcacgaagtgctttcgcttctaaaaatgtactatagtttccttccgagctatataatttaccattatctaattcaaaaatacggttcgtcacacgatctaagaaataacgatcatgggttacaagtaataccgcacctgtatatcttgctaaatattcttctaaccattcaactgtctcatggtcaagatggttcgtaggctcgtctaaaattaataaatcaggtgtttcaataaaacattgtgccattgcgatacgttttttctgtccaccagataaattcccaacaattgcagtgaaatctgtaattcctaatttcgttaaaagagatttcgcacttgcatttgcttcccatgcactcattgcatccatacgttgctgcactgcaaataattgttcctgtactttttcattacttggatctttttcaatatttaatagtgctttttcataatcacgaagaagacgaattaaaggtgtatcaccatggaacacttgctctaatactgttagtttttcatcaaactctggttgctgtgataaataactaattgtatacccacgtgaatacgtcatatcacctgtatcaggagtttctaatcctgcaattatttttaataatgtcgatttaccagttccgtttacaccgataattccgacacgttgtccttctgtaatactacatgataatccatcaaataacggcttttctccatatgattttgataagttctccacagttaacattttcatatttgtgcattccactctttcataaattgttcaataaactgttccatataacgatgacgaatttcagcctcttgttttgctgcattcgtattcattaaatcttttaatttcaaaagtttttcataaaaatgatttaaagatggatcattattttttctatactcttctttcgtcatttcttcacgcggcggaatagttgggtcatacattaatctccctttcgccccgccatatgcaaaggtacgagctattccaattgctccaagggcgtctaagcgatccgcatcttgaacaagcttcccttcaagtgaatccactttaccgccatggccacctttataagacatattggcgatgatatgaagaatatgtttactttccttttcttcaacacgtagctcttctaaccaatcagaaacttttttcattcctgcttcttcactttcatttagcttttcatctgccacatcgtgaagtaatgctgccatttcaattataaaacgatttccaccttcttgctcagataaagaaatcgccattttatgtacacgttcaatatgataccaatcatgcccactcgcatctttttctaaaatatgttttacaaaagtaattgttttttgaattttttcttgttttgtcattttatcttcacccagttacttattgtaacacgcccgcattttttcatcacatattttctttgtccgcccatacactaggtggtaggcattcatcatga

SEQ ID NO: 650 - DNA, 1168 bp, Bacillus thuringiensis
atcatggtgaaaaatgaaatgcaacaccttttataaactttttttaaaactgcccacatttctttttttatatcatatacttaaacgaaatatctctttcatgtatgagcaattcctacatatattttatataaagttactctatcaaaagacgtttctttctataataagcgttttattcatatagcatatcatacaaggaggaatatatatggactataccgatttattaatcaaactaggtctctcggctattttaggatttgccattggtttagaacgcgaattaaaacggaaaccacttggtttaaaaacgtgtttagttatttctattattagttgcctcctaacgattgtttctattaaagcagcttataacttaccacataccgatcatatgaatatggatccacttcgacttgccgctcaaattgtatcaggaattggttttttaggtgctggcgtaattttaagaagaggcaacgatagcattgcagggctcacgactgccgctatgatctggggtgcttctggtattggtattgctgttggggccggattctatattgaagcgatattcggaatgtgtttccttatgattagtgtcgaacttataccactcgcaatgaaatatgtaggccctagatcatttcgtcaacgtgatatcgctgtgaaacttgttgtacgaaatatggacaatatcccaatcgtaattgaagaaataaaagaaatggatataaaagttaagaatatgaagcttaaaacattagaaaacggttctcactatttacatcttaaactgtccattgatcaaaaaagacataccgctgatgtttactatgctctccagcatcttgaaagtgtccaacaaactgaagtggaaagtatgtaacgtaaaacaaactctctttaattagagagtttttcttttttctataatggcaacaatgaatgtagtcctacaaagtaaggaggaataggcaattgaaatcccgtccgaatttagtagatacatttcgtgattccattatttttcgtttaacttcgttttattattgtactgactgctttttccggatttcttatgcatagattagaaccttttcatttcactacatggtttgacggaatttggaggtcaatcgttaccatttttacagttggatat

SEQ ID NO: 651 - DNA, 1086 bp, Bacillus thuringiensis
gaaagatcattataaatccaggaagtgtaggacttccagcatacaaagatgagttacctgttatgcataaaatggaatcaggaactccgcatgcaaaatatgtagtgatagaaaaggttttgggagaatggacaattgaacaaatttcagttccttataattgggaagaagctgctggattggctgttcaacaagaaagatatgactgggcacaggcgctaaagactgggaagatagaatgaaggagcgtttactttatggtaaactggttttgtacaaaattataattggattgaaattgaacaggcagtgaatgagaaaggatttcctaatcatataaagggaatcagtccagtaaaaggattgtattatatcggtttaccatggcaatctcaaaggggttccgcacttatttgtggtgtaggaaaggatgcagcgtatgtactttctgaaatcaaaaaaatagatcagtagcgataactactgatcatccatatgtacatgaattaggagaggtcaaacatttattaactttattataatagatttttacggaattaaaaactgaaaagtcacatttaatgttgagaaagttttttgtatcgaaatatatgaaagaatagggatttttattgaaacagaaaaagatatttctattttagtaaattatgatatagtctaaataagcgtgtttttccataaatgtaattattttcattgtagttttgtttatatgagggaaggagaagtaattatgaagtttgatgatcaacgcttattaggagtccgattaggttctgtacttgtgacagaggaaaatcaatatttagtaattaagaaaaaagatcattatgcactgttaaatatacataatttagaatgcacacatgttgaagtgcagttagaacatttggaagaaatgttgcgggaagatttccaagaaagtataacggaaattatcgcaccagaacatataaaaattgttgcgaaaaatgttatatagataaagaagctggaaggaacagcttctttatctatataaggataacgtttttacaacctcacaatgatccttgcatttgatga

SEQ ID NO: 652 - DNA, 1582 bp, Bacillus thuringiensis
attaaaaagtaaaacataggaataattttacatcaacaggattgtaaatgaaagtatttttgcgtaatatacagatatacatttattcggttggcaaattaatgggatagaaagcgggagaagactgtataaaacggaataaataagaactgaaaatattgtaaaacagaagaggcatacatataattaaaataaagtttaagtttctgaatcttcaataacggtggtgataacatgtttactgaagaacgtcgagagagaatcttagaactacttaatacagatggaagagtaatcgcaaaggaacttgcggaaagatttgaaatgtctattgattctataagaagagatttgtctattatggaaaaggatggtttattaaaaagaacgcacggaggtgcaattgaacttacgcgagtgaggaacttagctgcggaaccagctaaacgttatagtgatagctcaatatatgagaacacaattgcataagttgcggcatcttatatacaagaagatgattctatttttattgacggggcttccattcataatgcgatgctgaaatatttaccggaagtatcatttacggttattacgaattctatagaaatagctggtcatctaagagaatataagaacatcgatacatatttaattggtggaaaagtaaagccttcaggaaatattactgatacatttgcctctgaattgataagtagattttctattgatctttatttctctacaggtggaggcatttcattacaaggtattagtactgcacaacacctgaagttgcttattttagtaaaagagtaagtgaaattgctagaagaaatatttgtttagctccgcataataaacttggaatagattgttttataagaggagagtctctaaaagaaattgaccttattataactgacgaagaggctagtaaagaaactgttcaggaatttgagaaacaaggtaaacaagttgtaatagcgccattatattgatttgaaaggagtttgacatgattgtaaaagagcaagagtatcatataaatggattaacttatacaattcgttctgcagctgaaaaagatgctgagcagttatcgaaaattagagttcagattgatggagaaactgaaaatatggatagagatgctggagagggatttatagatgacctagggtttcaaaaaataataaaaacagatagtgaagaaacgaagaatctctttttagttgtagaagtgcacaatcgaattgttggattttcaagatgtgaaggatcaaattttaagagattatctcataaagtggagtttggcgtttgtattttaaaagagttttggggatatagaatggggaagagcctattacaacaatctattaaatgggctgacgaaaatgcagtaaataaaatatctttacaagtattagagacaaacgagaaagctattcatctttataaaaaattaggttttgaagtagaaggcattttgaaaaatgacaaaagactatcggatggaaagtattataatacggtagtgatgggaagatttactaatacttttcatgaaagaggtgag

SEQ ID NO: 653 - DNA, 1210 bp, Bacillus thuringiensis
  unsure (1)...(1210): unsure at all n locations
tttcgtcacagtaggctctcttttttctttttgtaaatttaatgaatctaattccgattgactaattttttgttgttctttcatgaaagtaagtttttctcgatatatagttaatgcctttttaaatcgttcaaatgtaaatggtttaattaaataatctactacgccatattgtaatgctttttttatacttcccatatcatgtacagctgaaatcattataatatcgctttctttttcttggttccggatatacattaaaagctcaaaaccagtctcttcaggcataaaaatatcaagtaatactaaatctactcgtgatttctctaatatttctatcgctgactttactgagttaactgcttgaacaagttcaaatcctcctacttgctctaaataatgcgtatttaacattgctaccatcgggtcatcttctacaattaaaactttaatcatatttgcctctcatccctacctttaggtatttcaatcgttatcgttgttccctttcctactaatgaatgcatatgaatttccccatttattcgctgtatactttcttttacaagatacaaaccataaccgcggttatctccctttgtggaataacctttcgtaaataattcctctatttctttttcttgtataccttttcctgtatcttgcactgtaatagttagtatatccccatgttgtatcttaacttcaactcgcttcttttcacaattcgtaactgcctctaatgcattatcaattaaatttccgacaatcgtaataagttcatgagtaatactttcaacatctatttccggcatgtaagaatcttcacttataattaattttatatttttctctctagcatagctgagcttacctagtaaaaaaccagcaaatactggactttttattcttttcataactccaccaatttcatattgatgctctgataccatgccgcttatatacttctgtaattcttcatactgtttcatatgtgtaagccctaatacgacatgcatcttattcataaactcatgagattgtgcccgtaatgcttctgcatatagtctaataccagttagctcctctgctagttttctaatctctggtttatcacgaaatgttgcaattgcaccaactatttctnctttacatataaaggaactcgatttgtcacaatcgtaattccataaaaatttggtcttcgtta

SEQ ID NO: 654 - DNA, 1634 bp, Bacillus thuringiensis
  unsure (1)...(1634): unsure at all n locations
tttaaattagacataatcccgagcaatggtaatgctatttcgtgtaacacttcattgttttctactatgaccattccaccaccgagctcttttactctacgaaaagctgttagcatatcttcttttctttttccgataagaatgatgtcacctgtaccagaataagagctagcaagcccacctagttttttcgcaaaacctttcacagctgtattcacttgccaactgccatcacgggcaatcatcataaggaaacattcatcatgatctgtggacaattcatcacagtctatattgatttcactagtgtatggttttgtaataacgttatttaataagtgtatccccgttttattagagaaaatcatatcctctttttctattgaccaatctaatgataatggagttactttatgtttactccagtctatatgtaatgcctcatgtgtatttacaccgtcacgcttcacccatttcccctttgcaaggacactaattggtactgggttttctttactttctaaaatattgatattagcaattctacctgtcgcaatcgaaccatgtacatgttccatattataataacgagcaatattataacttgccatatcgtatgcatctattactggcactccttgttttatcgcggtagaaatcataacgtttgtcattccattctcataaaacgaaggatgtgagccgtctgttgtaaaaaagaatctatcaaactgctttacgcctagttccaacaattctttcagtaaaacttctaaatctgggcggattgaagaatttcttagggaaacagtgtaaccttgcataagacgagtgaaagcttcctgccctgtcatcgcttcatgatcacaatctgtacctaacagttttaacttcgctaaagtcgtttcagatgcacctggaaaatgtccttctactttcttctgcaatcgcttcgtttcctgcatccaagttaacatttcatcatcgccatgtaatagttttggccacgctgttaatgcgccgccttgaagaactgctttatgcttaagccattctattatttcttcacgagtaaataaagtttccccgttttgcaattcagtttgtccatcaaaacgacaccaccaatacatacttgctggaatcttttcaaattcatctaataaacgaaatgcttcttcacgttgtaatgtgaaaaataaagttaaattatcattaataaaagttgttgtcccaaactgcatcgcatgattcgctaaagtttcaggattatataattgatacggatgtgcatgaggttctatgtaacttggaactacatactttccatcacaatcaatgacttcacattcatgcagttgcactggcagcttttcccctacataaacaatccggtcatcatagatccaaatatttgcttgcatccactcgcgcatataggaatttaaataagttgcgttcttacataaaatgtgcggacttcttttaccatctattacttcaacatgttctcgtattgtgtgttactccatctaaactgattttctcccaatgaatntcactccanatcaaattactttttattattaaaataaaaacaattaacaaactaaagtattctccattcataactc

SEQ ID NO: 655 - DNA, 2158 bp, Bacillus thuringiensis
agaaggcggtgtattacatgtaccgttaaatgaaggacaaggagcaatatgcaaaagctttagaagaattagcccgtatttcagatgatagtacgttacttccgaaacaaggattccttcattatgtaaagagaaagagagaacgatcgtctacaatgatatacattggtttacaaaaaaatgaactccctcttctctcgcagccaacgtttctcattactagtgaagggatggtggaaccagttgaaaacttggctatatcacattcatgatttcattctgctcctcctgctttcattattaacagaaagagatgaactaattagtattgcaatatttttaacaacaggctatattggagtatttcttattcataaatttatgcagaaaaaaacaacaggatttgtaatacttttagttcttcaaatcgttcttttctctttatttttacctttttctctttttggcacaatcatattaccactatttttctttatcgtacatgtggtcggacctggatatccagttcaaaaatctttaggtggtattgtatggtttgtcgtttcagctatattttatgcaccctttccaccgttgtggaaactattaatgttagccttgcatcttatgattacattttggttaaccggggcaaatcgcaaacaacaactattacgttttgcttctatcattacgatgggcttaatgagtatattaattgttcaagtatttcctttcattcgacttatttttggttttataacggaagtagtcgcattaggcgtcggctatgctttaatgccattaattaaagcagcggaattaaaagatactgaagatgtttgggcaaataaaggacatctcttaaaacccaaaattgaagacggaaaaaaaattcctgattttgatccaatactcataaatagcgctacaataatagtctgtacagctatcgctatttacgtcgtttggaaaatagtaaaaaaacgaaaacatttaagtttaccaaatatgcccgccttcgaatctactatcattactgataaagaaggaataagccaaaatcgttttaaacgaaataaaccgccacataacgaaattcggaaggaaattttcaagctagagagtaagttaacctctcctttaaatagaaaacggggagaaactgttgaggcttggctagaaagaataaacgatgaagaagatgtaaatattcaaagtgatattattatagatgcttataatacggtgcggtattcaaatggtgcaaacactgtacttctacatgaatttatggaagagattcataagctttatgcatatcaaaaaagtttgaagaaacgaaagaaataacgtaacaaaaagactcctatattcataggagtctttttatacttctacgttgctttttaaatggaagcattcttccctgcttcaatttctaatgactcttcatgccaccaaagtgtttcttcaggatcttctttagcgatttggtgtgcttcttttttcgtttctactgtaggatatgaaccttttagcgcacgccctgaagtcgtaacgaatagtacactaaatacaactaatccaataatacttacacctgctaaataaaatgccggtgcgagcgggttaccagttgcatgaactaagtatgaacatacaagcggtgttgttccaccgaatatcgatacagaaatattaaatgagatcgaaagtgctcgataacgtacatcagtgaaaaagagtgatggtaataatgaaggtaatgttccttcatatacacttaagaagaaacctagtacgaaaatacctgcaaatatagctgcaatatgtccgttacctattagtaaaaatgctggaattgcaaatacagttaaaccaagtaaaccaatttgcacaacacgtttattaccaattttatcacttaatttaccgaaatatagtgctagtggaatcataagtgccatcgtaatagaaataattaataagcctgttgtttcttcgactttaagtacttgagttagataagaaggaatatacgaaagaatcatataatttgtaatattaaagaaggcgacaattactgtgcttaataagaagtcttttttgtgatatttaataatatccataaatgaaaattgtacaatgtcttcag

SEQ ID NO: 656 - DNA, 1281 bp, Bacillus thuringiensis
atctcgtaaattgatttggccttccactgcattttcccaagttggtgaattcgaatcttcaaaatccgccataaaaagatgcgctcctgaatttaaagcgttaatgaccatctttctatctaccggtccagtaatctctacacggcgatcctctaagtcttttggcagcttggcaattgtccaatccgcttcacgtatgtgttttgtttcttctagaaacttcggaaactcccctgcatcaattctcttttgtttttctacacgtttttgtaaaagttctatgcggcgctcattaaaattctcatgtagttccttcaaaaaactaagcacctcaggtgtcaatatttcgctgtacgctggtaacatttctccaacgagtgtaacccgtgaagtttgcgtcgacatattagcatccccttcttaaactgttttataacagatttgatttcatgttttatattatataacaaatcttcagaaaaggaagttttttttgaaaattcatttcgtttttttcaaaacgccattctttcgcgctttatttcatacaaaaaaggccgctgttatacaacaacgacctttttgtattatttttgaatttcactttgactagttaaactttattactgcccttgttccatatcatgcaatattgctctatgtaaaaactgtgcgtattgttctctcgttaccttcatagacggaccgaatttaccttctccgattcccattgtaataccatttgtttgtactgcactaattgcattcgttgcccatgaatttgctgaaacatcattaaagttatgagatcgctttgcctgtaggtcaaaagcattcgtaagaacttgtgccatttccgcacgcgttaacgtcgccttcggtctaaagtttccattctcgtctccctggaaaattccgatttccgttagagccaatatctcctcgataaagcttgttgaattttcatcgatatctccatatgggttttcatattcatcttgttcttccatatcaaacacacggtaaattaaagctgcaacttgctcacgtgttacattatccccaaaaccgaatattccatcgccatatcccaaaattatttcttgttccgctaattcatgaattgcctcatatgcccaatgtccttttggtacatctttaaatacaattgtatttgctttttgcaacggtgcactttccgcttttacactattactctctgctgagaataacaccccacccataatgtaatgctgagctggtttaatatttttgttataa

SEQ ID NO: 657 - DNA, 1797 bp, Bacillus thuringiensis
acacccagtggaaaagaaaggaggtgaatcctcctttcttttaaaaacattttacagatgaattatcttcggttcctcttattaatttcatcatatgcttgaatttgttttttcaaacgccgatcagcttttttatcatgcactacaagaattgcatgtataacctcctggaacccaaaatattaatgttaatatgaaatttaattattgcctgaaatggttttccacaaaacaatacagcaacaggtggaagaaaaattgctaataaatacatcatcccttgaaaactccttattttgtattttatatatcacttttcaaaatatacgcaaaaaaacctactaccattttaatcttaacctgcctctaaaatcaatgtatctccttctatttatataagtatttcagacttttcattgttttctagcctattttcttcctctattgcagttattccaattgcggaaattaacgttcctatcgcttgtatccaaataccaatgagtgcaatgattctctcatccttcttatcaaaaatattatctttattttctttctcatctttcaatacatttaaaacaccttgatacgcttgtaatccagcccctaaactttgcatggagttacccagtataataattttctgtaatacatttatatccaccaaagctgcttctactcctaaaaaagcaccgatcgattgtaaactgttccctgtaatgataagataatcattttctttcaattgttcatttatattaaaatatgttcctattacatttgatatattgcctaatgctaataactcaattcctatctgatcaagtaatttactttgattctctaagcctatattttgattttctcttttttcttccccatcatcatacttgctcgcaatgatttgtaatatatatccgagggcttgtaatgagcttcctacaataacaagatccgattcaactttctcttctccaataaatcctcttgtcgttccaatagcagctgtaagattccctcccacttgaaaccatgcccctgtcacttttaaactgcttggattcatttttatcacctattcaaatattttctaaagctttcaaaacaaacaaatctcacccttaatcttttattttatttttcagatgtaattttgtgaatgatataatgtgctactaatataaaaagcaccttaaaggtgctttttatacgcatgctgggcatgtcaatgaatctccatttttatctattgttatattcaatatatattcaatcgctttatgtgaccaagtttcaggtgtaggcgattcatttatatattgtggcgcacatgacttcagcattggagtattaatactccctccaggatctaaagcaactacagccatgccatggggtaattccagggccatagatttagtgataccttcaattgcaaatttcgaggcacaatatggcgcaagctcagcttcaccttctctcccccaactagaactcatattaatgataattccttctttcctagctaccattgcgggaacaaatgctcttattacatttactacaccattcacgtttacattcattacattttcaaattcttgagccgtaattttccaaagttgtgcattttgatttacaattgatgcattatttattatcagattgggagccgtatgtctattaagtatataatttgcccaattgttaacttgctgagatctgcaacatcagttacttggaaatcatgtatttcactgtactgtttttttaggtcttcaattttatcttttgaac

SEQ ID NO: 658 - DNA, 1891 bp, Bacillus thuringiensis
aaaaaacacactttgtgttatttaagggtgtaccgcatttatctcattttcttgccgtatggaacccttgtgtaattcgatctaatataattgcgattactacgatagctaatccagcttcaaatcccattccgatattaacttgtgttacagagcgatatacatcaactccaagtcctggagctcctacaagtgatgctgttacaaccatcgataacgaaagcataatgctttggttcacaccagccataatcgttccggttgcaagtggtaattgtactttaaatagtttttgtgatgctgtggatccaaatgcattcgctgcttcaattaaatcttctggaacttgtctaattcctaagtcagtaaaacgaattgtcggtggcattgcaaagattactgatgcaataattccaggtactacacctactccgaaaaatgtaatcgctggaataaggtatacgaatgcaggcattgtttgcataaaatctaatgttggttttaaaaattttgagaaacgttcattttgagatgctaatataccaattggaattccgacaataattgaaataataacagacgtaagtacgagtgctaatgtttgcattgtttgtgcccagtagttaatattcaaaataaataataatccaataagcgtaaaaatgactaaagataatttcctcgttgtgtaccaaatgaggaaacataagataataatcatcaatatggcgggtattattgttaaaaaattagtgagtaaatcaacaaatccgccaataatataagagaatcctcggaataagccttcaaagtgctcatataaacttgcaacaaatgagtcgacccattcccctaatggaatccgcggtatactattcatcgtctttcacctcttctcaatgtttcctgcagagcttgaatgacactttcacgtttaataattcctcttagccttttcttctcatcgattactggtacggaatatttcatctctgccatttttgcatatgtctcttccagtaaagtatccaaatacacatgcggaatatcattaagtaataaatcagcaatcggccactgtttttgtactgctttactcgcatcatccgcagttaatatacctaaaaactcatactttttgtttacaacatatacagttgaaacacctgcattcctcataatttgaagggctacacgaggtccacgatcaattaataaagtttctggtcgttttaaaatagactccgccgtaattacttttcctaaattcacatccgcaacaaacttttctacaaattcattagcggggctcatcataatttcttctggtgttccaatttggacgatttctccatctttcattaatgcgatacgatctccaattcgaagcgcttcatctaaatcatgcgtaataaatataatcgttttttccattttatcttgtaactctaacaattcatcttgcatttcttttcgaataagtggatctaatgcactgaatgactcgtccattagtaatacatctggattattcgttagtgcccttgcgattccaacgcgctgttgcataccaccactaagttgacttgggtaattatctttatgatgatcgagtcctactaactgtagcgattctaacgcttttttctctcgctcttcaaccggaactccttgtatttctaaaccatatgcaacattttgtataactgtacgatgcggaaatagagcgaatttctgaaataccatactcattttcgttcttcttactctccgtaactcttcttttcccatcgttgcgatgtcttcaccatctatgtatatatgacctgcagttggtttaatcaattgatttaacatacgaactagcgtagatttcccgctacaaaacaaa

SEQ ID NO: 659 - DNA, 1806 bp, Bacillus thuringiensis
  unsure (1)...(1806): unsure at all n locations
catggaattttttatggctatactaatattagcctttggtttcatttatatcgctgaaaaattagctacaattgaaaagaaaaatgatgcgcgtttaaagagaattgaagatagattacaattaattacgaaagaaatgggaattgtagaaagagaacctgaaattaataaagaactacgccagcttgtagaagaaggcaaaaaagttacagcagttaagagagtaagagaagtttttgttttttccttactagaagcgaagcaatatgttgataaattataaaaaagatcatccatttgggtgatcttttttactgcaccatgcgtgtatttacataagccgcgattataaagtgttcaattatatggaacaaacactgaagataaattgtctaatataggtaataactatttggcttgaaggaaagggttgatgacatgaaaaagaatacgttgttaaaagtaggattatgtgtaggtttactaggaacaattcaatttgttagcacaatttcttctgtacaagcatcacaaaaggtagagaaaacagtaataaaaaatgagacgggaaccatttcaatatctcagttaaacaagaatgtatgggttcatacggagttaggttcttttaatggagaagcagttccttcgaacggtctagttcttaatacttctaaagggttagtacttgttgattcttcttgggatgacaaattaacgaaggaactaatagaaatggtagaaaagaagtttcagaagcgtgtaacggatgtcattattacacatgcgcacgctgatcgaattggcggaataaaaacgttgaaagaaagaggaattaaagcgcatagtacagcattaaccgcagaactagcaaagaaaagtggatatgaagagccacttggagatttacaaaccgttacaaatttgaagtttggaaatatgaaagtagaaacattttatccagggaaagggcatacagaagataatattgtcgtatggttaccgcaatacaatattttagttggaggctgtttagtgaaatctacgtccgcgaaagatttaggaaacgttgcggatgcttatgtaaatgaatggtctacatcgattgagaatgtgctgaagcgatatagaaatataaatgtagtagtgcctggtcatggagaagtagggaacaaaggattacttttatatacattggatttattaaaataagaaattgtagaaatacaaaagagaggagaaataattttctcctctctttcttctaactatatttaaatgctgaatctgttgattacgtcagcatatattactgagattctaattccaagtatacaaatactagtactgtcataattgctataacaacataagtagcatcaagcattataagtgtttttaaagtttcagtcatcgtaattcacccctgttataaaaatataacatgatctttttattgattagataagagatcataaagataaaatgtatatgaaatttcttaagtagcttctatataaatatatcatataaataatgtaagtaatgttaagataatgtaaatgtattgtaaataaaaaggtttacaataaagactttaataaaaaatgatagttccttaaaatgacaaatgcgctcttctttctattgaatgatagaaagaagagcgtatttttatatctatttcatatgtgatgaattgcaactatttgtacatgggattcaaaaatttttttcgntgtatatatttctccaaattaattagctatttaaaagtatcgaaagatgtgtgtacactaatgcata

SEQ ID NO: 660 - DNA, 1785 bp, Bacillus thuringiensis
aaaagatggtaggtctattaaagatctagtgggtaaatgctaactactagatctttctttttatctaagtatttttttaggattacaattttcctatagtaaacaagcacaggtttctaaattaagttactggagaatatataactctggtgcaatatccctaccagctttcattccaataataactccatgatataacgtcaaagatgaaatcccttaacttaggtatttgactttttaaatttatacaaatgtcttagctctatgtactgtgatatataggtccacatcaatatgttattgcatcatatactgaacagataatttaaattacttttataaaggatgatgaggatgaacttagaagatatacaaaaatcctatggcgtaattgtaagtttaggaggattgtgtcaagtcaccaaccaaatcaaaagacacaatttaagaacattttctggacctttagattggttttattatccatcactttcagatgtaaacagattacttcaaaatcgatttaaaaaatttatgaagttggaaaatatggttatagaaggttcagaaagttacggtcttattgaatcagaatttgataatcaaattaaatgggcagaacgaattacctactgtataaaggacacttattataattgtttttcaatgcatgattttcctattaattcagaaaaggatttgaaatcaacctatccttcttttaaagctaaattagacactagaattaatcgattctttgaaaaaataaatagtagtgaatccattttattcattagaatttggggaaatcgagatgaagcggttgaattacaaaacgtattatctaaaattacaaataaggattttaatatccttattgttaatttcaaggagggtatatctaatattgttgaacaaaattggggaatatcgagggtttgttcaattgaactcccacgttatcaggatagatgggaaggtgatgattccgattgggatgttattttaaacaaaataacattaacttaataattttcttcttacttttaacatgatttggcccgtaaaatcaaataggtgtagagaaataaaattcctgtctaattgatacacacttaattaacaaaacgttcatataataattcgtaagtccttctttattgaataaatagttctttacaaaattagttccatcactagagcacctttatgcggtgctcttttttgaatttataaaatgtaaaaatagttgttccattttccttcaaatggctaattccctttgttattcttctgttgatttctgtataatcatttatgcgatcagcatattctgcttatgtagtgcattcacgactacttacttccatactttatcttatattttgtcttcttggatatttcattataagcttcttcaattcccttgatttccttccccttcttttatcttaagaacaagcaatttctttcatcaatattaaataaactaaagcatagattttaaaagaacctaatttacatataattaatgataaactacaatgtgtattctccacgtttaatcaacatctgaattataaatctaacatatcttttttagttgattgtcattatggataaatgctaacttaaatatgtacattaacgcttgaataaatatgtacattttcaattggattctccatactgactctgaggtggttagtatgtatattaagctagatattcaaacagaatttgaggttaaaagtctttcagacttaccaaattttaaaaaactaa

SEQ ID NO: 661 - DNA, 1098 bp, Bacillus thuringiensis
tatttccaccaatttccatactgtggttacaatttttaatttgcgctctctgcttcgcgctcgggttttgtatctttggaggcttcgtcttgcaccgagatcgcaaacgaaataaagtacaagctcgctttagaagataggaatgccccactatttataaataaaaaaatgagaccgttacacgcggtctcatttttttattggcaataacgttcttgccgtttcagggtaatcagtaataatcgccgatatattcatatcaaaatatttacgcataagcgtttcttcattaattgtataagggcgaacttctacaccactttccatcgttagttcggcaatagcatcttgaagataacgataattcggatgtactgctgtagcccccatttttttcgcgtatgcccacggactatgcaaaccttcgcgatataaaattgctgtttgaatatcaggagccatcatatggcaccgtttcatactgtagtgattaaacgaagaaaatataacacgatcctctagactaaatttccgtacaagcgttataacttcttcctctaaacctctgtatggaattttattatttttaagttcaatattaagtagcaaactcgtttgttcaagccattctaatacctcttctaaaagtggtattttacaaaaacctactttatcaccaaatttataacttgcatctaacttgcataagtcctcatatacataattgcgaaccgcaccttttccatttgttgtccggtccaccgtttcatcgtgaatgacgacaacttttccatctttcgttaattgaacatcaagttcaattccatccgctctaaaagactcagctgcttcaaatgaaatcattgtattttctgggtacgttccagccgcaccacgatgtgcaaatataagagtcatcctcactcccccaatcttatgctatactatacgaaaaaggaggtacttctatgagaccattacaaatctctccagatactgcagtccgcttatcaaaagcactaggtgttccacttgaacaactcatgcatatgccgcagcacattttaattcacaaacttattgaattagtgaaacaaa

SEQ ID NO: 662 - DNA, 1916 bp, Bacillus thuringiensis
atataaacttaataaaagttatgacaatgaagattttagaactggtaagatggggatagttagttattataaatgtgaaaagtgtgggaaagagaaggaaatcagcaaatatactaatgatgttaatagtgactattgggatgtttaaaataacattcgaatatagtccggctagaaaactagagaacaccaattcattaaagtagcaattaaagctgttttaggaataggtgtcctttttatttcgttttaaaattagaacacaataatatgaaatgctcataaaatcattcttgctatacatgataatagtataaactctatatttcttttaataatttagggttatatcttttctgcatcagccgcttttaaccacgcttcgtagaattctgtaactgatgcataccgttctgcccgattgtcatttacagcacgatacgctacctcatataattccttacttgcttcccattttataaaagaacgatctttttcaccgcctaagagtgagaaagccattgctcccatattaaatacatttgttctttcatcaattatagcgtttagttcaaattcctctggtgacataaaacgggaggaaccccatagccggcccattttatttatgtaaggtttcttactgtataaatctatatcacaaatttttgtttcgtttgtattaaaattatataaaatactaccgtcataaaaatctatcgctacataatttttcttttctacataagtatggaaagaaaaaatggaatgtaaagaatgaattcgttctataacaggtaaatgtctaaatttataaaatggagagtttggatttttatatttctcaggaggtgggaagcgccaatgcgaatgaagacattcaccatcaaaccaatcgaaaattaatacatatccagattggactggaaaatgatcaatttatcttatgagcgattcatgctttaaatcttcataaatagtaactgaattttttagcctttcaatagcatcacccgttgttccttcatatgcaattgtttgtgctcctgcgtatttgataaatttcttatgcccatttttttctacaccaaaacttatattacctgaatcttgctggtcaaaaactgcaaatacggtacctaatttaataagccaatcaaaattatgatgttcttttaattggaatattacactatttaactgaacttcgacggaattatctttcatagattacctcacatttaatataattaagttgtacattccactattcgacatattttgtggaaatcctatgctaacaacataaaattttataaatataatgataaacacttatagagaggtgagtacaatggaccaacaaattgttattaaaccgtatcaaaaagactgggttgaagagtatataaaagaagaagagaagttctgttccttgttaggacaagaaataatcgctgttgaacatatagggagcacagcagtagaaggattaggagctaaacctcttattgatatgatgattggcgtaacagacttacaaattactgaaaactggattgagattctatcggaaattggatatgagtatgttccaaaagatgcaaccaattggcgtttttttagaaagggaaaatggagagcaggtactcatcatttgcatgtttatatttataatagtgacgagtggagaaacaatattttatttcgcgactttctaataagccataaatgggcacgtaaagaatatagagaattaaaagagaggcttgctattacatatgcttttgatcgtgtttcatatacaaaggcaaaagcgccgtttattcaaaacataataaagttagctgcaaaaaacaataatagctggcagtgattttgaaactctcatttcatttaatctttctctcatttta

SEQ ID NO: 663 - DNA, 1901 bp, Bacillus thuringiensis
gtaaatagtttactggctgcaacaagcagaaaagttcgtacaaaattattggagagtggacagcattggtttcatctattaaaagatttttaattggaagaccgttaaaatcaacggagcttggagaacaaaagcttaataaaacgaaagctttagctattttatcttctgacgcattgtcatcagttgcttacggtccagagcaaattttaattgctttagcaggtgttggagcgatcgcttattggtattccattccgatcgctgttggggtattagtattattgacagcccttattttatcttatcgtcaaattatttttgcttatccgcatggcgggggagcgtatgttgtatcaaaagaaaatttagggatgaatccaggcttaattgctggaggatctttattagttgactatattttaactgttgcggtaagtgtgtctgctggtacagatgcaattacgtctgcgtttcctagcttacatgcacacaacgtaattattgcggttatatttgttatattaattacgatattaaatttaaggggagtaacggaatcagcttccgttttagcatatcctgtttatttattcgttttagcactatttatattaattggtgtgggcatatataatattttaactggtcatgtttcacccactttacatgcgccaattggtacaccagttgcagggattagtttatttttattactaagagcatttgcatcaggtagttctgctttaacaggtgttgaagcaatttcaaatgcaattccgaactttaaagatcctgcgccaaacaatgctgcaaaaacattgcttgcaatgggtgcattacttgctgtgttattttcaggaattgtatttttagcttattattacggagtgactccgagtaaagaagtaacagttgtttctcaaattgctgaacaaacatttggacgtaatttcatgtactatttcatacaaggtacaacagctttaatattaattcttgctgctaatacaggttattctgcatttcctttattagcggttaaccttgcaaaagataaattcataccgagaatgtttacgattagaggagaccgcctaggttactcaaacggtattattatacttggagttgcttcgattattttaattgtagctttccaagggcaaacagaacatttaattccactatatgcagtaggtgtatttattccatttacactttctcaaacagggatggtattaaaatggcttcgcgaaaagcctgaaggatgggctttaagattaacggttaatttaattggtgcagttattagttttatcgtaatgagcatgttctttttaactaaatttgcacaagtttggtcgattcttattttcttaccagttattatcttcttattccatcgaattaagaagcattatgatgcagtgggtgatcaattaagtttaaaaacttgcgagcctcttattccaattgaggggaatgtaattgtcgttcctgtagcaggtatgacgcatgtagtagaaaattcattgaactatgcgaaatcgctttcggcagatcaagttatcgcagtatatgttgcttttgacagagaagaggaaaagaaatttgaggagaaatggaagaagtggcaacctgaagtaaggcttgttacattacattctcattatagaagtattattcagccgctaacgaagtttatcgatacagtgcaatataaggcaagtgaatcgaattaccgtgttacggtcgttataccacagttcattccgaaaaaaggttggcataacattcttcataatcaatccagtttacttatacgtgcgtatttactttataaaagaaatgttgttattacgacagtttcatatcatttggaaaaataagaaaatttt

SEQ ID NO: 664 - DNA, 1703 bp, Bacillus thuringiensis
atcataaaatggttcaagaaaacgcccctttattcatctcttagtttaccacaaacatcagttcttctatatcgtatataatcatgaactaagtgaaatgggggaatttagcaggatataattattactttaatgtacttagtttttcaattgcttgttgttcagttgctaagtaaaaaatatcttttcctttattacattcataaataaaatcctttaagcttttactagtatacatagagaaatctccaacaatagcaatctttaccttgtagtttataaacttttgaaggatatcgcccgcaagccgtgtttttagatcaaagaaatcttcacttattaaagatttatggataataatatgtttcgcatctacctcatattgaactgttgccatagtatctaatgcagactgaacatccgatattaataccttatcgttcctaatgaccgcaatattgattccatcgattactactttctttatttccatagtcccacccctttataatttatacagtatgagtaaaattgttttacaaaacttcgtattaatcatagattaaattagcctcagctattaaaatagcctctattttttgttgtaaatacatattttttattactaatacggtcaatgaaattaatgatagtttctctttttttatatttttgaatatatatatggaattacttttacttgttataaaaatattgtggagtaacataacttaacaaactatccaaagtgttaatctcggcatatggttgtattttggtagtattcttgattttctgagggttaaaccacacaccttttatatttgcattttgaggaccagcaatatccttttctaagtcatccccaacaaataaagtattttccggttgtaaatttagcttatctaatgctagttcgaatatacgtttatcaggtttactaaatcccacttcttcagaaataatgattgtttcaaaatacctatttaaattcgtgttaaatattttagctttttgcctctgagttgagccatttgttataattccaactttaaagcgcttctttatttgatttaagaaatgaatagtattttggtctattgaaaaacatctagggaaattattattccaaaaatcttggatgtaattgcgtggcaatctataccttggcgtgaattcatcaaacaatgattctaaaactgtcgttttattacttatgccatattctcttttatcgtattctttgaatttctgtaacatgttgcttttagccgcaccatctacattttcataacacttttctaaaacaattaaaaataatgcctctactgctttatccctatcaagtaatgtatcatctaaatcaaacagcatcgctttataacccatcaaataatttcacaacctttctcgcatgatttaaataatccttagttcacaccttaatcgtttactaaattagcaaaaaactctaaagtttgtgaagtacactctataatttcgctagctttttttatattgaaattcatttccgtttccccttctagtaagtagcgaaagtatatgttcacacagtttaagaaatcacatgcagttcccaatattatacattggttttttagaaatataaatcgttcagcttttcatacgataagttttttcaagcatacaattattttttcataaaaaaaaatatggctaat

SEQ ID NO: 665 - DNA, 1660 bp, Bacillus thuringiensis
atgctggacgagaaaagattgcagattggttttaatgaggaagaaattcgtaaatttttaccacgtagcgttcgaacgtttttgaacattgaattgcaaaaattggccaattaataagtagtatttttagaaaaagttttttgaaaggaggaagcagaagatgattgaagtatgtgttacagttaattataatgatagaaattatcaaacaaatgttattgtgagtaaagatacgatttggacaaaaattaaacagttggcagaagaacaagtgaagaaacagtggagtgtttaattttattttcaacttaaaaagctaaatgaagttatcagatataggtgggaccggatagaatataagagaattaattttttatggcaagaagtattctatatgttttaacgttctaacctatctgtaatatttatggctacagttaatatatgagaaacaatatttttgatcgtaggaggaaaatcatgaacagcgactttaccttggccatacacagtttaacttatttagctttacagccagatcggatgtcaacaagtaatgctatttcagaaagtgcaggtgtacatccagtacgcattcgcaaagtactaagtttgttaaaaaaacataagtttatacaatcgaaagaggggactggtggcggttttattttcgctcgcgatttagatgaaattaatctttggcatatttatcagataacctctgaaggtgctttgcagccgaagtgtccagaatcaaacaatcagtgtgttgtaggttcgaacatgcgaaaagttcttttcgctattttcttaggtgctgaagagcatctaggtgaatacttaaagaattatacaatgaaagaagttgttgaccttatcaatcaagagcgttaagcggcttaattattatatagccgtgagttcttaacacttaaatgtaatgaaaaatattacagtataattgtttttatatcttttttattgtcacaaaaaatatttataggaaggtgaaacggtatgatgtcaaataataatcatgttttaaaagtaggagattgggttcgtggaatatcaaatgaaggtgaattaatagttggttatattgtatcacttgatgatgtagaggatatagttacagttagtattgtgaaacgtgacggccagtacacaataaacgaagcgattttactctttagtaaacacgttaacaaactccctgaatcaaaggtaataaataaggaacaaatcctttatcttatagatcttgcattattaacaggggatgaagaatggtttatcgagctttcttcaaaattaaactcgataaaagagctagttaatgagggattttaaaatttaaacttttgagggtgcacacaatccgccttatggagaggacacaattacttttcgcataaaaggaaatgatgtaaaaacgattcattacaaacatagagatattcctgataacgataattatgtaaatgagctgtccatatggggcagcttttttgttttttactcagtgtatctttttaaaatgtatatgaattcaatattaataatatatatcctaaaatttggttttttttttattttggaattttttctttttacctacattaattatttattagaatatcttttatgtttaaaatga

SEQ ID NO: 666 - DNA, 987 bp, Bacillus thuringiensis
gaaatagctgattgtaaaattaattatccctaaaaatacaaacaacgataaaccaaatcgaattaatttcttatttgtaaacatataacacctctcaaaattcattggttattcctgcttttgcttctttatatttccatatctctatatctaattttaacacataaagaactcaaaaaaatacgatatgcatatttgcatatcgtattaacaacactccatgataatttagaaattcctgcaaagaaaaaacaactccgttacagctaacagctcgggtttcttttcttatttaacttcataccaccaacatttacgttctttgattgtaaaataaatgtgacagaagtttatccagttaatgcgtagacaagtaaatgagctaaattatcgatattctatttcgccatttccgtagcactaatgactttacgcaaatttgacaagaaaaaatatatagctaggtatgatccatacctagctataacattacttctattctttatccaattacgtcttttacgtctgtatccactggccacttttctaatgtataagccatttcccaaaatgaatattcatattgactgctaataataaaatgctgtttcatacgtttgcgatctgcctctgttactttttcagcgatagtatctaaacgtgtaatttgttcttcaactagcgtacggaaccaatcagatccataagcagaaatccattcgttataaattggctcttccggctggcactcttttaagcgttcgccaatttcataatacaaccaatagcaaggtaaaattgctgcaatgatatctcctaaatgcccttcatacccagcacgatacatatgtgaagtatacgcatatgcagttggcgcaggaataaaattatctttttcttcttttgttatccctaatttcttcgcaaaattctcatgtaaagataactctgcctcatatgtattttgagcatgatgtgccatacgag

SEQ ID NO: 667 - DNA, 1361 bp, Bacillus thuringiensis
tagaaattgttattggtattattatagaatatatgtcagaaaatacagttattcattaatggagtgggagagaattatatgtcgatgtcgctatattataaaaaaatccgggagcaattaggacatgaactaatattcatgccaagtgtagctgcagttattaaaaacgagcagggagaactcttatttcaatatcctggcggagaatattggagtttgccggctggagcaattgaacctggggaaactccagaagaagcagtaattcgggaagtatgggaagaaacaggattgaaagtacaagtgaaaaaacaaaaaggggtatttggagggaaagagtttcgttatacatatgcaaatggcgataaggtagaatatattgttgttgtgtttgagtgtgaaattactagtggaaaactgaaatcgatagatggtgaatctttaaaactacaatatttctcattttctgaaaagcctcctttagcactaccatacccggataatatatttttatagatgtaaaatagcacaccttatttattgaaggtgtgctatttatataacccggtcgtatacatctccgttaacgtatacacaatttcctctaagttaatctttttgtcattttgcataatagtccaaagaaacgattcattcatcgcgaaccaaccgcgtgctacaatctctttatttaaattaggttgtgctaatccactttcttgagagtaagtaatatcctgtttaatgcttgttataaaacgttcccgaatctcatcccatttttgccgtatttctcttgataatcctatcgcttcctctacaactcgcaaaatagcgcgttcttcatctgctaattgcaggaatgctctaacttgattttggatcattatacgtacttcctcttttgtttgtggagaaaaagagcgttcagcgatattataaaaacgattcataacatcttccattaaactaattaggagatcatctttgtttttgaagtatacatatgctgtaccatatccggtttctgcatgtttaataatttgtgtaattgtcgttttttgaaatccgttacgtataaaaatagtgtaaccagagtgtaatagtttcttcttcgtttctaaggagcggtgttttcttgatgaaagggtactgtttttcaaagaatcacctctttatactgaaatatctgaaaatataattgtattgtaaaagaagttcatatataaagtcaactgacataatatatttgacgttgtatcaaattaaggcgatatatttcaattagtgagaataaaatgaaaattaagagaaggtgacaccatgtttaacgaaccatttgagcccacttatgagtttgc

SEQ ID NO: 668 - DNA, 1377 bp, Bacillus thuringiensis
cgtaaatcgtgttctttgtggcgcgggattactaaaggatttatatgaaatcacattgttagatgtgtatcatgcagtgaacgtagtcgaagaagacaagctatttcatattcacgagaaaccgaatccagattgtccaattggtgcgaatattcaagcggtgttagaaattattttaattcaagcacaatccgcgatggaagaagttttgagaaatattacaatggggcagttgtttgaaactttgcaagaaaaaatgaatgcttaaatcatatttatatttttttgtcattaatgtaaccgatttgattacaacaataaaggtaaggtgtaaaagttatgactgtaaaaatgaaagtatactcagattttatatgtccgttttgttttttagcaaaaggtccattagatgaggtagcgaaagagaaagatgtagagattgaatggatgccatttgaattacgtccaagtccatattcaaaaatagatccatggaatgaaccagaaaaattaggttcatgggatgctttcattcttccgacagcgaagaagttaggaattgatatgcgcttgccacgtgtttcaccgcatccatatacacatttagctttcgaaggatgtcaatttgcgaaagaacgtggactaggtaatgagtatcatcaccgcgtattcacagcatttttccaagaagagcaaaacattgaagatattgatgtgttaacaaaattagcggtagaagtaggacttcctgaggcggaatttaaagatgctttagtaactcgtaaatataaagaaaagcatcaagaagcaattcaacacgcatatgatgaagcgaatattatggctgttccaactgtcatgattggagatgaagtcattcaagggcttgctagtaaagaaacactagaaagggtcattgataaagaaattgaaaaggataaaacaaattcatttgaaggtatgcaatgtaataccgatggatattgctaattcgcttgttatgaaataacaaaataaattataaaacaaacatttggaggaattaaaatgtcagcaactacaacaaacttaaaagaagcaatcgtgaaccgccgttcaattcgtaaagtagcaaaaaacgatgcaattacgaaagaaagaattgaagaagtgttaaaaacagctttacacgcaccaacatctttcaatatgcaaagtggtcgtatggttgtattaatggatggagagcatgaaaagttttgggatatcgttaaagaaacactaagagcccgcgtaccagcagaaaactttgaagcgactgtagaaagactaaaaggcttccatgcaggtgtaggaaccagtctattctttgaagatcaagcaactgtagaaaaatgc

SEQ ID NO: 669 - DNA, 1917 bp, Bacillus thuringiensis
cctaagaggtattggcgatgatatgttattacagccgtggcttgagacgagaatttggccactggaaagtcaatttactccccaaattgcggtcgctagtacggaattaggattacttgagatggtgaaaagtggtacaacatcattctctgacatgtttaatccaattggagtagatcaagacgcaattatggaaacggtatcaaggagcgggatgcgagctgctgtttcaaggactttatttagcttcggaacgaaagacgatgaaaagaaagcgattgaagaagctgagaaatatgtgaagcgttactataacgaaagtggcatgttaactacgatggttgcaccacatagtccatatacatgtagtacagaattgttagaagagtgcgcacggattgcagtagagaatcaaacgatggttcatatccatctttctgaaacagagcgtgaagtacgtgatattgaagcacaatatggaaaacgttcagtagaatatgcagcgagctgcggattgtttaaacgcccaacagttattgcacacggtgtagtattaaatgaagatgagcgtgcatttttagcagaaaatgacgttcgagtagctcataatccgaatagtaatttaaaactaggttctggtatagcgaatgtaaaagcgatgctagaagcaggaataaaagtaggaattgcaacagatagtgttgcatctaacaataatttagatatgtttgaagaaatgcgcatagcgactttactacaaaaaggtattcaccaagatgcaacagctttaccagttgaaacagctcttacacttgcgacaaaaggagctgctgaagtaatcgggatgaaacaaacaggatcacttgagattggaaaatgtgctgatttcattacaattgatccgtctaataagcctcatttacaaccagcggatgaagtgttatcacaccttgtatatgctgctagtggaaaagatataagcgatgtaattattaacggaaaacatgtcgtttggaatggcgaatgtaaaacgttagatgaagagcgtattatatttgaagcaagtcgttataaacgaggtttgcaaagatagataattatgtggcagttgaaaaagctatccttttaaaggatagcttttttcttgaacgaataaatattcaaaagaatgtcgcatctttctgttagtatttctgctataatatattacgctttataatattttatatttaaggagaacaactcatgaagcgaaaaaagagccatttaatggtaatggcacttgttacatttttattattaacagcttgtaataataaagcgaataaaagtgatacagaggttaaaaaacaagtgttaaatgtaacagtatcagaagaaattccttctctggacactgcgaaaacaatggatggtacatcagcccacgttatgcagaatatatttgaggggttatatgtattaaatgatcaagatcagtctactccagccatagcaaaatcgtttaaaagaagtgaagatggtaagaaatatacatttgacttgcgtaaagatgcaaaatggtcaaatggggatagtgtaacagcaaatgattttatatttgcgtggaaacgtgcaattaaccctgaaacagcatctcaatatgcgtccatgctcttttatgtgaaaaatgcgaaagagatcaataagggaacaatgcctcttgatgcacttggggttaaagcaataaataattatacgttagaagttgaactcgaacagccggttccgtattttttacagttgttagcactacctatatacttaccacagcatgaatcatttttgaaagaacaaggaaacaattatgcattggaacctagtaatctcatatataacgggccatttgtattagaaaaatggaagcatgaacaagag

SEQ ID NO: 670 - DNA, 1113 bp, Bacillus thuringiensis
taaaataactcgtgtcctttctttgctttttataaaacatccacttattgttatttaatatatcttattcattttatttttgcaagtgtttaaaaaaattatttatttaatttaaaaaagtgaaaccaaatttttttggtttcacttcacaattttaccaatcttgtggttcgtaatttaagtctgcaaatagacgtcttttctctttcttcgttaaatctctccactgcccaactggtaaattattcaattcaatattcataattctcgtacgttttaacgtgtatacttgataacctaaagcttcacacatacggcgaatttgacgatttagcccttgtgttaaaataatttggaactcatattttgataactgtgtaatctcacaaggaagcgtttttgttcctaaaattttaacacccgctgccattttctctaagaaatcaggtgtaattggcttatctactgaaacgatatattctttctcatgtttgttttcagcacgtaaaatctcattaacaatatcgccatcattcgttaacaaaattaaaccgtcagagtctttatcaagacgtccaatgtgactaattcgtaaaggatgattcactaaatcaataatattaccttttactgatttttcactcgtacatgtaatacctactggtttatttaaagcgatatatacgtgatctcgagcaattcgaagctgctctccatttactcgtacatcatcacctgggttcacttggtcaccaatttttgcaaccttaccgttaataattactcttctctcattaattagtttatccgctccacgtcgagacgcttttccagcttcactaataaatttattgatacgcaaattaggcacatccttttctaaaaaaatttcaagctcacactgcttctaccgtacaatacaaaagggtaagcctcctattataacttaaatatattaacatgaaagggtatataacgtcttctattaattacttgtttataagaaaatatctttattatacattcatttatgcactttttcagcgtttaatatacaagccattcttccttacatacagcttggtttccttttatctcttctatctcttcatg

SEQ ID NO: 671 - DNA, 1084 bp, Bacillus thuringiensis
ctatcatccgaaatcgattccaatgtttattgtcggaatgattattgcagttgtaatcccatttactttaacatggttatttgcaaaaagagtgaaacagaagtaggaggatgttaaacatgaaggattggcataaaagtgtagtatatcaaatttatccgaagagctttaatagttattacaatagagaaaccggtgatataaaaggggttacagagaaactagattatttaaaagaactcggagtggattatatttggttaacaccgatataccaatcaccacaaaatgataatggatatgatgtaagtgattattacagcattgatccatcttacggaacgatggaagagtttgaagaacttttagcagaagcgaaagtacgtaacattgaaattatgcttgatattgttgtaaatcatagttcgactgaacataagtggtttaaagaagcgaaggaagataaaaatagtccatatcgtaattactatatttggcgtgatgaaaaaaataattggcagtctaagtttggtggatctgcttggaaatatgatgagaagacggagcaatattatttacatctatttgatgaaacacaagctgatttaaattgggaaaatgaaaaactgcgtgaagaagtatatgatatgatgcgcttttggctggataaaggggtaacgggattccgattagatgtcattaacttaatttcaaaagaccaatgttttttaaacgatgaaggtagtactgcgacaagtgatggacgcaagtattatacagatggcccgcgtgttcatgaatatttacaagagatgaaccgaaatgtttttgcaggaaaagatgtcattacagttggagaaatgtcatctacgacaattgataattgtattaaatattctaatcctgagcgtaatgaattaagcatgacgtttagtttccatcatttaaaagtagattatccgaatggtgataagtggacgaaagcagagtttgattttattaaattaaaagagattatgtctaactggcaaattgaaatgcaaaagggcggaggatggaatgcgtattttggtgtaatcatgac

SEQ ID NO: 672 - DNA, 2268 bp, Bacillus thuringiensis
catctcgaacgatcgctcttcttatcgcaacacgttggcgctgtccacctgataatgcttttggttttctatctaaatattgttcaagtcctaaaatttttgctgcatctttcacacgacgatcgatttcatcttttggtttttttcgaagttttaatcctaatgccatattatcatatacactcatatgtggataaagagcgtagttttggaataccatagcgatatctcgatcttttggaggaacatcattcattagtttaccatcaattgaaaactcgccttttgaaatatcttcaagtccagctaccattcgtaatgttgtagattttccgcatccagaaggaccgacaaatacaataaattctttatcttgaatgtgttaaattaaaatcagttacagctgttacgttattatcatatattttataaatgttttctaatttaagttctgccatggtatttccccctagaaataattatgcaaacgttttctttgagttcattataaacgaatagattcaaaaaataaataaaaaaataaaacgttttcatttattggagatttattagtggttttcatatgttttcttagaaaaagaacaataaaaattgtaagcgctattttaaattgagatagaatctgttatcattcattaatgaaaacgtttgcgccttaaaaaagagaaaaatgaatgatgaatgaaatggggtagcataatggaaaaacaatggtggaaagaaagtgtagtatatcaaatttatcctcgtagctttatggatagtaatggtgatggtataggagatcttcaagggattatttcaaagctagattacttaaaagagttagggattgatgtgatttggttatcaccagtctatgaatctccaaatgatgataatggttatgatataagcgattattgtaaaattatgaacgagttcggaacaatggaagattgggatgagctattacatgaaatgcatgaacgtaatatgaaacttatgatggacttagttgttaatcatacttcggatgaacataattggtttattgaatcacgtaaatcaaaagataataaatatagagattactatatatggcgccctggaaaagaagggaaagaaccgaacaactggggagctgcttttagtggatctgcatggcagtatgatgaaatgacggatgaatattatttacatctgttttctaaaaaacagccagatttaaattgggataatgaaaaggtaagacaagatgtttatgaaatgatgaagttttggttagaaaaaggaattgatggcttccgtatggatgttattaattttatttctaaagaagagggattaccagctgttgaaacagaagaagaggggtatgtttcaggtcataagcattttatgaacggtccaaacattcataaatatttacatgaaatgaatgaggaagtattatcgcattatgatattatgacggttggtgaaatgcctggtgtaacgacagaagaagcgaaattgtatactggagaagaacgaaaagagttgcaaatggtattccaatttgaacatatggatttagattcaggagaaggtggaaagtgggatgtaaaaccatgctcacttcttactttaaaagagaatttaacaaagtggcaaaaagcattagagcataccggatggaatagcctttattggaataatcatgatcagcctcgcgttgtatctcgttttggtaatgatggaatgtatcgcattgaatcagcaaaaatgttagcgacagttcttcatatgatgaaaggaacgccatatatttatcaaggagaggaaattggaatgacgaacgttcgattccaatcaattgatgaatatcgagatattgaaacgttaaatatgtataaagaaaaagtgatagaccatggtgaagatatagaaaaagtaatggaatctatttatataaagggtcgtgataatgctagaactccgatgcagtggaatgatcagaatcacgctggatttacaaaaggtgaaccttggattactgtaaatcctaactataaagagattaatgtgaaacaagcaatccaagatgaaggttcaattttttattactataagaaattaattgaactacgcaaaaataatgaaatagttgtgtatggatcatatgatttaatattagataatgacccttctatttttgcttatgtaagaacatatggagatgaaaaactacttgtcattgcaaactttactgcggatgaaagtgta

SEQ ID NO: 673 - DNA, 1867 bp, Bacillus thuringiensis
catgcaattcagtattataatatttcatgctatctggaagaaaagattaaagttttgaagggaaaattcacgccaaaagatagtgaaaccttttgcaggtgtcgaagaggttttgaaatttgcagataaaaatgtgattatgacccataaacatagggcaggagttatggacattttaaaatattacggctgggaaaaatactttgtagatatggttacaattgacgatggctttccccgaaagcccaactctttagcttataatcatttacataaaaagcataatattgatttagctattggagatagagaattagatttattacctgcaaaagaattaggtatttcaacatgtatgtttcaaggtaattgtgatgtagcggattattctttatcacattactcggagttttttaagatagtgagtgatagagagttttctttataaaaaaagttattaataaagactgaatcttttattttaaaggtacagtctttattttttagaactctttcattttattccgtaataacgggcagcctgattgcttcaactaataatcagtggagggtgaacaaaacctccactgattaaagtttcactttattttctgtatataataattactagagattaaaggataatcgtccatctttattaaggaagtggccagtttattttaactaaattatggttattcatgttaatatgcactcatagctatatagaaggggtggggttagtatgaaaactgaaatagttcctaaaaagaagtacagtataataagctatgtatctttactcatcggcattctgtgttttctattcgtttttataacgccaacaaggatagccaatgcaggtaatatagttggggattatattacaattgcccttacaggtgtaggtatcatgctttcaataatcacaatgacgaaaagaacagagaagaagggaattgctattctttcattaatactgtcctcatcattttttatattttggatcatagcaattatcctattgtttactggccaaattagttttgcgccgtaatgtgtaataaaaagagtccttctcgtatgaaggactctttttactcggtatcttcaggttgatattctaaaatatcccccggttggcattctaatgctttacatattgcttctaaagttgaaaaacggactgcttttgcttttccatttttcaagatagaaaggttagccattgtaattccaaccttctccgaaagttctgttacactcatttttctttttgctaacattacatcaatattaataataattgccatattattcacctcagaccgttaaatcattttctgattttatatctatagcatcttttaatagtctttggagaacggcagcaaagaccgcgattaccattgaagcaaaaatcataatcatcccgataataataatgccaggggcgtcatctctctctgccacgagatagaaaagtagcatacctaatacatataatacactaattgccaatgcgctgtacttaatattttttaaagcttgaacagatagctctgagaatgcgttatttttatcaatatagtttaaaagcttaaatgtttggtacagtgcgaagtaataaggtattgctgttgcgtataaattgataaatacaagatatttaatatatgcaatatctggatataattctgcggcgaaatttcctattttagggactaaaaaaatgcacatagcaagaacggggattccgatcagaattacaacggtctttaaaaagagtgtggatccttgtttcataaaaagcacctcatttatttaatatcttattgatttaacatgaaatttattgtttaacaat

SEQ ID NO: 674 - DNA, 1347 bp, Bacillus thuringiensis
gcagtgaaaaatattgaagaagtaccagatccagtatttgctggtcgtatgatgggtgacggtgttgcaatcgatcctactgaaggtgtagttgtatctccagttgatggtgaaatcgtacaattattccacacaaaacatgctatcggaattaaagcgaaaaacggtacagaaattttaatccacgttggattagaaactgtaaaaatggaaggcgaaggtttcgaagctcacgtttctgaaggccaagctgtaaaagctggagataaattaatctcattcgacttagaattaatccgtgaaaaagcgaaaagcacaattactccaattgttattacaaacacagatgcagctgagtctattaagacaactgtaggcgtagcagctacaaaaggttcaacagaagtaatgaaagttacaatgaaataattgcaatataagaggaatccgtttcgtatgaaatggattccttatttttgttgcatgttcagcatgtatgttaaaatactctaggcacttggaaatagggtttcacatatatgtggataaggctcatttttcttagaaaaaatataagagaaatgcgccttttgtatattcacatttcttttgttctattctaatgtaagttatgatgaatggtaagaaatcgaatataggggtgggtttgaatgaaacgagtgttatttgtttgtactggcaatacatgtcgtagtccaatggctgaggcgttgcttcgtcatcacggaggagataagtttgaagtgcaatctgctggtgttttcggctatcctgggagcgatgcatcggtacatgcgaaggaagctttagctgaaaaaggaattttaattggacatgccgcgcagcatgtgaaagaaacttcgcttgattgggctgatattgatgtaacgatgacagataaccataaacaaattgtacttgggcattatccgagcgttgaaaagaaattaaatacgttatatggattaactgaaggtataggcaaggacatttcagatccatttggaggctcgctttctatttataaagaaacgttagatgagatggaaaaacttgtacaaactttactgaaaaaacattcagtaggttgatgtttcgtgtataatacgatattggagatcacttcttcctatatgaggtagcgagtgtgaaatgaagataattgattgaaactttggaggggtaaaaatgaaagtagtaatagcatctgatcacggcggtatgaatatccgcaaagaacttgtaagtttattagaagagttaaatattgaatatgttgatttaggttgtgaatgtgaagctggttctgttgattaccctgacttt

SEQ ID NO: 675 - DNA, 1546 bp, Bacillus thuringiensis
aatcagttttttatctgataaaaatataggaggcgacataatgtttcgtacgatttcaaatttcatgagagtagctgagataagaaggaaaatcctttttacactagcgatgttaatcgtttttcgaattggcacgtttattccagttcctcatactaacgcagaggtattaaaagtacaagatcaagctaacgttctaggtatgttaaacgtatttggcggaggagcattgcaacacttctcaatcttcgctgtaggtattacaccatatattacagcttccatcatagtacagttactacaaatggatgttatacctaaattttcggaatgggcaaagcaaggagaaatgggccgtaagaaatcagctcaattcactcgatactttacaatcattctcgcattcatacaggccatcggaatgtcttatggctttaataatatagcaggtggacaattaataacagatcaaagctggactacatacttatttattgcgacagttttaactgcaggtactgcatttttactttggttaggcgaacaaattaccgctaacggagttggtaatggtatttcgatgattatcttcgcaggtctcgttgccgccattccaaatgttgcaaatcaaatttatttacaacaattccaaaatgctggcgatcagctatttatgcacataataaaaattgttttaattggactcgtaattttagcgatagttgttggtgttatttacattcaacaagctgtacgtaaaataccgatccaatatgcaaaagctgtttcaggaaacaatcaatatcaaggagcaaaaaacactcatttaccgcttaaagtaaatagtgctggtgttataccagttatctttgcttctgcatttttaatgacgccgcgtacaattgcacagctcttccctgattcaagcgtatcaaaatggttagttgcaaatcttgatttcgcacatccaattggaatgacactttatgtcggtcttatcgttgctttcacatacttctacgcatttattcaagtaaatcctgaacaaatggctgagaatttgaaaaagcaaaatggatatgttcctggtattcgtcctggtaaagcaactgaacaatatgtaactaaaattctataccgtttaacatttatcggtgcaattttcttaggtgctatttctatattaccgctcgtattcacgaaaattgctacgttaccaccttctgctcaaattggtggtacaagcttacttatcattgtcggtgtagcactagaaactatgaagacgttagaaagccagcttgtaaaacgtcattataaaggctttattaaaaaagtgaattaattattaaaaacacagttggttagttttccaactgtgtttttgattttatcagtcctgtaacatacagggctattgctttattaaattacatctccttttctaataaccggccttttttgaaataagttcgtagtgttgaacgaatggcccaaaatacaccaatcaatataagaccagccccctttccattgtggaattaaa

SEQ ID NO: 676 - DNA, 1073 bp, Bacillus thuringiensis
atttttttagaaaagtaacacaataccccccccccgcccaagctaatgtaaaattcacagcaaattacatgtcctttcgttcaaaaatcccatttaaaacgtaatgatacgatttatatataaaatataatcccgccatttggcccttgcaaaaacgagtagattccatttagattccccatgtttttatagttaaaaagatttccacccgcatatacggccagtaagtccccccactgattaaaagtttcactttattaaaacgattcgtatgtaaacaaactcactaatcggctttcgatatcctcgtgggcgagttttagtcgtatcactttttcctatcgtaatcattaaaacaggtactatatgctccggcatatttaattcactttgtactgctttttcatcgaaaccaatcattggacatgtatcatagccataatatttagctgcgtacataaaagtcatcgcgcttaacgaagcatttctaatcgcttcatcctccatgaaacgctctccttttccttcatataaacctttcgtttgcctaattgtatcttcatattcacattcatcaatcatttttaaaactttcataccgaagtaaatattttcaacattttggtatgcttttttatcaccacaaacgagcactaccgctgatgcactcgatactttatattgaccgaaagctaattcttttaatctttcttttcgctcttgatcacgaattacaacataatgtgtgtgctgcaaattatagcaagatggagaaagcttagttaactcaaatatttttttaaaatcctcatcagggatttctataccttgtataaatttcattgcagaacgtctagcaattgctaattcttcaaagttcaccatatatcctcctcgataactgtaaatttaaatatacattaatttatacaaatagataaatcaaataaaaacactttaaatccgaataataattatgattaacagcaaaaaagacaaaaagctgaaacaattagttcatacgaaattcacacgaatctattactatagaaactgtacatagtgaggttatt

SEQ ID NO: 677 - DNA, 1643 bp, Bacillus thuringiensis
gtgttgaagcttcaacgccaagttttaccagatctccaagcacctgtagtaattaatactagtcctgtaattgtacatacaataaacgtatctagaaaagtaccagtcattgaaactaaagcttgctttgcaggcgaatcagtttttgccgccgccgcggcaataggggcactccctaaaccagcttcgttcgcaaatacaccacgcgccattccgatttgaatagctgatgcaactgttgccccaataaaaccaccagcagctgctgtaccattaaatgcaccaaaaaaaataagtgaaaatgcttctggaatttggtcgtagtgatagaaaataattataagaccagcaattatataaaagaaagctttaataggaacgacatatcccgtcactttcccaattttttttacaccgcctaaaataacaattgcgattaaaaatgacattactataccagttaaagcaggagggaaagagaaattaattcgcattgcctctgcaactgagttagattgcaccatattaccaataccgaaagaagcagttgagccgaatatagcgaataatactgccagccatttcttacctaaaccacgctctaaataatacattggtccacctgaatattcaccattttcattactaacacggtattttactgcaagtattgcctcggcatactttgttgccataccgaataaagcggtaatccacatccaaaatattgcaccaggaccaccaattgtaaccgctgttgcaacaccggctatatttcccataccaatcgttgcggccatagctgacataagtgctcggaagtgactaatatctccagaagaagaggcatctcctgattctctaaatgctaggcagggagccgataatagtttactaaactgtaaaccttttaaacgcactgtgagaatgatacctgttccaacgagtagcaacaaagttggtaatccccacacgtattgattcatttgttctaatactttacttactgtctccatctttattctcctttatttagaaaaaataaaaaccacttcaagtaaatgaaatggtctctggagaaacaagggatagaaaaataaaccgatacaaatcggcattttctttcgcttgtctctgtccttttacctgagagattatccgctatagtagcggatttgctccttcggtgctcgttttcctccgcgctctatgaaagcgagagggagtctctccagagattcgtccccatgcagttctacttgtaaccaagacctgagagtttcaaagctggtataacaactttttgccccgtcggtagatcaatagaccttctcctgaatggttcatccgaattataaaatttataaacacattgattgtaaatcaataaaaatattatagacatacaaattgtgaattgcaatcattttttattttaaaatagtaaatagttttatttttttgtaagtcctaatttatcttcaacttcatttaaagtagataaagcgatgacaatatgttgatccgcaagtcctaaagcttgttttgttttttcaatagtttcatcggttggagtagagttatttgctccgtctataattaaatttgctgcatttttcatgaaatttgatgcggattaaact

SEQ ID NO: 678 - DNA, 2004 bp, Bacillus thuringiensis
gccctttcaaaaatcgtttcgatcccagggttataccgctacgatttcatactcatcgtatgccttcttatgcagtgggttatgtacaagactggccttgagacgaaagacgaattaaaagtaattactgtcttccacctcatcggccttttactagaaatatataaagttcatttcggttcatggagttatccggaagaggcatattcaaaggtttttggagttccactttacagcggctttatgtatgcaagtgttgccagttacatatgccaagcgtggagaagattgcatttacaaatgcatcattggccgaaagctatttttgtaatacctctaggagcactgatttacttcaattttttcacacatcattttctatacgattttagatggttcttaacgttacttctattcatcgttttctttcgaacatttgtggaattttcattacgaggcgttacatataaaatgccgctcgttctctccttttttcttatcggattctttatttggattgcagaaaacatcgcaacatttttcggtgcatggcaatatccaaaccaacgggaagcttggaatctcgttcacttaagtaaaatcagctcatggtttttactcgttgttattagcattatgattgtcacgcagctcaaacatttgaagcaatcaaaaagataatgctaattatgtaaaaacagttagcccatcaatcattagagagtgatgggcttttttttagtaatattttttaaaccaaccttatcaaaggagttataatttacaagagtataagcagttgcacattatgaactactactagcagaagatgttgctgcagatgaagcggcaatcgttgccatcatagcagcctgttgtgcttgtatgaggacttctatcattgtttgtaaacctgtgttggtagttttactttcctcacctttctgacttacgaacagttgaatagcaataagaatatttgtatctgtatgccaacggaacaatttatccccctgcaatttttcaataaatgctctaatagaatgaatctctttttctccatcctcgagtaacgctagtaacccgatagctgggtaatgcatctgttttacttttaccttttcttgctttaacaaattccatatatttgtgcattttgcgactaacagttcttccctgacatccttctttagtgaaagaatatgactcaaaaattgaagatcattccctttatgcaaaccagctgtcgctagtttctgataaaggcgttccactcggtccataagtgtgtctacattctctgattgtcctgctaataaaaccgcgagcggataatcatttgtacttgtaagaaagaggtgatcctttttcatgcgtttatatacttgcattgagcgttgaatgtgcgcgccatgctgttcattttcttctgttaaaagtacagctgctgcgagataagtaaatatactgcggctaaacccaccagtgaccaattgttcatataaatctaaaaactcccgaaaagctttctggtaatctgtaaagggaatatctaatgttgctgccactacaaaacgatgataagactttaagtatgaaaaacatccctacctgattcttaatataactactaatttctaaaaaacgtccgcgatcaaacagtttatcactacctgcatacatagcagcaatcatcattcctgttcgagaatctctcgttttccattttagttctccctttaactgtacatatgtatgtttatattgctccaacttttgctctaatgtaatcatagtattcacccctatttctagttcttctctatcattatacttatattccatatttaggaatactacaattaataatcacaccataaaaattataaaatcctcttatccttcttcatcagcatcacgatgatactccctaatccttcaagaagttaaacaaaaaaagtagataataatttatctaccttttttgtttatatcatttaacat

SEQ ID NO: 679 - DNA, 1504 bp, Bacillus thuringiensis
tccgtcatatgaataacccctaataatgctctaccaccaagaacacccaaggcaagaatggtaaatactttaatactagaaaaccaaaattctaattcagcataactttttgccgaaattgcgtttgaagcatataagataacaccgaatacaaggcaccatacccaaacatcaacatttggaaaccatcttttcatcattaaacctattgacgttaattctagacccactgttactgcccagccaagccagtataaccagccaatcataaagcccgttcctggtccaataaacttcgttgcatacttttggaaagaacctgaaactggcattgctaccgttaactctccaagacaaagcattgttaaatacataataaatccgcctactaaatatgaaaggatggctccccctggtccagcctgattaatggtgtaacctgaacctaagaagaaaccagttccgattacaccaccaagtgcgatcataaataaatgtctactcttcatcgtacgatgtaatttctcattcgttggttgctgcatctaaatcctccccctaccaatacccctatatcttgttaaaattttctgataataaaaatatacacgaaagcgattacattttctatataaaattaaaacttttctgataaaataatataaaaatcgaattattgcaagatttagattctatttagaggaaaataaggagaaacaaggaaaaaacccttacatatattgtaagagtcaacgaagttctaatcttctcgataaaattgataaactataatttacgataaagtacatacaagctactaatataaatgttggaatcatgtaattcacattttgcccgctaataatttgagcattatgcataagctcagggagtgatataacaaccgctagcgacgtatccttcagcaatgaaataaattgactgacaagcggcggaaccattctccttaatgcttgtggcaaaataatatgccaaagcgcttgcacataagttaatcccgaagatcttgcggcttcaacctgccctttttcaatagacaataaaccacttctaacaatttcagatatcattgctgcctcaaatattgttaaagcaacaattgcagctgttataatttctaatttcaagcctgcttctggaagtgcaaaatacgtgaaaaatataattaacagtagtggtaagtttcgaatcacttcaactataactcctaatatttgtgagacgacaggtattttcgtgtagcgcaatataccgattacacttccaataataaaactaagtacaattgctatgagcgctacctctaatgttataagtaatccttttaataaaaatagaatatgatctcctgtaattgctcccttgaaatccatttacaccgcctcctttgccaagcgtttttctaaataacgcactagcatactgagcggaattgtaatattaaataaaacatcccgacaaatatataaacatcaaacgtaac

SEQ ID NO: 680 - DNA, 1566 bp, Bacillus thuringiensis
atataaatgttttttatagaagtatggatgatgtacggaggcaattacaaatgaaagaaaataagaagagtaagaaaagacgaatctttcaagtatttttactaatgatttgttctgctattttatatgtaagttatgcagcttacgatatttggagttatcgttttaaagcaaatgatgacgtgaaaacggatgctggtatcgtactaggagcagcttcgtggaacggaaaaccatctcctgtatttaaagaaagaattaatcatgcgatttctttatataagaatggaaatatcaaaaagattatttttacaggtggtacaaagttcgaggcagaacttgaggaagcacgtactgcaagagtatatgcaatgaaacaaggtgtaaaagaggaagatattttaattgaaactaaatcccttttcactgaagaaaatttaaaaaatgcgaagcaagttggaatagagaacggaatacgcacatacacgattgtaagtgatccacttcatatgaaacgcgcaatgagaattgcaaaacatattaatattgaagcgtatgcttcaccaacgccgacatcagcatataaaacgttagacacagaaattccattcttctttaaagaattattctcgtatattggatatgtaacctctttgccattaaaggcattgaaaggagattaacataagaaaagaacctatccttaaataggaacttttcttattagtcaaaaacattgtatttttatcggaatagtgaaacaatagagaggtagcttcatataatcataatgaaaaagtgagcggttgatgaatcgaacataaaggagattatagtatggcactctcatttgttgaaacagaagaacaatctttcattattgcacaaataaataaattgattccgaagttcatggaaagggagcatcagctaagtgaattgggatcatttccgtatgaaaatataaatgatttgaaagatatcggatatacgaaattaacgttaccgaaggaatttggtggtagtgcgatttctttatatgactttgttttatttcaagagaaaatcgcggaaggctgcggagctactgcattatcgattggctggcatcttggcattgtgaaagagctagcggaaaatcgctcttggaatgatgagatgttcaaatggttttgcgaagaagtacgtaatggtgcgctctttaacagggcagcgacagaaccgaaaacagggagtccgacgcgtggcggcaaaccagaaacaatagcggttcaacaaggcgagaagtgggttataaatggaagaaaaacttttacaacgatggcaccagtacttgattattttattatttcagcaagtatggaaggccaagaagaagttggtgagtttgttattccaagaaatacacccggtgtatctattgaagaaacgtgggatagcgttgcaatgcgagggactgctagccacgaccttgtcttacaaaatgtagagatagaaagtcgcttttttacagatatagaaggcgggaaagtcaaacaaaaggctgatggctgggtgctacatata

SEQ ID NO: 681 - DNA, 1400 bp, Bacillus thuringiensis
ttttttaaatactcaacctgtgccttcaaataagcattttcttcttctagactattaaaattctttcgattccagacaccacgttgatcatcaaaggactccccttgttgcgcacgttttacccactcaataatctgggcatcgctcttcacaccgagttgttcacgaatttctcgcaatgattttctctcttctaatcgaagacgaactgcttctcgctttagttcttctgtatatttttgaaatgattgtccttttcttgccataaaaaaatcccctccagataaaacagtattgagtccatcatatcagatggactctttttttactgtctacctataggggataataccagatgcgtactctttttttgggtgattatattccatcttgaacagatttctttacaattacccatgtgtctttctttttaaccgttatagctacattagttccattagattccttataaaagatatatccattgtttgagtttacatatgtaactggttcacctatgcaatctcgcgagcaggatttgttgactagttcaattaaggatagttcacttggatcggttttactggcttctataacagcatcaaggcttgtttttcgataaccttgcaagtttatatgaaaaagctgctctatttctcctgtaatgctagtgttcattacttctactgaattctttttttcttgaagaaagccgttttcataaagtaattttgtatagccaatccatgctattaacactagcatgaaaaacatacccgtcattttaagtattcgaagtcgtttgcttataattgtttctgagtatttcattcactctaatcctccaatgtttttaatttaaaatatgcttggatacatacttttagaagaggatgaaagttaatgagtttttaataaaaaagaaaacatccagggtttaaaatgtaccctatagaatagacacttgaaaaaagtctattctatagggtatttcttgtataataaaaggaaaattgggatcggagaatgttgaaaatgacaaaaaaactatttacagaaagagaaattcaaattctatcaaataacctatacgtaaaatctgtaagtcagaaaggtatcacttatacagaggaatttaagcatatttttattgaggaaaatgaaaaaggaaagctacctcgaaatatttttgaagaatgtggttttgatatagatatgattggaatgaaacgagttatgtcatcgggaagtagatggcgtgctgcttatagaaaaaatggtgtattgggtttaagggatacacgtatcgaaagcgctggaagaactcttgagagagagcttacgttagaagaaaagtatgcccgtttagaagccgaacgaaacttactaaagggcgaaaa

SEQ ID NO: 682 - DNA, 1159 bp, Bacillus thuringiensis
aaagcatgcattttatccttaacatagcaaattatttttggagtgaatataaatgagcctattttcttttacaaaaatgcatggtcttggcaatagttatatatatgtaaatatgtttgaagagcacattcctgaagaagatttagcccttgtggccgaaaaggtttcaaatattaatactggtattggagcagacgggatgattttaatttgcccttcagacgtagctccggtgaagatgcgtatgtttaataatgatggttctgaaggaaagagctgtggtaacggtttacgctgcgtagcgaaatatgcgtatgagcataaactagtagaagaaacagttttcacaattgaaacgttagctggtattgtaacggctgaagtaacagtagaagatggtgtcgtgacattagcaaaaatcgatatgggagcacctcgtctaacacgtgcagaaataccaatgcttggtgaaggtgaaacaccatttattcgtgaaaacttcttatacaataatcatcgttatgcatttacagctgtttcaatgggaaatccgcatgcggttatttttgttgatgatgtagaaaaagcacctcttacaacacttggaccagttctcgagacacatgaaatgttcccagagcgagtaaatgttgagtttatcgaaattttgaataatgacgagatgaacttccgcgtttgggaacgtggatctggtgtaacgcaagcttgcggaacaggagcgtgcgctgcagttgtagctgctattttaaatggaaagatggaacgtggtaaggaaattacagtccatttagctggcggcgatttaatgattgcgtggactgaagaaggaaacgtgttgatgaaaggacctgcggaagtaatttgccgcggagtgtatgagtacaagatagaagcgtaaagatgtataatggactaagaacagaaaggaaggtgtatttcatgattgaagtaacagaacaagcagcttttcaaattaaagatatgttaaaagatgctgaagatggagagaagtatgtgcgccttgctgtacacggcggcggatgtagcggtctttcttacggcttaggatttgaagtagaaccaaaagaagacgacacagttcttgagtttttcggtgttgaatttgttatcgatacag

SEQ ID NO: 683 - DNA, 1034 bp, Bacillus thuringiensis
tatcatactcagtttttacaatactaggcggttgtttaacacatcctcagattcaccttttcttgtagcagtgcataatgtttaataaaattaaagcatatttttacttaccagacttaattttttcgttatattcttctaaagttaaccctttttcttttagataaacagcaacttctttccctacataacgatagtgccatggctcatacttaatgccagtaatattctctttatcttttggatagcggagagtaaatccatattctgcagcgttcttatctaaccatttgaatgcatcggtagtttcaaattttgcatttaaatcttctacagtattttgccattcaactgaaataatgtctaacgctaatccagtatgatgttcacttgcaccaggatactgaagatattccaatgccttagcactagcctctttatccgacaagccttgagatttatagcttttaactgaagcatcataataagtttgttgtaattttatagctcgataacctgatcttaaataaagattgattccctctttttttgcagctgctaccatatcctgataggaagttgcaattctactatctattttcatatttggcttcgcattttgagtgatacttgttaattcaattcctagttcctttgataacatatgctctctatttacaaggataattctccaatcattaacatcagagataggtaaaacatcttttttcttcgcatgtatttcatttttatttttatcgttattattagtagttgcctgagatgtttgctttccactacaagcagcaagactccaccccattgctaataccaatgctaaaattataaattttttaattgtatctcattccctttttgtttattagtctttataccaatttcccaacacgtctctaggaatctccttgaaatccttcaaagaaacgggaccgacaaattttttaattccatgttttttagaattttcatccgaataatcttttaaaaattgaattttaaattgtttcttacca

SEQ ID NO: 684 - DNA, 1415 bp, Bacillus thuringiensis
aatagatgcgaatggaaaaactgtaaatttagatcaaattcgagaagagggtaaaaagaaatatttaccgaaaacgtatacgtttgatgatggtgcaattgtctttaaagctggggataaagttagcgaagagaaaattaaacgtctatactgggcggcaaaagaagtgcgttctcaattttatcgtacagttggtagcgataaaccacttgaaagtggacatgctgatgatgtgttaacgatggttatttataatagcccagatgagtatcaatttaatcgtcaactgtacggatatgaaacgaataatggtgggatttatattgaagggacagggactttctttacatatgaacgtacaccagagcaaagtatttatagtctggaagaattgttccgccatgaatttacgcactacttacagggaaggtacgaagttcagggattatggggccaaggggaaatgtatcaaaatgaacgtttaacatggtttgaagaagggaatgcagagttctttgcaggtgcaacgcgattagatagtgtagtaccacgaaaaagtataattggtgggttatctaatgatcctacaaaacgttatacagcatcacaaacattaaatgcgaaatatggaacgtgggatttttataattattcgtttgcactacaatcatatatgtataataagcgcccagaaatgttcgataaagtacatgatttaattcgcgcaaatgatgtttcaagttacgatgaataccgtgctacattaagcaaagataataagttaaatgaagaatatcaatcttatatgcaaatgcttattgataatcgtgataagtatacaattccacaagtatcagatgagtatttaactcagcatgatccaaaatcgctttcggacgttacttcagatattacgaatgaagcgaaactaaaagatgtgaaagtaacaaagaataaatcacaattctttaatacatttacactacaggggacatatacaggaagtgcggctaaaggagaagttgaggactggaaagtgatgaatgaagcaacaaatgatatgttgaaacgcctttcaggaaaagagtggactggatataaaacattgactgcttattttgtaaattaccgtgtaaataatgctgggcaatttgaatatgatgttgtgtttagcggagtgaatacggaagaaggtacggctgtagaaaaagaaccaaataattcatttgaaacagcaaacccactatctttgaatattttgttaagaggaaccttgagcgatcaagatcagggggataaatttgttattgatgtaaaggatcaaaaagaattacaaatttcggttacgaacgaacaaaatcttggattgaactggtattatattctgaataagatctaataatatggagctatgc

SEQ ID NO: 685 - DNA, 1860 bp, Bacillus thuringiensis
gtcaactgggttagcagctagaatgccttcgtaacgtttgcactctttctctaaatcacttgccatcccgtttggtacataagtttgtttaaatggaagatgatcaaacaactgttcttgcatgaaatagtgatagctgtttttatcttcatgtggtaaatttacgtactcatctaagtttacagtggttacacggcttgtatcaagtttattttttcgcatttctgcataaatacctaatggagagcttcctgtagccattcctaatgttggattttcttttgtttttacaacttcttcaattaatttataacctgcttctgctagttcttctggagtttttacaacaagaatattcatttaattacttcccttccttcatatgaattcctaaacgaaccgtatcatatacatgtaaatcttcattcatcacaacaaagtctgcatcttttcctaccgctaatgcacctttattatttaatccaaactcttctgcttggttaactgatgtcatcagtactgcatcttcgattgaacaacctgtaaattcaattacatttcggaaagcttgatccatttttaaaatactaccagctaacgttccatcttctaatcgagcactaccatcttttacatgtactggctgtccgccaagctcatataatccatcttcaagaccttttgcacgcattgcgtcagtaataacacttactttttttggtccttttaacttatatgctaatttcaccatatcagggtgaatatgaatgccatctgtaattacttcaaccattacatctggatttaataacacatgaccaacaactcctggttcacggtgatgtaatccacgcatttgattgtataaatgtgtcgcatgtgtaatctttctaataattgttgcgcatcaattgcatctgtatgccccattgtgccaactacaccaggttcagcaagatattgttcaaactctaatgctccctcttcttctggtgcatatgttactaatttaattaaattcccacttgcttcttgccattgtttaaattgctcaatatttgcaggaacgatatgttcaagtggttgtgcacctgcacgtttctttgaaacataaggtccttctaagtgaatatattcaaaatgcgctcctttttcttttgcttcttttgcagcagttaacgctgcttcaattgcctctggagcttgtgtcattgttgttgggaaagtaagttgtaaccccttcttttaacatttctttacctagagttactaacccatcgctatttgcatccatcgcatcaatatcgtatccaccatgaatatgaacatcgatcatacctggaattacaatcttccctgtagcatcaaaaacagtttcattttcttgtggtacatattgagccatcaaaccaatttctttaatggtttctgcgtaacgaataaatccgttttccactatttcttgacctgtgtaaattttggcattgatgacaatttgcgttttcattttcatcgatcctttcccatgaattacctacttgttattattaccttattcgcctagttccatcttaatatacacacgagtagttgtctatacattctaataaaatttcctttttattcaacagaaaaggaaatttcttacgtctcttataattataatatatattattcatttttccaaaaagggacagtatcgccccctaatatagaaatcacttcaataatggcattaacccgctagactctaacataatatgttcaccatctgtttccatttctactgtacgtttattcgttctatataccattataccgtgcctttttaagcgtttcactacactttggtgaggatgt

SEQ ID NO: 686 - DNA, 1021 bp, Bacillus thuringiensis
aaatacttaatattcacttaaatacaagcatctttcaataaatcaatgactacttggtgtatccatttacctgtcgtatcatgtagtctttgttgttctaaatcattacaaattttatcctttacttcatcaaatggcttcaattcttttttatccgtcactttaataatatggtaaccgtaagttgttttaaccggctcacttacttggcctgcatctaatttatacgcagcttcctcaaattctttcactgtttgtccaggggcaaaaccagatatttccccgccctgttcctttgaaccagtatcttctgaatactgttttgctaaggcagcaaaatcttcaccattatttactttctcctttatttctttagccgttttttcatctttcactaaaatgtgacttactttcatttctggtttatagttatctttcacatctttatctgtaactgttgctttaattgctttctcaaatgcaatttctggcttcattttttcttttaattcatcttcatttttcaacccaagttgttctaaagtcgatttaaagttttcacccattttatcttttgcttcttctactttcttttttgcttcctcatctgaaactttatatttatctagcaatgccttacttaacatcatttgatataaagtactttctccatattgttgtcgtaattctttacttaattctttctctgtaacatttcctacttttgatgttactacgttgtctgaggaaccacatgcagataatgctagcatcatgcatgaaataattgttccaataaatattttcttctttttcaattcaaatacctcacttttatcattatgcaaattaactatacacagtcattgtgaaaacagtgtgttttctacatgtaattcatttcatatgagttgactatgtatcatgtattttcatttttaaatataaagagccttcctactatgcatagtaaaaaggctctttatataattctcaaaaaaatatagaaaaaatagttgct

SEQ ID NO: 687 - DNA, 1256 bp, Bacillus thuringiensis
cgcaacacctgtatacacttcatgtgttttccttgatagtaattgtaacatctctttcgcctcatcctcattagaaggcttaccaagaatacgcgactcatatgtaacaattgtatctgcacctaacacaatgtgatcactattattttctgccaccgctgatgctttttgcaaggcaagcgacattacaatatcagaaggcgatgaatatgcaccaattgtttcctctacttcacttacaacgatttcaaatggcacactagctaactcaagcaattccttcctccgaggtgatcctgaagctaaaattatttttctcatattttctccttcctttctcacatgaagcagaacaatttatattaatcgtatcaaaggaatagtttgcccacaaatgaaagaaatattaatttctctaactaaaataacacttctttattgcatacgattatattcccatcatagagaaagcactttgctctaaattcaaaagaaaagaaagaagtacatgtacttctttcttactcattttattatcctatcatttcactttctacgaaacaattttttcatacgagagtaaaccatcaataataacttgatttaatttcgccaaagattccttatccatcttcccatcttttactgtttgtacagctaccgacgtatacatatacagtttctttgcttcttctcgtttcatactttccccttctttttcaacctttttccattctttttcaattgcttctatatcttttgggctgctttttccaccaacttgtacgctagaagcatattttgctaaatgagtgtataatggctgcacttttgttaaaaatgtccctacttctttatcatctttcagcaatgctttatctgttatatcccagctcttttttaaaacggagacaccatcatttttatacttagtcattaattgatttatagactgttcatcgctagcaataccaacaactattgcatacttatcaccgctcggtctcaaagcaccaatgcccccattgcctttccattcttcaagagctgcctgtcccttttcttcagaagaataaagccccccttgaacaaaaaataatttcatcggatccaatgacgttcctgcctgtgctttttgtttttcttctttcggtgctggtgtttgttctgccgttccacccacccttgattctccatttccagtcggccttgaagctgtcacttcacttcctcctgtcgttccttgtccagtaagt

SEQ ID NO: 688 - DNA, 1363 bp, Bacillus thuringiensis
atcaattactttagagctgataaatttagcttccacgtattaagaaagcgtatgtaggtaaattcctttttagggaggtgacagcaagaagtaaggaacagcagcgtaagaataaataaatatatatcatttttggaggggtttctagtatgaagaaaaaagcaggccttttattatcattaacattagcagcaagtacagttttaggtgcatgtggtaactcggataaggcgagcagtgacaagaaagacacgaaagacaataaagacttcaaggttggtcttgtaacggatgttgggggcgttgatgataagtcattcaaccaatcttcttgggaagggttacaaaagtttggtaaagataatggtttaaaagaaaagacaaattatcgttaccttcagtctgaaaaagaggctgattatattccgaatttaaaaaaattctcgaaagataaatatgatttaacattcggaattggttataaattagagggtgcaattaaagaagtagcaaaagaatcgtcaaaacaacaatttgcaatcgtagatactgttgtagatgcaccgaacgtaacgagcattacgtttaaagatcatgaaggatcattccttgtaggtgcggtagcagctatgtcaacaaaatcgaataaagtaggatttgttggtggaatgaaaagtgatttaattagtaaatttgaaaatggatttaaagctggtgcaaaggcagtaaatccaaacattgaaatcgtatctgaatatgcagaagcattcgataagcctgaaaaaggtacagttcttgcttcagcaatgtatggtcaaggcgtagacgtaatttatcatgctgctggtggtacaggtaacggtgtgttcacagaagcgaaaaaccgtaagaaaaaaggtgaaaatgtttgggtaatcggtgttgaccgtgaccaacatcaagaaggtatgcctgaaaatgtaacattaacttcaatgattaaacgtgttgatgtagcagtagaaaaagtagctaaagaagcaaaagatgggaatttaaaaggtgggaaaattgaagagtttggcttaaaagatgacggtattggtatttcaaaaacaactgataacgtgaaaaaagttaaccctgaaattttaacaaaagtagaagagcttgaaaagaaaattacagccggtgaaattaaagtgccagctacagataaagagtataaagaatacgaagcttctctaaaaaaataaatagagaaatagcaaaggttagttcatagaactaacctttgtatgtataaaacttccgaattgcttaataagttaatagtgtaatagggaatgttccctgttaaaaggaggaacacaatggaatacgt

SEQ ID NO: 689 - DNA, 1862 bp, Bacillus thuringiensis
aaaagctgtatatagattttcttctggcttttcaccgaaacaacctgttaaaagtcctactgataatgctccaactactgctacttttccatacttcaacgttcattcctccattacatacggttatcatgccagaagttcactgggaagtgactttcttcatgataagcttcgaactcataacctttttcttttagcccttttaaaattgctggcacagcagcaactgattgcgggtgaatatcatgcattaaaattacttcttgtggttttgttgcgtttgttaatacattttgagcaatttgtgctgcagctgcatcaactggcattttattgtatttccaatctaatgaatcaattgtccaatcccatactttaaatccgccttctaccactttatttcgaagaccttcatttaatccaggcatcgaaccatatggaggacgtgttaatttaggtgatttcccaataatattagcgattaaaccttgatcttctttcatctcatttacatactcgccatttttatataactttgcgaaattatgtgtcatactatgcatgcctacataatgaccctcagcattttcacgtttcactaaatcaggaaattcttttacattcgctccaattaaaaagaacgtcgccttcgcatcatgttgttttagcgtatttaataattcagccgtatatttccctggcccatcgtcaaatgtaagataagcaacttttctttcttttccattaaaacgacttggtgccgttttattcatttcaactttcggctgttcacttgcaagctgcactacattttcttgtttcgcaacagcttttgctggtgaagtaattgattgaaacatgtaatacccaatagctactgcggcaatcgctattaaaacgactactatttgtttaatttttaaagctttttccattctatcgaattcctctccctattaatcttatatataaatcgcccaatataattatacatctatttatttttatttcaccatataaatagattttatttgtattataatgggagttttatcaaaattgttgttcctattccttctttgcttgtaacactaagcgcaccgccatgaagctctaccatttttttaacgatagctaaaccaatacctgcacctgcagcatgattattaatttggtaaaatgattgctcaatatatggtaaatgttctttagcaattccaataccttcgtctcttaccttaatcactgcttgtccttctattttagtcgcttcaatgtgtattgtgcttttttcatgtgaatacttaattgcattttgaacaatattcaagaaaacttgctttagcctatttcgatctcccatcaattcaattcggtctatagtagtaataaattgaatttccttctcttccgatttaggagttaattgccaaatcgtctcctctagtatatcgtacaattgcaccttttgtttatataaattaaaatgatttgattgtaatcttgaaaaatctagcaattcttctactaaatgaattaacctatctgtctcacctgaaataatgcccataccttgctttatttcttcttctgttaaatgatctactgtttttaacgtctcactccaacctttaattcctgttaaaggcgttcgtatttcgtgcgaaatagaagcaatgaattcatttttcatctgctcagccttatctattttataggccatataatttaaactatgtgccaagtcacctaattctccaggataatcttctttaattttttgctttaatgtgccttctgcaatttgtgaagaggcctcgaataatggattcaattggctcaacaaatgaattttgccaaac

SEQ ID NO: 690 - DNA, 1545 bp, Bacillus thuringiensis
gtgatgaaaatgtaattttaataggtgaagacgttgcaggcggtgcacaagttgatcatctgcaagatgatgaagcttggggtggtgttcttggtgttacgaaaggacttgtacaagagtttggccgaaatcgtatattggatacaccaatttctgaagcgggttatatgggagctgcgatggcagctgctgcaactgggttacgtccgatagctgaattaatgtttaatgattttattggtagttgtcttgatcaagtattaaaccaaggtgcaaaattccgctatatgtttggtggtaaagcgaaagtgccagttacggtacgtacgatgcacggtgcaggttttagcgcagctgcacaacattcacaaagtttgtatgccttatttacgagcattccaggtataaaagttgtcgttccttctactccatatgacgcaaaaggcttattattagcggcaattgaagatgacgacccggtaatcttctttgaagataaaacactttacaatatgaaaggtgaagtgccggaagggtattatacaatttctttaggaaaagcagatattaaacgagaaggttctgatgtaacaattgtcgcaatcggaaaacaagttcatacagcacttgcagctgcaaagcaattatcgaaaaaggggcttgaagtagaagtaattgatccacgatctttatcaccgcttgatgaagatactattttatcatctgttgaaaaaacaaatcgtcttatcgttattgacgaagcgaatccaagatgtagtatcgcaacagatattgcggcaattgtagcggataaaggttttgatttgttagatgcacctattaaacgaattacagcaccacatacacctgttccgttctcaccaccacttgaaaagttgtatttgccaacgccagaaaaagtaattgaaactgtatcagaaatgattggagaccaatctttattacatgtgtaataaaacgatgagaagggagagagacacatggctgtagaagttgtaatgccgaagttaggtatggcgatgaaagaaggtattattacgagctggatattaagcaggcgataatgagcaaaggagaactaatgctagtattattcagaaaaaattgaaacggaaattgaagcgccagctgatggtacggtacttgatatagctgtaagtgaagatgaaggagtgccgcctggtactgtaatttgctacatcggtaaaccaaatgaaaaagtagaaatgcaggaaagcacacatgtggtagaagaaaaaacatctaatatagaagtacaaaatcaagaaccaaatgggaaagaagtagcgaagcaaagaattaaaatttcacctgtcgcgaagaaaattgcaaagtctgaaaatctggatatcaaggcattagttggtacaggtcctggcggcaggattacaaaggcagatgtattaaaggcgctagaagacacagtagcatatccagaagcccccaatcaagaagaaagtgcagtcgttaaataaaactggtatgagaaaagcaattgcgagt

SEQ ID NO: 691 - DNA, 1128 bp, Bacillus thuringiensis
tgaagatgttttagtcgatgaagatcctgggtaggagagagagtatgattcaggggtgcaatttaactaagctacaacagcccatcgaacaacatttaaaagaacttgaaaacaaattggaagctcgtatcatctctattaataaaaggattacttctggaaaaaacaaatatgttcaagtgaaaaaacataaaaatcatcattcttggacacttccatatactcgatcttcatctcttattaatcattcttttttcgatgtattaccacaagttgatatgaggagtatcctgtattttgtaaatcagcaatgcaattttctagataactttgaacatattctgggacgctatgccaatcaaaaagcaaaggattatactctcattccatgtttaatagcttggggaacaaatatggggttatatagaatgggagaagtctctgatatagatttttcaaaattagctactacatcagctaattttattcgattagaaacattaaaagatgtaaatgattgtatcagtaatgccacaagtaagcttcctattttcccgtattttaacattgatgatttcatccattcaagtagtgatggccaaaaatacgaaacacagattcatacactacagtctcgtcattcttctaaatattttggaatgaataaaggaatcacttcgtatacaatggtggctaaccacattccaattcaagcaagaattattggtgcaaatgagcatgaaagccattatgtatttgatattttatacaataatacaaccaatataaaacctactatccattctacagatacacatggaacgaatgaagttaattttgctattttagatttgtttggttaccaatttgcacctagatataaagatattcaagcaacgatatctcgaaatttatatggttttcaacatccaagccattatgaagaattgctgattaaacctgtgcgtaaaattaatacagatctcattgtaaaagaatgggacaatataaaacgaattatggtatctcttgctttaaagacgacgactcaaaatgttattgttcgaaaattaagttcttatgcacggaaaaatcaaaccaagcaaaacactatgggagtatgataac

SEQ ID NO: 692 - DNA, 2312 bp, Bacillus thuringiensis
gtctcatattgacagttaacgacctacgtggctggaagaaggagttgccaattatttagggaatacggatcttaatgtccaaaaagtgctcccaaccttggtttctgcggataaaatacctaactttgacgagataaatgggccagcattcgtgtatagaaacgggtatccatattcctatacgatcgtggaatttttggtaattaaatatggatatgagaaattaaacgacttcattcgacacccagaagaatataaccgaatatttggcgtcagcaaatcagaattacacagtctttgggttgattatttaaaagcgaattatagccactgatccaagattgtttgccgcacgcgtatctctctgattttcacctgtattatgatcgttctcgatgttttccactttccggtacttggtcctgctgttcatacaactatggatataaaaattattttatcaatatttataatgagctttctatactgttggatttatgcaggtttttgcagaataatgatgaatagattatataaagtgttgtattgacaatggcataatgaggatttggagattgaattcatgactaacgttgcagttagaagaccgaatttgaatgatgtagatgaactatatttatttttccgtatagttattacgaatacatacaaagatgaaggattgtcacaattattagatgacatagaaaatgaaattaactcaaaaaagcagtatttgaaaagtgactttgatagtaacggagaaagtcgttactttttattagcaattgatacaagtaacgataaaatcattggaacaatcgaaatcggtccagcaagtacattgattaatagttgtacaggtggtgtacttaaaaatttgtatgaaataggaactgtattcatacttccggagtatcagagaaagggaatagggagtttattactacatccaatgtttcttacattacttagcagagggataacagaatattgtttagatagtggatataaaaatgcgcaaagtatatggatgaaaaagtttggaaaacctagctatgtattgaaagattactggggagaatccagtgatcatatgatttggaagaaaagtttacatgatacacctataatatttgaattataaaatgaaatatgcctctgaacatagcttttcttacttatgtatgctattatttatctttataataaaagaggacgtgaatgaacttgattaaaattaaaattcctgaagctgatgtttcaattactgaacgtaaacaagttattaaaggagacgagccaatcattactccaattaatggatttatcgatttccacttgttccctagagataaaggcggcatttttatgttttacaatattaatgacgaacttcttttcgtaggtaaagctcgtaaaattagacaacgtattaagaagcattttgaagataatgtttcaccaattaaaaatcaccgtgatgaagtataccgcattgatgcatgtatcgtagaagatccaacagaaagagaaatttacgaaacatatatcattaatgaatacaaagcgaaatataacgttgataaagtattctacaaataatcaacattaataaaaagcaatcctagctaatatgcaaggattgttttttatttagatttattcttcatatctttctccttttttcaaatgattagcagcaacaaaacagattacacctataaatataagtacaataccaaccgttttatgttttccctcaaagaaaggaatatctgaaataacatttgtcatacatagtcctaaaaatacaaggatagggcccacccaaagtaatacattaccgaattttgtgtgcttccacataataaccctccttaaccctctttacatatatatccataaataaaaagtaaattcatagagaaatatagtttttttcatatcgaaaatttaaccctcatatattggtacaagcaaaagagaaaggagaccatcatgaattggttagaagctttcatactaggtataattcaaggtttaacagaatttttaccaatcagtagtaccggacatctttatttaggaaggcatttgttccgattagatgaggctggcttatttttagatacgatgctgcatattgggactttacttgcggtttttatttattacaaaaaagaatttatatatttaattaaaaacccattttcaaagctcatgttattacttatcgttgggccaatacccgcagttgtaattggtttattgtttaaagacttctttgaagatatttcaaaaacaggaat

SEQ ID NO: 693 - DNA, 1464 bp, Bacillus thuringiensis
tcaacgtataagtgagccaaaaaaatttaaaagaagagttcgataaaaagctttatattatcgaatcagatataaaggtttcattttcactattatctgttagaatttcgatataaagtgctaatagatggtttaggtaatttgaaaaaagcttttgataaaatagatgcattgcctaaaccaaatgatgaatattctaattattattattatttattcaaagccattcattatacaattcttactaattatagtgaagctagcaactattttgaaaaagctgaagggttattagagcatatttcagatgaaattgaatatgcagagtttaattatagagttgctatattaaaataccacttgcattacgcatattcagctattgaatacgcttcaaaggcaagagatatctttgttaaacaagcagggtatgaagtgaacatagcgctgtgcgaaaatatattaggattatctttttcggaattaaagcagcatgataaaggtgaggaatatattgcgtcagcaataaacattttacaaaaaaatgatgcagaaatgttagtattaagaatcagacataatttaggtttattgtatgcgagtcaaaatctttcagttttagcaattagacacttatctgaggtttctaaaaaaatgcctactcattataaggcaatctttttagaggcaagagaatattataaattaggtgaaatagaaaaagcgaaggaattaattgaaagtggattgaaggtttgtgaggaattaaaaaatgatgaatatagatatcactttttaattctaaagggattttgtcagcatttagaggtagaaaaaatagaaaaaattattcttgaaggtttttcttactttgaaagaaaaaatttatcggagtatattcacgaatatactgaaagtctggcattagagtttcataaagtaggtaatatagaaaaagcagaaaagtatttttttatgagttatgaaataaaaaagagaatatttgaaaaagaagcattaaaataaagaaaaaacttggattatctataatgggaatagcagctggagttatggggttttatggtagaaggtctttgcaataaattagctcacagtggatatggtggaacgtttataattataaaacctaatgaaaatccatatgctgtctctgaagatacaacgatgcctgcaaaacaaaccttctattgaacgtgggtaattaaacaagtcacaaattataatttgtgacttgtttaagggtggatactaaatgtgttgctttcaatattgaaagcaacttttaagtttgtgattaatagttaacttaataaattttgggttaaaataaaaacaaatttttaatcaagtcccacaaaaagtacgataagggcgattcgtcggtgcaagcggaatgcagtattcttcttgattttgtaaatacgcataaagatttgataaagc

SEQ ID NO: 694 - DNA, 1228 bp, Bacillus thuringiensis
  unsure (1)...(1228): unsure at all n locations
ttgtaataattgaatttgctgtaattcatcttctgctttcgtaggtaatgcaacctggaataatgtaggagattctagttttattaacgctcttcctgctgtttcttccacttttatatcagatctccctacaatactagctacttcactttgatcaatcatatatagacaagtttgaattttaatattattgtacaattgaattctaagtgcattttgtcgccctgcactaattaaggtatgaattcctaaacttgcaccatctcggacaatttgcataattagcatttcaaagctttcatagaacttcgcttcttttactgcatcataattgtcgatcgcaataataatatgtggtatttctttcccacttgccttttcatacatttcaatatttgcaacgtcatattcacttaataatcgtttacgatttttcatttcttgagttaatctttcaacaaactttaaacatttttcagattcatcaatcgtaatcgtatccgctacatgaggtaatccttttaaaggtagaagaccatttgttccaaggtccactaaatacacatgcaaatgctccggactatgctggcgagctacatccataatgactgattgtaagaatgttgattttccgtagcctggacttgagaagaccgctacgtgtccgtctttactaatatctaatgttaatggtgtttgtgattgtaattcaggctgatctagtagaccaactgttgcttgtaatggtttcttttctttcgtccatgcttctttgaactgaatagcgtgtaagtcttgtaaatatacgctttctggaagtggtggtaaccacggtctagctaacgcttcaatttcatttatttctgcgtaatcgtgaatgtagtcaataacagcatccagttcagatggtacgcttattacttctttactgctaccaagtccacttaagtcttcacttaatatttcatattgtcctagatcatttattgcatagattgatgcgtctaaatgttctttatcctctttgttttctacatagtctgctccgctccaagctgattggaatagttcataaatttcattattcccaacttgtaagtaagcacgtcctggtaatgtaatttcagcagcatctggtggttttaaaatttcattactatctgatgtantttgcacttttaatgctagtttgaatttcgagttacttcaaatttgatcatctacaaca

SEQ ID NO: 695 - DNA, 1509 bp, Bacillus thuringiensis
ttcggggaattaaaataattggtgatacattaaaaaatgaaatttggagttgagaaaatgaaaatcggtgttattatgggcggggtatcgtctgaatcacaagtttcaattatgacggggaatgaaatgattgctcatttagataaaaataagtatgaaatagttccaattacattaaatgaaaaagtggatttaattgaaaaagcgaaagacattgactttgcgttgctcgcgttacacggaaaatacggagaagatgggacagttcaaggaacactggagagtttagggattccttatagcggaagtaatatgttatctagcagtatatgtatggataaaaatatttcgaaaaagattttacgttatgaaggtgtagaaacaccagattggattgaacttacaaaaatggaggatctaaatcttgatgagttagataagttaggatttccattagtagtaaaaccaaactctggcggatcgagtgtcggagtgaaaatcgtttataataaaaatgaattgatctcaatgctagaaactgtattcgaatgggattctgaagtagtaattgagaagtatataaaaggtgatgaaattacatgttcaattctggatggaaaacagttacctatagtttcaattcgacatgcagccgagttctttgactacaatgcaaaatatgatgatactagtacagttgaggaagtcatcgaacttccagtagaaattaatgaacgtgtaaataaagcgtcacttgcttgttataaagcattaaaatgtagtgtttatgcaagagttgatatgatggtgaaggacggaattccatatgtaatggaaattaatacattaccagggatgacacaatcaagtttattgccaaaaagtgcagaagcggcgggaattagttatagcgaactattagatatgattattgaaacatcattaaaagttagaaaagaagaagggttttaagggaattatataactaattttttgacagtttcacgaagtatgctatgatgaatacattataaaaacaaaatatttatccactaggggggccttttataggctgagatcaaatgtgattttgagactcttagtacctgatctggttaatgccagcgaaggaaagtgggaaagacgttgctatttaatgagtaaataaatactgtcgatttcactttctttacgcctgtaaagaaagtttttttattttacagctttaataattgtggataaatacttatattttatacattattggagggatttaaatgactttttcacaatcgttacgtaaagaagtagattcaatttgggaagcgagttttaaccatccttttgtaaaaaaacttggtgaaggaacgttagatttagctagttttcgttattatgtgcttcaagattcatattatttgagccattttgctagagtacaaactttaggagctgcgaaagctatagaaaagagacgacagctcgtatggcacatcatgctatcacgaa

SEQ ID NO: 696 - DNA, 1106 bp, Bacillus thuringiensis
ggtcgactctccgtacaatacgtatgttgtaaaaggattaccggtagggccgatcgcaaactctggtagacattcagtagaagctgcgttagaacctgcgcaaacagattattattatttcttagctgcaccaagtggtgaagtgtactatgcgaaaacattagaagagcataatgcattaaagcaaaaatacattacgaaaaaatagtgaaatggggagggatagcgaaaaaagtcgcacatccctcttttttgtggtaaaatatatcgggttaaaaactggcagaagaatcgtttttaatatcaaaacgggacgtacaagctaaggataaagctggcttgtatttttattgcattctatgtgtgaaaagacgtcatagaggcacttctccatgtaaataaggaggaccatttatggaggatgcagttaacgagtacctattatcatttattgatccgaaagataaattaattcttgaaatggaagaatatgcaacagaaaatcatgtgccgattatggatcgacttggaatggaatttatgctgcaatttttacgtttaattggaccgaaaagcattttagaacttggaacagcaatcggttattctagtattcgtatgatgcaagctattccaaattcacgtattgtgacagttgagcgcaatcgtgagcgatatgaaaaagcacttgaatatatagaacgttccccagtaacagatcgtatttcagttatttacggtgatgcgttagagacaggtgaacaagtaaaagaacacgggacatttgacgttatttttattgatgcagcaaaaggacagtatcgtcgcttttttgacttatatgaaccgttattaaatcctggtggcgtaattatttcagataatgttatgtaccacggtcttgtaacgacaaaagagaaaattgaaaacagacgtacacgtggtttaatccgtcgtattaagacgtacaatgagtggcttatgaaccatgaaggatatgatacaacgattttcccaattggtgatggagtagctgttagtaaaaagagagggtgaccaaggtatgaagaaacctgaattgttagtaacgccaagagcggtggcgg

SEQ ID NO: 697 - DNA, 1943 bp, Bacillus thuringiensis
gttagagtgtctttcgtattagtaagtgaaataaccgcttgattagccaaatcagctttcatacttaattctccgattttattcgaaatttcattataagaattcatatgattagatgcctcgacgccagctgctgttcctaaaccgataccagcggctcctagagctgtaagaccaccaacaacagctggcgtagctgtaccaccagtcacaacaattactaccgctcctgcaatcgttccaataactaaaatagctgctcctaatccaccaccaattgaccaggctaatacattatcaaaatgtgttttctgtgtagaacgtaaattctcaatttcggcctgaagttgtgggactagcgcttgttttcccgctaatatagccgtcaatcctccctgtccatctggaccaccaacattatttttaaaatctacagtatttgtatacaactttgttttgaaagcctctaacatcttaatgacttccgtaacttcatttgaatttgtatgaattgtatagattaaatcccctattccttctttgaggctcaccttatccttcttttttacagtatctactaatgtgtcgtaataattttgaaattgctcatcataatttacaatattacgtgctgttttttgaatgtttggcttcgctgtatctaaccagtaatttgcattgattcgtgacagttcttgattcaggtgaatatttttgattaattcttctccacccgaacctaaatcaatgttggataaatttacattcggttgcttaatcatagtttttgcgtacaaatccattacaagaatatgagagcctgtttcagccaacgctttctttaatccttcaggtcctaacgcataattttctattttctgttcttgagctgtctgttcttgtgcaagtgcatgaatagtactaccatttgtagcggttataatcgttgctaaagtagctaaggttataactttaaatggaaatttcatcatttgattctcctccttattttccgtttcgttataattttttaataaacctaatttcttaatatcaaaatttataaacttgttcttcaagttgaattgttacactttttaatcgtcttaatatatctttttgagcctgagtattattggtatcaacttcagtcgataattttgtaatactattatttattagatccaaatcctctttgtaacgtttcattaactcaatttctccatctacttgattagtaaatgtatgcaagtcattttgcatgaaaagaatcattgatttttgtaaatctgctactgttaatttagttgttaagtcatataatttctgattttgtttctctaaatcatttaaatatgctctttgctcagctgttagtttattaatttcagcacaagtattatatgttttttttattttttcaggatcaatcactttcataagatcatactctttcgtttttgtaactgcagctgcagcgatttcaccttttttacttttctctatcgtttcacgtgcttcttttttggcagcttcaatttctatagctgattttcccttttcttttgcttcttgctctgctttcttctctgcgtctacaatggcattgtttatttcttttcctttgttatacgctactactgctgtttgagcagccggttcaatgatatctttcgatagactataaatttcttggaatacctttagcccttgttcatttaacgcgcctggtaataatgctatttgctgcaaatcattttgaatagatttttttgtatctagcatttcattttttaacttatctatatttcctgttccctctgaattaaggacactttgtgcttttaccacatcagtatcaagggtttttcaacttcttatctaccagtaatttaaatctgttaactcattaatttgacgttgcacactttcttgatttgtat

SEQ ID NO: 698 - DNA, 1164 bp, Bacillus thuringiensis
cgggtccccaacaggtggcctagagctagccaaggctgccgacgaatgcagaccaactcataataaaaatgtacatctatccacctgaactcaatcttttgacatacaccctttttcaatgtgataattatattgcgcccactcctatttcttcttgcgcgctacgaatgctccattttgaaatgccaataacaccgtttcaaacatttcatcttcttctatcatttttttaaactcggctaattcatttgcatgagaggttgcgttatcaacaacaagaaaaccctttggttgtaaaatgcgttttatatgctcaagccaccacatgtattgcgtacgctctgaatctaggaaaataaaatcaaatgaatgatctaattgcgcatctaaaaatgcccctgcttcttgattatgaacatcaatcctttgtaaaaggtttgccttttcaaaattgacaagtgcctctccaactcgttctgaagaaagctctacagttgttacatttccatttgtttcttctaccgcattagctaaccacaatgtagaataaccattagaagttccgatttctaaaatgttttttgcgctacacccttttactaaaattgataaaaattgccccatctcacgagtaatattccgtaatttttcttcccttgtttttttatttcgatcatgctcttctccatattgttcaagttgaaataataataaatctaacgtatccattttttccatcgcctttccaaagcaatatgatgaaaaagctcttgctgcccgtctactttcattatatgcgaaacaaaaacctttttcctgttatatgacaaagatttgaatttttttatagcatattgtttcgttttttggtaaagttaatttctacgtgcaattattccattcatattatttcatattaaaattgcagttattaaattatataaaccccatttaaatgaatcggtatttcaaattcaattaagcgcccttttcggacgcattttctttgtttatatatttccagaagaaaggatgcttacaaatgaacgtgattagcttagatgctgctagaaaacgaaagcagcataaaaaattaatgattactataccgattattacacgtatttatgaagaagacggggaaattaaatttgaggtagctgg

SEQ ID NO: 699 - DNA, 1294 bp, Bacillus thuringiensis
ttgtactatttttaattattggatttacttttacaaaggatatttatttttggcttgtaaaagatttaccaatgaaattaactgttctcggtccaagtgatgtattgtggatttttttctcgattgctacagtatttgctatcgtttgtacaattccttttgctgctatacaaatttggttatttgtaaaaccgggtttacatccaaatgaacaaaagatgacaataatgtatataccggtattgtctatattatttctcgcaggtttatgttttggatatttcattgtaatgccgtttctatttcactttttaactacgataggtaatgaaatgtttaatacgatgtttacgacagaaaagtattttcattttgtacttaatttaacagttccatttgctgtgatttttgaattgccagtcgttgtaatgtttttaactagcattggaatacttacggcggaatttttaataaaaataagaaggtatgcttacgtagcattaattatcattgcatcttgtatatcaccgccagactttttatctcatagtttagttgcagtgccgcttatttgtatttatgaagtaagtattgcgttatcaaaggttgttagtaagaggaaaaagaaaagagaagaaatgcagccgaaaagtgcctcgttataaaggcacttttttatttatttgttatactatagctataaacgtatacaatatatagaagaaaaaaattatagaatctccaaaatttagacaaactttgcgcttttataagcttatactaaatgtattaaacaattgatggataatgagattcccgtctcagagatatttaggacgggaaggtgaattaggtggagatgaatagagtataaatcttctagccataaggactacagaaatcatataagtctgattttactccactttaaacaacgtgttacagcgcaaagtagaggaagttcaaaaatccaatgaaaaagaggattgatattgtgattacgaaaagtttttatttcactcattcaacaggggattgcattaaaatattcgaaatccctgtcctacaggcacagcatccattatcgtttctaattcagtctcgtcttcaattatttattgcaaaaattcaaagacaaaaacacccaagattttcgtattctttccgtgaatatttacaaaattgtttgaagtggaatgattatttaaatgtatataaaacaaatacccttgaaaaaaatgcatgatacgaagtacggacagggttagtaaactctgtctttttattttagata

SEQ ID NO: 700 - DNA, 1405 bp, Bacillus thuringiensis
agcaaccttttatcgcagaacttctaaaacgaattgaaacttcaaaacagcaagatgttgagctaggtacttatgaaatatatttgtttagtgaaagtgaattagaaaaaggacaaatcggttaccgatacgataaacataaaaattcattaataagtgaagaacacggaaaatggaaagaagaatggattacaattggatatgaaacggatatgggcgatccagttttcgtaaatatagatgatgccgcttatccgctttatactgcagaacgtggtacagaaaaatggcaaccagtttatattggaaatatagatgagattatagggcaattataagaaaaactttgaatccggtgcaaagtgatgggagagaagtatgaagtatataaaaataatgagcatgattgcattcattggaatatatatggccggttgttcacaagggcagccgaaaaaagaaactacatcttctatacaagagaaaaacaaagataccaaagaagacgcaccggtagaaaagcaacaagaaaagaacgaagaatcgcaagcaattcaaacgaatgagcaagtagaacataagcaagaggaagtatcatctgatgaaaagaaagaagaaactacgccagtgcagccgactgagcaaccagtgcaaaataatgaacaaaaagtagagagtaatgaaaaacaagagaagtttctcgtcgttattgatccagggcatcaacaaaaagcgaatttaaatttagagccgattggaccaggggcaacaacgcaaaaatataaagtgacagacggtacaacaggtgttgtgacgaaaaagagagaggctgtacttgtattagaaatggcttttttattaaaagaaaagcttgaagcaaaagggatacaagtattaatgacgagaacatcacaagacgttgatataagtaataaagaaagggcgacattcgcaaataatcataaggctaatttatttttacgtcttcatgcagatggttctgaaaatccaaaccaaagtggattcgctgtattgacgccggcagaaggaagtccgtatacgaaagagatttatgcggaaagtcttcaaatctctcaaacgattgtaaataaaatgagagagaatcaacaagtgaaagtgaatggaattaaattcagggatgatctttctggatttaattggtccaaagtacctggtgtactattagaacttgggtttatgtcaaatcctgaagaagataaaaaattatctgactcgcagtatgtaaattccttgttgcaaagtgtaacggatagtgtagatgaatatcggaagagtaaagcttaaacgcagtcttacatgaaagactgcgtttttttatatgaaaacactcgtaaattagaatattatggattaatatgacatg

SEQ ID NO: 701 - DNA, 1302 bp, Bacillus thuringiensis
aaagtggcaaaaggtaaattccgtgctgttcaccctcttgtatatgtatttggaattttgtttgcttatcaattgatattcttaccacattaaaaaagtagagcatcgaaatccgatgctctacttttcttttacaacaatcattcaaactataaaggcacctccaaaatatgaagaaggttataaccttttaatacttctcttctacctttaattctttactatacttttgaatgaaaactgatgaaataaccattactatgcccacactaaaaccaataagttgatctattaacatttcatcatgaataaaccagcgaagtaaaaatacgctaccaaaaataaacatcataataaacccagtatgcctaagtcctttatagacattttccatatgtatcacctcttcacatagcattatccatattataccatacaaccatcaagtaaccgtatcgtcctctgacaatatgcagctaccttttgatcatgtgtaacaactaacactgtttttccttctttattaatctcttgtaaaatactcataattttctccccattttcttgatcaagagcaccagtcggttcatcagcaagtataatttttgtatcttgtgctaaagcccttgctattgctgttctttgctgttctcctcctgataactcgtaaggatatttgttaatatgcctctcaagccctaccattttcagcatttcttttgatatttgcatacgtttcttatgagaaattcttctatatataagcggaagcattacattttcaacaactgtataatcatctaatagcgaaaagttctgaaacacaaatccaacttccgtgtttctatacttatgataatttgacttgaatgtactcgtatccattccatctaaaaaatactttccagtagaggggctatcaattaagccaataatgttaagcaaggttgatttcccagaaccagatggtcccataatggctatcatttcgcctttttctattgtaagattaatatcttgtaaagcactaaaattactctttccgtatcccttagccacatttgcgagctgaatcatctataacacctctttcatatatgtattttttatttttagtacattgaaataaatgattgcatatataacgaggatcattacaattgataaagcacctataacaaccaatgattctatagagacttttaacgttccaaagaaagatactatactattttctagccctttctgaattttaattacttcgctattcttccattgaaaatacattatgcctataccata

SEQ ID NO: 702 - DNA, 1741 bp, Bacillus thuringiensis
  unsure (1)...(1741): unsure at all n locations
gattttagaaagagtagaagaatttttctacggatatgaccaagattttttgcattataaggcaatcgagttattgaagagaaaagggttaactttagcgtgtgcagaaagtttaacaggtggtctttttggaaatcaagtaactgaaaacgctggtgtttcttctgtatttaaaggcggtgtcatttgttatcataatgatgtgaagcaacatgttttacgtgtgcctgaagaagtgttgcatactgatggtgcagttagtaaagaatgtgctcgttatcttgctgaaaatgttaaggatgtattaaaagcggatatcggaattagtttcactggggtagcagggccagatgcttcagaacagaaagaaccaggaacagtatttgttgggctttcgattaaggatgaaccaactgtagtctttcctcttaatttaagcggaagtcgtcaacaaattagagaacgaacagcaaaatatggattttatcatttatataaaaagctagaagagatataagtttcttctagttttttttacggttaaatttagatattatttgatagaaaataaaaaaatcgaataaatgttcgatttttgttggcaaattgaattgaaaataggtataataagattagcaattcagttaaggaggaattttgaatgagtgatcgtcaagcagcgttagatatggcgttaaaacaaatagagaagcaattcggtaaaggttcaattatgaaattaggagaacaagcggagcgtagagtttctacggtttctagtggttctttagcacttgatgtggcactaggagtaggcggatatccacgtggccgtattatcgaaatttacggacctgaaagttcaggtaaaacgacagtttcattacatgcaattgcagaagtacaacgtcaaggtggacaagcagcattcattgatgcggagcacgcaatggatcctgtatatgcacaaaaattaggcgttaacatagatgaattactattatcacagcctgatacaggggagcaaggattggaaatcgcggaagcacttgtacgaagtggtgcggttgacattatcgtaattgactctgtagcagctcttgtaccgaaagcagagattgaaggcgatatgggtgactcacacgtaggtttacaagcacgtttaatgtcacaagcacttcgtaagctttcaggagcaatcaacaaatcaaaaacaattgcaatctttattaaccaaattcgtgaaaaagttggggttatgttcggaaacccagaaacaactccaggtggtcgtgcgttgaaattctattcaactgttcgtcttgaagtgcgtcgtgcggagcaattaaagcaaggtaacgacattgttggtaataaaacaaaagtaaaagtagtgaaaaataaagtagcaccaccattccgtgttgcggaagttgatattatgtacggagaaggtatttcaagagaaggtgaaatcttggatatggcttctgagcttgatattgttcaaaagagcggtgcctggtattcttataatgaagaacgcctaggacaaggtcgtgaaaattcgaagcagttcttaaaagaaaatacagatttaagagaagaaattgccttctttattcgtgagcatcacggaattagtgaagattctggtgctgagggcgcagaagattcaactcttcttgattaaaaaaataaaagacacggactcgngtcttttaattttttatctactatt

SEQ ID NO: 703 - DNA, 1779 bp, Bacillus thuringiensis
cgcggtcttttcagcatcttaatctctcccatcgaacattacgttctttatacagaacattatctatattatagtaaagaactattaaaattgatagacaaatactagaaaaatagaaaaagggctatccatgtgatagccctttttcttattatctttcttcacctgctgtttgttgtgcatcaaacgtccaatttaattgtaacttgtcgccttggaattgattttgatcttttccattatcaacaaactcaaatttcactttgaatttatcagatttacctgctgaaatacctttttcatcccagaaccaagccgataaatcattatctacagctgtaagtgtgtcaccttttaatttatctaaagtagtttgtttcacaattgtctcatgcttatctacattttttaagaatgttactttaatatgtttaccaaaatcatctttattgtctttctttacatcttctacattataatctgttttcagtagaacctttttaatatttaaagagcctttattttctagtttaaattctttttcaattgtatccccaggttttaaattcgatacgttaacaactgttgatggatttaatgctaaatccagtgttccagccgcaaatgtattatttgacacttctttatcactgaaaaatgcaaatgttcctccaccaactaaagctgctcctaatactgctgatgtaatacccattcctaattttttctttaaagtcatgtccatatccccttaatatatatttgttaacttcctaaacggaaagtataaccaaacgaactagacggattgttctacttttttatctttcttttctccgtcaatgctacgaatagcaccaaaaatagaaatcgcggaatacccaagtaaaaagactcctggaataataagaagtaatgctgctcccgcttttgaattcgcataattcagtaaataaccaacatacggaactgtaatatctgcatactttccaactacattttctgcaagtactggctctaaatctggtccgttgttgttatccccttttgtttcatacattacttttccatttgtatctttcacaccgataatacggtgagtgataattttttgatctttctctttaaaggtaataacatcacctttttgatatttagaaccatctttgtttggttctattgcaatgattgatcctgttaaaaacgtcggctccattgatcctgaaagaacgctcttaaattgatatcccatcactgtcggatcaccaccgcttgcttttgaagaaataactacaaaagctaaaaaaaccatcaatgcaaataaaacaaatgagatcgcgttgctaattatcttccatattaatttcatcgtctctctccctctccgttgttttatattatttgaagtatgcaatatccgcttacgttctttaacaagaacacaagtaaatgatataacgaactttaagttattgcaataagaaaatttacaattattaggtatttaaaatatagaaaaaagactgtgccaaaattttacacagtctttttattagtaatttatttaccttctgatttcattccttttggattccggcgcaacactacatataaaattgctccaaacaatataatcgcacctatcccaacactgattactttcacatgagagtcttaaacttcaggcatagatgtatcttttttaggcatcgcaaaagtgacatgttctgttgaaagaacatttaccgccgcaattgattgattattggtcgaagtatc

SEQ ID NO: 704 - DNA, 2043 bp, Bacillus thuringiensis
ttcacaaagaccagagaaagaagaagaactgtatatctacttggaaaatttccaaaaagaaatggaagtagtagagcgagatattcgcgactcaattgatcacgatttaaatgtgaagatgagagcagcgactgagaagtttaagaataaataacaaaaagcgccttaaaagctaagtatcacagctttagggcgctttttgttatgagattttattttgcattaacggtagtatgactagaagccacactttcattatgcaatcgatcaactgcagttacgacatacgtatacgtttctccagaaataacggttttatctacataaatttctccaagttttgtttttcttacagtagtaagtaaatttttcggattttgtatatccacttcatttttcccattcgcgcggtaaatagcgtaataagtagaatcattatctctattgtcaatgataccgattgcaataccttcatctcttggaatggcaccttttaaagtcggttgttttggtggatcatgatcaagccaaggcataggcggaattaatgcaggatatttatatatgtcttttgagagtctatctttagctccaagtggattgttattaatatcttttaagctaaaatgcatactaccttttatttcaggatatagccggtttaatgcaatttgtcttggatattcttctggatcagaccaagcagggacggagttattattaattttataggccgcttgaccgatgtataggtgaatcggtttgttatttgtttctttaacccaccaatctactaatatgtcatatgcagctggggtgaaacctatattccaatatatttgcggtgtaatgtagtcaatatatcctttttgtatccactcacgtgtgtcagcataaaggtcatcatagtttctttggcctgcggttgtgttagagccagtcggatcgtcagctatatttctccatacgccgaacggactaatggggaactttacatatgatttttcttgttttatagcagtatttaaatcttttacaagttcatttacattgttacgtcgccaatcttctatatttgtaaatctaccgttattatatgtttcgtacgttttctgatctggaaattcttcaccggctactttatatggataaaaataatcatccatatgcagcgcatcaatatcgtaattttgcacgatttctaaagcaccttctgttataaattttttcacttctggaataccgggattgtaatataactttccgccataagggacaacccaattgggatgttgccttgcagggtgattatttgataatcgatttatatcggtgtgattcatcgttattcggtatgggttaatccaagcgtggaattctatatttcttttatgagtttcttcaatcataaatgcaagcgggtcataaccaggatcttttccttgtgttcctgtaatgtattcagaccaaggaccgtaatttgaaggatagaaagcatcagcggttggtttaatttgtacaacaactgcattcataccagtgctttttacatcgtctaataatcttataaattcttgtttctgtttttcaatgggtaagccagtttttgagggccaatcaatattcagaacagatgcaatccatacagcacgtaattcatgttttttgtatgcagtatttacttcagcataagtagagtgagggggaatgaaagagaaagggatgaacaagatgacgattcaacatatcattaataaacgtttaacgatcatttatacgcctccctatcatatgattatttaaaataatataggaggcgaggttgactttgcaatagagaaaattgcatattgaaacattaatttaataggaaaaatatttttaatgaaatttactttcattataactaaattcatttactacttcatatgcttgttagtaaagtgaaactttctttcatttgaagggtaataaattataagtataggaagattaataaaatgaaagtttgttcggctgttctggaagaatgtccagtgcaat

SEQ ID NO: 705 - DNA, 1564 bp, Bacillus thuringiensis
cttcgatgtaaacagactcagagtgtcctgatacatttggtaaacgtacacatgttgccgctacttggaattcatgcatatgcataatttttttcgtttcgttaatcattttcatttcttcaaacgtaaatccattatcttggaatttatcaatctgtggaatcgcattaaaagcaattgggaaatgcttcttatcacctgatacaggaagaacatttgccttaacttcttcgccatttaagattgcttgtgattgttcatgcagtgcttcaatagctgccgcaccagcacctgatacagcttgatatgtggaaacgattactcgttttaaaccatattgctgacgaactggctcaagagctactaccatttgaattgtagaacagtttggatttgcaataataccattatgttcttttaagtcgttttcatttacttcaggtacaacaagtggcacgttttctgtcatacggaatgcacttgtattatcaacaacaatcgcaccgcgttttgctgcttctggcgctaattgtttcgatacagatccaccagcactaaatagtgcgatatctactccttcaaagctttcaggagttgcctcttgaactgtaaattcttcgcctttaaatacaagtttcttacctgcagatcgtttagatgaaagtaacgttaatttcccgattggaaattctcgtttctctaaagtatttaacatttgttcaccaactgcgccggttgctccaactacagcgacatgaaaagttttttgcttttccatcactatgcccctttctagataccaatccttctataacttagaatcagaaggagtatacaataccccttctaatcttaataacgttaattttatcatattctacagtaagaatgatggtttcatcaaaaattgtccgttttttttcgttttttaattcatatatctgaatttttctacgaccaccggttgcaattgcttcccttgcagcgcttctaacactgtatcttccagcagctccatgcgagctaccattgagttcggttttttctctggtgcatcttggccgaatgggacgaagtagatgttttttggtgccattaggcgcatgagatttactccattaagccctagagcatcattcgtcgaaacagccaatacgacaggcttgccatttcttaacgtcgctttcgctgccattaatactggagagtctgtcattgcatttgcaaatttactcatagaattccctgttagtggtgcaattaccatacaatctagtggaattttaggtcctagtggttctgcaccaacgattgaattaattgctttaaaacctgttatttcttcaatcttcttaatccactctgctccttctccaaatctagtatttgttgattgaacagtgtaagaaacaacaggacgtacttctgctccctcagcaattaatttttctaaatgaggcattacttcttcgtacgtacaatgtgaacctgtaaatccgaaaccaattcgtttccccttcaaactcatttcttttcctcctcctttgcaattgcatcctgctgc

SEQ ID NO: 706 - DNA, 1691 bp, Bacillus thuringiensis
cgtaaatgaaactttgaaaaattccgctaatggcaagagggatagaacttgttgcagttaatgctaataaaaagataaaaacgatacaaatgatagtcgtatcttttcggagaataaaaaaggtaataatagtgagtaaacaaataatgtagagagcgtgtaatagcgttaattcaactcccataacattcacatcctttaggcattcgtgtagtgtattgtatgaaagcagtgaaagtatgtgagtataggaaaaagaaaaaatgaaatttcatgtactgtaatggtaagaaagataaatggatgttacaatacaaataatcctaaaaatggaatttaaggagaacttatgcgcaaaaaaattgggttttggggatttaccatatcttgtagtctattaatcactttaaatttgtttacaaacaatgaatggatcagtatcatacctgttttcggctttgtttttatactgttatataactgggatgatatgaaacaatatagtaagaaaagtatcggaattatgataggtgtcattgttgtttgctcatttttcgtagggtttattttaatagaagggcagaaacaaatagagaaaacgtctatttttcaagaatggatgtcgtctgcaaaaggtctttatattgtaattatagctgttatttttctaagaattattataagcatagcaagttacgtattaaaggagaagtagaatgggggagtacgaatgagagagaaaataggatattatggtgtgctcgtttgtttactattatcagttatttcaggacaattccttaacagtgactgggtaccagctatattatgtataggagtattgatttttgcatctatgtatcgttggaatgaatggaaagcatatagccgaaaaaagaaatttgttttcagtatcgagtttgtcattattattagcacaattccgttttttctattgaaaggaaatgagataatagatggaattgtaatgtttcaagggtggttatttattgcgaaaatgctgtatttaatatgtatattaatgtcggtagtggtaatcgttaaaaaagtaaacgaaaagttattcgttaatgaataaaagaaaatgccaccttattcggtggcatttttttctatgatttcaacaaggaataacaattagttcccgatttgattttgtaataacttcatagccttcttttgtaatgacgatatcgtcttcaattctacaaccgccccagttcggtatgtaaatgcccggctcaactgtaacaaccataccttcttgtaaagttaccttactttcttgggataggcgaagcggttcatgtatttctaacccaagaccgtgcccagtagagtggccaaagtattgaccgtatccatgttctgtaatgtaatccctcgttatatcatcgatacttttcgcagtttctccaggcttaatcgcttcagtcccacgttttaacgcttctcgtacaacattgtatatttttttgaattcttccgatggttcccctattgctacagtacgtgttatatcggaacaatatccgtcgtaaagtgcaccgaagtctaatgtaacgatatcccctcgttcgattattttatttgatgcaactccatggggaagtgaagaacgaacgcctgaggctacaatgatttggaatgaagaagatgtagcccctttt

SEQ ID NO: 707 - DNA, 1272 bp, Bacillus thuringiensis
agaagtataataccaaatttaatgtgtgtactcacaattgcatttacagccacaagcgcagcgctcttcttccatcttacagcgccggttgctaattcatttatgtaccaattcgatacgaaagttaataatgcaactccaactgctgcaaatgctgtaaaacctacatgaaccaatttgaccgagtggaacgaaaattagcgctgtaaaaataggagctaaagaattccccgtgtttcccccaacttgataaatcgcttgcgctaaccctcgttttgcacctgccgccatatacgcaacacgagcgccttctggatgaaagactgcggaacctaagccaataaataaaacagaaataataacaataataaagtttggtgcaaacgcgagtccaatcattccaagcatacttgaaaacataccgagtggtaataaaaatggtgacggcttcttatctgaatacataccaaacaccggttgcataatcgatgacgtcatatttaacgcaaacgcaatccaccctacttgcatataggataaattcatcgttttttccaaaataggaaacaacgccggcacaactgcttgcatcgaatcatttaaaaaatgtccgaaactaatcgcaaataatattcgatatattgtcggtgtttctactgtgtttttttgtgaaactgcctgcatatgtgaatcgctcctttctgtacaaaatatatatttattacagtaggtgtaataaattctgacttttgaaacatttctattctatactgctttcatttctttttccagaaatataacttaactcccatcattgacttgcatccttgtaactttcagcagtaaaacattatagaaaaaggcaacccaatcacaaactgggttgcctcttacattaaattgcaaaacgcttatacttctcataatcgctcgtcttacattccacttctagtttcgtaccttcattttcataactcgttgataaaacgtgcgcatgattattgaaatacgaaactacctgtccgtgatcatacggaattaacatttcacatttcgtatattctttataaatatgggaacgaatcatttctacaagctcttcaattccaacatgtttcttcgcagataaatacacgcggtcttcttgtactttcggaatttcaacatccaccatatctgatttggtataagcatagatcgttggaatattttctactccaatttttttaacgtttcatttgaatatcaattaaatgttcataatttggattt

SEQ ID NO: 708 - DNA, 2021 bp, Bacillus thuringiensis
cgaagggactggccctacgatgcctcggcagcggactcgatttcagagtgctgtgccaaatccagcaagcgtgtgcttgaaagatgagaagagtgtttcttatagatgtataagacctcttctcatcggaagaggtcttttgttattcattagaaaaaggttgaaactagggagagatgatactttgaaagaaacgagaggaaatggtttagctttattaccacttgggatatttttggcgctatttattggttctggaattattacaggtgatttctataaattgccgatacttgtagcgatctcaattgctgtaggagtcgctttaatgatgaatcgtaaagaaagttttaatgtgaaagtagagcggttcgctaaaggtgcaggaaatccggatattatgattatggtattaatttttgtgcttgcaggtgcattttctgaaactgctaaaggaatgggcggagtagactcaactgttaatttagcattaactattttaccgccaggatttatcgtagctggaatctttgtattggtgcatttatttcattagcgatgggaacttcaatgggaacaattgcagcattagcgccgattgctgtaggtattagtggtcaaactgatatctcaattgcgcttgcaatggctactgttgttggcggagcgatgtttggtgataatttatcatttatttcagatacaacaatcgcagctgttcgttcacaaggaacagaaatgaaagataagtttaaaacgaactttttaattgtgttaccagcggctattattacaattgtactattagtaatagttacttcagggagtgacacgcagattaaagcacatagctttgattggataaagattttaccgtacgcaggagtactaattacagcgctacttggctggaatgtacttattgtattaactggtggaactgtactatctggtgttatcggtcttatagatggaagttacacgttagaaagtttctttaaaagtgtaacgactggaatgggcggtatgatggagttagtattacttgctatattaattggcggtatggttgaattaatccaatataatggtggtattcaatatttaatgaatgtattaacacgtaatattcgttcgaaaaaaggagcggaatttggtattgctggtttagtgagtatgacgaatatgtgtacagcgaataatacgatttcaattatttttacaggcccgcttgcaaaaaatattgcagatcaatatgaaatagaccctcgtaaatcagcgagtgtattagatcttttctcatgttgtgtgcaaggattaattccgtacggtgcccaaatgttaacggcagcaggatttgcagcgttatctccagttgaattgttaccgtatgcgttttatccaattttagttggagtatgtgggattgtttctattttaattgggtttccaaggttttcgaaagtagctaagaaaaaagagtatcataaaactgcttaattaatatgaatgttagtaattaaaaaaagtgcagagaatagactctgcactttttttttgcgtaaagggctgaatatgactcggtcttaagtctgagttaaaaacggttcttaagctcgttatggaaagatgaaaaaatagttaagataagagtatcaaatcgaagggaggcaagcacaagatgaaacaatttctagcgtttatcgcagccggtattttggctttaattgctcttggtagtcttgctggtattgtaggattcgcaatcggagcaggagttgtatattggagctataaatcatttgtgcgagctaaatcattttttggaaagttagcttggggtattgttggtttaatcggtttatccattgcactttctcattcgccagcattaatcggtatcgctgctttagtggttttaatctacggataccgcgagtggaaaaaagaaaaagatgtagttgttgaatctgctccacaaagttcctaattatttagcaactttgaagaatagtggaaca

SEQ ID NO: 709 - DNA, 2357 bp, Bacillus thuringiensis
aaattagtcccgtacatagtagatatatctactatgtcgagtacttttgtttactattggttcatttaataaggaaatatcaatacttgatatggcgctctcattgcttaagctcctctcgaaaataagttttaaataaatataaataaagagccgacatcacaattctacattattaatgcaggtttataatgtcggccttctatttttaaagaattttatttttcataaacaggttactcttaacagagggaaaactgcttattccttgtcgaatttgtttagcatggttcttcctaaatgttagcagtaccctatattattcaattgcgccagcaacatcataatcatttaaatctaactcaattggttgtcccagcgctaatttagcaagttccgctcctaagtatggaccagctgttaaacccgaagctcctaatccattcgcaatgagaattcctccaaagttaggtagtggtccgataacaggtaagaatcctggtgtgaatggtctgaatccaactctcgtttcaagcattgtagcattttctaagccaggtgcaactgctaatgccttatggaatacttcatgtaaaccacctgctgttacacgatgatcgaaaccagtatcattctcatgtgttgcaccaattacgacatgcccattgtcaaacgttaaaatatattgatcgttcggtggcataacaactggcatattttctgttgctgtattctcgatttgcagatgaacaatttgtcctttttggaatgtaactaagaaattaattcctaatggattcaagatttcattcgcccatgcgcctgcagttacaataaccttttccgctaagattgtttcatcgtttactgtaactcccgtaacatgatttccttcacggactaatatggcatcgccttttatgaaagttgcaccatgttttttcgcagcacttattaatgcattacgtaataatcttccatttactcgtgcagcaccactaatatgaacagaactatattcgtctgataatgctgggaataatttttttgtttcttcagctgataagcgagtgatttcaccaatctctggggcatcttcacgtcgtttataagctcgctcttccatttgatctaactttttctcgtcagtatgtaaactaattgcacctacacgattatatcctgtgtcagtttcaccgtcttcttctaattgctgaattaacgaagaatagtaacgtgcaccgcctttaacaattttataccatgctttattacgacgctgcgatagccatggacatacaatacctgctcctgcatcagttgcttgtcctaattgttggcgatccacgatagtaacattcgcacctgccttagcaagatgataagcagtagacgctcctaaaattccagatccaactacaatatacgatttcatttcaaacaccttttctcttttactaattatataaatataagaacattccttagtataatggaaggaatgcttttttcaatgtactcatcacaattaattgttgcagcattgtgactttcttaatcattattttttcttcttacggaataattcaattgttttatagccttgtgaaaggatctctatcattttctctagacgtttttcacgtgttttttcttgttttacagaaaaaagattacgtgcccaatctttctgatatccaggcgttaaactttgataaaacttaagttcattcggatgattagctaataatgcttcaacatctttaattcgatctgcataatcggcaacacattgactcatagcagatgttttcgttgtttttttcttctcgcgttttaaacctacaacagtaaagacttcatccatacttaccattcgtgcaaatttaatgtcgctttctcccacataaccatcttctccaacgtttaatgccggaaacatctcatcacggtgaataaacgtactataacgagcattaccttttttcggatatgcgaagaatacgtaacctttttcaattagtaattcttcattactaataataaaattcgtttgtttcaccatttcatcaagcgtttctacaaatataaagatagcatcgtgttcttttgagaatgcagtttctttacctgtaaaaatgtcataatcacttggttcgttaataacgaccatatttgtatacttattaagtttcaatttatcaataactgacataataatcttcctttacattcaaaattcattgtacatactttttcgtactgttctagtgtattatatgtattaagaaaatcaaactttaaatcgtattattctgctgcaaaagaacataattctttactagaagggggggttt

SEQ ID NO: 710 - DNA, 1821 bp, Bacillus thuringiensis
attactgactttactcgattatgctttttcctttaatgggtatgattggtcttatgtgcaatatttttggtgataaaacaattatgttaaaagtacttcactctcaagaggctacacaagcaatgggtgttcttggtgtcggagtattagtgagtatattcgtatcattgttcctctcaatgaaaatgtttcaggaggcagagttatagaagggacattttcatattaggaggtgtaatacatgatcaagcaactaattttaaaagatttcatcattcaatggaaatttttaatttggtacatactgtatcctgttttcttttatatggccttaacagatacggaaaatttattcatcattatgtcagtaattattacaattggggcaacagtaaaaacatttgagcagatagtaaaaatgagagtgaagttatagtaaatagtttaccaatattgagaaaacaaattgtgtatgcgaaatatatagtagcaattattattctttttataagtgtaacggtcagctgtttcacgatgggaatgaagaatgggattaacctatttgaatttattgaaacgacattgcttgctagtattagctttattttagtgtatttaagctttgttctaccaatatctttttggttaggatataaaaaaactattcttattacaatagtaatattcatggcgccgattgttattttagaaactttgtttcaaatcaacttggaacaaattcaattatataataccttgttattcattggttcaatatgtatgctcatagcatctatcttcgtttcagtgaaattgtatgagaagagagaattttaaaaggtgccctataaaaggcaccttcttcaataacgacaatacgagagcagtagtttataaaaagaaacgctatttggcacatctttcggagtatgtaatataaagctgaaaacgatgatgagaataagaaataggaaaaataaaaataggatttgcttatgtatagaattttgcatattatccactcctttttttgggtagtatgtccaaaagaaaggaatgtatgaaaaaaattggagggggaacaatggggaaacgaaaattgttatttgaaataggagtattttttttgtcaataggtcttttgttatcaaatttttattcagacataccatcaccgtttcctaatttgcataaaggaattggtataagtattgttataattggtctgttttgtcttatcacatctaacttctacagaaagtctgaatgaatataaaaaaggacagttactctttttcagaagtactgtcctttttaaataacttattccatagtttggcgatactccatataatgacgattgcaatggaggcgataatggaccaaacaatcgatataatttcaagtgtcatgttaggaaggaatgtgagaatggataatactttatgaaacaatgattctattatatgaaaacttatttgtaatagaatgacgatacaaagtgtgatccatgctaatattttctttccttgttctttccacatgacattcacctcacgttagcttaatagttttaagccaacagcgccgcataaaatgcagcttaagaaagcaagacgacgccaatccgctgattctcggaaaatgagaatgcctagaagtgcacttccagcagttccgattccagtccaaattgcgtaagcagttcccatcggtaatgtgttcatcgcaagagataagaagaagaagcttacgccgaagttagcgattaaaataacttttgagtgcccagcctttcttttcagtggctactttcataaa

SEQ ID NO: 711 - DNA, 1783 bp, Bacillus thuringiensis
cctccccatgttcttcttcttgatactttcgtttcccgattccaacgccatgttctcctgtacacgttcctcctcgtttaagagcatactgaacgatactttcatttatttcgtctgccttcttcacttcctccttatcatttgtgtcaatcattaagagtacatggaaattcccatccccaacatgaccgagaataccgccaataagccctactttatgtaatacctctttcgcatgttgaatcgctccagctaattccgaaattggtacacatacgtgtgtactcattagctttttaccaggataactatgcacgtaagagtacgctaagttatgtcttgcatcccacagcttatttctcgctgctgtttccgtctcaaacgcaatttctatacatttatgatcaagaacgatttctttcgtaaattcaatatcttgctttaaccctgcttcattgccgtgaaactctaaaaacagtgtcggttcttctctgtaacttgtttcattgtaataatttacttgtttcatagataattcatcaacgagttcaattctcgcgattggaatacctgcttgtaatatgttaattacagcttctactgcatcatttatagttggaaacgatgccctcgcagccataacatgttctggtataccgtatacttttaaagttaactccgtgaaacatccaagtgttccttctgagcctacgaaaataccatttaaatgataacctgatgatgacttcgccgctaaattcccggtatgtattactcctccatcagcaagaacgacttctaaatctcgaacttgatcacgcattaccccatactttaccgctgtcgttccgctcgcatttgtagcagccattcctcctaacgttgcatcagctcctgggtctacactaaaaaataatccatactttttcaattctttattaagctgagagcgcgtcacccctggctgtactctcacaagaaaatccttttctcttatttcaagtattttgttcataagagaaaagtccattgtaattcctttttcgtaaggaattacatgtccctctaaactggaccctactccaaatggaacgacagctgttccgtgctgaatcgctattttcattatcgcgctaacttcttcggtcgtttttggaaaaacaactacatcaggtaaactactactatggtaagattcatctttactatgtaactctcgtactgtcatatttattactactcgatcttcaggaagtatgccttttaattcatttactacatgttcaattgttatttccataatcaactctcctttttaattttaaaacaagtataccatctttatacaaaataattagaaaaataagattattaaacctgaacatacaaaaaagaacctgcagcacacgctacaagttctttttcactacattttaaacgatttctttattaacaacataaaccaaattaaagtaactgccatcaacgaatgagaaaatcctacaatataagttaaccctttaaagtcagctccatttaactgaagaagccctctcgctgctagcgaacctaacattaatgttaatgcaatattatgtaaaacaaaccacttattaaacccttgcacttcatgaaacgcgaatacttttgctaatcctaaagcaattaaaaagaagaaaaagccaagtacaagtgtatgcgtatgcaaaagatttaacaaagtagaccctaaaatccctttatacttaccatactccctagcgaaaatccctgataataaacc

SEQ ID NO: 712 - DNA, 1586 bp, Bacillus thuringiensis
  unsure (1)...(1586): unsure at all n locations
gcctgagatccttgacaaaaataacaggttaaaagagattacttttgtaaggttaaatccttttgcacagctagcaaatatactttccataaaaaatttaaaatggttacttatctcagcgtttttactttggatacctaacggatctttacaagcaattttcacgcaatttacaatggatactttcagttggaaacctgcattaatcggacttatgttttcaattttgggctttcaagacattgtttcacaaagttttataatgccaaagcttttaattaagcttagtgataaacaaatagcaattcttgggatggttttggagattataggatacagttttattgcagcatcagctgtattttcactctctccactacttatcgttggaatgctaatgtttggttttggggattcaattttcgggccttcattcaacgggatgctttcaaagtctgtcagttctaatgaacaaggaaggattcaaggtggaagccaatctattcaagctttagcaagaatgattggtccgattattggaggacaaatctatgtatcacttggtcatgccgtacctgcttttatgggtatgattcttatagtagcggcaatggcagttttgtataagggaatgcatgcaactgtataacagatagatataagaacaaataaaagggagtcagaacttaggaacaagtgctgattcccgatttgtttacggtttgagagctaagagaaatgcttttgtttagggatttattctgctatgctctcatggtgaagggtaatattcagtgaggtggaactatcattaattacagttagctttatttgaaagtaaaaaggtaggtaaatgactagataatttcattatgcttgtgctgaagtaaataatgactccatctttactttgctcttttctcgaatttcagcatctgcgtgtctcataacgtatttatgcgctacagcgattgctaaaacatcatctaataagccaatcccaataatagcagctatatctggaatgaaatcgattgttaatacgtaataagataaagcggctaatattatgaatttcgccttagtaggtaattctttctttttcattgtgtagaataaaataatactttcatatacgctagatttaccgaggtttacagagctttttttgaactttttccaaagtgtctgtttctccatataaacactccttttacaaaaacatagattttttaaaaggatggacaaagaagtgagagattaatcaattttattgtttttcttaattatatatttccataaaaataggggattacctgttcaaaataatataatgtggattatacaatgattcacagtgtttcattacatagtatgcaagtagtatttgttaaattaaacaatttgcaaatggtatctatctaaagaagatttcaccgaaggttttaattacttctaaaaggatagggattgtacgtcttattagtgaatcgctgcaatataaggtacataataaataaagtatattactgcanataaagcttattcatctaaacgtcatattttacaattatgactaagcacct

SEQ ID NO: 713 - DNA, 1794 bp, Bacillus thuringiensis
tgctgcacttgaatggctgatgttttacaaagtttacttttccataatgcagaaaaaatatatttcaaaaattcaaccgcttttttatcaaagcgtttattgagtccttctggactcataagagtgcctgtggcggcgtgtaattgactgcatagtcgaacgagagaatcactcgctgtacgttgactgacccagatacatatggtagctaattcatttcctgaaaactttcgttttctttttacaaaacctaattctttagcgagttcttccaaaagagaaggggttaaatgacgatacagctcttcagaaaatagttgtaattcatcttgaattgaaagattcataaaaaatgtcatcctttctagctagctttttagaaagaataacgttttttgacacttgggggtagtgcaaattcttaagttgatgggcatggggtactaacatcaataacaacacaattcaaaataaaaaagaagctacacacttttttaaaagtgtgtagcttcttttttattttgagtatagaattaaggtggtcaaaagtaagaatattttaaaaaataaaaaatgatggatgttaaggagggagaatagtttgagaacattagatcagaaattccattggataccaagaggcgtgattatacaaaagagggtggggaaggagattcaatgtgaagaagtagttctgatatgcctaaaaaatactgtgaaagatttaattattccacaccctattacagattttattagaaaaacttataggaatagaggagtaagttatcacactcaacttaaagctgctagggtcatatgcaaatttcttaattttatctatagtaacattgaagatgaggttgcaggatataaagcattgcaaaataaagggttagaaggattaaagttaatacatggtggagattttattacacatttgacatacgaaggtgttagttttaatcactctaattattgtgaaaatgttcttacaaaattatatatatatttaaaggaaaacgaattaatagacgaagattttcaagtgaattacaaaaaagattatttaagaataggacagcctttgtctttatttagtaagtcgttttttgacattgagcgaccaaatagaaatcagagaaatgagaaacaaaaattaaaagattttggtcctaatcgttatagacttgtttatgagtttattgaagaagcagaagccagtgatatagcgttaggagtatgttttcaatttttagcaggattacgggtaggagaagttgttaatttgatgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcaagtacccaatttcatcaataataagtaatttgtattttgtatagtgctttaaacgagattctaggcgattctcaatcttggcacgttttaaattttgaagtaaatcatgacatttaataaaataagtacttgttcgctttttagctgctgctataccaatagacgtggacaaatgggtcttaccaacaccactaggtcctaacaatactatgtttt

SEQ ID NO: 714 - DNA, 2462 bp, Bacillus thuringiensis
  unsure (1)...(2462): unsure at all n locations
gatcatctttctgcttctagttgttcacgatattcataaattaaaaaagcaaggcgatgtaaagcaattgttgtctttccgctccctgcaaccccttgaataagtaatggtaaatttctttccgctcgaataatatcattttgttccgattgaatcgttgaaacaatatcctttagcttattatctttattctcacctaatcgatatagaagaaaatcatcggcatgcgatacatcttcatttccttttacatatgtatcaacaacacgttcaagttctctttttcgaatggaaatgtttcgttttaaatacacatcaccttctactaacccatctggtgattgataaaatgctaattcttctccaccggtaaatgaataaaacatactggcgacaggcgcccgccaatcaataatgattggcttcatcgtgtccatatccgaaacccctacttttccgatataaatcggcataacttcttcttttccatcttcctgaaaatctaaccttccaaagtacggctcttgcacaccaatacgtaagttttgtctattagactccctcatactttcaagaatttgctctttaaaatcttctccataataaaccggggttttttcaagcttatccaattgctcatccatcgtatgtaaagtatccttcattntttgtaactcatcttcaaatatgttgctcatttcgacgattccctcctgtccgttctaatttttcagtcgaagtatcattgtattaaaaacccaatcataaagtcaatagtttccgtttaaattttccgaaaaaacttacttttcatctttctaatttaaaaagaatatgcaacatcaaaatcacacaaatacacatatagtatagtgatgcatacaaaagatactactttctatttgtctcctatttaatttatccattaacaaatattgtaaaaattaaagactttaatcaatgggcgttttactgcccacaaataataggataaataaaagtaaaggaggctcttcaaatgaatattttgaatctatctcaagattaaatatgcttctatctggctgtatccttatgctttgttggtcaattatgtatgttgaaatatatagacttacaaaatcagtctggccatgtgttatcatgcatgcaatcgaggatgctgttcctactgttttagttacaataacagggattattactcttacaaacagtagtgatttttggttaaatcctactagcggggtcgctgctactgttttatttctcggaattggaatcgtactaagaactataagaataaaaagagaacgacaattattcacacaataaaaagcagataatgaattcgtcattatctgctttccaatttttaaaactaccttattatattttttgatacataagccagtcaccagagtctatcactttctttaacatctttttattctgagcgatatacacatatgcctcaatttccctatcagcaacatatactgtttgcgtgattcgatcatataaatcagtctccgcattacctgtatattcttctagttcatctaacttacacaatatcttatcatttactacataaacttctccatacacctgttcttcaatcgaataagtcatggccggatatccttcattcgtatcaaataattttccatatgtccaagctctgtctgcgatgcatgttgcaccttgcatataatgagcattcgtttgtcctcttcttaatgtgccataaacgaacacatgatacataaattcttatcccctttatatgtctctactttcttatttgtaaataagcacgaatcataaagtaactcacttcattcggaagctgttctttaatagatttcagcccaccctctgcattttgaacggcagtttcaataagagattcatactctgctggaacaaagctttgccaatctacttccattccatcctcatagcagcgaattaaatggttttcaattgtttgtcttgataagttacgttcttttgcaatctcattcaaatcaataccttgtttatacatttcatatgtttctaaatgagaatttgcggatgcttttcctgactttttacgctctgaaactacttctgtcttaatcgtttcagcataatttggattttcctcaataaaatgctgaactgcttgtaagaagtgcgagccatatttcacaagtttgtgttctccgataccttttaccgtcaacaattcagaatcattttgcggcattttcacacacatatcttttaatgtttggtcagagaaaataacgaacggaggtacaccttctccttgtgcaatttctttacgtacttcacgaagcacttcaaataaaggatggtcttgaacaatttgtcttgtctctactcgttcttttcgtaaaacattctctttaccaagtaatacttctttccctaaaaagatacttttaacatct

SEQ ID NO: 715 - DNA, 1176 bp, Bacillus thuringiensis
gctactcataccattgtatttaaacaccactgtaaaggtacttaagttggcatataaaatcccagtgtattaaaaacagcttacataggtgtcttaattttccaggtttatcaaaatgtaataattgcttaacaaactttaaaatatagaaatctattataaagagaattatgtatgaagatatgtatacaacgatagaggcattaatatcgctacaataatcgaaaaaaagtcttgataaaatggtgaaatggaatccgtttgcttcaataccgaagcaatacgaggaaatacatagaatgtttgaggaacaatataaagtacctaaaccttttttaacacaagatactatggaacgaatagaaagagcgttaatgcaatcttttcacgaggaagaagaaatacatatctcatactatcgtgatggaatggtgcaagacatgtacataaatgtattacatattgaaccgatgacgaaaactatatattgtacagatgcctttggtttgaatactaagtttaagtttgatgaattggtgaatataaattaaaagaagccgcccgacaggactgaagtgcaccccaattgttagacacagcctaacaattggggtgcacttcacatatataggtggcttttgtacgacaaaaaaaagagctctgctatacagcagagcaaaagaaaaatatataaccctataaaaataatacaaattattgatactttcaaaagacgaaatttaaatttccatcacaataatagctatgtttaagtatgaaacattctaccttcactatagctatgaatattcttattttagaattccatagtatccaaatagctctttgagagatacctcaataccgaacttcttcaaagaatcttttctttgttcaaagagaagttctaaaacttttttcttatctttgtctcttccataatgaatcaacctatgacagttcggacatatactaactatatttccaacaacatctaaactattttcaaaatcatgttgcattcttaacggtattagatgatgggcctccatataattttttcggctggcttccgatacaaatgtttcatgtgtgtcatctatttcacatttaaattctgcctgtttaatagcttgtttagcttttttcggatcacgaggccatacttccctacca

SEQ ID NO: 716 - DNA, 2407 bp, Bacillus thuringiensis
ttctaaatgaaaataaatattatatatactattaactttttataagcctagtttaataccatataggggtgaacaaaatattgcattaataatctaatggtagcaaaaataaatttgataagaagtatatagtaagaatgatttggagatacagatggggatataactattttatttaggacggtgcactttaaatggatttacagaaagggaaattatattggaacacaactttttctaatacatcttcttatcctcgcttgaaagaagatataaaatgtgacgtactaataataggagcaggaagttcaggtgctcaatcagcatactatttgagtgaatcagatttaaatattgttgtcgttgataaaagaaaggtaggacacgggagtaaccttacaaatacagcacttattcaatatttaggtgacaagatgttttttgaacttgtaaatacatttggagaagagtatgcagttaagcatatgaaattatgtgaacaagctattaatgatattgaatatgctgatcaaaacttgccttattgctctgattttaaacgacgtgacagtttatattatgcaagttatgaagaggatataaagaaattagaaaaagaactgtattatttacataagcatgattttaaagcgacttggctatcagaggaacaaattggacagagatatccatttaaaaaacgtgcagctatttatacgtataatgatggtgaaataaatccttataaatttacacatagtttattagaacaagctgctaataaaggagttcaaatttatgaagatacagagattgttggcaaaaagttagagaaagaatgtgctatcttttatacaaaggggggcaattctattactgccaataaagtaattgtggctgcaggatatgaagggttggaatttaaaaaggaaaagaacgctacactgattagctcatatgcagttgttactaatcctgtagaagatttatcttcttggtataaacgtactctcatttgggaaactgcgagaccatatatttatatgagaactactgcagataacaggattattataggtgggttagatgaagatacaaacattgctcaagaaagagattcaaaattaatccataaaaaagagaaattagtaaatgaatttaataagctctttcccaatataacagttgaacctgaattttatttaagtgctttttatggtggtactcatgatggtttacctataattggaatgtatgaagagtttccaaattgtcactttatctatgcgtatggagataatggattagtatatagtatggtgctttctaaaattgttcgagatataattattagcggttcaagtccggatttgaatttatatttacaaactagaccaaaactaaatgagtaagctacatgtatgcaaaatcatagtagtaacgagtttatttagggttccattgtaaaaaaacgctattttaaatgtattagtttaatgtgactatttgttatgtttatgaatgcttaaataaagcatttataaacaatattatttgttaaacccattcatcttactaatttctgttattcgtataatccattctttttttaggtagggtagagttgcttggatatgatgatattcccattcttcctcaatggtaggataaaggttaaataagtatttttcttcatcatttgttacacttgctttaggattgccagtgagtttaaaataaatgtcgcaccatccgctatagtttgttaacataaataaaaaattaggacatgtgaatccgatgaggtatattcctttctctaattgaatatctgatagtaattcccttgcactctcaaaagtaggcttctttttgtaaccattgcatgaatgccatgcccaaatggggaaatctatagtaaagtcaataccttttctgtttcatgtgttttacaatgtatttatatgctgtgaaatcttctttactaacaaacaataggattggctataagcttaccttcattcaaaagtgtatttatagcaatttcggtttgaaacggccgtaggattgttgaatcaataaatgtatttaagtttgattgtttatcaaattgttttttcatctttcgctccattttcttttttattttgcagaattaagaataaatatgactaatcggataataagaaatacctatgctagatacaattgtcaatgcttatttaaagtaacagcaaggaataacctttgtatatagagtgtacaatacatgcaaaacaggattaaagaagattttaaatatactatgaaatagtacaaaataagaatttggtacatcttttatatataaactattaattgaagtttgcaatcacacattatagctagtatactaactatataatta

SEQ ID NO: 717 - DNA, 1864 bp, Bacillus thuringiensis
aaattcaagaggattcgttccgtacaggtgatcttacacaaccatcaaaaaaggcgccagagaatgtagtgaaagatgcacttaaggaaaatacggagcatgctttgtctccaaaacaagttagtgcagaaacaggagtagattacaaggttcttcaaaaacgtggttcttatgatggaactacacttgtgcgcatgcaacaaatatatgaaggaaaagaagtgtatggccaccagttaactgctcacgtagataaaaaaggtattattaaaagcatttcaggagctagcgcacaaaatttaacacaagaagatttaaagaaacctattaatttatcaaaagaagaagcgaaacaatatatttataaaaagtacggaaacgacattaaatttatttctgaaccagaagttaaggcggttatttttgttgatgaaaatcatgggcaggctagcaatgcatatcaagttacatttgctgctacaacaccaaattatgtatctggaacttatttagtgaatgctcataatggcgatatgttaaaagatatggtacaagaatcaagtttgaaaataagtgaagagtatgttgaatccgttaaggaaaataaaactagcaatttcacatcattaactggaacaggaaaagatgatttaggcgtaactcgtacatttggtatttctaaacagaccagtgggaattatgcgcttgctgattacacaagagggcaaggaattgagacatatgatgtaaattatagagatattacaaatgaagaaagttattatcctggcatactagcaactagcgcttcaacaacatttaatgatccaaaggcggtaagcgctcatttcttagcaacaaaggtatatgatttttataaagaaaaatataatcgtaatagttttgataataaaggaaaaaaagtagtttcaggttgtacatgcatgggattctggaggaacaaatgatcctgaaaattgggagaatgcatttagtactaatattaataacatcagtatgcttttatatggagatcctatggtaaaagcgttcgatatagccggtcatgaatttacacacgcagttacatcaagtgaatctaaccttgaattctcaggagaatctggggcaattaacgaggcattatcggatattatgggaacggctatagagaaatacataaataatggggaatttaactggacaataggagagcaaactggatcgacttttcgtaatatgaaaaatccaactgcaattaatttttcagaaggactaccgtatcccgatgattatagtaaatataatgatttaaatggagaggattatggaggcgtacattttaattcaagtattattaataaagttgcgtatttaattgcacaaggtggtactcataacggtgtaaatgtaaatggtattggtgaagataaaatgtttgatattttctattatgcaaatactgatgaattaaacatgacttctgatttctctgaattgaaattggcatgccttaaagtcgcagctaataaatatggaacgaactcaattgaagttcaagcagtccaaaatgcttttgatgcggcaaaaattacaggaacggtgaaagaaaacgaaaaaacagcagaaaaccaagctccagagttaactgtaccgtttacgattacactacgtgtaggtgatacgtttgatccaatgagaaatgtaaaagctgttgataaagaagatggtgatttaacaaataaagtaaagcataaaggcgatgtagatacttcaaaaccaggtacatacattgtggaatacttggttgttgattctcaaggggggaatgcaacggctacacagactgtaattgtagagggaa

SEQ ID NO: 718 - DNA, 2346 bp, Bacillus thuringiensis
gttcgaccactgaggggaaaaaaggggcaaatgtgttccgttttaatactcattcagcgaagaattagctgacaaactggctgattctatctgcaaacacgatcctactttacctaaaagaaacctggcatcttccgtaccatgttaagtggaaaatttacagctaaagcatcggatggaagtaatcgcagacgaattacacattgctctacaaaacgatcttaatgcatacatacatatattggtgaaaacattaggaccagaaaatacaacagaagtaggcacatttacatgtatgaaataacgaaaaggaatactgctgaatatgccattcggccttttcttcaaacataccatgaagacacactagacatattgcaacagtggattcatgacgaaaacagccacattagaagattagtttctgaaggtacaagaccaaggcttccttgggctaaaaaaattggagctctaaaaggtgactttaagaacaatttacagcttcttgaacctttaatgaatgacccttctaaatatgttcaaaaatctgtagccaatcatatgaacgatattacgaaagaagataaagaactcgtttttcagtggttacagcaattacgtgataaacagcatcctattaaaccttggattataaaacatgggttaagaacaataataaaaagtggtactttaccaaaagatttttgtttttgagtattttaaacaaaaccgcttatgcttcaaaaatgaaacataagcggttttccttttgaatacagaaataacaaacataaaaagcactttaaatttcttctttatatcattattttactaactcttctatgttattactttccttaattttttcggatgatagccagagtgaataacttgttccatccttgttccttaaatatatgttaaaatccttattatatagttcttctttaagaatagtgactacctttctcaaatcatctattacatatggatcatttctatattttatctcactgtcattgaaaactaatgtcaattcatactctagacaattgccgtctttcgggtgtggacaagtaatatcctcaatttcaaaacgatcattttgaatttcatttaaccttacgcctacttttgtttcagtttgaaccaaatatgtccaataactgcttactgtgtttttcattgttaaaagcagttcttctttcgttatagctttttgcacattttgaaaaggcaagcctatagattcaccattataatcctcaatttcaagtgttgttatctttctattactcttctgaatgaattggattagagcatataaacgatctaattcttttgattcaaattgactgtaatcaatcttgtcactcgtttttaaagttaataataacttatccggtggtttctcctctatatcatcatccactatatattgaaaaacatttttattttcaggttccacgtaacctaattttttaatttcttctagcattggtttaaatttcttatattcctcatatgttttttttccgtattgatattcatcaccttttattcttgaatataagaagccatctacctctactctaaattgaatatttttgttattttttgcttgaacagtatgatatgtatgccccatatttccttcgtttatagcaccccaatgtgttacaatcacatcaattccgtgcttttttttcacatattttttcacctgatcgtcatctttataattacacccacttaaacataagaaacataacaatagtaacattacatttttcattcttttcatatagcaccttgccctcttttcgcataaacaaaatattccatatataaagaatactaaatcgctgaatgttttcaaagaattaaaatatttttacactcggtatatatatctatttcttttattaatggctctaataagttttaatattgataatcgaatataataaaaagaaacctaaatttaaggtttcccatttttaccaacaatttaaattttaatagatattttttagccaagtaataattcgtagtacctgaaacgactcaaaccaagtaatgaaaaacaggacaacaaagaaagagataagtgatatgaattttaatcttccatcttcacgtctagcaatcgttataatacttagaaccactccaattaaaaaagaaatataccctaataggataataggctcagatagctatttattatcctatttaatccaataataacattccacaagtcatcacggtatttgaaaatcactaaattttttattattcaacctcaatatatattactatttattgagagataatttttatgcg

SEQ ID NO: 719 - DNA, 1921 bp, Bacillus thuringiensis
taaaatatgctgtagtatattgtgatatggaacaaattgagcatatgatgcataagttgaacaaacttccttttgtgaaaaagatagaacagtcgtatcgcccgtatttaaaaacggaatttgaaaattcccgtcctgatcgagcaaaagaatacgattatagctaatagaaaaaatcccctgctaaatttagcgggggatttttcacttgaaataacgtgttatttcatcggaggaatgaaattgttcattcgtaaaataccaattaaatgattaaaaaatagttctttttctgggaaagttgtagatggttttacagtaaaggtagccacttttttcccgagttgttctgccgtttcttcaaataaaatgacacgtttactttttttattttcaaatacaggaatgccttcacgacatatgtataatggttggaaatcaccagtagtagttggttttaatattacaacaagcgaacacacttttttatcgttttttatcgtttcaaattgtaacatatgtgctatacgttcttgatttgttttggcaatttcaagtaattcatataaatcagagtagccttctccaagttctataaagcgttgaatcatatcttttcctcctctttcttttactgtaccatttcactttttaaatgaaaagcacacaaagaaaaaaaaccctgcatagcagggcccttcttatactagcatgtactagtaagaaggcaaagggagaggagaaaccggaggaagaacttatggggaaacgtaagtcttctccgcggttggcaacaacatcgaaggtgatgttgttataattatttatgtccaatctaaatgaagatatacataatgaaattaaattttatgttgggctttttatttttcttttttttattttgtgataggataaaaaagataaagtggaactaatatacatattgggttcatattagtgaatgatgagatgaatacataaaaataacgagaggttatttgaggccgagtttttctatagttaggtgaatgtggtttgttaacggttaccgaagtgggaatggctttctataatcgctcgatagattgaaataaaggtagtgacaacagatgagagtagtttcaggaaaatgtaaaggacacccacttaaagcggttcctggtaatacaacacgtccaacgacagataaagtaaaagaatctatttttaatatgataggtccttattttgatggtggtatcgcccttgatttatttggtggtagtggtggtcttggaattgaggctttgagcagagggatcgataaagcaatttttgttgatcgggatagtaaagcgataaaagtaattcatcaaaatttagaaagttgtagagtacaggaacaagctgaagtatatcgaaatgatgctgaacgtgcagtaaaggcgttaataaaacgtgaaatgtcattcgatcttatattaatagatcctccatataaagagcaaaaaattgtatctttaattagtgtaatggatcaacatggattgctacatagtgatggattaattatggcagagcatggtaatgatgtagttttacctaattcaataggaaggcttgtaaaagtacgagctgagaattatgggattactgcaatatcgatttataagtatgaaggtgaggggacagaatgacaagtatagcgatttcttcaggaagttttgatccaattacccttgggcatctggatattattaaaaggggagcaaaagtatttgatgaggtgtacgtagtcgttttaaacaattcatcaaaaaaaccattcttttcagttgaagagcgattagaactaattcgagacgcgacaaaggatatcccgaatgtaaaggtagattcccatagtgggctattagtagagtatgcaaaaatgcgtaatgca

SEQ ID NO: 720 - DNA, 1300 bp, Bacillus thuringiensis
tcatatatacttttgaatcaaactccttttgttttatatgtattggatatatgaagtgtgaacgggcatgataatagaaaaaatgtgccgtttttttattaaatgctatacagaacatttgaagagtagaaaggtgaacatatatgaatcatattggacaaataacgatagagcttttaattggtttttttgttctattaattgctacaaaaatattagggaaaacacaaatatctcagctaacgccctttgattttatttctgcaatcgtcctaggtgagctcgttggaaattcaatatatgatcctaaaattaaagtatggtctattttatattcagtatttgtttgggtaattttaatttatactattgaagtgataacacaaaaagtaagagggacaagaaggttttttgaaggatatccttcaattattattcgtaatggaaagattgatcgtgaacaattaagcgtaaatcatttggatataaaccaattacaacaaatgcttaggcaacaaaaagatatattttcaatccgagaagttgaatatatgatattggaacctaacggaaacataagcgttttgaaaaaaagtaaatacgaatctcctactgtaaatgatttaagtttaaaacataagcctgtatacttaccaatttcattaattagtgatggaaaagtagttaaggataatttgagggaagcgggatttgatgaagggtggctttataaacaaataaagcaaaaaggaattactaaatttgaagacgtattatatgcggaatggaaaacggatgatggcttcttttgtcaggaaatgcagcggtagagaataagtgatatatgtaatgtttgtttctaagttatcttttacatatcaaaaaacgtaatcattgtatacaataaaactagatcaacaatttgtatggagtgataaagatggaagcgtttattagaagtgatcaatataattttataaaatcacaagcttatattttagcaaacgggcatgcaacggcaaatgatagaggtgtaattcaagcgttaaaatcgcttgcgattgaaaagataatacatgtatttgagaatttaacggatgaacagaaagagttaattgatacggtattaacagttcaaaatagagaagatgcagagtcatttttaatgaaaataaatccgtatgtaattccgtttcaagaagttacagcacaaacattaaaaaagttatttcctaaggcaaaaaagttaaaacttcctgatatggaagaaatggatatgaaagaaatatcttatttaagc

SEQ ID NO: 721 - DNA, 1756 bp, Bacillus thuringiensis
  unsure (1)...(1756): unsure at all n locations
tttggaggctcgcatgaaatagtctaatactgaattgcatgttagtatgatattgttaagaccgtgtatatgtcgtgtgtttctactgagtcacctaatatttcagaaagcattattgtatatgcaggatacgtatcaaataacgtcccatcaaaatcccataaaatattcattctattcaccttctattttcaaatcattggatgactaaatccgccctatccctcggcaattccgtttctaagtaataatcctctgctttccaatacctattttcaaactttgaaaggttcttctgtgtctcctcactctcacgtagaaaccttgtctctcttggacagtccaaatagaccatataatgaaagaaatctctccattcttttcgctgcagaaaaactccttcaataacaattacgcctacaataggaatctgtactttttccatttcacatatatctgtttcttcgtgaaagaaaggtaatttcaattttgtttcatgttgtagcttttgaaaaaatttctgccttaaccattcaatgtcccattgtaaataataatactcgtaccattcttcatatccagtatgatatcgtttattacgctccactatatgatcatcaatatggaaaatatgaaacggaatgccttcttgtttcatattttcttttaaattggctacaaatgttgtttttccagatcgacttaaaccatctatacctaaaatgaatctattttccctatgcttcttcataatcgttataagttcgtttgtactcattacttcttccactcttcttttaataaagaatataaaatagtatcatgagcaactccattttgaatcatatgttttcgaagtaatccttcttcttgaaatcctgctttacttaataatttttgagaagctttattttctacatatacaacagcagcaactctaataagttgcaatgtttcaaacccgtaagttaaaattgcctgtaacgcttccgatgcatatccttgtccccaatatgtatcgtctaattcataaccaatttcagctcgtttatgatgattattaattaaatgaaatccgcacgttccgattaattggcccgtcccttttttctcgattccccagcgaaatacactgccctcttcataacgatttttaaacgtttgaatcgttgttttcgcttgctcgatattttcgaaagaatccattccgaaataacgtataacagattcttttgaaaaataacggaacattgtttctgcatctaacagtgttagttctcttaattgtaaacgttctgtttctagtctcggaaaccccatctctttttctccttttattctaatgaactgcaaatttcaatataattcccatctggatcggcaatgtaggcaattgtttgtccccacggtttcacaattggctccactaaaattttaataccttgctctctaaattgctcaatcgtttcttgtacattctcaacaacgaatcctaattcgaaatgagaagactgtaattcaccttctgtaagcggtagtcctgttaattctttcacatcttgccgcgtattcatcgctaaaatggtagttccagtattaaattcaatatatgttccgtgctctgcttttataggtaactgtaaaatatctttatagaaccttaaacatgcctcaaacttttctacatataaatggatgtacttcatttttaaattcattttacatccccctttatatccatccntaaaatttcgac

SEQ ID NO: 722 - DNA, 1391 bp, Bacillus thuringiensis
tatcatgtaacccattaacattagcacgtgatttaaaagtactagaagaaggtggatataaaacacaggaagtacaacctgttgatatgttcccgcatacgactcatgtggagtgtgtggcttggttaaagcttgaaatataggggtttgatattaattgttgatggggttgaccacaaaatgaccacatcaacaatttttttatgattttaacgcctcacttagcgctatagtggcactttcttgcatatctaatgtaacatgactataggtgtccaatgtggtcttaatggaattatgtcctaatcgttcacttacgattttcggattaatacctaatttaagaagaagtgtggcatgagtatgtcgtaagtcatggaatctaattttaggcacttgtgctgtttttataaacctttcaaagacagtagttaatgttcttggatagattggtctaccatcttctctactgaaaactaagtcattatcttcataagctttaccgatagctaatttaaattcattttgttttgctttataactttttaactctttacataagctttgatcaatggaaattaagcgtttagaacccgatgttttcggttctgtatatcgaaatcctaattcatcgtaaattagagtttcagtcacactaaccttaccttcaactaaatctacatttttccactttaagcctagcaattcacctctacgcataccggtattaagcgcaagtaaaaataaatgatagtaaataggattgtcaaatttagcgtatgttaagaaggttttcgtctcctcaattgaccacgtattattgaccacttttcgtgggcgagggatttctacatgttcaaacggatttttatataaaagttcccatttaacagcatcttctaatgcaccttttaaaacgataaaaatatactcaatatatttaggagataattcgtcatcgattagcgatttaacaaatctttgtccatgtagaggttttaaatctttcagtttatgcgaaccaactacaggaataatcctactgttcacagctcttctataattaatgaatgtagaatctctcactcgttgcttagctgtgttttcaagccactcctgtaaatattcactgagagtaagatttttatcatcaactagactcccagtattaaactgatgaataagttcattacatgctctttcggcttctttctttgttttaaagcctgatactgtttttttgttttctttttccagtaagaggatctcttccaatatcaattgtaaatgaccatttttcaccgcgttttctaaaatatccttttcattatccataccttcttgaactaatagtattcgaatagcacaaataattccagtattagaaaaag

SEQ ID NO: 723 - DNA, 2269 bp, Bacillus thuringiensis
ctcataatatttcatcaggacgggcatatgctttttctaaaatatcccctctttttaacgcttgaaatgcgagctccacatcttctttcggaaccaaccctaacgttgacggtaatgtggaatgatatccaacacgaccagctaatacattttttaatactgttgatcgctttacaaggttaaaactttggaagatcataccgatatcccggcgcatacgccttaatccttttcctttcgcagcagtaatagactcaccttcaataatgatttctccttcggtaatctcatgaagacgatttacggatctgagaagtgtagattttccagctccagacagccctaccattacaacaaactcacctttttgaattttcaagtttatattattcaatccttttgtaccgtttggatacactttggagacatttcgaaactctatcacacatcttacctaccttctatgtattcaaaacggcaaactaactgaaaacatcccctttcagctagctgccatttccatatgtattattgcgtttttactttcttcccatattcacgaacgatatcaaatttactatcatcagatttaacatatccttcatgtgaatatacttctttaatgattttacggccttcctcattctttccaatttcaatgaaagcatcttgtaatttcttgctccattctgcatctaaatcagatcgtacagaaattgtatcgttcggaattttctcagtaaatttcactattttcgtttgatcaaatatattcggataatctttttttacaatattacgagcatcttggaatacaacagccgcatctacgtcaccatttaaaagagcaataagcgactgatcgtgaccttttaatgtaacaggtttcacatcttttaacggatcaattccctcttttaatagaacagctgcaggccacacatatcccgctgatgacgttacatcttgatagccaatttttttaccttttaaatcttttacactattaatatttgaatctttcttaacaacaaactcagatttataataatctactaaatcttttgtaggggctcctgtttcattctctactccaaaacgttgtgcttgtaaaattacatttgcagccttcttttcatgtgctaatacgtacgctgtcggcggtaaaaatcctacatctacttgtttagatgccatcgcttctacaattgtattgtagttcgttgaaatactaacttttactggaatatttaacttatcacttaatagcttctcaagcggttttgccttcgcctctaacgtatctgcattttgagaaggaacaaattgaacatttaaagtcttcggtacatacccttttttcgtatcttcatttttacttgcgcttgattccttcgttccacagccacttaataatcccgctgctagtacaactgttgtgctcattgcaaaaacttttttcaacatattaatgcctccatttttcattgttataaaataacctttcataaacatgaagaaatatatcacatatttttacaaataattgattatttacagaatctttacacattctatacactcacattaaaattctcttcacatatttgatatgatgaattggaagataacaatagaaaaggtgagtcatattggaacaaaatcaaactgtaactttaaacatcttattaacaagcgatatacatggcactgtttatcctattcactaccaagataactccccagcagaacttggtttagctaaaatttctactcttataaaaaaagaacgttcccaaaatacaaacgttcttttaattgataatggcgactttattcaaggaacaccatttacttatcattatgttacatacgaaaaaaacaaaaaaaacccaatgtccttattagcgaattacttacagtatgacgctgcaattatcggcaatcatgaatttaattacgggatggatatattaaataatgctgtgactactgcgaacttcccgtacctatcagcaaacattttagataaaaacataaagaaaccttatttcggaaaaccttatataatcaaacagattgaatccaatataaaaattgctattttaggggtaacaacacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatt

SEQ ID NO: 724 - DNA, 1330 bp, Bacillus thuringiensis
ttttgcaagctgaccagtttcaactgttagctggcgaccagctaaatctatcgagaagacttgcttttcttgactcatttaagtacccctctcaatttaaagtattcaattcttctatgtaaatggatagtatatcacaatattctacctctagtattgcctaaaattaagtaagctataaagcgtagaagatatatttttacctaacaaaaaagcgggaatattcccgcttctttgactatcgacgtaagccaagctttgtgattaattcacggtaacgtgtgatatcgctattacgaaggtaagttagtaagttacgacgtttaccaaccatctttaatagaccacgacgtgaatgatgatctttcttgtgagtacgtaagtgctcgtttagagtgttaatttgctccgttaggacagcaatttgaacctctggagaaccagtatcagtctcatgagttctaaattgtgcaatgatttcatttttacgctcttgtgttaaagccatcctatttcacctcctattaattaaacccccaattacctagcaagcgtcggtgagtcgcaatgccaagcaatggttgtcataaagtacataacatagaatactacttttcatttgaaaaagcaagtatattcttttcgctcacaaaatattcttgggctgttttcttatcttttgcgatttgttcaactaactcatcgataccgttgaatttcttttctgctcttatacgcatatgccactctactgtaacattttgatcgtatatatctttgttaaattcaaataaatgcacttcaattgataattgacgctcatcttctttaaaagtcggtttatatccaatattacatacaccatcgtaccattcaccgtgaacttttaatctcactgcataaacacctacaggtggcaataaatactcatcacttaaacctacattagctgttggaaaaccaatttgacgtccacgtttgtcgccgtgtataactgttcccgctacagtataggctctacctaaaatagatggaatttgctccatttcgccatttcgaattaactttcgtaatgctgtagaacttactttctcttcttgaaattcaactttttcaatcacagtctgtgtaaactcccctcttgcatgaaatggtaaagtctccatctttccttttcctaaacgtccatatgaataatcaaaccctgctactacatgctttacatttaaaccaataatataatcatctacaaattgttgcggtaataaccctgcaaatgattcatcaaattaattacatataatatatcgattcctaagcttgcgactat

SEQ ID NO: 725 - DNA, 1971 bp, Bacillus thuringiensis
aaagagtattactacatgaaattacattaggagcgaaacaatacgtcatactcggtgcaggcttagatacgttcagttttagaaaccgagagttagagaataaaatagaaatatttgaagtggatcatccttctacgcaggcgtttaagaaggaaagaataaaagaagtagaacttgaagttccaaataaccttcattttgtttcgatggatttcacgaaaggatttttctatgagcagttacggaatgaaggatttgaaaataaaaagacgttctttagtctattaggtgtaacgtactatttaacgaaagaggaactttctagtttaatagaatgtttatttgaggtggttccggcaggaagttctatcgttttcgattatcccgatgaaaacttgtttacggaaaagggactgtccaatcgagttgaaaatatggtaaaaatggctgcggtaggcggagaaccgatgaaatcatgtttttcttatgccgaaatggaagcactgttagagaaggcgggcttactcatttatgaacatttatcgccagaagacataaataaattatattttgaaggacgaaacgattatttgaaagcttttgagacagtgcattatgtgcatgcggtgaaaaggtaggaaattagtaggcatggggaggaatctctgtgtctttttttataaaaaaggaaatgagctgtagtggtggaaaatataattataaatatatataaattaatgttttgtagaaactaaaggaaaggggaaatagaagatgttgaaattacaagggaaatacaatgaagcaaaagtgtttactacgaatgtagaaaaaactgcagcaggtcaaattattgatctttgtaaccaagaattcgtaaaggatagcaagattcgtattatgccagatacacatgcgggtgcaggttgcacgattgggacaacaatgacaattcaagataagattgttcctaatttagtcggggttaactaatcggctcagactttaaactactcactcaattgactgggaaccctaacgataaaaggcgagggcaatcagcagccagtggttatggtgacataatcgaatggttcagagacttgtaccatgttagcagactaaggtacagaattattcctcatctattttgaattgaagaggaataattaatacggtgagcctacagtagagactgcatatctcgatgactgtagagaaggtatagtccactctttcaggaaactgagaggtaagtacgatattggttgtggcatggaagttgttatgattaataagaaaaaagaggaaatcaacttcgatcacttagacgaaacgatacgtaaatttgtcccaagtggttttcgtattcgagataaggaacatagattttcaaaaatgattgattttgatagtgtaagagccccgtttacattgcaacgtgctcaaaaaagtattggtacacttggcgggggcaatcattttgtcgaactgaatgaggatgataaaggaaatgtatacattgtcattcatagtggttcgcgtaatttagggaaacaagtagcagagtattatcaaaactttgcttacgagcaacttataaacgttaaatctattaaagaagaactgattgagcgtttaacgaaagaaggtagacaacaagaaatacatgaagctttacgtgaaattaagaaaccggtgattcgcaaagaattagcttatttagaaggacaaggatttaaagattacatgaatgatatgaaaattgcacaaaaatatgcagagttaaatcgtaaggcaatgattgatgaaatcgtcactaaaatggattggaaagtaaccgatcaattcactacaattcataactacatcgatatggaaaatatgattctacgaaaaggtgctatttcagctcagaaaaatgaacgagtaatcaatcacaatcaatatgagagatggttcaatcattgc

SEQ ID NO: 726 - DNA, 2365 bp, Bacillus thuringiensis
agaaaatatcgtagagaaagtctggggttacgattattttggagaaacacgaataattgatacacatattaaaaacctacgcaaaaaattagctatcccttatattaaaacaataaagggtattggttataaaattgatgaatagtattgtgaaactcatgaaaatgaagcaaattacttataaactctttatgactacatctctcattttattatcctttgcagtattgatttatttaactttatacttctttctccctacgttttatgagcaatataaaacagatcaacttcaaacagggataaacgaaatcattgataagtctaaaaatcttacgtttcaagatgcgataccactttttgatgaatacgcaaaaaaaaataatgcgatgctttatcttcaaaataaagaaggagtaattatttactctccttcattttcttttattcaaagtggtacgcaaaaaacagtagttactaaagcaacacgattcgagaatgcaagtaccctcagcaattcatataatgttacgaaaccaattcaatttcaagatggtagtttaacgcttatagtgtttgctacatttcaaccgattgatgaagcttcacaggttttagtacgctttctcccctatattagtatcattgtgctcgttattggtataggaagtgcttatttttattccaggtttattacaaagccacttatttatattaatgaaggtgcacaaaagatggcaaatttagatttctccgaaaaaattgaggttcgctctacagatgagttaggagaattatctaatagtttgaatgacatgtctattaacttgcaacaagctatgtttgatttaaaaaaagcaaatgaacaattaaaaaatgatattgaaaaagaaagagaaatagaaacaaaacgcagagagttttttgcgattgtagcacatgaattaaagtcccctcttactgtaatgaaaggatacttagaaggaatgatatacaatattggcccttatcaaaatcgcgatcaatatttaaagaaaaatcatcaaattattgaaagtatggaacaattagttcgtgaaattttaagcgtatcgaaattagaacaacacaccttcaaactaaaagtagagaaagttaatctttcaaaattaataggtacaattacaaaagatctcgaattttttgcttctcaaaaaaacatcgaaataataaaagaaattgattttgacctttctatttatacagattgtgctcttttagaaaaagcatgtaaaaatattatacacaatgcggttatgtattcaccacataatgaaaaagtctatataaagttaaatgaggattcgaaacaaggtcaaatcaaaatgcaaattataaatacaggtgtcaatattaaagatgaagatttacaacaaattttcaaaccattttatcgaattgaaaaatcaagaaatcgaaatactggaggaaatggtttggggctatatattgttaaacaaattcttgaaacactagatataaagtattcaatgaaaaatatggaacatagtgtgcaattttgcatgagtattccattatctaaacataaaaacaaacaaactctcctttaaataggacgagtttgtttgtttttgtagtaagtataaacttattaacaggtttttcatttgatgatatgtatgttcttagagctgcttttgataagcaatctatgcaagatcttcttgggaatttaatagttgttcgccaatctaccctgcatttacttagaagcttagataaagaagcttggtcacaaagaggaaatgcgaataattctgaagttacagttcatgcattagcatacattattgctggtcatgagcttcatcatcttcaaattataaaagaacgttaccttggtcctgatctatatccagcaacttaatatttgaagaaaatgagtcctatttatgtagtgctctattagcgcttagaaccatggcaattaaatgcatttatttataaaattcaccacataatatttatgctatcccttcttattctgtacataattttctttaggctgatatactataaacgcaatagttctggaaaggtgatgatagtatgtatgaacaacaaaataatagagatagagatcaaaaaatgatgttttctatgcaaggagttcccacaaataaaattaacatgcatcaattacctaaatggattagaatttttggctattgtgcgtttggttggataatagtatttagtttaattatattggtaagggtttaattctgcaataactatacagagtaggtaaacgggacgatatttaggtcatacatctaggtaatgtcccgttttttatgtgtga

SEQ ID NO: 727 - DNA, 1457 bp, Bacillus thuringiensis
taattcaagatttgttttttaaaagttaataacttaccttatgtaagtataatacaaaaagttttaatcaatgtcaataaaaaatagctacttttttttcgtaagttaatgatttactttgtttccttaaaatttagtatacagatattaagaattctttcgtataaaaaggctacctctacaacttatagagatagccttctattacatattatttttgaaatacatgttttactttttcagctggaatattactcccgcctctaccttttacatcttcaatcatcattgtaatgaccatatctggtgaatttaaatcaaatgcagcgaaccaacctagttcttttccttcggcctcttttgatacttttaattccgctgtacctgtttttccagcaagagtcataccatcaattttagcaattttccctgtaccatctggatcattaattactttcgtcattgcagtttttaatatatcctgatttcctttagaaattacattttctttccaagcttttggttgtttatctgttttaataatatacggtgacggaatagttccatcatttacaatcggcgcatacgttaaagctaaatgaagaggagtcattaatacttgtccttgtccatatcccgtatctgccatttgaatatcatttttaatgccgtcatttgcaattttagaagcagggaatccatattcaattggtagtttctcatcgaatccgaattttttcgcttcactcataaacttgtcttttccgatttttaaagcttcttgtgcgaagtaaatattatccgagtatttcatcgccttatcaaaatcaatcggatttgcatctttcacacgcgttacatagtaattaccccaagaagaatcttttgtccattttaatccttcaattttcaactcttcttttggatcaatcgttttcgtttcaagaccaattgcagctgtaataggtttaaatacagaacctggtaccgacaattgtgtaaaacgatttgtcattggttttttcggatcattattccaagcttcgcgttgtgccttcgatgtccctcgtgcaattatattaggatcatatgctggactacttactagtgcaattgtttctccacttttcggattaattgctgcacttgaaccagcttcgcccttcatttcattatacgttttttcttgaacaacactatcaatagttaaagttacattttctccatcaacagcatctgtttttgctaaatttttaatttcttttccttgcgcatcttctacaaagacacggccacctttcttaccgcgtagcttttcctctaatacttgctctaagccagctttaccaactgggtcatcagcttgatagcctttcttttgtagcgtttttaaatcttcagcatttacctttccaatataaccagtcagatgagctgccgcttcccaaaacggatat

SEQ ID NO: 728 - DNA, 1367 bp, Bacillus thuringiensis
gaaatattttatttatttctaaccttattccaaatgattttaaaacgattattaacgtagatagaaaaaagatattacaaggtgtagaccgatcaagtttattagcaagtgaatgggctaataacaatgttaacttagaaatcataaacgaatccacaattaaaatttcttcaaacgcttctcaaattgggaaaatatctgaaacgcaacaaatagatgcgattcaaggtgaaaaacaattaaatatatctttcgatgggcgttttatggttgatgctttaagagcaataaaagaagaaacgattactttaagttttggaggttctatgcgaccgatattgattgaagcaggagagcaatctgcagcagtacatcttatatcgccagtaagagcttattaaggatagaggaagggattaatagacaaagcagcaatggtaatctgaaatacaaagcaaaataataataacctgaatataaaagccatagattaatcgatatggggtgagtacgatgaagaaaataattgttttactcattggtatagttttaattatttttgctttttatcaatacaacaaaaaagactatgcagctaaaagtactaacttgtatgtagaaaactttaaaggggaaaatgattcaataaaaatacaatctgctattaataaagcagagtctagtaaaattaaaactgtattgcttgatgataaaaagtataaaatcacgtcaccaatcattgttaaaaaaggtgtgaaattattatttggttatggatcccaatttgtagttgagggaaactttagagttttagaactagagaaaaacgcatccattgaaggagcgtatataactattgacgatcctaaatttaactctgaagttatttatttagacggtaaaaataaatattataacacttggaacaaaacacaaataaaagatataaatattatcaattggacggaaacgaataaaggtaccggaatttctttatactctgctggaaaagaaaatgaaatttcgtttgttaacttcgaaaatattaaagttgtaggaatggaaactggactgaaattagtagcgaaaaaaccgagcaccggacaagcttggataaatgccaatcgttttatgaacttttctttagaagactgtgtaaatatgatttatatggatagtcaagtaactacgccaaatgaaattagtgggaatcaatttacaaaccttcaaatacagccttcaaataaaacaaaaagcattatacaggtaagtggtcaacataatgaatttcatggaatggtgtgggatttaaataaaataaaacataaaaacgtactcattgaactgactgataagagtatgaatac

SEQ ID NO: 729 - DNA, 1559 bp, Bacillus thuringiensis
acttttcattatcgtccatgtagaatcatttttgggctctctataaaaggacgataatacttttaaagtgtaaatataaaagaaaattgctccctacttattactttttgtgatgaggggagcaattttcttttttgttttttgtttagaaaataaaaagagtctaacaataagatggatacagtgttatctacatacgttgcgctttgcaacggtgattatataacagcaaaatagaagggagctttttcatgactaagtatatttttgtaacaggcggtgtagtatcgtctttaggaaaaggtattacagcagcatctcttggaagacttttaaaaaatcgtggtttaaacgtaacgattcaaaagtttgatccatacattaacgtagacccagggactatgagcccataccaacacggtgaggtattcgtaacagatgatggcgcagaaactgacttagaccttggtcactatgagcgtttcatcgacattaacttaaacaaatacagcaacgtaacaacaggtaaaatttactcttcagttcttcaaaaagagcgtcgcggtgaatatttaggaggaacagttcaagttattcctcatattactaacgaaattaaagaacgcgtatatcgttctggtcgtgaaacaaatgcggatgttgttattacagaaatcggtggaactgttggtgacatcgagtctctaccattcttagaagcaatccgtcaaattaagagcgacatcggtcgtgacaatgtaatgtacattcactgtacgttaatcccgtacttaaaagcagcgggtgaaatgaagacaaaaccaacacaacatagtgttaaagaacttcgtagcttaggtattcaaccaaacattatcgttgttcgtacagaaatgcctgtttctcaagatatgaaagacaagcttgcattattctgtgacatcgatacaaaagcagttatcgaagctcgcgatgcagatactttatatgcggttccattatctcttcaagaacaaaacatggaccaaatcgtttgtgaccacttaaaattagacaatccagctgcagatatgacagagtggattgcgctagttaacaaagtgcgtaatctttctaagaaaacaaaaatcgctcttgttggtaaatatgtagaacttcaagatgcttatatttctgttgtagaagcacttcgtcatgctggttactcattcgacacagatgtagaagtaaaatgggtaaatgctgagcacgtaacagcagaaaacgtaaaagaattagttggcgatacagatggtatccttgtaccaggtggcttcggcgatcgtggtgtagaaggtaaaatcgttgcgattcaatatgctcgtgaaaacaaagttccattcttaggaatttgcttaggtatgcaacttgcatcaatcgaattcgcacgtaatgtattaggtttagaaggtgctaactcttctgaaatcaaccctgacacaccatatgcaatcatcgacttattaccagaacaaaaagatgtagaggaccctagtggtacacttcgtcttgtctatacc

SEQ ID NO: 730 - DNA, 2074 bp, Bacillus thuringiensis
gcaaatactgtgaacgaattttttcgcatgaaattcattatgtaccccctacatagtgagaatttttttcaatagcaagcatgatgttaagtctttatctttttattgtcaatacatatggatgaaaataattctcatttccgttgacaatgagaattaagttgaaatacactaacaacgtatcattatacattgaaggggaaacgctgcatgttattaaaaacaaatcgagcaaaatggattggattatttgttggaatcattgcaggcgttatttggatttgggggaagttttatttttggatatacaaatacgagttggaaactagcattggatgcttttttccattttaacggttccaatgaacatattattattcaaaacgtacgtctgcctagggcgttaattgcagctagtgttggtgctagtttagccattgctggttgtcttatgcaaactttaactaagaatccacttgcttctccagattttattggattaaattcaggtgctgcgttcttcatagttgtagcaattgtaatcttttcagtaacatcattatcagctttcacatggattgcctttttaggagcggcggttgcagctgtacttgtatttgcttctagttctttaggaaaagaaggaactactcctcttaagttaacgttagcaggggtcgcaattagtgcgttattttcatcattaacacaaggattacttgtgttaaatgaaaaagcacttgaagaggtattattttggcttgctggatctgtgcaagggagaaagttagaaattttacaatctgtattcccatatttattaataggatggattgcatctcttatgatggcagggaaagtaaatacattgatgatgggagaagacgtcgcgaaaggacttggacaacgaacaattttaatgaaatcattcgtgttacttattattgtactgttgtctggtggttcggttgcggttgctggcccaattggatttattggaattattaccccgcattttgccagatttctagttggagtagatcataggtggagagtaccgtatagcggtttattaggtgcaatactattaatcttagctgatatagcagcaagatatgtcattatgccacaagaagtaccagtaggagttatgacagcatttattggagctccattctttatttatattgcacgtaagagagggcttagcaaatgaaaaaatatattccgtttcgtatagggaaaggcgggccctcgtttttaatgtataaacgagcttgtctcgtcttatttagtttattagttgttttaataggattattttttgcgagtgcaggtatgggagacatgaaaattgctccttatgatgtatggcaagcgatcactggaaatggcgatgcgatgtctaacatggttgtaaataagtttcgtatgccgcgtattttaattgccatcctcgtaggaattgcgcttgctgtagcaggatgtattttacaaggtctcgttcgaaatccacttgcttctccggatatcatcgggattacgggcggggcaagtgttgcagctgtattgtttttagctatatttagcgataaaaataatgcgctaactgtaagcattcattatatgccgttagcagcctttgttggggcaacgattgtggcgctttttgtatatttatttgcatggagaaatgacgggttatcgccgattagtcttgttttaattggtgtggggttttgggcattaacgaaagcggcaacgactttgtttatgttgttagcaccaatttatcaagcgagtcaagcgaatgtatggattacaggtactgtttatggttcttcatggcaaaacgttatggtgcttgcaccgtgggttctcattttaacggtaatatcatttatagctgctagacatttaaatgcgcaagagctaggggatgatattgcggtaggacttggtgttcctttaacgaagtcacgcgtattcatgttattacttagtacggctttaattgggggagcagttgccttcgccggaggaattggatttgtcggtttaatggcacctcata

SEQ ID NO: 731 - DNA, 1473 bp, Bacillus thuringiensis
tatgcaatggaagccttttttatttctcgggataaaagagggctagggtgaaatacggcgagtaatcatataacgggggaaacataggatgaaacgctattttcagtttgatgagctcggtacgaattataagactgagttcatagcagggttaacgacatttctatctatggcttacgtactatttgtcaatcctgctacgctgtcgcttggaaatgttaaagggttaccagcaggtacagggatggatccaggtgcagtattcgttgctacggcattagcggcagcgatcggttcgttaattatgggtattttcgcgaagtatccaattgctttagcgccaggtatggggattaacgcgttctttgcttatacagcagtcttaacgatgggtattccgtggcaaacggccattgccggaacattaatgtcaggtattatctttattattcttactgcttcaggtattcgtgaaaaaatcattaatgcaattccatcggagttaaagtttgcagtagcagcaggtattggattattcattgctttccttggattccaaaatgccggaattatcgtgaaaaacgatgcggttcttgttgggttgggggacttaacaaagggcacaacgttactagcaatcttcggggttgttactacgatcatcttcatgattaagaaagttaatggtgcagtattctacggtatgattcttacagcgatcttaggagttgcaacaggattaattgatactccgaaagctgtggtgggagcaataccaagtctagaaccaacgttcggcgtggcgttaacgcacttcggagatattttcacagttcaaatggggattgttattataacgttcttctttatcgatttctttgatacagcaggtacgcttgtagcggttgcaaatcaagcagggttaatgaagaacaataaattaccacgtgcaggaaaagcgttatttgcagatgcgattgcaactgtaattggtgcgattttaggtacatcaacaacaacgtcttacattgaatcgtctgcaggggtagcagcaggaggacgttctggatttacagcagttgtaacagcaggattcttcttactggcactattcttctcgccattattaagtgttgtaacgccagctgtaacggcaccggctttaattattgtaggaatcttgatggtttcttccttaggggaaattgattggaagaaattcgagattgcagtaccagcattctttacaattatctctatgccacttacgtatagtatcgcaactgggattgccattggatttatcttctatccaattacaatggttgtgagtggtcgtcgtaaagaggttcatccaattatgtatgttatgggagttttattcgtactatatttcatctacgttcgtaaataaaaggggttttttaaaggtctagacttaaggggagtctagaccttttgcgtcttagaaaa

SEQ ID NO: 732 - DNA, 2476 bp, Bacillus thuringiensis
taacaactgagtattataaaacacccgaatgtgcaaataacttatataaaataaattcgattacaaaaagtatcgtatctttattaattggtattgcagttgataagggctatataaatgatatacatacaccgatcacagagtggattgaaaatgtacctaggggaaaacataatttaacactatatcacttattaacaatgactactggtgaggactggaaagagtttgggaatggagtagtattcccaaatgactttgtagaatcagagaactgggtacagtacatattagaaaagccaataattgaagaacctgctacaaaaatgaattataattcaggttcttctcatttactgagctatattattcaagaagctactggaatgtcgacagagcggtttgcaaagaaatatttatttaatccattagaaattaacgaatacgagtggcaacaagatccgcagggtatatatgccggcggcttcggtatgaaaatgaaatctaccgatttattaaaattaggaaaattatgtttgcaaaatggatattggaatgaaaaagaaattgtatcagcgaaatggttagaagagtcaagtagggcgcattttgaaacatatgaacatgtcggcgcatatggatatcactggtgggtattacataccgaaagatttcacataccgtattgtatatatttcgctatgggatacggcggacaatacatcggttatcattcctcagttagaagtagtagctattataagtagtcatatgccaaaacgtgggctcgttccattaaaactatttattgagcatgtacagggaaattctaattatatataagaaaaggagggaatgtatgaagcatgaaaaaattttatctttatttagattctgtttaagtcttctagtatgtagcgccattattacgcaattcataatcagggcacaagtgaaaccgttcaatccagttaacttttttagtttctttactatcgaaagtaacattttagttgcatgtattctccttttaagtagtatcggaacagctacatttggtcgctcagagcagtttagtatacttcgtggtgcggcgacggtatatatacttacgacaggactcgtttattttttgttactaagagggttagaagagtcacttcaaacggcaataccatgggtaaatactgtgctacattatatcatgccgattataatgcttttagattggattttaaatccacctattaagaaaatcacttggaaacaagctgcaagttggcttttattcccgtttttttacgttgtatatagcttaatacgtggtccaatcgagaattggtatccatatccgtttttagatccgagaataggtggatatggtaaagtacttttatacagtatagggatagcagttgtaattggtgctatttgtatattggtaagatttttagggaatcgaaactttagaaaagaattttagaaatgcaagaaccccactgtgtctgtttttaacagtgggggtttcactttatccagctatttgtcgggctgcccgtaaaagtccgattggtgagggctgatgattagtgggagatgaacaaaacccccgctgattaaggtttcactttatctactcgtcttctgaaacgacaactttataaatttctccgtcttcgtttcaaattctacatcaacaaaaacaccgtattcttttccgttctcacgtaaccacaatttaaatttttcaacagttatttgaactgtttttggttttctacctatatgaagatagtcaataatttctgcttttgggtattgttctttcgtcttttctacggcaagtttaccccatttggcatacggcggctgcgcatgaacaattgatgagcctgtatatatatttgaacatgttgttaggaacagaatgacaagtgcgacacgttttaaccattttttcatgatgaactccttttatccttttttatattgtttacatattttttcaacgatattagtttggatttttttgtcttctttacataaaagcgaggcttttacaaaacataaccaagaaatcatttccgtaattaaggagggaaaattatgcgccaaaaagctatttttaaaatagcagttttacttgcgttcataggactgtctttaatggtcagtagtatacaattaaagaatgtagaggctttttctaatcaagttattcaaagaggagcatctggcgaagatgtcattgaactgcaatctcgtttgaaatataacgggttttatacgggaaaagtggatggtgttttcggatggggtacatattgggcacttcggaattttcaagagaaattcggattacccgttgatggtttagctggagctaaaacgaagcaaatgctcgtgaaggcaacccagtatgacaagtcaactgctaataaaagaacgacaacgaataaaggaaatagcggtggca

SEQ ID NO: 733 - DNA, 1367 bp, Bacillus thuringiensis
caacgcatacttcgtgaaatggacttaacctctgatgaagcaattgaatttgcgaaactaaatgcaggtgtcgttcagccatcaaaaacaagtattaatccatactacctcgggtattaaaatctttgaagatattgaagaacggtacaacaatccgactgaagaaatgaaacgacgaggcgtaaaaccaggatctggccgtgacaaaatctttgaagtacgcgaaatcgaatgggatgtatcgtttttaagaaactacttaaacaaagatctcgtaatgagagaagatatgtacttattccagcgccagggaaaagaatataaagtaatagataaagagtgggaacatgtacgtgatcagctcgtaaatatgcgtacaaatggtggattcccgtatttagtagtagaagatggagactacttaaagaacggagaattgtacattaaacatagttacgaaggaattgagctcgatttaaaatatttagaaaaagtattaccatatcttcatcagctgtggggaagaacggtgcatatggagtcgattgtggagagtaagggtgttgtgttttcttatgatgggaagatggtgcatcggaagtatgtgtgaggggaagaacggacataggatactgtgtccgttctttttatttggaaccaagttaaatatgctattcttgaaaaaagggagttatatagagaaatggagtgatttaaatgagcaaaataggggtatgtaaggttgatattacgccgcctgtaggtattgattttgtcggatatcatagagagacaggaataaataatattgaagagcgtatttatgggacagtttttgtatttgaaaaagatgaaatgaaaactgtgtttataagtatcgataatattgggatgttagtagaagatacgaatatgattcgtgagcgagtagcaagtagccttcatgtgccatttgagcgaataacggttgtttatactcatacgcattccggtccagagacagtcggtgatgatccgctagtgcagtcgtataaaatgattttagtaaataatgtagtacatggtgctgttactgcaaataacaatttaaagcgatgcgaagttggatggggtgttacgacaggtgatatcggtgtaaaccgacgagagagaacatctgatggaaaagcaaagatgggaacaaatatagatggtgttgtcgataaacgaattggcatgttagcaataagagatgctgaaacgaaggagttatctggggttttagtgttttgtactgcgcatccgaatgttttaaaaggtgattgtgatgaattatcaacggattataaagaaatgccgagagagattctagagaagttagtgaactg

SEQ ID NO: 734 - DNA, 1865 bp, Bacillus thuringiensis
taaaatagattatgaaatttcaaatcttactgatcgtgaattttgtcatatgtattttcacaatgtcatcaatccacttccattcgcaccaggtgaagaagtagacgatgtgatgaaagtacatgcaacttcttttctacaactattaaatggtgaaatttcatcttttacagctagttctgttttaaacaataaaccaattacaataacatttgaagatatttatccgtatgatcttgcatactatgaatttgttatagagaaaggaaaagaattattaaaaaataatagtttataaataaaataggactcttagcataatattgcgtagagtcctattttttattattgttcaagtatctttaatttattctctacttgtataaataaaagaataattaataacagcataaccaccataatcgctattattgtatgtggatatctaaacagtatactaataacacttccaattaacatcatgatgaatccgttttgcttcatcacttctgcactatacctgttacccgcatcccataattccttatttttcatagatcgtttcgtacgataaccatatgccgcattaatatcggtcggtggatttttttgaagaacaattgccgcaagtataaatatagtacctattaaaatactcattcctatgtttattagtgcatacatcaattatatcccctcctaacttacaccttcattatacgacatgacccttttttcaaatttataacacattcaatttctttcttttgatgtgtggaacatacttggaagtgttacaaaacgtgcccctttcgtttttaactgcggaatgattttgtctagtgcatctacagatccttgtaaatgcccacctggtgttgaatgctgaaggatgacacttcctggaaatgaattccctaatacattatttgtaatcgtatcagcgcttacacctttccaatcaactgtatcaacactccactgtacaatcataaaattttgctctgttgcccacttcaattgctcttcaagtatttcaccgtatggcggacgtataaacttcggtgcataaccagctaaacgatttaatatttcttccgtttttattatttgattacgatactcagcatcatttactttcgctaagttcggatgactatacgtatgattaccaattacatgcccttcatttgcaatacgctttactacgttcggaaatttttctgcgttttcaccaagtaagaaaaaagtagcttttacattatgttgttttaacttatctaatatttttggcgtgaattctaaatctggtccatcatcaaatgtaagagcgacttccgctttattatacggtcctgaaaatgcgtacgcatatttttcgacccacgaaaatggtgtccacgatccacgctcatatgctttcatttgtacttcatagttttgagggatatatgcgtatggcaatgaacttatatagtctccataataaaatgagttatatggcatataagcatacgaaacatctcgttctagtccccattgatatggagcaaacatttgtggcgaataaaaataatacatgataaaaaaacctccctaatttttcatatgtgattcctctgcactttgttagagaaattgttattcataaacaaaaaataagactgtccttaattaggacagtcttgctgctttatattattaatacatcgatgtactatctttcggcaaagctttcacatgttttaaataagttcgtcactttaatcatcctcatcttgcggatatagatattcatatgtgtaagcgatttcgttcgccacttccctaaataaattacccatgacaaataatgactcccatat

SEQ ID NO: 735 - DNA, 1513 bp, Bacillus thuringiensis
tagaatcattcctcggtacgtctcgagatatctctagtgtgcacgccgaccaacaacctcgtgtatgagagctagtcctgaatcgaaagccgccctagagctactaacatctaggttcgagggtcaggctgctcagcctgcgagtagggagtcccgcacgttcactgagaaacactcttaattatgtggtaagtccacaggagcggtaagaattgtcccaaatgatcctaagaccattatctagaaatatcttgagacgtccaagagttattttacaggtctctcatgaaagtaaaaaaattaagtttaaacatactatacgaggagtggtaaatatgaaaaaagtagagcaattatcttctcacctatatcttattgatgatttcgatttacagcataatgaacgaacaggtacgtacgttttattaggtgacgatattactttaattgaaacttgtgcagccccttctcttccgtatattttagacggcttacaacaattacatattgatttaaacgatgttaaaaacattatcgttacacatgtgcatttagatcacgctggcgcagctggtttaatgatggagaagtgcccaaatactacgttatatgtgcattctcgtggtgctcgtcatatgattgatccaacaaaactcattttaggtgcaaaagctgtatacaaagaagattttgataaactatttgatccaattcttcctatagaagaagaacgtgttcgtattgtacaacatggtgatacgttaaaaattgccgaagaacgtatccttacattttatgatacaccggggcatgctaagcaccatattagcattcacgattcattaacaaacgggattttcactggtgatacaattggaatttattatagagaactcgcaaacgttggtgtagaactgtatctaccatcaacgtccccttcacaatttcaaccagatgcgatgattgcttctaaaaatcatattcaaagtatggatgtagatactatttatttcggtcattacggcgcatcctctcatgttacagaagtatacaatcaactggaacattggctacctattttcgttcagactggtaaggaagtctttgaaaagtataatgatttcgatgaagcgactaaagctttacaaactttgttaatggataaaatatcttctcatcttacaaagttaaacgttccatcagatcattccgtttataatattttacatctagatatagaaattagtgcaatgggcattattgattatttcacgaagcaagaaaaagcaaactccactattaactaacagtaaaagaagagatatacaacagtagttattgtatatctcttcttttttttgaatatattttgagtaaaggatggtggaatataatgcaaaaagtgatgctatacctctgctttacattatttatcgtcttattattatttgtaggagtaaaaattcaattttatttagatacagaccggcaagtgaactttaacgtttatcca

SEQ ID NO: 736 - DNA, 1684 bp, Bacillus thuringiensis
agaagccatttggcaattgtttaaacaaggtggttatgaaagaacagaatatgaaaagaaagctgatgtatatgttattaacacatgtacagtaacgaatactggggacaaaaaaagccgtcaagtaatcagacgtgctgtgcgtcaaaatccagatgcagttatttgcgtaacgggatgttatgcacaaacatctccagctgaaattatggcgattccgggtgtagatattgtagttggtacacaggatcgtgaaaagatgttaggttacatcgaagaattccgtaaagagcgtcaaccaattaatgctgtccgtaatattatgaaaacacgtgtgtatgaagaacttgatgtaccttatttcacggatcgtacacgtgcgtctttaaaaatacaagagggttgcaataacttctgtacattctgtatcattccttgggcgcgtggtttaatgcgttctcgtgatggaaaagaagttattaaacaagcacaacaattagtggatgcaggctataaagaaatcgtattaacgggtattcatacaggtggatacggcgaagacataaaagattataacttagctggattacttcgtgatatggaagcggaagtagggggattaaaacgtcttcgtatttcttctattgaagcgagtcaaatttcagatgaagtaattgaagtgttagataaatctgaagtagttgtacgccacttgcatattccgttgcaatctggttctaatactgtattaaaacgtatgcgtcgcaaatatacgatggagttcttccaagagcgtttagatcgtttgaaagaagcgttaccaggccttgcgattacatctgacgtaatcgttggtttcccaggtgaaacagaagaagaattcatggaaacatacaatttcattaaagagaaccgcttctctgagttacatgtgttcccttactcaaaacgtacaggaacacctgcagcacgcatggaagatcaagttcctgaagatgtgaagaatgatcgtgttcatcgtttaattgagctatctaatcaattagcgaaagaatatgcatcagcgtttgaaggtgaagtgcttgaaatcattccagaagagcaatttaaagacggcgaccgtgaagggttatatgtagggtatacagataactacttgaaaattgtatttgaaggatcagaagaattaattggtaagctagtgaaagtgaaaattacgaaagctggttatccatataacgaagcgcaatttgttcgtgttcttgaagatgatgtaaaaaaagaatcagctagcgcataaaaagagcgtgcaaccggaaacggtttgcatgctttctttatgtgaagcggttaagtactataaggtggggaggcgtttcatgcatccctgtataaaaaaaagtgaaatgataatgaatataggttgtcttcgatcgagtatagcgatactagctagttctgctatagcattttgcatagtttaggcttctattcttcttttgttgtggcatatagttgccctgaagtgatgtggtgtattattgtcgtgaaattcatgctgaagaagtggtgctttttgcatgctgaagttagtatgtaagtctcatgtttggcagggaggtgtatagtgtgtctaaaacagtcgttcgtaagatcaagtctttgaagcatgccctgcgctcac

SEQ ID NO: 737 - DNA, 2094 bp, Bacillus thuringiensis
tctactaccgcttcaaccattgttccatttttagcataattcgtatgccaagaaaaagctttttctaaaatatgaggagtttgtccacctcttgtttttgcttcttcgtaataagcacgtagttgatcacgatacattggatgtgcgcaattctcaataataagttccactctttctcttggcgcaagtccccttaagtcggcatacccctgttcagtaacaataacatctacatcatgttcagtatggtctacatgagaaacgaaaggaacaatacttgaaatgttaccacctttcgcaatcgatttagtaacaaagatagctaggcgtgcatttcttgcaaaatcaccagacccaccaattccattcatcatttttgtacctaaaacgtgagtagagttaacatttccgtatatatctaattctaatgcagtattaattgagattaatccaaggcgacgaatgatttcaggatgattggaaatctcttgcggacgcatcattaatttgtcacgatatttttcaaagttagaaaatacttgttgcattttctcttcagaaagcgtgatagaacaacaagaagcaaaattgacttttccagcatccataagatcaaaaactgcatcttgtaaaacttcagaatacacttgtaaatcttcaaattctgaatctaacattccatgcaatactgcgttagcaactgaaccaattcctgattgtaacggcgctaaacgatttgttaatcgccctattttaacttcttctcgaaggaattctattaaatgctgtgccataatgaccgtttcttcatccggaggaacaattgtcgatggcgaatccaattgattcgtaaacacaattccctttactttttcaggatcaattggaataccgattgttccaattcggtcatctgttttcacaagcggaattggaagcctctccccttgtttacctggttcatatagatcatgtagtccctctaattgcgtggattgagccatattcatttcaataataatagacttagcatttaaggaaaacgctaaggaatttccaattgaagtggttggaataatcattccgtcctctgtaatcgcaaccgcttccaaaatagcgaaatctatatccagaacgtcagcgcggagtaactctgctgtatgagataagtgttgatccacaaataaaaagtctccgttattaattccttttcgcatcgtcgcgtcagcttggaaaggtaatcttttccctaaaattcctgcctcagcaaataatttgtctacatccgagcctaaagaagccccagtataaacatttactttaaaagattcatcattcttaactcggtttacaagcgcaaatgggactgcttttacatcacctgcacgtgtaaacccacttaagcctaaagtcattccactttgaatccaggaagctgcttcttcaggtgtaactacccgatcttttagacgttgatctctgattctatctaaattattctccatatgtaatccctctctcattgaatattcataattattttacacatttacactatcaaaatagggattttagtatacaatgccgaaaattcagacagaacagcaaatttaggttctaaagcagaaaaatttagaatcctagaagcttacggaaataactagcgtatgattgactaactggtactctctcaccattatccatcgaaagtacaaaagtagaatgggtatcaggataaatcgctttaatatgattaacatttacaataaatgaacggtgacatctaataaatgaatctttaggaagcaagtattcgaattcttgcagagagtatttatgtgttcctgataactcttctgaattcacgtacgtctttttatctttagcctctaaatacataacctttgaaaaaggaaccggaatccagccatctgttgtttttaaagtaacgactgactttccatccgttaaagctggataaattgccgttacgcacccttcaagctttccattgtttgaaaatggtacagccattccatgataaggaataccaaaaacatcccgattcataaactcagatgttttttgattcat

SEQ ID NO: 738 - DNA, 1635 bp, Bacillus thuringiensis
caaatggctcttcgataggataagcatcacgtgcacccgcttgacgagtcgcatcgattactgcacgtctttctacagctgtaataccagatggtacacataccattacatacggcttacgtgagaagaaaccgtttgatttttgagcttgttgaatgtaatatttcatcattgttgcagttgtttcgtaatcagcaattacaccgtctttcatcgggcgaagtgccacaacgttccctggtgtacgaccaatcatttgttttgcgtcgctacctacagcaacgatttgtttcgtatcagtttgtaacgccactactgaaggttcacgtaaaactacaccttttccttttacatatacaagcgtgttcgcagttcctaagtctattccaagatcgcgagtaaatccaccaaatccaaacatattatttatcttcctttcttgttttcacggactcattttttcttaatttatattataaaaacagtacgttttttatatctttatcctttttgtagataaatttctacaaaaaactcataaatcacattataaaacaaaataagtaaaaagcatagtcttaaatatgacctttttcctttaaactcacgaatttatggtcacctattataatatgatcaagcacttcaattccgataatctggccgcattctactaagcgttttgttacttcaatatcttcacggctcggcgtgggatctcctgagggatgggtatgaagacatatgatagaggctgctgcacgacggaaggcttctttaaaaacctccctcgggtgtacaattgacgtgtttaaacttccaataaagatcgtttgcctatgtataactcgattttttgtatttaaatataaacaaacaaaatgctcttgttgtaaaaaacgcatttcttccatcatgtatttcgcacaatcttctggacttcgaatactatatctattttgatattctaaacgtaccattcttctgcctagttcaaaggctgccataagttgcgatgcctttgaaatcccaataccatgtatactaattagctcctctaatgttgcatctttcaacatacgtaagccatcaaattggtgtaaaattttatctgacaactttaaaactgtttcttctttagaacctgttctgagtaacactgcgagaagctctcgatttgataaacttccagcaccttctaacaataaacgctcccgtggctgttcttctcttacaacatcacgaataccgttcatctctccacccctttatttgttctctcaaagaaaaccccatgcaattttacgcatgggttacatcaatatcaaattgttttaattcccgaacgaggcgtgcgattggtaagccaactacactatagtagtccccttgaatattttgaacgaaaatagatcctttaccttgaatcccataactaccggctttatcaagaggttctttcgacgcgacgtatgtatcaatttcctcttctgttaactcccaaaatgtaacttctgtacgctcataaaaagtaaccgttttttcttttgctataatacgaacacctgcatacacttcatgtgttttccctgatagtaattgtaacatcctctttcgcctcatgctcattagaag

SEQ ID NO: 739 - DNA, 1153 bp, Bacillus thuringiensis
cggttgtagtgaaacgggtcagccgattacatcgaaaagtactgggatttggaatgaatatttcgtatatccgctttctcagttaatcacgtattttgccgacttatttaacagtaattacggtttagcaattgttattacaactcttatcattcgttttgcattattaccactaatgattaaacaaacgaagagtacgaaagcgatgcaagcgttacaaccggaaatggtgaagttaaaagagaaatatagctctaaagatcaagcgacacagcaaaaactgcagcaagaaatgatgcagttatatcaaaaaaatggtgtaaatccattagctggttgtttaccaatctttattcaaatgccaattctgttcgctttttatcatgcaattatgagaacagctgaaattaaacaacatagtttcttatggttcgatttaggacatgcagacccgttctatatcttaccggtcgttgcagcaattacgacatttattcagcaaaagcttgcaatggcaggaacagctggtcaaaatccgcaaatggcaatgatgctttggcttatgccgattatgattttaatctttgcaattaacttcccagccgcattatcactttactgggttgttggtaatatctttggtattgctcaaatgtactttatcaaagggccagaaattaaggctagcaaagctggaggctcaagcaagtgagtataattactgctaaaggacaaacagtcgagctggcagtagaggatgctttaaggcaattaaatacatcaaaagatcgagtagatataaatattgtcgatgagggtaaaagaggattcttaggtttatttgggaatcgtcctgcagtagtagaagttgtattgaagaaagatccaattcaagaatgtgaagaatatttaagaaatgttattcacgatatgggtgtggaagttgagattagtaaaattgtaaaaggacgcgaaattgaatttacaatttctggtgataatgtaggtgttttaattgggaaaagaggtaatacattgaactctttacagtatttaacaaaacttgtcgcgaatcgtaacacgaagcagtatatcggtattacactagatgctgaaattatcgtagtaaaagaaaaagacgttagaatcactt

SEQ ID NO: 740 - DNA, 2379 bp, Bacillus thuringiensis
caccgcattttttagctgatgcacattataaatttgtaccgaatcgtaatttttactacttaacgggaatcgatgaaccaaatgttatttttatgctgaaaaaggttggaagtagtgttgaagaaacacttttcattgaaaaggcagatccagtaatggaaaaatgggtcggtaaaacagtttctaacgaagaagcagagaaaatttcaggtataaagaaagttatatatttagatagctttgaaaagacaatgtcaaatatactttttacagaaaatgcgaagcatctatatttagatatagaacgtcgtgattggaatggtacggagacaaaaacattagcatttgctaaacatgtaagagaaaaatacccacacgtaacaattggtaatgtatatccgaacatttgtgaattacgagtatttaaaacagaggaagaaattgaaattattaaagaagcgattgctataacgaaagacggtatttacaacgtacttaagcatgcaaaagcaggcatgatggagtatgaattagaagcacaatttgattttacactgaagtcatctggaattaagtaccatgcgttcaatacaattttggcgagtgggaaaaatgctacagttcttcattatgaagataatgatgcacaaattcaaaatggtgacttagtattactagatttaggtgctcaaaaagactactataacgctgatattagttatacattcccagcaaatggaacattctctagtcgccaaaaacaaatttataatattgtattaaaagcattaaaagaaacaacagagattattaagccaggattaaagttcgctgcattaaatgagcatacaaaaaaggtactggcagaagagtgtaaagcaattggtttaattcaagaagatgaagagttatcaaaatactattatcatggtgtcagccatttccttggtttagatacacatgatgtaggaacatataaagatagagtgttagaagaaggtatggttataacaattgaacctggtctttatattgaaggagaatcaattggaattcgtattgaagatgacattcttgtaacgaaagacgggtatgaaaacttgtcaaaagatatcattagggaagttgaagaaattgaagaatttatgagtgtaaataatgaacatgtaaaaggaaaccaagctgtagttaaataataaaagagtcatcactaatttatttgaactttatctcgaatcgtggacaattaaaaaatccatgattcgggatagggttcttttcttcgaaatactaatctttaattattaatcctaataaagtagcaaactgaacagcttgatatgtcgatactttacatcctcttaaatcgttcactgaaactgtaagtgtatcaaaggtagaagaactaatatctatccccttcagtgatgtctgatcaaaattagcttcatcaagactacataattggaattcaacttttttaagtttacagtcaaaaaaatctgcattatttaatgaagtttcattgaagatgattttttctagtttagaatttccaaatgccgctaaattcaaaattgaattctcaaatttaacatttcctaagctagatcctgtgaaatttactccgattaatttactgcttttaaattcgactctgtgaacagaagaattgcttaaattaacatttgataaatcacagttttcaaaacaaacatctgtaatatcaatattgctaaagtctgtattagtaaacttacagttttttatcaccgcatcatataaccgcactctatctacagattcattttcgaaagtggagtctataatttcacacacttccaatgttggatcttcttcataaaaaatatcttgaaaattctttgaagataactctggtgaaatttttggtctatcaattttcatcgtatatcaatcctcttctatttgatatatttgcgtaatttgagtccattgtctgtgaggaacattagtttttattatacaaaaatctaagttcttttgtgaagagcattttagctacatttttcttatttaataatagcagtgttattgtttcttaagaaataacgtcaaaacaaatacgagaacggctaatatagtcgctacaaggaaagcattttgtattactaaaatattcgtctcttgtaatgtctccgcttttagtaattttccaattagcttacgtaagatctaattacatctccttattttcttgaaaatcaacttctataatgattttgaaaaagaataaggagggattgtccatgaagcgatttgtattagcagccgttactgtctctgtaatatttttaattgctgcctgttctgtgacgaccaatacaacaaaatgatcat

SEQ ID NO: 741 - DNA, 1848 bp, Bacillus thuringiensis
  unsure (1)...(1848): unsure at all n locations
catacaaattaacaaaagagcaagcttctattttttatatgactccttttcaagaaggaaatggcatattttataacgttacgcttaaaaatgataaagatgaaataaatgctacaattgattattataacaatggtaagaaaacaaaagaaattgctaatatagctacctcacatttttcaaaaaagaaagtaaagctttcttttttaccaccacatttccaatttgataaagatatacaagaaaaaaggcagtggtatctgaatattgaaggtggttcaacacttgttcctgaagaagcgccaccaagcgtaaatagctctgcaactactacaatccaatctataaaaaatttaaaatacaatcaaaaaacaactttagctgctgtaatccaaaccagtaaagaaactgtaagcgtccctacaattgacgaagaaaagggtattgatttactcttaaaagaaaatgaacacgtttatctatttagtatcgagctaaaaaaagaacataggcggggaaaaaggcaacttaaagnggcatnnnccgctttattgtttaataaggtgtacttttatggatttgaatcaaatccattttctgttactactattactcatcttctacttctattcttttcttctctcttgcaatttttaaaaactctagcagctctggattactattcatttttttgtaagccactgacatttctgcaacgaaattagaatcatataactctttatatacaacttctgttttatataacttatttgccgacacgggtattactgtaattccaatccctgctgctacaagccccataactgtttgatactctgttgcttcttgtacaatacgtggactaaatccaacttctctacaaagagataaaattgtatcatacaaagctggccatactggtctcgtaataaatacaaacggctcatctcgtaaatcttctatatgtatttcatctttctctgcaagtggatgtgcctttggtaaacacaaagtgcaagataacctttgaattggctctaattctaataattgcgttggaattggtggacgtaaaaagccaatatcgatacggttatcatgaagtgcatgaacttgatctggtgttgacaattcatgtaatgcaacagacactctcggaaatttctttctatattccctaacaattgatggtaaaatatcatatatcgccgcacctacaaaaccaattgaaagtgatcctacttctcccctttgcgcactttgtgcaacttctactgctttttcaatttgttcaaacgctttttttacttcttttaaaaacatttctcctgcttctgttagttcaacctttcttttcgttcttgaaaataatgtaactcccatttctttttctaattgctgtatttgttgactaagtggtggttgtgtcatttgtaaacgagcagccgcccgtccaaagtgtaactcttctgccacaacaacaaaatattgcaaatgccgtaattccatttttggacacccttttcactttcgattaatatgtcttatatattaataacatataatttatatattagacaaatattttgaatgaacgtatagtagaaattgttaattcttttttacaatttttatgtaacaaaagaaagaggtggttactgtatgaaatggtggaagttaagcggacaaattttattactattttgtttcgcttggacaggtgaatggatcgcaaaacaggcacacctcccagttccaggaagtataatcggtattttcttattattaatttcattaaaatttaggctagtcaccgaagaatccataaaggaaccaccagatttttta

SEQ ID NO: 742 - DNA, 2849 bp, Bacillus thuringiensis
attaaatccatagttgttgttaataattgctactgatttttctatatgtccaaataatacagcccataggggtcttattgacataccaggaggtgtccaaaacggcttttctaacgcatcataccaagtacgatcaatagggaataaaacactagaaacataaaacaaaccatatgttagtaaaaatactataatactagattttttcataaacattctcctttttaatagaaggttttagaaactctatatgattcgtatactctttcaatgaatacaactttaatacgcaaatagacattataacttttacatatcaaattcatattgactcgtgtattttatataaattctttcatacttttatatgcacaaagggctctctctcgtgctgccttatgatcaacaatcggataagggtatgtattcccaagttttatattggatttttgtaaaatatgctcaggtgcttcccaaggtttatgtatatatttgtttgggatatctcttaattctggtacccatcttcttatatactctccatttttatcaaacttttctccttgtgtgataggattaaaaatacgaaagtacggtgatgcatctgctccacttccagcaacccattgccatcccattgtattatttgcaatatcagcatctagtagtgtatccataaaccattttgcaccttcttgccacggaattaacaaatgctttacaagaaaagaggctacagccattcttgcccgattatgcataaaaccggtttgccatagttctcgcattcccgcatcaataaacggataaccagtttcacccttctgccatactcttaataactcctcttccttattccacggaaaatgttcaaagctcttattaagaggtttatatactgtaaatggataatggtatagtaaataataagaaaactctcgccaaattaattgacgtataaagctattaacttgtttttcaaagagactagattgtctttcagtacttttatttattaagtaatgaaacattagctttactgatatttgtccaaatgaaagatacggtgccaacatcgaatggacattttgatttggaaaatctcttccttcactataagaggctaatttactagagaaaaatttcttaaatgttttgtatgccccttcctctgtaggctcccatattgcttccatatgagatgtccacggtatagtcggcaacaagtgtaattctgagacagataagcttgctggtaaagagtttccccactttatactctgcactctgttaataggtttaggtattacctgcttttgaaatgcattgtaaaaaggcgtaaacaccttatattcagtgttatccttcttttttataatccacggttctaataataaatgcgaattaaattccttacaaataatacctttatcttctaatatcattttcattttttgattagattttaacctgtctggatcataacaactattccaatatacagccgttatatctaattgttttatgagagaaagtatttcttcctgtgtatttcctttgcggattattaaagtagagcccaatgccttaagttgcttttggacatctattatagcatggtgtaaccaccactttgccgcacttcctattgaaaaagtttcatcttgtacatataccggaagaacctccccggactgaacagcctcaaatagagctgggttatcatataaacgaaaatctttttgaaacataacgataattttgttttgcatggctatcccctcttactcttaaaacataatagattctttatgtgaataatcctcttttttacttttgcattattatattaataattctttgtaatcgtaaacaaacgtttccatagttattggacttctatctagtaaattcgataaatctgatgtgacttttttagctaaccctaattttgcagttgtatatattccaatcataacccaaataaagtcactgttaagtcccttttgaatcattctttttctaaatttaaatatacttggatttgtataagtaatatctttatttattatttttgaaataatagcagcaacttcataatatgttaatgcctcatttcccgttaaagaataagctttaaattcatgtccctcttcggttaatattttagctgcaacttctccaatatcccgtacatctataaaacttgtttcccctttaccagcaggtacttcaattattttttcatttcttaattcatcaccatgttgtgataaataaattttgcataaaaaaactcggtcttaggaatgcgtaggggatcccagaagcctttatcatagcttcaattttagcatgaggtactatcggatttttttctacacctaataaagataaaaataccatgtgttttatacctatttcttttgcggcatctacaacaggctggaaatacttttttgcatcagctagatgtggtggtcttattagaaagactttagtaacacctgttaaagccgcctttacagatgaggggttttcaaaatcaaaatacactccttcagtttctctactgcgcgttgtgactttgaaagtatcatttctttttattaggcattttacaacctcttttcctacattccctgtagcacctgttactaaaatcattttaatcaccctttatttttttgtaaattttgaatcatactttgcaaaactcgaactgtattttctacttcctctttaggaatactagctgtagcattttttataacttcatcgcttacattttctatctcctgtattaatgcctgagttcatctgctatactatatatgcgaccgttatct

SEQ ID NO: 743 - DNA, 1896 bp, Bacillus thuringiensis
aaacgacaatgggcggagcttttgctattgatccaaatcattttgaaggaaagatatttataaatattgattctgaagaagatcataaattacttgtaagtagtgcaggtggtgcgaaagctgttgaaacaattcaagtaatttgggatgaaacgccagcgaatatggatgcataccgtatatatgttggtggtctaaaaggcggccattctggtatggaaattgataaacaacgcggtaatgcgaacaaagtattaggacgagtattacgtgatttatcagtacatacggagttttacataagtgaagttcacggcggattaaaaacgaatgcaattccgcgtgaaagtgtagctacaattttaattcgtacagaagatgtaggacaagtagaagaaaaactagaatcatggacacgtgtattacaagaagaaatgcgtgctgttgatccagatgttcatgttacactgacaaaattggatgaaaaagttgaaaaagtatttgctaaagagacacaaaagcagcttatttcatcattattcttaattccaaatggcattcaaagtatgagcatggatattaaaggtcttgtagaaagttcaacaaatttaggcgttattgaaacgttgcaagatgaaattaaattacgtaacgaagtgcgaagttctgtaagtagtttaaaacaacatgttgcagaagaaatcaaatatattgctgaattagttggtgctacatttgaaatagagtcagagtatccagaatggccatacaatccaaactcacaaattcgtaatttatttgaaaaagtacatcaagaaaaatacaataaagaaattgaaatcttcgctgtacatgcggggattgagtgtagcgcattcgttcaaaagatgcctgacttagatgcaatgtcattcggaccagacattttcaacgtccacactccagatgaacatatcagtgtctcttctgtagtgaataactggggattcttcattgatgtaatgaagggtacgaaagaattagctaagtaataacgacgaaataaaaaggagcctataaaaatttataggctccttttttgtattggaatttatcccactatttgccgggcagcccgattggttcaactaataatcagtgggggatgaataaaaccactactgattaaagtttcactttatgagaagtcatttttcgttagtatgtaatattaagcttgaacaattaataaggatgaattgttgatgttttttagtactgatgaaggggtggagaaatgaagggaagaaatcattttattgtttgtatgtttttattgtttttcacatttagttttattggtgttcagaaaataatagcagaagaagttgaattttcaggaacaacagctccattgaatgtaaatgttagagaggcaaaaagtttaaatgcaaatattgtagatgtgattcccggaaatacaaaagtatcttttaaaggatgggagtatggtgaagcggttaaagattactggacaggaaatttagataatcgttggttttattattttaaagatggaaaaaaagtatatgtaacgtcagcgtatattaatggaaatcccccaagtacaccaacagaccgtaaattatctgtacctaacatattacaagaaagatcaaattggtgttgggcaggcacttcggtttcagttttaaattattttgggaaaactccttcacaagatcagtacgttaggtatgttaagggtggatcatataataatcctgcaacttcacgtgaaatacaatatggattatcgggatatggtgttagctcagctataagttctggagcaaaatcttatgattggttcaaaagtcaaattaatagtaatcagccgatgattgcactcattat

SEQ ID NO: 744 - DNA, 1847 bp, Bacillus thuringiensis
tgcatcatcagagaaaccaccttttccatctacagttaaggctgcattatctaacgcaaatcctttataagctactgcaatatctgttaagtactcaaattgcagttttactttttttcctttgaattggcttaaatcgtatgatttatcaacccacttaccatcagttgtatccgcgccgccttttatatctttttcgcccattctatcaatgcgtgtcttcgttccatcttctgcaatcgcatatacgtcaaggaaatcatacttcgcttcaagttcgtaaaatgccttataatcgaacttagcatcctttgcatttgttaagtcaaatactggtgtctcaagtgttgtatgaatgtcatttccttttgtactgtaatagaacttcttaccaaacgctgattcgatattttttatatctttgtccggcaagttaacacgaacaattccaggtcgtttagattttgtagtactttgatctacatatgttgcaacaccgattcctttgctaagtttgtcataatctacttcaagaatattcgcccagttccccttcatattcttttggaaaaactctttattttgtggcgagaaactcgttggctctgttcctgcaatttttccagcccagctaccaccactcataatagaccatgactcaacaggttcaccttgtcctgagtactttgtatcatattcatctggtaagcctaaatcatggccatactcatgtgcaaacacaccaactgctccgtcttcaggctcgattgtataatcatatgcagccatctttccgccccagttcgaaacagaagatttcgtgccatcaattgcatatggttttgaacctaattttgaacgatgtgaccaaatcgcatcatctttcaatttaccgccgccagcttcttgaccaacaccagcatgtacaaccattaaatgatcaataatgccgtctggctcgtttttatttccattaccattttgatcgtactgatcatattgatcaaagtctgctaaatttatcccttttgctaccgctgcttttaatgcttctttcacaagatcttttggtcctaaaggtcccttgttatcatgaccagtacccgcatcagcaccataatctgatgcttttcctggaacagtaagccattctgttacagtcccatcaactgtatagctaccaccagattgttcttcataatattgcttaaatgtgttaatcttcgatccatcaaataaagtaaatggttcatcaccaaataacattttttgataatgttcacgattaaagtccttagaatacatgtatcctggctcttgatcaatattgttatgtttaaaatcgctaaattctacaagtaaaacaagtactttatcttttcgaacagctccattgtattcttcttgcttcgctgatgtagtaggtacttttccatttaatttcccagggttcaatgctgcaccttgtccagctactgggcctacttcaggctgctgcgcctgttcattttccctcatttttgcatcttttacttttttcataaagtcagaggcttcttgcgtaagactatctcctgttaagatttctttcccagggttttcccctttctttttctcaacatatttttcgacagcctttgaagtctcagcttgtgatgcagattgatcaattaccccccgttgttttagcgcttcagccaaacgctcctccggtattaagtgctcatctattggtagagatgatgttgggtgtctcagcatacgctgcgtgacctccaaaagcaaacgtactacttagtactgctgctgttgttaataccgctaatggttttaatttctttttcttt

SEQ ID NO: 745 - DNA, 2159 bp, Bacillus thuringiensis
taatcgttttgatatgtaatgtatgttaccatatttccttaaaatcttggcatgtttcaatgaatgtaaataaacaatcatactttgtcgttgcccgaacataatcttctccatcttctccttttaaaaacatatattttatattctatgaaaaccaatcagaaatttataacattacaggacaaactctgtatacgttttcttccaacttctaaaaaacggggtacatcaccccgtttttttacaaccacaacctccgccagtaccacaacctccaccacagccaccagcatcaaagaatggatttcctgttggcactttaatggaagaagacacttccgaaccgattgctacactaacttcatctaataacttctgcaaagcagtttctgctcttttaaaagctgcaaccttatcatgtaagtccacagaacgctttaattctctcattttcatcgacacggtagtatagtcaggatggtattttccaaaacgctgtacttcctcataccgttctttcatcgctgtaaattgctgaattagcgtctgaagttccatatcttcatgtaattctctataatacttacgataatcttctgctatatctgaacagataatcgcttttgcaagctgctctgccttatctaatattaatacgctttctagcgtcgctacaatcatgagagacacctccgagtatccatcataccacatttagattagaactactaattgaagtgacttactcaaaagaaagatataacgtaactatttttacactatatccgtacacacttatacattaatatgttccgctatattatatttaagaacatcccattttccactattttgtttcacataactaatacacgcattttttaatggtgtcttaaatgtaatttcatctggttcaatggcatgtaaaatcgcttttatcgcgtgtgagtgagcaacaataataatacgtttgccaaaatgagttgtcgcaacatcttctaaagcagcaaagcaacgagctacaatctcttcatctcgctccataccttctactttaccctcagcaatcaactctctaacagccgcaaccggcttccctgaagcttctccaaaattccgttcaacaaatcgctcatctaataaaatcgattgtaatccaactgccgttgcgatttcattagccgtttcttgcgctctaattaacgggctacttataatgatatcccacgtttcttcttgtaaagcagctgcactttgactcgcttgcttcttaccaacttcattaagcggaatatcttctcgcccctgaataatttcttgaaaattccaatcagtttgtccatgtcgtactaaacaaatttccgtcatgctgcaactcctttttaaataatcaacttctattgtaacaaaagttctgcatgacggacatatttttcacttccaattaggttgcgttttgttgcttcatatactgaaacatatcaatcatgatcgaagcaacggccaattgattttgaaacttttccactttatctggtatcgtttttttgaaatgttgcatcgccgctaactcaaaagcctctttttcttcaggatttcgtgttaattttctataccagtacggttgctctctaatataacgagataaatcctcatcagcctttataaactccataatttctgctctcatcatctttccccctaatccttttgaaagaaaaacgggttattttctgaagtactttgctcttgctgcgtacggttaccttgaaattgctgaataacttgttgcacgctcccaattgcactcgtcacattggctaaatggttctgcatttgttccacgtccaactttttaaaaaaagaaagcatttgccccatcacatcagccgctttttcctcttcagttcgattatctttatgttttttattttcttttaccgaagaaaacgcatgcgctccatccggtctataagttgcccatattggatcttcttgaccgggtaagtgccattcttcatataggtgatgccatggattcgtgaccactatccaacctcatgaaccattttagggtgatgcgttacaaattccttagactgtggaaccgatggatgtacccgcccttttgttgttggcataatcctcacctttccatg

SEQ ID NO: 746 - DNA, 1562 bp, Bacillus thuringiensis
ttaggttttcgggagggctagcggatggcaaaagttaatttagaacaaattgaacatgcagtacgccttattttagaggcgattggggatgacccaaatcgtgagggagtacttgatacaccaaagcgtgttgcaaaaatgtacgcagaagtgttctcaggtatgcatgaagatccgaaagagcatttgcataaagtattcggagaagatcacgaagagcttgtactagtaaaagatataccattttattcgatgtgtgagcatcatttagttccattctatggagttgctcacgttgcatatattccgcaaggtggaaaggtgacagggttaagtaaattagctcgtaccgtagatacaattgcacgtcgcccacaactgcaagaacgtattacatcaacagtagcgaactctattatggaagtactagagcctcatggtgtaatggtagtagtagaagcagaacatatgtgtatgacgatgcgtggtgtaaaaaaaccaggtgcgaaaacagtaacgacagcagtgcgtggtgtgcttgaaaatgatgctgcagcgcgcagtgaaattttatcgtttattaaaacgaagtaaagaaaagcgggaaactgcttttctttttttttttagtaaataaatgatatagttttaactagacagagtgagattagaaagattgcttacatgaatggtaggtgtagccaagttttggttatagaaaatagagtgtatgtgttataataagttttatgaattagaaaacaagggtgattttttgtgtgtgacatctacggagggtatgcgagtataaaagaaaaattgatggagaaattacgccatccttactttataaactatattgaagaaccatttattgatgaagaaaagatagcattgttatatggtgctttaaagagtgcaaacttacatatagaacaaattgagcattacgtagtaacaattatgcttgtacaaattgcgcttgatacgcatgaaagggtatcaaataaagcaggcgaggaagagattgaattccataaatgtcgtcaattaacagtacttgcaggcgattactatagtggactatattattatttattgtctatgaatcgtgatattgttttaattcgtgcacttgctgaaggaattaaagagataaatgaacacaaaattatgttataccaaaaagcgcatgaaacgacggatgacataatgaaaagcatagtaatgattgagtctgcgctccttcaaaaaacatgtgatcattttcagttatcacattggaagccatttatcacatacgtattaggtggaaatcgccttcaaaaagaaattcaattgtatgctgataagcaacattcgcctgtttttcaagctatgcaagatgctttaggggaaaaagcaaaagtagtgattaatgggtggatgaaggaattggaaaagaaagaaaaacattttttagaaaattacacagacataaatggaataattcttgggtaaggaataaatgaatacataagccattttacattggagaaggtacaagccttccacaataaaag

SEQ ID NO: 747 - DNA, 1560 bp, Bacillus thuringiensis
cactcaccggctccttgaattgtaatagaggaacctgcttgagatagaagccctatcatattattacgagatgccagccagaagaatcctttcgctcttacaacatctaaaggccatctttctagccaattcataaggcgctcgggatggaaaggatatttgcggcggtaaacaaaggaattgataccgtattcttccgtttccggtgtatgatggtcactatttaattcttgtatccagccggccgattgactggcttcttcataattaaatagatttgtgtttaaaatttcttgtaatggtactttgctaaacgaagattcaagaacttttgcattaggatttaatttttttagtaaatgatgaagctctatcacatcttctttttctagcaaatctatcttattaagaataattacgtttgcaaattcaatttgatctattaataaatcaataacttctcgggtatcattctcatcgattgcttgttttcggtctaataaactttctccatctgcaaaatcatcccaaaatctatttgcatctacaactgtaaccatcgtatcgaggcgacaatttttcgttaaatcaatgttaaggacttcgtctgtataagtaaacgtttgagcaactggaataggctcacttataccagaagattcaataataatatagtcaatatcaccattttccacaagacgattcacttctatcattaaatcttctcgtagtgtacaacaaatacagccattgtgaatctctactagtttttcctccgtacgtgaaaaaccacccttttttataagagatgcatcaatgtttacttcgctcatatcattaacgataacagctacttttaagttattcttattagtcaaaatgtgatgtagtaaggtagtttttccagatcctaaaaaaccacttaatacagtgataggtacttttttcatgaaatgatctctcctttaaataagaatgatgacgtcttatattaaacgataagaaaagaaaaatcaataataaatcataatgattacgatttaagaatagaaatagactataaaatttgtgctgtagtatgaagcatttggacaagcacatgtttacatgtaaataaaatggaggcgagaagcttggtctttaatagagtttcaaaagaattagtaggcatagctcttatcgctatgtttctctttttattattttttgtagattttacaagtctagtaaatttgcacacaaatataccgcaggaatggctgaatgtgaatacggtatttttaagtatcatttttgaagcaataccttttattttattaggggtaattgtttcttcatgtattcaagtgtttgtgacggaagatatgattcaaaaagtaatgccgaaatctccaattgttgcaatgattccagcagtatttgtgggagttctttttccaatgtgtgaatgtgtcattataccaattgtaagaaggctcattcaaaaggggctaccacttcatgtaggcattgttattttattgagtgcacccattatgaatccaggtggtcttttatcta

SEQ ID NO: 748 - DNA, 1639 bp, Bacillus thuringiensis
acgcgtattgatcggatccgaaggcgtgatcgaacttaaccattaaatttgcaattgtatgttgcttttgttcatcagcaactttccaaagctcagctaataatttctcttggtcattgcgtccttctacttcattagcaagatagtcgccaactcgaaatgccatatctgataccgcaccgccatctaaacctttgtcttgcgcttgctctaaacgttctcctaaaaagctcttccactgatcaaaattatctaatactgacataattaagcacctcactattgagtaataaaatcatccttaatttgtgcaactattcattttttatgtaagaattttttagcagtgccaaccgccattcactccgataatttgtccagttatgtaagacgctcctggtgatacgagaaatgaaactgttttcgctacttcttctggtaatcctattctacctaatggtatatcttcagcaattcccattttatcttcttcagaaaaaacacttaacatttccgtttcaattgctcctggtgctactgcattcacacgtaatccacttaaagaaacttctttcgctaaagctttcacatatgaattttgcgccccttttaccattgaataaagtacttcacaagaagcccctatttgtccccatatagatgaaacaattacaatattaccacttcttctcccgatcataggcggaagtgccatagaaagtaatttatatacgttcttcacttgaagttctaccatataatccaattcatcgtttgttacatctgttactagtccaaaaatactcttcccagctgcgtatacaataacatcgataggatgttcaatttgtccccacaatcgttctgctccatcactagaagctaaattagcttgaacagggataacttctccccatgccttctgcaattccaataccttttcttcactgttattgtaatgaacataaactgtatatccatcttgaattaattgtttcgaaatagcagagccaatccctccgctccctccagttactaacgcatactttttcataaattccctctcttatctctacaagttcaattttcacacaactaaataataccctcatcttacaatttttcaatgataagatgagggtatctttaaaattttattttttcggtaacacctgacaaacactcattttttcttctgataacaataatcccgctacttcttgtaagtcttgaacggttagtccttctaatacagtcaatgcatcaaataggctagattcattaaacgcgtatcgtgtaaattgatttgcaatatattctggtgaatttaacgagcgtaaaaaaccaccaattttctttttcttcactcgttctaatgccgccgcatctaattgatcataatctgtttttaataaaatatcttttaaacgatctgccaatgcatcaggttgtttcgtatcaccaccaaccattgcaaaaccgaagttattttcttctgtatagtcatacgagaatgaatcatcaataagtccttcattatataaagcttcgtaatgaacagaactttttccaaataaataatctaaaagtaacgtaagcgcaatttcttgtttaaaagcgcttgcccctttcttttaaa

SEQ ID NO: 749 - DNA, 2083 bp, Bacillus thuringiensis
  unsure (1)...(2083): unsure at all n locations
acaagatagtgctcgagcaattgctacacgctgttgttgtccaccgcttagttgcaggacgtttcgtttcgcttcaacttctgtgagtcctaccctttctaacaattctaatgctcttgctgttttattttgcactttaacacccgtaatttccattgctgttaagacattttgaagagctgtcatataggttatcaaattataagattggaaaattacagatacattttgattacggtatcgatccaaaccaatttttctaatatctttgccattatacagtacataaccatttttagggacgtccagtccacaacctaagctcagagttgtggttttaccagatccagatggtcctaaaatcgtgtagaaatgtcctttttgaaaagaaaagttaacattatctagtatcgctacatttttcccattactttcataataataatccaaatttttaaactgtaaaatcgtctccatattaagcctcctcattcatcttttaaaagaatttgttttgggtttaaacgtagaatagataatgctggaagaagcgttgctattatagcaatagctagtccaattccacccattttccctacatcttctcctgttacacttacatcaattttatcaattggatcttctttttgattttgtagagtaccaccagatccagccatcattacagtaccatgttgcgaagtatctgtttcttcgcttgcagtagcaatttcattcgaaagtaaattatctccgatatattgagaaactttagctcctgttgttatggataatccaaatgctaaaatagcgacacacactacttctactacgaattgcgctatcaatttccactttttctctccaatagacaatagaattcccatttctttacgacgtcctttaattgatagcataatgattaatcctaaaataattgcacctgcaatcgatacaatataaataatcatttgagaagtcgaagagatattttcgataggaccaatcatttgcttgtacaatgaatcatgcgcatctaatttataataattaaaatcaatgttagattnttttgcttcttttttaaatgcatcaatatattgtggatcattcaagaaatacacgacttgaccactacttataccttggtctacttctaattttttcatagttgaatgcggcatatatagtttattagctggatccataataggaggagcctgttgacccattgcttgctcatttgtttcgtaaatgccgataatttcaacctcaagagtttccttcttatcccctgattgtactttaactttgtctcctactttcaaattgtttaattccgctaatcgtttttccattaaagctacattctgatctttcatttgctctgttattggttttccatcaatgattttactttttccgtttttaaagctttcttgtaatgcagtcttgcgaactccctcaatcataaaagaagcattcatatctatttctgtaccagaacttgaaccgcctcgcgcagccgtcattcccactttaccttttccttcttcttctccttctgaagctcctactagtttaagcccatcagaaataccgaaagtgttagctatgtaattataatcttttacatacttggacttcgctaattgatttgtttcttttgcatcgagctgcggcggatttggcatttctccagtttccttagctttttgacctattttgtcgaaatcaagacctaaagtaacatctgcaccaagtttttttcttgcagcatccgctgctttttttgatgcattttggattgtgtaacctgaaagaaccaaatttgtaacaatcagaaaaactgccatcaaaattaatgatgttcctatcctttttttcatactgagaattgctcgtttcataaaattcatttttcttacctccttgataacttgtattctatataggttatctagagtttatatggagctaatcggtagtttaactagagatataaggagtttatgtgtagttattcatttacctgttcaagaaaaactagaacacaaattcaaaaatgcagtcgtttttgtat

SEQ ID NO: 750 - DNA, 2535 bp, Bacillus thuringiensis
atacttttttaatgtcttgtcccgtaactaccagggcctgatttatctccaactacggagtcagttggtacgcctgcacgaataagtttgtcccctgtagcatttcctttcatccactctgtaagaattttacgtttttcagctggaagtgcatttccgaccgtaaaagctttaagattcatagcaatagctttcgctgtactagtgtcacgaatgtctcctggaatagcttcgtttaattctgtttcaaagcgatcagacatagtaatccgatcccccatatgcctaagcgctttttcatatcctttaggtccgactattttattaaataaaatgttccctgcagtattatcacttgaacgaacagcagcctcagcaatttctcctagtttcattccagtatctacatgtttctctgtaacaggtgaataatccactaagtcttctttcgtaaatgtgattacttcatttaatgtatcaattgagttttgctgtagtaatactcctgctgctaaagccttgtaggttgatgcgaaggcaaatctttcgttagatcgataagagattgtttgatttgtaccagtatcaatcgcatatacacctactcgagcatcaaattttttctcaagttgtgagaactctttatgcgtcgcctgatttttatgtttcacttgtccagtcttttctttcgcttcaacttgcagtgcccctcctgtaaaagcttctaggcttgtaatacttaaacctaatataccaacgcatattcctatttttagcatcctcttatttttcaaaatcatcattccttccaaatttttagcacctttttatacgtacacataatagacaatcaccgaaccaaatttgttccacaaactaaaaaaattatagctagtatgagagttattaacaaaataagagatagtagctacgacgcctctatctcttatttcatatttcatttttttacttataaatggctttatatgaacagggtctcttccctgagaaaagtactctaattttgcttagaactacctgtactagtagcttcaccatgtatacgttgctgtttcaaatcaaagtatacatctaatacttcctttccaattatagaattaattccatttttatcatcatgaagccatggaactactacggaaaatgctacttctggattatcatatggagcatatccaactaacgttaagttgtaacattccatacgttctccttttgcatttctaccaatcgggtcatctccaccatatacagtttgggctgttcctgtctttcctgctggtttatatggcgcgtttttgaaatatttcacgccagttccatcaccttcttggaatacccatctaaacccttcttttatccgatcaatatgttctttcttcatatcaattcgatttaatacgacaggttctatggaacgtataactttgccaacctcttcttttattgattgttctcgtatttcttgtacaatttgaggttgcattctataaccaccattcgcaatcgttgaaatatattgcgctaattgcaacggcgtatacgtatcatactgaccgatagaaaaatctagtaaaaacccaggttgactatctacttttctcgtttgtccaattatttcattcggtaaatcaatacctgttgggacacctaaaccaaattgcttgaaataatagcgcatcgtatcaaatgctccttgtttaatatccaatgagccatttggtacgtaattgacccccgcaatttttaaagctgtctggaacatgtatacattcgaagatacttgtaaagcccgtaaatcattaatattaccaaatccggatacattccacgatttcttagcttgtgtacctttaaatttcatcggcgcgtcataaaattgatctcctggatgtattgcccctgtctcatatccagttaataaagtagcaccttttacagctgaccctagctcatacgaagttgtcatgtttcctaatgccaaatcctcaacctctattttcccttctttttctacaatctttttgcctgccattgataaaatttgtccgttatttggattcgtcatgacaacaaaagctcgatcgagcagtggctctgaactcttaaaagctctcaagtttttttctatactttcttccactttcttttgtaattccatatcaatcgttaatgttaaactattaccactttttcctttagagattatttctgtgctaacaatgtttcctgatttatcagtaatattttttacttcttcttttgtgccgtgtaatacatcttcatatcgttgttcaatataactttttccaacacgatcattacggttatatccacgtactaaataagaatctaaattttctttcggtaatccttcttcactactcgtaatatttcctaatacagaacgaaataaattatcgtttacataattacgttcccaatcaacagttgcatctactcctggaaaattcgcaagattttcgcttatccgcgcatactcttcatctgtta

SEQ ID NO: 751 - DNA, 2633 bp, Bacillus thuringiensis
ttcatccatagtgatgtcaatatttaaatatgagttaaactttgtgtaccaccagttccaattaaaaacggtgtaaaaccagctggatttactttaaaataattagacggatgatatgcatccattcgtaaaaattctgatgaaccgtacatcggtaaaatactgtaaattctctaacattttttgctgtaagaaaacactttgtaatttctctttttgtaaagaagttgccgcatcttctaccttcttatcactaataagcgatactaaacttttcgatgggattagaatgataatgaaaaaaagcacacacgctaaaattataggaccaaaagcatgcttcattttcatcttctgtccctctttctatcgttattaaattgtaacccttgtttttgacacgtcatcttttctctcctttgtctctatacatgttccattctatttatctattatatacatgtatgtatttccttccttgttctattaagccctatataaatagcgcaagaaaatgtttccatagaaacatgttaattatacaagattctacataaatttcacactggaattttagtaataattttattttttaacaatgaaaaaatatatgaaatgtctagaattctttggatgatgtatggagttcaaaatatgataataagcgcccgctatgatcaacttcatgagtatatataaacccgagctttcgtaaaagttttttcgagctctcatttgctactttaactctagcaattattcttgttacattcaaagtctctattgcatatttaatggaagcctctgctgcttctaatgcatacccattcctccaatgttctgggtcaagaagatacataatttctatttcacctgtttcatctacctttcttaaaccacaatgtcctaaaagctttcctgtttcactattaaataacaaccataccccgaagtcatactgttcccaatgtaagataagttgcccaatataatcatttgtttcttccttcgacattcctcttgatttagccagccatttgccaacagtatctttttttaatatgttataaaactgatcaatatcttctacaattggtttcctcataaataatctttttgtataaattactttctcttcttcaaacatagacatcattttcccttcaaatactgtttacagactaataaattataccatgaactatttttctaactttaaataagaaaaaacagactatcacatacgtgaagtctgtttccccattcttttatttttgtaaatctgcccattttaaacttgtagctggaccaaattgatgtacatataaatctttcacatatggtttttgtaagtaagataatccacgctggaataccggtgcaattactgcatcatcaagtagcattttttcagcatcttgcattgctttccagcgagccttttcatcattacctaattctgttttaatcttcttaattaatgcatcatattctggatttgcatattctgtattattaacactgcttccagaaaggaatacttctaagtaagtcattggatctggataatctggtaaccagcgtgataacgacatttcatattctttcttcttctcaagtgctaatttttgcgtatgcggctgtaatttcacattcacttttaatcctggtaagtttttctcaagctgctctttaatgtactctccaacttttttaaagttttctaagtcataatttaataattctaaagtcacttcatttgtacctgtctcttgttttgctttctcccaatattccttcgcctgttttacatttgtcttattaaactcaccagacgtacttctaaaatctttcttatctgggccctttaaaaatccttttggtacgtaatagttcgctgcaaccgatccatcatttaaaaatgaatctgcgagtcccttcttatcaaaaactgtacttagcgcaagacgtgcatttttatttttaagaatcggtacattttcattaaatcggaagaagtacataactggatctgtatattgttttagctctttattatttttatatttatctacgaattctgtagaaataacagctctatcaactttatctgtttcatataaatttaccgcagttgaaatttcttttacaatttgatagtttacttcatctaacttcacttcttttttatcccaatacttatcgtttttcttcattgtaaagctagcttcatgcttccactctgataatgtaaacggtccattatataccgctttatttgcttctaatccatatttatcaccttgctctttcgcatatttttcgttaattggatagaaggatggtaaaattaataatttcgtaaaatacggtacaggatgttctagctctacgacgaatgttttatcatccttcgcttttactcctaattcatctagacctagttgttttttatttatcttctcagcattttttacatcgtacgcaatgtatgcatattgagaagctgtatctggattaatcaattgcttccaagcgtatacgtaatcatgggcggttactggatcttcgttagaccatttcgcatcatgcaattggaatgtatatgtctttccatctttactcacttcata

SEQ ID NO: 752 - DNA, 1038 bp, Bacillus thuringiensis
cttcattgggccaaattgtagtgggtttacaaatacacttaaaactacagtttcattttcttctcttgccttacgtaataaagtagcatggccttcatgtaaataacccattgttggaacaaaaccaatactctttccacttgcacgaagttcgctcgtaatttgctgcatctcttgcactgtagttacgattttcattattgttttcctccatataacgctaagcattcttcctctttcattgtgaacgaatgtttttcttcaggaaattgccttgtctttacttcagtaacatattgtgaaatcccacgcacaatctcctcttgaacagacgtatattgcttcacaaatttcggaacacgatttacgccgtatgagataagatcatgataaacaagcacttgcccatctactttttgtcctgcgccaatcccaattgtcggtattgttagttgctctgaaataagttctgctaactgcattggtacacattctaacacaagcgctattgcaccagcttcttcacatttctttgcatcttctattaatttttttgcactctccgcatcttttccttgcactttatatccacccaacactcctacagattgaggggttaaacctaaatgcgctacaacaggaattcctgcgttcgtcaaatattgaatcgtcgatataacttctccagcaccttctaccttcagtgcgtgtgccccgctctcttgaacgatgcggcgtgcattcaccatcgtttcttgtaatgatacgtgatacgacataaatggcatatcagttacaataaacgtctctttcgctccgcggcgtacagctttcgtatgatgaatcatatcctctactgttacaggtactgttgaatcgtatccgagtacaaccattccaagagaatctccaactagaatcatatcaacttcagcttcttctgctaatttagcagatggataatcatacgccgttagcattgtaatcggctcaccttgctctttcatcttcaaaaaatctgtttttgttttcaaaact

SEQ ID NO: 753 - DNA, 2198 bp, Bacillus thuringiensis
tcaccgggtattttttatatttaatttaggaaatcctaccttttctttacctttgttttaatttctattaagttttaaacattatattaatatttgtacaaagcaatgtatagaaattgtacattacttttaatatagaaatgtgattattatttgaaatattgtaaggaggagattatgacaaggtgaaaaagcaagagaagaaaagtggtagagtagtacctctccggttaaatattttattcctttgtgtatttttattattttctggcattattattcagttagggaaagtgcaaatttttgatggagaaacatataaaaatgaagtagagaagagagaaaatgcaaccgtgggcctttctgtaccacgtgggaaaatatttgatcgtgaaggaaatccagtagttgataataagtctttacgtacgattacatatacaaaggtgaaaggtgtaaaacaagaagaaatattaaaatcagcaagacaacttgcagatattattgaaatgccacaagaagatatagataagttaacggagactgataagaaagacttttggatgcaattaaatccagaacttgctcaagacttagtatcaaaaaaagaaatagataagttccgagataaggatattaccggaaaagagctagacaaaaaaatagaagatttaaaaaggaaacgcgttacagataaaaatcttcaagaactaacggctaaagatatagaagtgttagctattaaaagtaaaatgacctcaggttttcaaatggcacctcaaattattaaaaaggacgttagtgaacaggaatatgcggtgattagtgaaaatttagcgaaccttccaggagtagacgcatcagttgattgggagagaatctatgtaaatgatggattattccgttctgtccttggtaacgtctcaaatgctgatgaaggattgccacgtgaacgattagattattatttagtgcgtgattatagccgaaatgatagggtcggcaaaagttatatcgaacagcaatacgaagatgtacttcatggtacaaaaaaagaagtaagaagcattgctgataaacaaggaaatactattagaacggaaacggtttcggaaggaaaaagcggtaaaaatttaactttaacaatagatatggaattgcaaaaaaaagtagaggagagcatagaaaaaatattaaaacaatataaagggtcagaatcaatgttagaccgtgctttcgtagtgatgatgaatcctaaaaatggccaagtattatcaatggctgggaaaagacttgtagaaaaagatgggaaaatggaagtagaagattatgctttaggcacgctgacaagttcatatgagcttggatcaacggttaaaggtgcaacagtgttaacagggtttgaaacaaatgcaataactcctggaacacatttttatgatgcacctatgaagtttaaaggaactaaggaaaagaagtcttggaaaaattttggtgatatagacgatctaagagcgttacaagtttcttcaaacgtttatatgtttaatatcgcattaaaaattgctggtgtggattatgtgaaaaatagttcactagatattaaacaagaatattttgataaaatgagatattatttcaggcaatttggactaggcgtacaaactgggattgatttaccgaatgagactgcagggcaaattggaagaaaagataatcagcctggtttcttattagattattctattggacaatatgatacatatacaccacttcagcttgcacaatatatttcgactatcgcaaatggagggtatcgaatgaaaccacaaattgttcaagagattagagaacaaaccgttcaaaaagatgaggttggtaaagtagtacaatcaatagaacccgttgttttaaatagaatcgatatgaaacaagaacatattaatcaagtaaaagaaggatttagaaaagtatttcaagaaggagatggaacaggagtaagagcgttccaaaaagcaccatataaaccagctggtaaaacagggaccgcacaaactgtatatggtggagaaaatgaaattgggcgaaatgcgaaaggcgatcgtagagaatgttataacttaacattagctggatatgcgccatatgatgatccagaagtagcattttctgttgtagtaccgggggttgaaaatgat

SEQ ID NO: 754 - DNA, 1850 bp, Bacillus thuringiensis
tgagcagagtttaggatgcatagtatattgtgaactatagagataaacaacgaatgagtgctatgcaaatgatgagcatgatgggacgatgaaggccagtagatacggtagcaattggtttaatgctatttgcattatttttaggagcaggaaatttaatttttccgccagttttaggtcaacaagcaggagagaatgtttggattgctacaataggattccttgtaacgggagtcggattacccctactagctgtaacagctgtcgcgtttgtagagggggacttgaaagcgctatcttctagagtccaccctatatttgcgtttattttcccattgattagttatttagcaattggaccatttttcgcgattcctcgtactggagctgtttcgtttgaaatgggtatgaagccgtttttatcagaggcaatggtttcagagtggtacatgctatttcttttcacgatagttttcttcggaataacgtggtatttatcattaaatccatctaaattagtggattggttcggaaagtttcttacaccattattagtattaattgtcgctgttattgtcggaaaggcaattattgatccaattggagagccagctgcgccgttagctgcttacaaagaaaatgctttctttggtggatttattcaaggatatttaacgatggatgcaattagcgcgctcgtattcggaattgtcgttgtacaagttatccgctctaaagggataaaagagagtagtcaaattgcaaaaataacagtagtatcaggtattattgctgtacttggtttaacgttaatttatttatcacttgcttatcttggttcaacaagtacatcacttggtatctcagaaaacggtggtcttattttaacgaatgttgtaaatgagctatatgggacgagtggtaaaattttattagggcttgttattatactcgcttgtttaacaacttctgttgggctaacatctgcgtgtgcgggtttctttacaaacttattcccaaaactttcgcataaaacgattgtaacaatggtatgtgtatttagtttaattgtatctaacctaggtttaacgcaattaatcgcagtaacattacctgtgttaatgatcatttatccagttgcaattgtattaatcgtactttcttatttccataagtggattgggaagcgtaatacaatttatattggagctattttaggtgcattgttaattagtttctttaacggtttagaaagtgcgaaaattaaaattgacgcgatttctaatgtactacaaatgttaccgttatataacgaaggaatcggatggttaattccatcatgtattggcgggattctcggtttcttcttctataaatcaaatgaatcaagtgaattacaaaagaaaggtgcttaggcacctttctttttttgaaggggatttttgtattttgtctaagtaataattggggggaatgataaatggctaattttgaagattttttaaatttggatttgagaattggaactgtaatacatgcagaggaatttaaagaagcgagagtaccagcgattaaactagcaatagattttggagaaatcgggataaagcagtcaagtgctcaaattacgaaaaggtatagtccagaagatttaatcggtcaacaaatcgttgctgttgtaaactttccaccaaagcgtgtagctggattctaatcagaagtacttgtgcttggtggtgttcctgaagctgatgatgttgtgttacttcagcctaatatgaaattgccaaatggaccaaaaattagctagggtgaaggtaggggctaatatggaaaacggacgagaatat

SEQ ID NO: 755 - DNA, 1273 bp, Bacillus thuringiensis
cgaaaaaataattttttattcttattacggtatatgaaatttaacacgagagtatatatgctatacagtttttatggataattcaatcctgaaaagatacatgttttttcaacgcatgttaaaaaagtccaagttaattttttctgtaatcaatttaactatatagtataactcttaaactaatgatgcaggttaattgaggaaagtacttaacaaaggagaattgcagatgtctatgaacaggtggttatttcgattcagcagtttgcttgtaatgattgtatggtggatgtctttaggatcctcccaagtatttgcctcagttcatgtcgtaacacaacccaccgatttaacgaaagtgattgaggttgaactaaatgatgattactttaatccaaatgtcatcacgattccgcttgaaggatcaacaacattactattgaaaaataaaggtaaaaacgagcacacctttacagtgaaaaaactcggtattgacgtcgtagtccagtcaggaaaagaaaagaatattaccgtgaaacctaaaaatactggtacatatgaattaatatgtcgataccatcttcttaaaggaatgacaggcaaagtaatcgtcaaataacatgccaggtcaactcgacggaagctattttgaaatgaactttaaatatgaaaagaatttattatcatgttacaaattcaactcaaaactattgaaataaaaagaagttccaaaagaggaacttcttttacttaatttcgatatctgcagaatgaatatgatgtactttcccctcatgatcctccagaagtaatacaccatcctctgtgattccttttgctaaccccgtaattgtctctctcatcgttcgagcggtaatttctttcccgatgctcacagcgtaactttcccaaagaattttaatgacagagaaaccattttgtaaatattcttcatataatttttctagttgtaaatagatttgttgcataagttctgcacgaacaatcggcttacctgattcaatcgctaatgaagtagcgatgtgctgaatttcttcatcaaaatgttcttgcttttgattcgcattaataccgatgcccataatgacagcattaattttatcaggatccgcttgcatttctgttaatatacctacagcctttttaccttgaattaaaatatcatttggccattttattcctacgtttacacctgtacatttttcaattgcctgtgcaacactaacagccgctaacaaagtaagttgcggtg

SEQ ID NO: 756 - DNA, 2618 bp, Bacillus thuringiensis
catatttacaacgaagccagctggtttcacaaaacttatggctcccttccctactcgaaaacgtgttgattataatccgctgaatcgtaaggattatttacttcatgttttgaaggcttattaaagtaaaagaggtgcaattcgcacctcttttgcatgtattaataggttagtttgtcctaacaacttctttaagttttcctattattttcgctatagcctcaattgaattttccgtttcatatcccccaacatttacagaatgatttgcatttttgacaacttcaatctgtaaattcgttttatataactgatcaatttgatctgcattgtattggtgatctttatccccaataactaaaaacccttcgtgtcgactatgtaagataaaatcaaaaattgtatcaaacgtcagtaaaggtgtaagtagtatcatttttgactgcgcgaattcttctctcttcattaaatcatttgcaatcggaattgttccgaatgacttccctaaaaacatagtctcgttgtattgctcatcttttaatacttcatttattacaggattaatatcatccactcatagctttcgtcacttcttccattggttgtattcattaattgtccatcataagaataatgaatatgtacaacatctattttatgttcaagcattaacatcgttgcgtaataaaataacggcttatcataattgtatcctgaacctgaaaacataaaccaagccgtactagaacctttttcgatatgtgtgtaacgaattactttgtcatttatatgtacctcttttttagtccccttcaccgttttctcctccgaatacgtttacttttgtaatacgatatgttctgtgtgaactgatacatcctttactttctcttttataaatgcaggctgtaagttatatgtatgcagttcttctactggcacccatctaaacaaatacgttctaccctcttcttccaaaatatattgatccgctccactcgcaggtaactcatgtagctctacttcataataaaaactaatttcatgaaactttcgctcagaaagtgtaaagaaattttctactgaccatattaaccttttccttttaataggaacacctatctcttccgcaagctctcgttttaatgcatcttcactattctctagcatttttactctaccgccgggtacatacaaaaaatcttcaccgtcaccttgcagaatgagtattttattatcatgtttacaaattgctccaacgcggtaattaaaacatgtttcctcaactttaaatgtaagatccatccgtaacgcccccttatataaatatcgaattattacaaaacaattatgtaattactgtacaaataaggttactaaatttatccactccattcaatgatttttgaattttctaaactattatttttcatcattacaagtgaatatgcatatgatacaatcatattgcacactagaaaacattatgggggtacggatggaaacgttattaatccagcaaactgagaaatcaaataagttttggaaaatcgttgtgaaagaaaaagactatgttgtgttttacggaaaaattggcacagctggcagtgtgaaagcgaaagagtttgaaacagaagaagaatgtatgaaagaagctaataaactagttgcttccaaacgtaaaaaaggatatacagacccgttgcctggggaagattacataaaagaaaaaacgataacagaagaagaattttgggaactacttaatcgtgcaaaaacgaaaggtgaagaccaagaagaacaaatagaatggcttacttcccaccttgctaaacgtacagtacatgaaattgtagcttttgatacgcatatgcatcgtcttttgaaagattcctatacctcccgtttatgggcagcagcctatattattatgggtggctgttcagatgatactttcgattacttccgcggatggttattatatcaaggaaaagagacatacgaagcttgtattgaagatccagaacgattaattcctgtattagaaaatttgagtgagtatgacgtcccagaaatagaagaactttctttatatttcggtttcactgtatatgcagaaaaaactggtgacgaagatgatacttactttacactttaccatgtcttatctaatgaagaattcgacgatgtagattttgaatttgactggaatgaagacgatgaagaaggtttaaaaaagatgtttcctaagctatgggaactgtatggagaagaaccgtttgagtggtagattcattattcgtgaaaaagtgccttgtttctttagtaacaaggcactttttttgatactatatttaaattatcatctttccactctcccaccactccataaaagtctttaaagaaagagcaacccacgttctactatcattttcatggttccatacatatatatcatctctttgtacttttccattcaaaatggaatagccaaacaaatcaccatttcccccatcagcaaaaaataataaacagtcaaaaggcatgtataaatccttaaaatcaactatatttctcatactcatattttcagttttaatttttgaagcagaccatat

SEQ ID NO: 757 - DNA, 1653 bp, Bacillus thuringiensis
cacatcaacatcaggcatagccgtttaagcttcatagtcatgtaaagtatcccaaattttagaacgaacaaattccggcacaaatccaccaatcaggtagctctagtaattttgccatttgtaatacattcatcatccattcgtcgttttctattaagcgaattatatctttctctgttttgatcttcattgataaattcacctttctagtaaattaatgcatcagttcaataatccataaaatccagtaagcacctggtacaaatagcagttgtgctaataatgtgccgagaagtctagaaatcattagccaaccatacattttactcatagattcagcaccgctttctgattgtagagcacgttctgttaaaagagcaatgcgtggatcgagtaatacagttaataaaatagtggcgaaaccatttacaaggccagaagctgtacttgcatttgttgcataatctggatttaaaaaagaagcgtaaagggctgaaagtacccctgctgtataaatagcagtagcaaacatgttaataagcataatacgctttggaataccaccgatacgcagtctatgaatcatttctaactttggaaaacggacatatttttttgtgtactttaatttttgaatgttattcgttttcatcattcgaatgaaagaaccgtctgtttcaaagttttgaatgacatatccaaataattttgtcaaagttggataaagaatgatcgcgattaaagtaccgatagaagccgataatagtacgagtcgtataatatgctctaaattaatagaagaatctagttttgcttcatcgacaataccaccgattaaaaaggcttgtagtaagtttgatgttcttgaaataagtaacaccattcctacaacagacaaggcaaccgcaatcttctttaaacgtactccagctaatcgaatactataagagcttgtttcaactgcgtggatcacaattgtgaaagccattataaaaattaacgtaattgacatttgtttcaccagtttctattaaaataattgtaacttttttactgtatcatatctatcgtattttgtaactgaaagtatgtgacatagggaaattgatttttcgaaaaaatagataataatagtataatagggagaagtggaagagatgttagcacttatttatacagcaaattaagtggaggaatgaagcatgtataaaatatttctatttgatttagatggaactttaactgatccgaaagaagggattgtaaactcggttttatatgcattaaaaaaagtaggaattgaagaagtacatataagtgagttagattcatttataggtcctcctattcagcaatcattcatagagagatataatatgagtgaaggagaggttgaacgtgctgttttttacttccgtgagtatttaaagcagcgtggattgtttgaaaataatgtataagaggggattctgaagctcttgcaacaattaaaaagttcagggaatcgcatattcgtagcaacttcaaagcccactgtatttgcgaaacaagttatagagcattttcaattaacgaattatttcgaagacatcattggaagtaatttagatggtacgagaataaaaaaagaagaaataattgctcatattttac

SEQ ID NO: 758 - DNA, 2006 bp, Bacillus thuringiensis
acaagcgcaggggaaacatgcaattccgaatagtgatgcatataattatgcggagactatttggtattgatacgattatacatgttttaagagctgttatttgatataaaaatgaaagagccttactgcattttattgtggtaaggttctttaaaattgtttaatagattaagtacattcatttacaaaggtctctctatataatcacttttaagtatggccataataatttcatctgagtatgtatcgttataaaataaagattgacgtaaggttccttcttttgcaaaaccaactttttcataagctttaattccgcgtaaattatggctaaatacttctaactgtaaacgatttaatgatagttgttcaaaaacaaatcttaaaacgattttaatagcttcagttccataaccttgtcctgttaatgctatggaaagcattgatattctgaatcctgctctttcgttctcctcatcgatatctaaaagcgacaactctccaatcatctcgtcagtactttgtaaacaaatagcgaaatcatagcgacttgaatcattatttatatgatctatatgtttcgtaatttgctccaatgaaaaagtggacttagttccagtcatatatcttatttcatcatccattgtactttctaatataataggagcatctagctggcaaagaggccttaaataaattctttcgctctctaatctcattataattttctcctttagttagtaattgaatgtataaatacttaaactttcttcaatgagttacataaaaaatatgaaccttaattcgatgttacatgaattttataatggtatggtatacctaaaacaaataataaaagttttatacacaacaaaatgtatcaacgagttttttgatcatactattattcttgctgcccattccgctttgaaatgaacatgaatgtattaactaaggtctgtatcaggaggagtatatccaaggtgcctggccattgatacaatttgtcctttatgatgaaactcatgggtttccgtatgagttaaaagccatagcggagttgtactccaaggccctttttgccactttacttcatttgcaatattttcgagccaacggtcattgtattcatctaaaaaacgttgtacagtctcatctactaacttaaatctagcgcgaacttttttcacatctgcatgctcaatttcgtaatcgctagcaaatgaaaagtctactcgcttttgtttaaatgcgaatgatccaagccagtatcggtagcaatcggctacatgaatatgagtctttataatgctaccgctcccgaaattaggaactgtgctatgtaatttttctactgggatttcttccaaaaacgaaaatagagtttctcttgtagagctaataagattatattgctgttttaaaacatgtaacatgaaattaacactcctcttttatttactaaactatttgtgtaataagtaattctatatgtacgagaggtgaacctttttattatttttactaagcatattagatgtatttcttcattgtttctgatagattaaacaaagtgaaactttaatgaattgaacattcttagttcataataaaatgtacatgaagaaggagaacgataaaatgaatagaataattggtctaaaacaatttgaaataacgcgcggggcattacttaaatttatggagacgctagatgataaaactgtggatacgcagccagagggttttaacaatacaattcgttggcatatcggtcatgtattaacggcagcagaagttttcatgtttggaaaagaattcaaacaattaccaactgaatatccaggtatgtttggatatggatcaagaccatctaaatggacaacagaaggaccatcattagaagtgttaacggtccaattaaaagaacaagcaaaacgtattaaagaaattccagcagaagcatttgaaaataaactgccagagccatttctaggattggaaac

SEQ ID NO: 759 - DNA, 1962 bp, Bacillus thuringiensis
tacgtaaatagggatttaatgtaacgcaagcaacagtggcgcgctatattaaagaactgcacttactgaaggtgccattacatgatgggcgctataaatatagcttgccagcagatcaacgatttaacccgttacaaaaattaaaacgaaatctagtggattcatttgtaaaattagacacggcaggacatatgcttgtgctaaaaacattgcctggtaacgctcattcacttggagcacttattgatcatttagagtgggatgagatcatcggaaccatctgtggtgatgatacttgcttaattatttgccgtacacctgacgatacaggtgttgtctctgatcgtttcttaaatatgttgtaacaaaaaatcttgtttgctttccatcgtaaagtggaaagtgaacaagatatttttattggttaaaaatatgaattttcaattgtaatataatattttgtttgcataaagttaaaaaatagatggattgacccgtaaaacaaatgtttggtacaatgaagcgggttagaagagtatatacatacaaatatatagcatgattatttgaatgaagaactgagaaaatcctttagtaagggattattttataacgaggtgaatggggcattgttatcggaattatcgattagaaactttgctattattgaagcattaaatatttcttttcaaaaaggtttaacggttttaagcggtgaaacaggggccggaaaatcgattattattgatgcaattagtttacttgtaggtggccgtgggtcagcagaatttgttcgatatggaacagaaaaggctgagattgaagggctattttatgttgaagatgagaagcatccatgtattgaaaaggcagaagagttagatatagaaatagaagatggtatgattattttaaagcgtgatattgctgcgaacgggaagagtgtatgtcgtgtaaatgggaagcttgttacacttagcatattaaaagaaattgggaaaacacttgttgatattcatggacagcacgaaacgcaagatttaatgaatgaagaacgacatctgtttatgcttgatcactttgatggggatcgaatcgttaaacaattagacatatatcaaaacgtatacgctgactatgaaaaattaaaaaaacaattgaaatcgttaagtgaaaatgagcaacaaatggcacatcgcttagatttaattcaatttcagcacgaggaaattcgcaaggcggatttaaagatggatgaagaaaatgaattaactgaggaacgattgcaaatttctaattttgaaaagatttataaagcgttaggtgatgcatatcgttctttaagtgccgacggacaaggattagataatgtaagaagtgcaatggggcaaatggaaagtattacacatttagatgaagtgtatcaagagaatcatgattcaattgcaaatagctattacttattagaagaggttgcctatcaactgagggaaaagctcgatatgatggaatatgatccaaatcgtttagatgaaattgaaacacgtttgaatgaaattcgtatgctaaagagaaaatatggaaataatgtagaagagattttagcgtatgctgataaaattgaacaggaaatttttacgattgaaaataaagacgttcatattgaaacgacgaagaaacagttgaaggaattagaaagtgttattatgaaagaagcaacgttgttaagtgatatgcgtcatgagcttgcagaacaccttacaaatgcaattcatcaggaattaaaagaattatatatggaaaaaacgaaatttgaagtgagaattatgaagagagaaggaaatgcagaagagccccttgtggaaggtgcgccggtaagacttacggcggatggatacgatcatgtggaaattttatatttcaacgaacccaggagaggccgttaaaccactttcaaaggtt

SEQ ID NO: 760 - DNA, 1288 bp, Bacillus thuringiensis
tagtacagagaaactgagaattgaggaatagttataatgattcgtgtacgcattgaaggtactgaggaagaaatgcttgaatttatggggaaaatgccagacattcctggatttgaaaagacacatatgagagagccgagaaaaggaaataacccgaaatacgattcaagtaaaaatgtacttgcatatttgtcttataaaaagattgaagtcgccaataaataggcggctcttttagtttgcgctgtttcaccgccttgtctttttcacataataataatagtagattatgctcaagaggggtgagaatagttaataagaaaattatcttttttggagactttggtattgatgacgccgtagcgttaatttatgcaaataaaacatgtaaattagatattttaggtattgttgctgagtatgggaatgtatcacgagatatcgttacggaaaatgtttattttttagaaaggtattatgctacacaagtgaaaattattgaaggtgcgagtagaccgatgacagctgaagagcctttgtttttccctgaaatccacggggatcacggtttaggtcctattattccacctgagatgagaatttgtaaacgagaaaatttttgtgaattaatcaaattaatcgaaccttgtccagaagatattataattgtggcgacagggagactaacgacgcttgctacgttatttttattgtatccaaatataatggatcgtatttgttcgtattatataatgggcggcgctttcctatttccaggtaatgttacaccagtatctgaagcgaatttttatggtgatccaattgcagtaaatattgttatgaaatatgcgaaaaacgctagcatatacccgttaaatgtaacacagggcgcgcttataacacctgaaatggccaatataatagataaacaaggaactggacaggcgaaactcattaaaccaatgattgatttttattatgagaacttttataaaaaagaatatccgggtattggtgggagtcctatacacgatttattaccgtttatctcgtttataaatgacagtattttcgaatataaaaaatcggcagtgtggattagtacgacaaatgatgtgactaggggccaaagtgtagcagactttagaaaaatagctgagccaacaaggtttgatgatcggccgattcaaagaattgctgttggttttaactatgcagcttttaaagaagagtttatgcgaacaatattgaagccagattgtccttaatgtgtgtaataacaagtcgg

SEQ ID NO: 761 - DNA, 1821 bp, Bacillus thuringiensis
tttgtttttacagctttcaagttttctatggaaaactcagggatctcatatgttactttatacgaatgtaaagtagtagaagagtctccattcattgtataaattttttctgaaaacgggtcaacactgtatgatacatcagaagcagcctcaactgatactaatcctgctggataggtaagatgagggtaacttttttgcatggtaattgttgcctcagtcgttttcatttttgtattttgttcgtaccagcttacgacgtcgtttttatttttaaaagaaatctttttcggattttcagaaatttcccagccttttcctgtataaaaatcttttgtttctactctccaatattgtttgttttgcgttcgtgctgtgaaaacaattgtaggatccgccttaaaaggaccgcctaatcgcgagtcatctaaaccatacccaattgtagaaactttttgctctttacttgcttcagatgtgttgaattttaaaaaatccattgggtttggccattgagggccaaattttggagcaaagtatgcaatggttgctaataatacgataaatattgtaagtggtctaagtaattttgagatttctctagcataattttgtaagtgttcacgttcttttattcgttctacttgaagaagactaagcataaaaaagccgatgacaacagtacgaataatagcgtagtttgcattgtataaatgtaagttatgaaaagttgcgatataaataatagtcaatacaaggaatagaaacccacgttttttatgaataatccaaaataaagtgaaagacttcaaaaaccaaaatgagagaaaaaataaaaccgtcggaaaaactggagaaatatctagtaaattcccttggaaaaacagggaggaatttcgaaacatattagaaaagaatgttgttagccaagatggatttataaaagcatttttataatatagggaatgaatgataaataagactgtgacaatttttataggaatctgccacctcgtttgaaaaaaagagagagcgaagcaaattcctataaatgttacgaaaatatctaatctacctacatttgtaatgcctataagaggtcttagccattctagtaaaagaagaaatacacatgcatgcatgaagaatctgttcgtatcccacttgtattttgcttgtaatatcatcatttgctcacctcaaaaaacacgtttgtataccggttttcataaaccgtgtttacaaatatttgtcgtttttttagagtttctagtatactgagttctcggtgtgaaagttgattcgctttttctttcacgacaaaaaccatacattttctatttcttatagcagcacaatcagccgccttttgaatatcgggagaaagattactggtcacgagtataaccgtgacgggctcataaatttttcttagttccatgtctacactctgggagagcggaaatacactgtctgcttgtacttttgctaaatgacaaaggatttgttgtaactgcgtatctccattgtctaaagggaaaatagtttgttcttttccgatagacacgaatgatgctggtgaattttgtttcaagacagcccttacaatagaggcagtaaatgtgacgactgattcgaatagaggagactcgtttctgtctatgaatatcatgatattatggctgcgctgttgttcaaactcttttgtcataatattgtttgttcgtgcagttgctttccaatcaatccatgaaaagcgatcaccaggtttatagtctctgacaccgacagagattggagagtctttttgctgatttatat

SEQ ID NO: 762 - DNA, 1739 bp, Bacillus thuringiensis
gaccaagaaggggttagttcaagtattaatggtattcatgcgacggcattgtacattgggatattagtcatttcgccgtttcttgaaaaaccgatgcaaaggtttggaatgaagccgattattgttataggtgggtttctcgttattatttcattattcttttttacacaaacattttcgttttgggtatggtttatccttagatttctagttggagtcggagatcatatgcttcatgtcggaacacaaacgtggatcacgacaacatcagacccaagtaaaatagggagacaagtatcgatatacggtgtattcttcggaattggttttgccgttggcccgtatttagcaagcactgtgcagtacggtcttgcaacgccatttattatatctactttactttgtttaataggttggcttttactacttccaacaaaaaatgcattcccagcgcaagatgaaagagaagtgaagagtgaatcatcattttctcgttataaacaagttgttggattaggatggattgcactgctaggaccacttgcatatggcgtacttgaagcaatgttaaacagtaacttaccagtatacgcacttcgtaaagggtggtctgtttcagatgtatccttcttattaccagcatttgcagttgggggtattattacacaaattccgctcggtatattgagtgataaatacggaagggaccgtatattaacgtggacgtttagcataagtacgggcatttttctacttgccgccgtatttgatcaatattactggatcgtctttgcctgcatgcttttagcgggtatggttattggatcgtgcttctctttagggcttggatttatgactgatttattaccgagacatttactaccggcaggtaatatattatccggaatcgcttttagtttaggaagtattatgggacctgtattaggcggcgtatttatagaaaaaatacagtatacaagcttttttattgcggttatgattataatgggaattctcgcaatgttatatatggtctacatgaaaaatcaatttgcatcaagaaaaatagaaagtaggttagggcatgacaaaacaacctaataaaaagaaatttgaagtacttgaaaatgaaacaattacagactgcttagcacgtatggaacaagaaggctacgctccgtctcgtcgtatggaagagccaatctttcatgaagtaaaaaaagacggcaaaacagtagttgaaccgtgcggtaggaagattgtttttgaagggaaattgaagtaatccaataacaaattctctttatagtatagagccatccaatagttgggtggcttgtttttttattaatcaatgcaggaattgaatagaatgaatctctcgttcatttctcctaatgggcttctttatatgggacaaaagattgctacttttttcgtatattggtaaaataagttcttgggtcttacttattgttatcggtataatgtttgtcgcttgaatgaaagaaattagttacaaaaatttcgtactatgtaaaggggtacagcaacgatcccttttttggaggcactttaaacataaagcgagagaagaggctatatgaacgattctcctatcttgtttaaatattaaacgagttattgcaattggaataggtatatcaaactagtcgacatcctgatggatcatcattttctagtaacctatcacttctgatggaatcgatagattgcta

SEQ ID NO: 763 - DNA, 1301 bp, Bacillus thuringiensis
atgccatgattttattttcgttatttcgcaaacaatattgttttgttatatgtccactaaatttctatactcacatagctacttctctatatcaaacatttcggcattcaattatgcaaagttccaaaccgctatgctacaatatacaaatagaactaggagggatactatgattcggaaagcaaaaaagccagatgcaatggcaatagctcctttattgtataatgctatgcatgaaattgctgaaaaaatcacaggtagcacagttgaagcagaagtattactaggacttgagacatggttctcaaaagaaaataaccgtctgagctacgaaaactgttttgtctatgaacaagacgagagtgcagttggaattattgtcgcttatcacggtagtgaagcaacacagcttgacgcaccaattgtacatcacttaagagcattacataaagatgaatcaattacgttagaaaaagaagctgagcttgatgagtattacattgatacattatcagtttcaagtgcacacggcggaaaaggtataggttctaaattaattgaagctgccgaaatctatgcaactgaaaaagggcataaaaaaatcgctttacttgttaatttagaaaacaaacgcgcctattcactatacgaaaagttaggttataaaaaagatgaaattgttatgctagtaggagaaccttatgctcatctcgtaaaaccattaaacgtcaaaatttctatatcttaaaaagaaagcacacgatttatataaatcgtgtgcttttatgttaaatttgtatttaatatatttccatccatcgcctcgtgaaacgtatatgttgtacatccccatggctctctgtgcaaaataggagaaccagaccatcccatcgctctcagttcggcaccaatcattacattcacataattatgacctacaagagctatacttccatgtacgagagcataacgatgtaacaggtaagccgcttgccttaccctctctcttacttccttataagactcaacatctttatggtagccaagtatccataatgttcgtccaatgaacatccataccttaattgtgcatttcaaccacttcggagcaaaaaagcatgaaggaacttcagcttctctaaaaagagaattttgcataaaagataaagaatccgtcaattcagctgctgattgtacagcacgcctttgatcacttgttaagacaaatttcgctgcttcaattgcctctattgattctatcggcattttagctttttgtatcattgactcggaatcatact

SEQ ID NO: 764 - DNA, 2453 bp, Bacillus thuringiensis
tcaaaaaaataaaatctacgtgaatggggatgtttcataatgggtatggaaaaattaattttagcaggtgctttacggatcgcagcattatcaggaacaaatttaccaggactagaagtaacaaaagcgagtgcagcttctattgaatcgaatttctcgacgttggaaggacgagtggtacaagtagataacggtgtaattgttgtaaaatctaagcaatatgaggaaccggatagtgtgtatattgattcactttcaaatgtgaaagtaggagatgaagtaaaagctactggatctatgatgcgtaattttacagaatatatggttgcaactgcagttgaaaatacaacaaacaagttaggtatgcacatgaaagaagatggctcacctaattatgtaattggagaagtatcaaaagtaggaacgatggaagatgagggagacggtgctactaaatatgttgtagttgagtatccatcgttaaatgggaagaaagctattattgatgttttcttaacaaagggacaagtatttaatgcgggtgagaaagtgaaaattgatatgaagtatgtagggtggggcggaagttctattaactggaacacagttgaccatattgaaaaagttcatgaagcaaagacgaacgctgaaaataatgatggtgtatggatttggtcttaattaaaatcctgtaaataacaaatgtatcatgtagtatccagcaaatggtgatgtgtatgaccatttgctggatacttttttgctttgtattttattgagaataagggatatccgactagaatatgatgtttaaatcggtgcgagttaaaaaatacaataatgaaagaggggtttatatatggagcgagatgagaattatttacgagctaaaaaaagagtggagaatttaaaagcgttttacattcatttaacggtctatatattagttaacttaatgctttttttcataaatataagctctgattcaagtaaattatggtttttatatccacttggaggttgggggattggtatcgttatacatggtttaacaacttttccatttgggatattcggaaaagaatgggaagaacgaaaaattaaagagtatatggagaaagataagtgaaaaaatcagagatttatgaatataaatctctgtgagcacacgtttgatgcgaagcctattctatagcttcgcctatttgttttgtactcgaagttaatgcgagtacgtgttcctattcatttttagcatgaattgcatgtgaaatcaaaactttagttgtagtacataataaatacagttattttactttcttaattacaagtggatataggataaagttgatttatcatcctatattaaaataaaaaacaaaccactgttcgatttgaatattccacgatataatggtgagagtttatgacagaataaatatttacataagaagtgaggtactgtatgaaaaaaagaacgacagacattatttttattattattggtgcatttctttttgctttaggtgtcaatttatttgttatcccgaacgagtttggtgagggtggggtaacaggtattacgaatattacgtactatttatttgaatggtcaccaggtttagttaacttaattttaaatgcgattttgttaatagccggttataaatttttaaataaaatcacaacaatttatacgattatcgctgtagtgactaactcgctatttcttcatttaacagaaggctggacgattgcttcggatgaaatgcttgtaaatgccattttcggaggaatatttatcgggtgtggtattggtcttatcattcgcgttggcggaacaactgcaggtactacgatcttagcaaggatgacacataaatatttaggctggagcattagctacggtctactgttcttcgatttaatcgttgcattttcatcttatttcatcattggtgcagaaaaactgatgataacaattattatgctatatgtagcaacgaaagtgatggaatttgtaattgaagggttaaatccgaagaaggctattacgattatttctgataatccagatgaaattgccgggaaggtgacaaccttaatggggagaggggttaccgtgtattcaggtcatggctattacacgaaaacgccgaaggaaattctttatgttgttattaataagcaagaagtagtgaagctaaagcggattgttcaaactacggatccggcggcgttcatcgctatacacgatgttcgtgatgtgttcggagaaggatttgttgatatttcgaaggcttagaaattgtttttgattaaaataatcttaatactaaaacgtaagaatctattttgaataatcttttttcaaaatagattctttttctttttcttgcaaaaaatccaattgtttcttaatgtagtgatgtagaaggatgaacgagagaggg

SEQ ID NO: 765 - DNA, 2548 bp, Bacillus thuringiensis
caattgctaattggttggaaattaccttttttttttcatccgttattaatctactaagttctttgccttctttatctaacacttgaaatacagcgccttttagctttaattcactatccttatcatcaactttttcaatttcaaattgcccagtcggatctggcaatttcttattttctattttaatttctactactgtatctttttctatttttacagctattttatcttttaataattcataacctttaggtgcctctatttccactagggtatagtttcctattggtaagtcctttgatattatttctcctttttcatctgttattaactctccaactacttttccttttgcatcttctatatgaaactttgcccctgctagttttttatttttatcacttatgtctactttcacaagcttcatttttcccattggatctggcaatttcttatttcctatttcaatttctacttctgcatctttttctatttttacagttattttatcttttaataattcgtaacctttaggtgcttctacttccactaaggtatagtttcctattggtaagtcttttgatattacttctccttcttcatttgttactagttctccaactattttcccatttaaatcttcaattttaaactttgctcctgctagctttttatttttatcacttatgtctactttcacaagcttcatttttcccattggatctggcaatttcttatttcctattttaatttctacttctgcatctttctctacttttacagctattttatcttttgataattcgtaacctttaggtgcttctttttccactaaagtatagtttcctattggtaagtcttttgatatcgcttctccttcttcatttgttactagttctccaactattttcccatttaaatcttcaattttaaactttgctcccaccaattttttattatcattattactatcaaccttttttatttttacttttcctgtactaggcttgttccaatgtttccagttaaatttgaaattgtgaaactcaaatccaccagtttgttgtaccgcaccaacaaatgcttgtccattaatcgaaccgccttttgtttctaatacagcattgggagcaaacacactcccaactacaccatatccctctgttgtaatttttttcgcatttggaaaaacccaaatcattttcccatatagctcagtaaacggggaattaggcgaatatggttgtgatgtaggaactatatctgtagcctttccaatattgttcgtgtcatatagaatagacccatttttaaatgtaacctctattgcatctgaatacattacaataaaatctttgtccttagcattgggcaaaaatacatctcttatatctacactgattttccctgtcaattctgatgaaacataaatattaggattgtttatatcttttccgattccatgactcatatttggaattggggtattcgttttatattgacctgcatttttactaacttggttcactatattgcgaaattcattaaatttcgcgtcaatttctagtttttctttataaacgatacgatcataagaagattgtatgatgcgatctggatcactctcttttgtcattacgactattccgttttgaatgataaaagattcttctcttgatttttttagttttccagacaataacaaggacggatatccctcatcaacccatttttcacctactatattagatgttcctgctgctgcacctacaatcgtataccccgatgcatccatatcaccttgaactgcaattgctccttcaatgtcgccacctattgctttatggttaccaaagacaacagcattataacgcgatatatctcctagaccttctaaggtagtcgtggaaccatatgcttcttttggtacatatacgacaaaacttacacttaacattaacaaaacaataaaatgaatacttaccagctttaatcgtagcctcaattcctttgttcccacctttaccgtatttttttataatcgaataaaatgaatttttattaatgatgatttacttcatcccctatataccgtctttacttatctttgaatttccggtcccacttcccattaatgcaggataaatacattctatcgagttaactttttcttataaattacgactagaagcacacataacaataggattgtaactattacagtccacttattaaatataaatatctctgtactcactttttgtttttctttcttgtttaactccacgcgctcacctcgaactagcaatctattggtgtttactccataaggcgtacacgtaattaaagttgtataatctttattttctacaatttgtagatcgtccgtttcatgtggtaacactactttaatttgatctactttataagcaagaactttgtctaaagaatgaatataaaaaagatctcctttgctcaacttatctaaatctgtaaataattttgctgatggtaaaccacgatgccctgttaaaatagtatgcgtact

SEQ ID NO: 766 - DNA, 2220 bp, Bacillus thuringiensis
aattgctatgtaaattagatgctttaccgaaggaaattgttacagctgtacgaaataacggcggtggtcactattgtcatagtcttttttgggaagtgatgagcccacgaggtggcggtgagcctaatggagacgttgcaaaagtaattgattattatttcaatacctttgacaacttaaaagatcaactttccaaagcagctattagtcgttttggaagtggctatggatggcttgttcttgacggtgaggaactctctgttatgagtacaccaaatcaagatacgcctttgcaagaagggaaaatccccttactcgtaattgatgtatgggaacatgcttattatttaaagtatcaaaataggcgcccagagtttgttaccaactggtggcatacagtaaactgggaccaagtaaacgagaagtatttacaagcaattcaatcacaaaaacattagtcgtacgtataaggtaaatttggtaatgtaaaatcagtattgtcgaaatcctccagaatcccccggattgccaccgggggatttatgattacttcattgtatttatataatgttttaaaatattttttatttctagtttcagctctcggaacaaaaatccgaattcacgagcctttccattatgtaacgtacagttagttacctcattataaggagctatatttcccccagctttctgaatgagtgcttttattcctgtcttctcttctatgaaatgaataatttcttccatagaaactgctccggtactacaggcgttaattggtcctctcacatttgccattccgcaccaagctagaaactctcctgcctctttttcatgtataaatgacaaagttccatctacatgatccacaacgataggtttttggttcacaatacattcaacgtaaaattgtaaccttttcgtataatcattttctccaataacaactggaaaacgcactgcaacgactgggaatgttgcatgttgaaatacaacggcttcagctaatctctttccttcaccataattgaagtcattcctatctccatacgcgattgcattactcgtacggattaaagtcttcttctgataagcttagggcaggttcatagacggccattgaagatgtcataacatatttcttcgttttccctcgtaacacttcacatattaccttcgctgcattcgagctatagcataaattatcgtatacaatatcataacttttatctcctagacgctctgctagttgtttttcatcttccctatctacaataagtctttttactctactgccaaaagaatcttccgtaattcctctcgtcgcaatcgttacatcgtgcccctcttgcaaaagtgcttctactaaatgtttaccaaaaaatcttgttccccctagcaccaatacttttttcaacttcatcatccccactttagcaaattgtaaaatactacctctctattataagtgctaacatataaaaagcatggaattcgtttaacgattccatgcctttatacagataatatattaacgtactcgatatttataaatacaataacagaagtataaaatagaaattacagatacataaacccataattcatatacgaatccctctccccacactcccataaaataaaagagtgaaggtaaagtcaatgttacccatgattgtacgaaggcaatccttccaagatattgattaatgttcttcttttgtgtatttaatacaaagaataaataccaaagtgatgcccacataaaccacgttaacgcattaacaacatcatggaattgaacaaatgaaacaaccatatagaataaggctataattgctacccaaatacaaaaccatcctagaccactactatccattccttttataaaagtaacacctacatataaataagttaatccaaataagaaagtagccgcatatgaatacactgtccaattgctttggtcagaaatcataatcaaataaaacggaataataatttgtagtgcacccacaaataaattaaaaacacccgcacttttcatctctgctttccctaatataacaagactatttaaaaataaagctgcccctgaaagtaataatcctacataacccatatatattcgtgtgaaaatctttacctttcacacttttaacctccccacactataaaatgatacttatattatttttctttccatttaaaactaca

SEQ ID NO: 767 - DNA, 1461 bp, Bacillus thuringiensis
ttgggggttcaagtcctctagccggcaccatgtaagtttcggaggggtagcgaagtggctaaacgcggcggactgtaaatccgctccttcgggttcggcagttcgaatctgcccccctccaccatttacataggggcatagtttaaaggtagaactgaggtctccaaaacctccagtgtgggttcgattcctactgcccctgccaaatatatttacacaacatggcggttgtggcgaagtggttaacgcaccggattgtggctccggcattcgtgggttcgattcccatcagtcgccccatttttattttaaaaattacaaataatctaatggatacttacatataattaagtaagaattcgatgggctatagccaagcggtaaggcaacggactttgactccgtcatgcgctggttcgaatccagctagcccagccatttttgcggaagtagttcagtggtagaatacaaccttgccaaggttggggtcgcgggttcgaatcccgtcttccgctccaataaaatttaatatggcggcatagccaagtggtaaggcagaggtctgcaaaacctttatcaccggttcaaatccggttgccgccttttcttttgtgccgatgtggcggaattggcagacgcgcacgactcaaaatcgtgttccttcgggagtgtcggttcgaccccgaccatcggtatcatgaacggcgtaaaaaagctctatacaattagtatagagcttttttgttttcttttcattacatgacaaaataagcagaaaaagtattgtatatacaatatttctttcgagtactctagagagaatttctccaccccggtgacatgaagttaaatccgataccaccagtagatattagtacactatcaacggttaagtttgtaatctctaaaaacttcttttcaaacccttctctgttgtacttatacatagttgagtggcacgcccacatatgcgttgaagtacttaaccagtcccctaaatcttttaattcagggaacgactcaaattgaattggttcatctaatttcatgaatctcacttgatagatagttgggtttaacttttcttctatccctttaagactatgtgcttttttctcatttgaatgtgtcataattctccttctctcttttcttcaaatttttccctatttttattatacaacaatagaaagtaattatgggaataggtgtcagcaatataaaaagactctaacagaaatgttagagtctttttgttaaattatactatgtgcttctaaaattcgtaataaacgtaggaattcatgtataatataacttgtcgaaagaacaaaatgatagtgatttatattatgtctataatatgaatcaaaaatgaactttttatatttcttttaaaaatgtgctgaacacacattatatttcatattaatatttttatgtagatttaaaacgggaaag

SEQ ID NO: 768 - DNA, 1965 bp, Bacillus thuringiensis
tcttccccctactacgcccgtatttggataaatcaaaaagagaagtatcacaacttctcttttctcccctaacactataattcctgtgtatacactggctcatttacgacattttttgctgttcgcttttgttgctgcagtaagaaaacagatacaccaaacaatacgagcatgctaccgatcatttgcattgcatttaatttttctccaagtaagaagaacgcaagtatagatgctccaacaggttctcctaaaatactcattgaaattgtcgttgcatttacataatttaatagccagttattaattacatgtgacactgtcggcacaaccgcaagtaaaagaaaaacagtccaatcccacttcgtataacctgtaaagggtacttgtaatataacattataaatccccataaaaagacctgcgaacgcaaagactgtaaagctataaatccagtgcgatactttcttcactgtcgtttgcccgataaataaataaccgacaaccgctattacacttagaaaggataatatgtcaccataaattgcttgcttacttaaacctaaatctccccaaccaatgcacattactcctaaaatagcgattcccatcgttgcaatggctgaatatgttgttctttctttaaatagaaaaaaacctccaactaaagatacgattggttgaagtgccaaaataattgttgaactagcaactgttgtatgctttaaagattcaaaccataaaagaaaatgaagtgctaaaaagaaaccagatccaattaaaaagccccaatctttcatttgaatcctattaaattcctctctttttttccatacgataggcagcataataagtacgataatccataagcggtacatacttaatattgaagatggtgctgaggacatctttacaaaaactgctgcaaaggaaatggcaattatagaaattgctaatggtagtgcgattgatttttcttgtttcaaatcctgtctcccctctcacctgtcaaaaatcccacttcattatatccgttttctttcgcaacttaaatactaattttttagattcttcgtatcattatggtaaaatagaaattaaggcaccaattagtgaatatttctttccttttcactacaagcgtcgctcttacaatcgttacagtaaatttttatttagggggatctacatgagtcaaacaatagggagaattgaagaaatttcattttatagcgcatcacttcaagaagatgttacacttctcgtttatttaccagtaaattacacaccactgcacaaacatacagttgtaattgcacaagatggtagagattattttcagcttggtaaagcgcaccgtgtaattgagcgccttcgtgaaaccgaagaaattgaccgtacaattattgtcggtattccatataaaaatgtacatgatcgtaaagaaaaatatttcccaaatgaagtaaaaaatgctgcatatattcgtttccttgctcatgaacttgcaccatatattgatgaaaattatccaacgtaccaaatgggaaaaggtcgtgttttaattggtgattctcttggcggaacagtttcctttatgactgcacttatgtatccgcatacattcggtaaagtcgttatgcaatcaccatttgtggatgagacagtgatgaacttagcaaaagaattcaaagatccacaggcgttagaactgtatcacgtcatcggtacagaagaaacggctgtaaagcgtactgatggacaagtatctgatttcgtagggccgaaccgtgagttaaatacacttcttacagatagaaacttcatcacgcattatgaggaatttgaaggcaatcatacttggaaatattggcagactgatttaccgaaagccttctctcatattctatcaatgaaataataaagaacagtattcagaataatttgatataatagatataagat

SEQ ID NO: 769 - DNA, 1501 bp, Bacillus thuringiensis
agtgtgcttaccagttatgcaagacttagcgaaagtcttaaatataaatgagtttttccaagttggtgacctttctatgttaggaaaaccaggtgagtatcttgtgaaaatgaatcaagatttcgtaagtggtaatgaagcattcgtgagcttcttaaacttagcgcaaaacccggaaaacttaccgttagtaaaccactgtacagctggaaaagatcgtactggatttggttcagcattattactacttttactaggtgtaccagaaaaaacagtaatggaagactacttactaagtaacggattccgtgaaaagctaaatgaaaaaatgatggcctttttaggtgcgaaattacaaaacgatgagagcagagcgatattaggtgcaatgtttgaagcacgtgctgaatacttgcaagctgcgattggtgaaattcaaaagcaatacggatcagttgaagcatacgctgaaaaagctcttggctttacgaaagagtcgttagaggaaatgaaagagttattgctagaagattaataatgagaaggaggctgagcggattagcctccttttactattgttgctataattttgttaatgaggatgttgtgcaccgaggagaaaatggatgaaaagagcttaagaatcggggaataaaatgattcatacacgtgtaaaagcagaggggataagagaaaagctggcaacaatactaagtcaagagtataaggaactagctattcaagatttaaaggtgattggaacgggagtgcaaaatattgtttttcaaggagattcagaaaaggggtctttggcatttcgagtaccgtgggaaagagaagtggaaaatataaatgaagacttatttaacagtcggatttcgttgcaaaaggaagcggagctgtctaagtattgtcattcaaaaggtattccagtaccaaggatacacggattgcatctttcaaccgaacttgattttttaatttcggattgtgtgtatgctgatcatatgccaatttccgcatgcaaaataggggagttagtgagcaatcttcatagtatgccaattgatggtttgtattacaaacaaaatattagagagcccattagtaagtatatagcagaacgaattgtgaaacggatagaagggtttaatacaatcacgaactgcaaaattaatcttccggatacaaaaacaattgaatatattcttagtacagcagatcatgtaaaatgtttattacatatggacattcgaccagccaatttaatcggatataatggagaagttaaagcaatagttgattgggataatgctttaattggtcatccattgctggagcttatgagaatagctgaaacaaatgaggttagttgggatgaatttaaagatggatataagaatgatagtatctttaatgttactcctcatactgttagtttattttatagactagatacaacagacatgctagcaaacttatttatagcacatttgaaaat

SEQ ID NO: 770 - DNA, 2219 bp, Bacillus thuringiensis
gtgaataaacaagagttagatgtgatcgtaattggtggagtcattactggttctggtattgcattagatggagcatctcgcgggttatcaacaattgtgtttgaaatgcaggactttgcagcaggtacatcaagtcgttcaacgaaacttgtacacggtggtctacgttatttaaaacaacttgaagtgaaaatggtagcagaagtaggtaaagagcgtgcgatcgtatatgagaacggtccccatgtaacaacaccagagtggatgttacttccattccatacaggcggtacgtttggatcatttagtacatcaattggtcttcgtgtatacgacttcttagcaggtgtaaaacgaagcgagcgcagaaaaatgtttaaccgtgaagaaacgctgaagaaagagcctcttgtaaaaaaagaaggattaaaaggcggcggttactacgtagaatatcgtacagacgatgcgcgtcttacaattgaagtaatgaaagaagcaattgaacgcggtgcaaaagctgttaactacgcaaaagtagatggtttcttatataaagatggaaaagtatgtggtgtacgtgtaatcgatttactagacggtgaagtatatgaagtttacggtaagaaaattgtaaacgcagcaggtccttgggtagatacacttcgtgaaaaagataactcgaaaaaaggaaaagtacttcagttatcaaaaggtgttcacttagtaattgatcaaaaacgtttcccattaggccaagcgatttacttcgatacaccagataaacgtatggtattcgcgattcctcgcggcggaaaaacttatgtaggtacaacagatacgttctacgataaagacgcagctgtaccacaaatgacaacagaagatcgcacatacatcattaatgcgattaactacatgttcccaagcgtaaaaattacggaaaaagacatcgagtcaagctgggctggtgtacgtccgttaatttacgaagaaggtaagagtgcatctgaaatttctcgtaaagacgaaatttggacttctgaatctggtttaattacaatcgcaggtggtaaattaacaggataccgtaaaatggctgaaatggtagtagactacgtaacgaacttactacaaaaagaaggtcatagcgcatatccgaagagcgacacgaaacatatgccaatctctggtggacatgtagatggttcacacggattcccagcatttgttgcgaaaaaagctggcgaaggtacgaaatatggtttaacaacagcacaagcagaagaattcgcgaaattctacggctctaacgttgacgtactatttgacttagcgaaaaaacataaagacgaagcgaaagaatacaacatgccgcttgacgttctaatccctcttgtatacgcaatggattacgaaatgacagcaaaaccagttgacttcttcgtacgccgcagaggcactgtattcttcaatatccactgggtatacgagtggaaagaagcagtaatcaactacatggctgcgaaactaggctggagcaaagaagagcaaatgaaatacacagcagaattagaaaaagcattaacagatgctgtaattcctgtagatcaacaagagcaagcagctgcgttagcgtaaaatagagaactacctgaaggggagccttgaggtggttctttttttatggaatattcttctaactataagaaagctcgtaagtggtatgttatgacctttcttgtttgggagatattacatttactaactttgtctgatgtttttgatgtgtggcggattgctataaatatgctcggtgcgtcggtaggatatcttttatttataagcatgatacaaatagataataaatttaggataatgcgcaagaagatatttgaaaattagcttgctattctgtagtttaaattatacaaatttagtttgatggtaatagagtatagctgaaaacataggtgctatatagtgagaggattttatatattcgtaataggtgttgatccttgtttactcatactgttatgaagcgggtacataatccgtctttattggtgctataaatgatgagagcggcacagctgaacttgcaaaagtctagctgcgttagcgcaaaatagagaaccacctgcaggggagccctctaggtgggttttctcttgactaaaactaaataaaatgtgttacaatgatgatagagtatg

SEQ ID NO: 771 - DNA, 1984 bp, Bacillus thuringiensis
aagagttaatttcagaagttactattaaaggatcacatgatggttttattgaaaatgccacaaaaaatataggcttaattcgtcgatatcttccttctgcagagttaaaaatcaaaatgttgacgattggagaacgggccacttctttcgtatacttaatttacttaggtgatgtagcaaacgcagatgtagtccaagaagtagaaaccagaatctgtaaaattaaaacagatgcaatattgagcattggtgaactatctaattttacaaaggatcaaaattggtctccttttccacaggcttatttaagcgaacgcccagatgctatttcaaatcatatacttgatggaaaagtagcggtgttaatggatagatcccctggcgcaatgattgttccaatgaatttaattggattctttcaaactccagatgattataatattcattggctcgttgcatcattttttcgcttattacgatttgcaggatttattatagctatttttttaccagcattttatatagctatagtctcttttcactttgaaatcattcctatagatttatacacttctattgcaacgtcaagagtcaaagtccctttctctcccttattggaagcttttataatggaaatcacactagaaatgctacgtgaagcgggtattcgcttaccacaaccaattggacaaaccattggaatagttggaggaattgtaattggacaagcggctgttcaagctggtcttgttagtaacgttatggttatcatcgtatctattacagccattgcttcatttattgtttctaattatgatttatcaagttctatacgccttattcgttttccaatgatgttattggcttacttttatggcattgtaggtattgttagtggattaatgctcttatttgctcattttgtttcactaacttcatatggttcaccatatggattgccaatcgcgccatttcgtctccaagagttaaaagattcttttgtaagatttcctatttctatgcttaccagccgttcgagtacagggcagccgaaacaaagaaagaaaaaagaaggtggttaacatggggaatcttaaatttaaaaatataactttattcgaatttattattttcatccattcgctgcaacttgcatctggtatgttaattatgccaagcccacttgcaactactgctggcacagatggctggatttcaatcattcttggatggatggttacttctataatcggtgtatttattatattaatgttacaaaaaaatcctaacaaaaatttctcacaaatcttaaaaacatactttggtaaatggatagggacaattctttttcttacatatgccttttatctattttttgctggatttaatactttattaaaggcaactgatattgtaaaagtgtggatattcccttccactcctgcttatcaaatcaccatattattactattaccttttattattttagccttgagtgggttaagggctcttactagttattctatgcttgttttcttcttcactacttggatgccactatttcttcttttttcactaaagagtaactacaatcctttacacctactacctatttttaaagagggattataccctattttaaaggcaacaaaagaaactattactccttatgctggcttagaaattgcatattatatatatccgttcttacaaaaaaaacaaaaggccataaaaggactactaatagcgaatactggaaccatgtttttctatctatatgttactattctttcttatatatactttagtccagaggggataaaagacgtaatttggcccgtatttcatttgttacaaggggttcgtttttctttcatggaacgattagaaattatttatatcgcttactatttaattgtattctccactactttatatccgtatttatttttcagttttgaatctatgaccatatcacttcaaa

SEQ ID NO: 772 - DNA, 2193 bp, Bacillus thuringiensis
attcgtgatgaactaaaatatcgcaatcaagttctaacaattctttgtttgaaattgtattgttaaatagctttgttactgtaccgaagctatcacgacggtctaataaataatcaatatctaatccatttggatcatgtaacgcgccgtaagcatctgagattgcaataactttcgcacctgcatcatgcataaatttagctaagaagctaccagcattaccgaatccttgaacaacaacgcgtgcacccttaatatcaatgccacgttttttcgcagcttcgcgaatacaaattgttacacctttcgctgttgctgtttcacgtccatgtgatccacctaatacaagcggtttacctgtaataaatcctggtgaattaaattcatcaatacggctatactcatccatcatccatgccataatttgagagtttgtgaatacatctggagctggaatatctttcgtcggtcctacgatttgactaattgctcgtacataaccgcgacttaatctttctaactcacggaatgacatttcacgtggatcacaaataattccacccttacctccaccatatggtaaatcaacaataccacattttaaactcatccagattgaaagtgctttcacttcattttctgttacattcggatggaagcgaatcccacctttcgttggaccaacagcatcattatgttgtgcacgatatcctgtaaatattttaacagtcccgtcatccatacgaactggtattttcactgtcatcatacgaattggttcttttaataattcatatacttcgtttggataacccaatttttctaacgcttcactaataacaatttgtgttgaattcaatagttcaaaatgttgttccctttgttgttgtgtttttgtttgagttcccttttcgggctaccatagtaagtaaaccccctgtaatttcacttgtttagtaacccttcattgcctagtacacacccttaaatttggaatgcaatagaaaacgctaacaaatatatccaaactattttctgttgcaagcgttttcactattattatagtccttttattacttttagaaaagtaaaatacttaaatatttaaatattttttattttcatcaaccacactcccataaaactgcatattttattttcaataagtatgttcgagtatttacaatcatcccttcccttctccaaataaaaacaaaacctcagctatgttgtattagctgaggttttgttttttcacgaagtaattgtgtatttgctctatcgcgttaacatccattaattctttaccgtactccatgatgcgataaatggttgctgtagacggattaccgtattccgctaaaatagctataaaatccgcctttaacaattgaatttgttcctcttcttccacccaaagatagaagcgctcatcccacgtatatagctttccgccagttacaccaaggttatataagcgattcgacaggttaattacgtcatctagcgtagcaaactcatataatatatgctcactttcatctagagtcacttgcatttcaataaactcgtcacggaactcatcatctgtatccatttcttgattttctttcgttacaattacaaccatcccttgtgcttgtagagaaaacacttcaactgcaatcggaccatctgcttcaaaccctaattccttatttgcttcttgcatcatatcacgaaataattgctgtactttcggtgcatttctccataaatcttctttcgttaatcctcgttcagataaatcatcaaatgttagaaaaatttttatcttattgtaatttaatcgttccagcctcatctcataccctccctacgtaaccaatgcatctaatttttattatatgaaatagaaaatagatggttcttttcgaacaactattccgacatttttaaccatccatcccattcttctttcgtatcaccaattaagattgtttcaatgtccaactggtttagaacgcctagctttccgataaatccaactaaaagagattcccttttttcttgtaataaatttataaagttcatcgtctttttcatttcttgttcgtcagcaaaagatacaaatacatatttcggctgtatttcctctaccgctgataaccataccatcttcagctagcttgtcctaatatatatcggctcata

SEQ ID NO: 773 - DNA, 2060 bp, Bacillus thuringiensis
tatcaaactttctagttgtccgcatctttcattatttcatccctcaatttttatcagtaaaacgccctattactttatatttacccaaacacttttcacttctgtataattatcaagcgcatatgaacctaattcgcggccaataccagattgtttatatccaccaaatggtgtagctgcattttctaagttataatcattaatccacactgttcctgcttttaatttatttgctacttgatgacccgttttgatattttgcgtccatacacccgcagcaaggccataggatgagttgttcgctcgttcaattacttcttctgtcgaatcaaatggaagtacgacaacaactggtccaaatatttcttccttaacgattgtcatatcgtctgtaacatctgtgaatatagttggcttaacgaaataacctttttcaagcgcacgttcgccaccagccgcaactgtagcaccttctttcttcccttgctcaatgtaatttaacacacgctcttgttgtttcttagatacgagtggacccatttccgttcctttctccatacctgctccaagttttacgttgttcgccattttcacaagtgcatctactacagtttcataatgtttacgatgaacaaatacacgtgatcctgcgctacaattttgaccgtgattatacataataccttggaatgcaccatttatcgcttcttccaagtccgcatcttctaaaatgatatttggtgattttccgccaagctctaacgttacatgcttaatcatttctgcagattgacgcataatatactttcctgtaacagtagatcctgtaaaagcaactttatcaatgtcatgatgatttacaattgcagcccctgcttcaggaccaaagcctgatacaaagtttacaacgccgtttggaaatccagcctctttaaagagtttcgctgtatatagtaaagataaaggcgtttgctctgctggctttaatacaatcgtacaacctgtcgccagtgcagctcccattttccaagaagacataacaagcggaaaattccacggaataatttgtcctacaacaccaacaggttcatgtctcgtataattcaagtaatcttttgaaatcgggattgtttgcccaataatttttgtagcccatcctgcgtaataacgataattttctacagtcgctgaaatatcatcatcaagtgctacttgatatggctttccattatctaaagcttctagttgcgctaattcttctctatgttcttcaattaaatctgctaatttataaataagatgcgctctttcagcagtagccatttctgcccacgggccagattcaaatgcagatcttgccgcttttactgcagcatcaatatcctcttcttgcgcttcacatacgactgctagaacctcttctgttgctggattgtacgtttcaaacgtctttccgccaatagcagaaacaaattcgccattaataaacattttaatttcttcatttaaaaacgcttccacttttggtttcagctcaatatttgtctttaacattatgttctcctccttatttaaacagctgcatgagctgcaatatttgataaaatcgtttgaagcttttgatcttcttctacagttaaccctagtcttggatagcgagaaggtcctcccgcttgcccatgtaattccatagaacgtttaacgatttgaacatatttccctgatccttcaagaaactcacaaagtggtaaaatagcatcgtttatttcccacgccttttctaattcaccattttgaaaatgctcatacatttttgtaacgagaccgggaacgatatttcctgctactgaaacccatcccgaggcaccaactaaatatgattccataactaaatcttcagaaccacagaagacttggaaagccccttcactttgtcttactaaatctctcgcttttcgaatatctccgctagattctttaatatgtgtaacattttcacactcttttccaatacggagcattagctctgtactcatatcaacaccagaagtaaataaatt

SEQ ID NO: 774 - DNA, 2168 bp, Bacillus thuringiensis
aagagcgtgaatatgtgcaaaaaattcatggaaaaggtgtttttgttttaaagcgaaaaaatattgaatttaattttggcggtattgtaagtttccaagaagaaaatgaacgtttaggacgtcattgtattacagaagttgtggaaatggacaaagaaaaagccacaaaagaaattgcaaaattattaaatgtaaaagaaaaaacagagattgaccatattaaacgtgtacgaaatattgatggagaaaaagtaattttagatataaatcattttgtatctgagtttgttccaggattaacgaaagaaattgcaactgcatcgatttataaatacatcgagaaagagcttgggctacatattagttattcgcagagagtaattgaagtacagccatgtacagaggacgatagaaagtacttagatttaaatggaacagactatgttgtcgttgtgaaaaactttacacatttgtatgatggaagtcagtttgaatatacagaatcacgccatcgtttagatatttttcacttttcggatgtggcacgcaggaagtaaagaggtggaacaaaatattgtttcatctcttttttttataaaaaaaaaacataaactcgtatatacgagtgttgactaacttatatatacgagttaatatgtaattgtaaacggtatcaaaaaaagaaaagagggacgggaatatggggaaagactatcgtaaaacagcagaggaagtgttgcagtatattggtgggaaagacaatattgaacaagctgcacattgtgtgacgaggctccgtatcgctttaaaagatgaaagcaaaatagataatgataaattacagtctgtttcattagtgaaaggagcgtttcataacgctgggatatttcaaattgtaattggtccaggggatgtagatcgtgtttacgctgagttgataacgcttgcaggtatgaaagaatcgactgtagctgacgtaaaagactctggaaatcagaagttaaatccagctcaaaagtttgtgaaaatattttcggatgtatttatgccgatattaccagcgatcgtaacagctggtttactaatgggtattaacaatctattaggcgcaaaggacttattttttgatggaaaaaatttattagatgtttatccgaacttaggcgggctttgggatttaattaatatgatggccaatacagcattcgtattcttaccagcacttgtcggttggtcagcaacgaagcgttttggtggtagtccaatactagggattgttatgggattaatgcttgtgcacccggccttattaaacgcttgggactatggaaaagcagcgactggtttagagggtcaaaagattgagtacttcaatattttaggactgttccaaattgagaaggtaggatatcaaggacaaattttacctgttttagtagcagcatttgtattaagtaaagtggaaattttcttaaagaaacatgtaccaaatgcaattcaattactagttgtaccaattacaacaatcgttgtgacaggtgtgttagcgttaggaattatcggtccggttacacgtcatattggagatttattaacagtaggattagtaggtgtatatgaaacagtaccagtagttggagcagtattatttggagcgttatatgcaccgctcgtaattacaggtatgcatcatatgtttattgcaattgatttacaattgattgcacaacatggcggtacatttatttggccgatgattgctctttctaacattgcgcaaggtagtgcggcacttgcgatgttctggatttctaaaaatcaaaatgataaaagtatggcatcaacatcagccatttcagcatacttcggtattacagaaccagcgatgtttggtgtgaatttacgaaataagttcccgttttatgcagcgattatagggtctgctgtggcagcgatattcattacattaaatggtgtattagcacctgctatcggaattgggggattgccagcatttatttctatcattccgaaatcgattccaatgtttattgtctatatgatgattgcagttgtaatcccatttactttaacaaggctatttgctgaccgagtgaaacagcagtcggaggaagttacacatgaaggaatggcataaaagcgtcaga

SEQ ID NO: 775 - DNA, 1484 bp, Bacillus thuringiensis
  unsure (1)...(1484): unsure at all n locations
aacttaggcaaatataatgctaaggtcctctatttttaatgtttaaaaaccgtataaggagtgaatatgcaaaaatgcataattgacgaaaaattcccatgttaccattatatattgttttatgcatgttaattgtataaaataccccaagtatccccattacataaagaaggcttattatgcaaaaaatatttaactgggttaaatgtatgagtatcaataaaaaattaatcatttcattctttattattttaactataccaggaattattattggtggtgtttcatatcaaactgccaaaacaaattttgaacatcaaatgacagctaaagcaaaggagaatatttcgattttaaatactgttatttctcaaaatatagaagagaaatttgttgatgcgacgtactttgcagacatcttaacagaagatacatatctaaatggacaggaagaaatagtaagaacgaagcttgcgcaatatataaaacttcatccagaagtagaaggtatttatattggaacagagacgggaaagtttataagagaaccatttatccaaatggctgatggatacaatccaagagatagatcttggtataaagaagcacatgaaaataaagggaaagtaattgttacttcaccatatcaatcagcatctaccaaaaatatggtagtgacaattgctaaagaagtaaaagatggtaaaggtgttataggaattaacttaaatttagataacatcttaaaaatttccaaaatgattaatattggtgaaaaaggttatgcagttattttagatcaaaataagcaaattgttagtcatccatctagaaaaccaggtgcaaaagttactgatccttggattaaaccaatttatgaagaaaaacaaggaaatgtgtcttatacagaacaagatgataaaaagaatttaatctttgcaacaaatgagaaaacaggctggaaagtagttggtgttatgttcgatgaagaaattaaccaagctgccaatccagtgttttataagactttgattgtcattgctattgctattgcatttggtagtatattaatttatttcattacaaagtctattacagggccattacgaaaaatagctgaatcggcatataaaattagtaagggagatttaacagagaaaattacaatccattccaaggatgacatagggaaattagggaattcatttaatgaaatgtctatgtctttacaagatgttattacccaaattagcttttcagcagaacatgttgcagcatcggctgaagagttaacagcgagcgtacagcaagcaaatgatgcgacagatcaaattacaattgcgatggaacaagtatcaggtggggctgagtcacaaagtcaaggtgttgaagaaggtgcggctacattacaacaagtaaatacagcaattcaagatgtanactggagcgcagagtcaatttctatttcctcattacatgcccgt

SEQ ID NO: 776 - DNA, 2420 bp, Bacillus thuringiensis
tcgtggaagcttagattccattttattaaacacaaaaattgttgatcaaaatggtcttaacgttacacctgctgcattacaagatgctcaaatacgtttaaaattaagcaaatgagttccgagctaaagaattctaataaaacataaaaagagctggatttcctatatagaaattccagctctttttattttcttttttaatttagtaaacgagcgatacatcgcaattctccacgacacaatcatcgcaaatgcaagtaagaaaaacattccacttaactccgctaaatcaatcgattgacttaaatatgatttcaacgctactcgtacagctaataatccgactaaaataaatataaatgcttttgacggtttcatatatatttgttcgtctcttatttcaaacttcgttgtttttataagaaatacagagaaaataagccctgcaataattgcttctattatttctaacgacgttaatcggaattccggtaaaaagtacatcattgctccagtactcataaaaattggcggcaatataattttctttttcgttaccggttttttcgctgctttaaagcgcagaaacatgacaccaacagccatacaaaccgctaaaatacttgataaaagtgctatcatactcttcccactcctatctatttaaaagactttttgagcaaaatcataaaccaaacgagcccgatacttataataacatgacctaatccagccatatggcttaaaccgtaaaagtcagttccatttacttgtagaagacctctccatagcattgtaacaatagtaaagattactcctacattataaacaacaaaccatgcacaaaagctctttgtttcttgtacatgaaacactttacataaagctaaagcaattaaaaagaatacaaaaccgagcactaatacatgtgtatgcactaattgcaacattgtggatcctttaattccttgtgctttcgaatactctcttgcaaatacacctgataataaaccaataattaagtaaataaatgccgcattatataatttcttcattctattcctcctgttgaaaactttctatattcgctgcaattattttaagcaaagtttatgaacggagtatgaacaaaatattacattcaatttttgaaaataaaaaagccattccacaaataataattgtagaatggcttttcaatttattttaaatcttctattgagaaagcacctggcagtaactgctcaacagtcacttctttttcatcaccttttacattcgttaataatacaggcattttcgggtcacagaattcagcaattacttgtctacacgcaccacatggtgaaatcggtccatcagtttctcctgtaataactaagtaactaaaatcgcgctcaccttctgatactgctttaaatattgctgttctttctgcacagttacataaaccgtaagaagcattttctatattacaaccagtatagattttcccttctttcgtaactaacgctgcgccaacaggaaatttagaatacggaatatacgctttcgataacatcttgtttgcttcttcaatatattttttcttacccatattatttccccctcaaagtaaacgaaatgatgattagtcagtaataactgtatgaactaatttaggagccactgctgtttcagcgatagagatgttctcataaatttttgcttttacatcttctacattttcacgatttgcgtagattgttacgaatggctcgccttcttttactgcatcgccaacttttttacgtaacattaatcctactgctaaatcgatttcatcttccttcgttgcacgacctgcaccaagtaacatagctgcaataccaatctcatctgcaacaatgttagaaataacacctgaagtttttgcaggtacatcaattacatacttcgcctgtggcattttttctggattgtctacaattgagctatctccgccttgattgcttaagaactctttaaacttctcagttgcttttccgtttttcataacttcaattagcatttcacgagcttcttctaacgtatttgcttttttcgcaagtacgaccatttggctacctaatacaagtactaattctgttaaatcttctggaccttcaccttttaacgtatcaatcgcttcttttacttctagagcgttaccaatcgcaaaaccaagcggttgtgacatgtctgaaataacagccatagtttgacgtcctacattatttgcgatacgtaccattgcatgtgctaattcttttgcatcttcttctgttttcataaatgcaccagcacctgtttttacatcaagtacgattgcgtcagcacctgctgcaatttttttactcataattgaacttgcgattaaaggaattgaggtaaccgttcct

SEQ ID NO: 777 - DNA, 1826 bp, Bacillus thuringiensis
tcatgcgtatttaccgtgttatacaattataaataatattgctacaaaagcagttgcaggagaggttgtagatggaccatttcgctctgcgcaagcaactgtagctgaaagtggtttacaagataaagtagatgtgcgtaaagggaatggattagctgttatcgcaccaggagaagtagatgtaattacggttgccggaatgggcggagcgttaattcgtgacattttagaaagtggtaaagaaaaattagaaggtgtaacacgtttaattttacagccgaatattgcagcgcatcatattcgtgaatggtttattgagaatggttgggagcttatccatgaaaaaatcgtaaaagaagatgggaaaatttacgaaattttagtaggggagcgcggaaatgttgtagcgccttactctgaaaataaacaagctgaattgtttatgggaccatttttaataacagaaaaaagtgaagccttcgttgaaaaatgggaaggagaattaaaaaacttccaaaatattttaaaacagttagaacgtgcggctgattctgaagaaacaaaagcgaagcgtggggaagtagaagcgaaaatgaaaatgataggggaggttttatcatgagtaaaattccaaacggccatgaaattatttctttatttgaaagtatgtatccgaagcatttggcaatggaaggagataagattggtctgcagattggagcgcttaataaacccgtgcagcacgtattgattgcgctagatgtaacggaagaagttgtggatgaagcaattcaattaggggcaaatgtcattattgctcatcatcctttaatttttaacccgttaaaagcgattcatacagataaggtgtatgggaaaattattgaaaagtgtattaaaaatgatattgcaatctatgcagcgcatacaaatgtggatgttgctaagggcggggtaaacgatttacttgctgaggcgttaggattgcaaaatacagaagttttggcaccgacatatgcagaagaaatgaaaaaagttgttgtgtttgtgccagtcactcatgcagaagaagtaaggaaagcattaggagacgcaggtgctggtcatatcggcaattatagccactgtacgtttagtagcgagggtacaggcacatttgtacctcaagaggggacaaatccttatatcggggaaactggacagttagaacgtgtagaagaagtgcgaatcgaaacgattattccagcttccttacagcggaaagtgattaaagcaatggtaacggcgcacccttatgaagaagtagcgtacgatgtgtatccgcttgataataaaggtgaaacgttaggcctaggaaaaataggatacttacaagaagaaatgacgcttggccaatttgcagaacatgtgaaacaatcattagacgtgaagggcgcaagagttgtcggtaagttagatgataaagtgcgtaaagtagctgtacttggtggagatggtgataaatatataaaccaagcgaaatttaaaggagcagatgtatatgtaactggtgacatgtactatcatgttgctcatcaataaaatgatgctcggttaaactatagttgacccagaacagaatgttgaaaaagtaatgatacaaggtgtacgtaagcaatcacaagacaaagtggaggcaaagaaactcaatgtacacattcatgcttcgcagttacatacagatccagtcatatttgtataagagaaataaaacccgttgctcatgtaagcatcggttttaattattgttcctttttcactttcacgcgaggtaatattttttgttc

SEQ ID NO: 778 - DNA, 2119 bp, Bacillus thuringiensis
  unsure (1)...(2119): unsure at all n locations
cagaaccacctgttgctagcatcggatctagttcgataaagtcacgctcttctacatgcggtggaagtttcacatagtattctaccggttgcaatgttttagggtcacggtataaaccaacgtgtcctacttttgctgctggaattaatttcagaattccatcaaccattcctaaacctgcacgtaaaatcggaattaaaccaagttttttaccagcgatcacttttgttgtcgctttgcttacaggtgtttcaatttcaatgtccttaagtggaaggtcgcgagtaatttcgaaagccattaaacttgctacttcgtccactaattcacgaaaatctttcgtacctgtattcttatcgcgaatatatgtaatcttatgttgaattaacgggtgatcaaatacatacagttttcccatgtgaatctctcctttagatgatattcatgcgtttgcacgcttttttacactatttacgattgtaaagaaaacgctactaatattcaagggcaaatttggcaaaatcatgattttacgatgaatctatctagtatctttaccaattatgggagctgtatccttcattatatcgccaaaatttattcatcatttgtatacatactttaaaaataatatatgtccacaaaaaagaccgccaaaacaattaagtctcggcagtcttcttcaatctattatagatttggatacattgtgaatttgctagttaacgcttttacacgcttacgtacttcttctaatgcagcttcattttcatgattttttaatgtataagcaataagtgacgcaatttcatccatttcttctaaaccgaaaccacgagatgttacagctgctgtaccgatacgtacaccacttgttacaaatgggcttgctgtttcaaatggaattgtatttttgttcactgtaataccaacttcatctaatacgtgctctgctactttacctgtgatttctaagttacgaacatcaatcaagattaagtgattgtctgttccgccagaaacaagtgtaagtccttctttttgaagaccttcagctaagcggttcgcattgttaatgatattttgtgcatatgttttgaaatcatcttgaagtgcttcaccaaatgcaacagcttttgcagcgattacgtgcataagtggaccaccttgaataccagggaagattgatttatcaatttgttttgcaaattgctcttcacataaaatcataccaccacgcggaccacgtaacgttttatgtgttgtcgttgtaacgaaatgtgcatgtggtactggatttgggtgtaaaccagcagctactaaaccagcgatatgtgccatatcaaccattaaataagcgcccacttcatctgcaatctcacggaatcgcttgaaatcgataacacgagggtatgcacttgcacctgcaacgattaattttggtttatgttctttcgcttttgctaatacatcatcgtaattaatacggtgagagtcagcatccacgccatattctacgaaattatattgtactccactgaagttaacagggcttccgtgtgttaagtgaccaccatgagataagttcataccaagtactgtatcgccttgctctaaaatcgtaaagtatactgccatgttcgcttgtgcaccagagtgtggttgaacatttacgtgctctgcgccgaaaatttctttcacgcgatcacgtgcgatatcttctactacgtctacgtgttcacagccaccatagtaacgttttccaggatatccttcagcatacttattcgttaaaacagaaccttgtgcctccattactgcttcacttacgaagttttccgaagcaattaactcaatctttgaacgctgtcttcctagttctgcctcaattgcagcaaataccttttcatcttgacgttttaaatgatccaccaaaatcccccttttctgaacgaattacatcgattcccaacagttttttcttatttattcagaaaaaacgaaaattcaggttgtaattctttcgaaccttcatgttttaactacattctacatgacttctattcatanagaaaaaagaccgaaatcgtctttcttttttatataagtagacacatac

SEQ ID NO: 779 - DNA, 2825 bp, Bacillus thuringiensis
aatgtcatatttttatacactagtagtatagaatgcgtatgtaataaggtaggggaagaattttatgtctttatgtcggttagcgagaaaaaatattataacatttgctaccaaaaggatgaagcaatttatgtggattgctatgagtactatgattttgttttttatgatatcgttacaatttaatgaaggagctattttgaaagtagggaatgcatttgtatttcaaatgtacttttacacactttttattgtactaattttcatatgtatttttactacatataaaatgatgtactcccttttgcatgtgaggagggaggagtttatatcttatgtagaagaaaatatgaaaagaaaagaggtactatgtgtattatgtcaggagcaattattcatttatggagcagcatttgtttttggattaattaatgggatgctatttttgaaattattcacggttatctttatgaaaatcgcagggatacaaggaataaatagtgcgccaattacaatatatgcagttgtaattattagtgtaattatgatgactgtcgttttaatatcgatgatgcaatgttatcgatttgttcgaaatttaaaaggtgaaaattcgttgcggtttaaagaaagggcatgagaaatcatgcttttttctattttacacataaaaataatcatgttacagtgaaaagacctgacaaagaatgggaaggaaaggttgtatagaatgacaaatgaacaatcaattgtaaaagtcgatcggttaacgaagcgaatcggatcaaagacacttgtacaaaatattagttttgaagtgaaaaaaggcgaggttgtcggtttactcggaccaaacggtgctggaaaaacgactttaatgagaatgatggttggtatgatccgtatgacagaaggtgaagtatggattgatggtcaatctgtgaaacagcaattcgaaaaaacagctgcgaaaattggagcggtaattgagacacctgaattttatccttttttgagcggctatgaaaatttaacatatttcggacgaatgaatggtaatgtgaccgaagaacgtatcgatgaagtagtgaaattgttagggatgggacaagtaattgatcgcaaagtaaaagcgtattcactcggcatgagacaacgtttaggaatcgctcaggcacttattcacgatccagacgtgttgatactagatgaaccgacaaatggattagaccctagtggaatacatgaaatgagaatgtacataaaaaaaattgcacatgaacaaggaaaagctgtacttgtatcaagtcacttactttcagaagttgaattaatgtgtgacagagttatcattattcagcacggggaatatgtggctacgcaaaatattcagcatagccaaagcgaagagatggagacgatccgtatacgtgtagatgatgcgaataaagcagcagaaatattagggcatgatgttttagtaaaagataatgaattacttattaatgtaaaagatgaagaaatcccaaatgttattcgtacattgcttgagaaaaatattcaagtgtatcgtgtatatgaagaaagaaaaacgttagaagagcaatttttagaattaacagggggaaaagatattgtttaatttagtatataacgaactgtataaaatatttaagcggaagcgatcgattattccatttgcagttattgcagtattaataatcggattaggatgggttacggtaaagtattttgaaccggaaacaaaaggatggaaagtagattatacagaacgaactgtagaaattgagaaaaagcttggcatgaaaaaagaagctattttagcagaaaaatcaggggatgagcttgtaaaagaataccagcttaagatgaagcatttagatacggatacagcaccggcaagcagttctccactttctttcatgagagatacaggttttatcgtatttccaattttgctcccatttatcctcgtgtatgcaagtacaatttttgcgaatgaatatagctggggaacatataaatttttaacgatacgaccagcgagtcgctttaaaattttaacagcaaaatttttagcaattgttatatttgcagctttattatttatatttaatatgatcttctccgctttatgtggacttgttatttataaattccaacagcctgcatggagtgagtttattttccaagatggaaatataataaaacaaaacatttttgtagaagcaagtaaatattatgttttatcgtggttaccaacggttgtgtacgcatcgtttgcatttatgatttctgtgttaacaagatctagtggaggtgcaattggtatttcactattccttgctttatcaggcaatattgcgctattagcagccactagatataactgggcgaaatatttattgccagcaaacacagatttatatagtatttcaaagaatggaagttttattgatggagtaacattcccgtttgcatcatgtatgttgttactttatttgttcgtatttttatgtatttcatatactgtgtttttaaaacgtgatttaacttaataagaaaagccgttcagggtgtgagatgccctccgaacggcagactggatgataaatgatgcagtgcttgtctaattagtaaagcatagtattctgctcttataggcagagcctgttcattaattgtaaaagcaggatgatgccattcatgtggaccgctcgttcccataaagacgaatgaacctggtattttctgctggtgaaatgagaaattttctgcagccattgacggactacgcgagatga

SEQ ID NO: 780 - DNA, 1546 bp, Bacillus thuringiensis
atgatatattcataatttgaaatatttcacaaggaaaaaatatattttcactgcggtgtatgcataattaacacatacatcggtacaagtttgtctcttgttattcttttacatcaaagcccacattccactacaaagtataacaagaaggggacatgaacatgaataatcgatttttaaaacaactacaaaatatgaaaatgaacaaaaaaagtttaggagttgtagcattaacagctggaattattagtacgacacttattcctcaaaatgcttatgcgcacggttttgttgaaaagcccggtagccgatccgctttatgtagtccaacttatggtgcgctaaatgtaaactgtggaagtgttatgtatgaaccacaaagtttagaagctccaaaagggttcccacaaggtggtccagtagatggacaaattgcttcagcaggcggaaaatttggtggtattttagatcaacaaacagaaaatcgttggtttaaaaatacaatcactggtggggaaaatacatttacttggaagtatactgcgcctcacttaacgagtaagtggcattactatattactaaaaaaggatggaatccaaataaagcgctaacaagagcagatttcgaaccaattggaactgtacaacatgatggttctgcagcttcaaataatttaactcataaaatcaatgtacctactgatcgtagtggatatcatgtgattttagcagtatgggatgtagctgatacagcaaatgcattctataatgtaattgatgttaatcttattaatgatgtgaaaccagacatagaagcaccaagtattccaaatggacttcagacgcaaaaagtaacagcgaatagtgtagaactaacatggaacgcttctacggataatgtaggggtaaaaggatatcaaatcttccgtaacggagagatgattgatacagtaccagggactcattttattgataagaagttacaaccaagtacagaatactcttatactgtaaaagcaattgacgcagctggcaatgtatcgacagaaagtacagcgcttacagtaaaaacgacagttgagactcctgatacagaagcaccaacacaaccaaaaggattacatagtatgggaacgacagcgtcaagtgtggatttaatgtggagtccatctgacgataatattggtgtagaccattatgatatttatagagaaacagaaggatcaatgaaaaagattgcaacatccaatacaacttcttatttggataaaaatctgctcgctaatactacttataaatatgtagtgaaagctgttgatgtagctggaaatgaatccgtacagagtgatatattcacaattactacaaaaaccgaaagcgcttcatatgaagcgtgggatgcaaaaaaagcatataaaaagggagatagagttctacacgaaggaaaagtatatgaagcagtccagagttatcaaggaaatggtgatccaaactggatatatgcattataattatggaaaacagtgtaagctttacttaggtatga

SEQ ID NO: 781 - DNA, 2300 bp, Bacillus thuringiensis
tacaagtacttcttatatttttacatggaatgaaactattgcctggacagtttgatttattgaagaagatacgccacaaactattgctaaaatgaaagaacgtgctctatctgtttctaaattatccgatgggattattggggcattttatcatccttacttaggtgtgaaaccattaaaagaagtattaaaggatctagaaagtattccaaatatagagtggattgatttacaaaaggaaaagaatgaagtaaaaatgaaagatattcatattacgacgaataaagacggcattcacgttgaaaaaccaaccagtgcgaatgacataattgattatataaagcaatatggcttcttccttatactggggttcgttatcattgtctttcttttattattaaaacgtgcgaagaaattagaatcctaatacaaaaccaccgagcggaacgcttggtggttttttgtcatatatcaaaccgtggcattttattaaatacattcaattttcactttttccgttacatgattaaaactataattctcctatcctttcaaataaaatcgacttgtattttcatatattgtttctgcaacctgatcaacagatatgttttttataacactaatttcctttaatacatctcgaatcattctcgggtgcgtcataacatcgtcttgtaattcccacggtccatctgtttctaccatggtatattcaagcggataatacgaaacaatttttctaatcttctccttatgtaaaacatccggtgtaatcgaaatataataaccattcttcatcatccgtttcattgtttcatcacttcctttaaaccaatggaaatgtgcacgtgaaactttatatttctctagcaaatcacatacagtgtcagcatcttcataaactgcgtgtaatacaatcggcaaattatacttactagctagttctataaattttttcaatacagctatgtatggatctacagcaatgctttcatcttctttcctcaaataatagggcaaacctacttcaccaatcgcaacaatttcctctgcgttctgttcaataagtttataaatctgttcacactcttctttatgaatctgttgctctggatgaaaccctatcgctggatatataaagggatacttcttcgctaaagataacgtttccttacaagattgataattcatagatacagcaataagcccctttatttcattactattttccacctctttcagtaatctgttcttctcttcatccttatattgatcaacatgtatatgactatcaatccatttcatctttatgcccccataaaaaaaacaagaaaggacttcctttcttgttttagcatctatattatttaacaattaagtttgttatgatatcaaataatccaatacacactacggcaacagtaaagtagctacagaaatctttaattggtaacttcactacttcttctttacgcatcccatttttctcccttcttactagatccctaattatttttctatctgtatctattatgcaaaaaatatgacaaatttactatcgaattaacttacgtaaaccttacaatattgtaaggtttataaaaagagcctcatctacatacagatgagggctattaaaaagtagttggttttcattcttcatttatattacaaacggaaagtaatacagtgagactttctaattacactatataaaattcactatcttttaaccatcgaattacattacagaagacttacatgtttgtaagctatgtgtaatgtaattcgatagtttcccttacttatatttcgtacaataaagttagaaagtaagccaaataagaagaacactcaaataaccaaattgcattgctagtagctactcttcttatacctttcaactatgctactacaatgtacccccttcccctttatataataaaaaagccttagtctatatgtgaagtgacccccgaaagttagacaggtcgtttcattaggcagcctctagggtatgagcccggtattgtgctgggctcataccctttaattttgccttaattcttttatgattatagtattctatatactttgctaattcttgtttgaaatgtgttatactttcaaattcttttcgatacagaaattccgatttcatgataccgaagaaattttcaataacggcattgtcataacagtttcctttgcgagacatactttgagttatgccacaattcttaagagaatgacggtattgcctcatttgatagtgccaaccttgatcaaagtgaatg

SEQ ID NO: 782 - DNA, 2161 bp, Bacillus thuringiensis
taaaccaaattcgtcaacttgtaaataataaaaatacttttatccatcaaaagttaattttaaagctcggcgcattgtaaattcctccaaaatataagttattacaacatatgccaagctttcaccaatttataccttattcaaataaaaaacctcttcctagataaataggaaaaggttatttttcatccgtttcattttcttgacaatttttacaaatcccatggaatgttaaacgatgatctttcaccttaaagctccagtctcgttctactttcctttccacttcaccaagtaaatcttcttgtatttcttgtacagcaccacattgtgtacaaatcaaatgatggtggaaacgctgcgcaccttcttggcgtaagtcatagcgtgaaacaccgtctccgaagttaatcttatcgacaacttttaactcagataatagttctaaagttcgatagacggttgctaatccgatctctggcgacttttcttttacaaggaggtaaacatcttctgcgcttaaatgatcttcttcattttctagcagcacacgaactgttgcttcacgttgcggtgttaatttgtagctcgctgcatgtaattgcttcttaattcgttcaattctttcttccattcggtactactccctcctcgccactcttacaccattatatcagaagaagggcttctgtcaaaagaaaaaaacaataaaaacaaattgataattattctcaaaaagtatttattttttattaatagcctcaacgacttctttcattaaaactggtgatgcgtaagcctccacactagaagcaagtgctaacaccactccaattacgagaaagaagcatgtataacggattaataatggtaatagtggctcggttatttttctaataaattgatgcctaatcatccgtaaagaaaaacttgcagcaatagttgtcataacgagaaagactggaatgataattaaattttgtggcaaaacggatacaaatgctaataataatccattccatccatgctgacttactaaaaaaccaactgtaaatccaacgacaacttcttttacaaataataaagtagatataagtggcaatccaataattgaaatccctaaaatccaaataaatccgatgtattttaattgcgaaaagtaactttctcgaaacatttcgcccgcaatggcaaattctcctttagagacttgtccaaaaaaacgttgtaaataaaatgataaatcttgtttttgattgatttgtaaactattcaccagaatagctccgaatattactcccatcaataataaaacggcgttaaatatatataatgaagagttttcctgtatgtgagacattacacggtcttgccaattttttcgccacattttccttccctccgttcacactcttattaaaaatgtatgaaagaaagaaaaaagtatgacgaattaacattgaaattccgctctactttgctaaactaaaaagtagagaataggagggatttctcttgaaaccattattattagattttccaacattatttcaaactgaacgcttgcaagttcgtaaaccatttccaggtgatggtgcagaagtatatgaagcaatccaagcttctctagaagacttaggaccgtggataccaattaacgctgaaacagaagagagtgctgaagaaattgttcgcgaagctcacggacagtttttacttcgtgaaacacttgattttcacttatacgataaagtatctggtacattcatcggagcaattacactacagcctgaaaactgggatattccaaagttttcacttcacttctggctacatagtgcctatacaaaacaaggctatatgaccgaagctgttaaaggtgcaattcagttcgcctttgataaactaggcgctagaagaattgaaattcgtactgatgcaacaaatataaatgcatgtagcttagcagaacgtctagaattcattctagaaggtacaatggaaaatgatttcctagcaccagatggtagcttacgtgatgcacgtgtatatgcaaaaatcaattaaaaaacactcgcctttggcgagtgtttatttttgtagttggaaatattgtactgcaaacatcgtcttcgcatcatgaatacgaagatctttcata

SEQ ID NO: 783 - DNA, 2035 bp, Bacillus thuringiensis
tctggaaataatacattacccgtagtaaaactattttgcattaaatatagaacagtatgtgcaatttcattattatggccaggcctttttacaagagaaagagatttataagattcataagcagctagtctattttcgttttgttcattctctctttgtatcgttccaggagaaacaacattaactcttataggagctaattcaacagctaaagctttccctaagctttcaatagccctattacaagctccgtaagcaggcgcacctttaattggtctttgactaaaggcaccggacattaacacgatcgatccagagtttgaaagaaaagggatggcatattttacggcataatattgaggccaaaactttccgatgaagctactttcagcaatttcctctgtagaggtaattggtccaagtgtgtaagaggctccgggtgtgaataaatgatcaaagttcccaactgtcttgaaaaaattttgtaattgctctttattttgattatccaatacgtaagtgtggagatgattgctatttattaattttttagcaatctttaatttttcttccgaacgccctgcaataataatatgtgcaccttgtttaattgcttgtgttgccgttgctaatccaataccagaactcccgccaatgataacaatacgcttatcttttaatgtagtaatagacatattttagccactcctttaataaaaaactttagaatataacttatgcttttattattcgctagaagggatcaagtgaaaagtacgcactttgtatgtacatagtcgcaaatttcgtactaatcgctatttacgcggataagtaataagaaaaattgctaaatatggtttatcccgcattaacgggcagtaaaactctcacctcaaagttaggaagatgcgaggaagttaggtgagagatcaactgcccgtaaacgcccgattggttcaactaataaaaagatttatgattattgctgtaaaatcttaatgtattttattgtaaaagctgcttttcgtttaaggaaaggcagcttttttatatggaaataatgcaggggaaacttaaaaaaataaaaataagtaaagtgttaatcaaaaaaatgaaatatggagcataattgttttgaaacattactgtactagcaatgaaagaagctaacatattcatactaaagttgtagtttctatataaaaaatccatccttccgtttgattttatctatttataagtgtaatacaatacgaatagataataagaaatgagggagaatgtaaagtgattacacatatatcagatataaaactacaaacggtttccatagaaggggtaaaacaagtgtataaggacatattatcttttccaataaaaaaagaaacagcatccttcattcaatttgaagtaacaccttatacaacaattagttttcaagaagtgtatgaaccaattgcacctgcacattttgcttttgaaatcccatattcaaaatttcatgaaacagcaagatggcttgaggagtctggattactcattgcgaaatggaaagatggtcatacaattgatgaagaggatggtcgattcaatttatactttaaagacggagatggaaatctactcgaaattatcgcgcatagttatgttaaagaagatgtattagtaccgcagtcacctttaaacattttatatgtaagggaaattggtcttcctgttaaaagtgtacctatttttagggaatggctgaaatcaaatctaaatatgaaaacgatggaagacggggatatttttaactttgtagttggtggcactgcttatgtcgtcgcaacttggtggcagcgaccttggattccaatcgcgatgaaagctttaccaccgaaagttcatgtttctttcggaacagcggatctcgcatttttacagcgaatccaaattaactttaagaaaaataatgtgccatttgaatgtaaacataatgaagtgtcatttattgtgcagggatattcattttctattgtgtatacaccag

SEQ ID NO: 784 - DNA, 2019 bp, Bacillus thuringiensis
ccaattgaattttcattttcatcctacttggaaatactagcgctctgttcattatatagaacataagatactatatcaaaagaaccttgagatagcacatttgtttaagttattagttaaaagtgtgggattgctggcattgaaatgatggcttcaccaaacataggataataatcttgtgaatttagtgttacatagtcaaaataaaaattagtttatgtgttcggtaacgcaagattgttttaagtgtagagaaaatcatagggctattttaattagtagctactgtattcattgaagctattaaggaaacgtgggtaatcgccagccctagtgatacaaatcatattaggatttagtaaaaaaaattttttctgaaaaagaggggggattaaagataagagcacttcgaaaagagcccttcagtaacgactacttattctaaaaagaaaggatgcaatatatcatatgaagtttagtgtatttaagtatgggtcttttatataaatgtgaaataaaagagggttgtcttcttattagaaggcagctttttgttattacaaaaaagaattagaaataaaatataaattcagttacttgtccaaacaatttttttgaaaatacataaaatgctagtagttagccaatatttttatattgttaattttttagactaaaaggggtgattttatgtgtgattgtgaagtttgtagaagaaagaaaaaacgtgatccattaaatcggggttctgaaccaaaaaaacaggattccgaatcagtaaattcttattcatttagtaaaaatgcaaattttttagaagaagctatacaaacagatgaaatcgatcaagtttctgaggaatatattgaaatagtagattcagcagatgtacaagttactactacagatacaaaagctgcactatctatccaagccgcgttacaagcagctattgtggttgtagtaagtatttctatagcagatagtgaaaaggcagataaaataacacaagaattgtttcaaaaatcatctattaaacaaattaatagacaaaaaacatttattaaaaattccagaaacgtaaccgtaacaactactgatacagatattgcagtgaatattcaaattcttcttcaaattttattagcgttattagttaaactaaacattttataaagtgtctatcctatttatatttagctataagggttcactctaagtaaatattttttgttgtaatatgtggtacaagcttggactttctcattatgactgaattaatattcaaaattgatgggaaattaagtgtggaaaactacacaataacaaaggtgaacctattatttaacagtgaataaaacttatatatgtgaagtaaaggaaagctgtcttcgtattagaagacagctttttgattttattagtaaaaagccgtgaaaataaaagattaagttacttgtccaagcattttttatttaaatacataataatgctggtagttaatctaaatttttatagaaaactgatagaagtgaatattgtaaatggatgatttaaataaattttcttcctttaagtttgataaggatcaaaagaatataattatagaccttttactctcagatatttttaataggcatgggataaatgaagaaaaactaaaaaatttatcaccagaaaaaaagcagcaaattaaaagtattgtttctgaaatacaatcacaagttaataattatttagattgaaagggggtgaatgtatgaaaaaaacatgtcattcagaggaaaataaaaggtggagtgcattagactcctcaaatcctcatccatcttttaaaaatgctactgtttcagaagctgcagcacaagaaagtaaaacttaccaaatttctgaagaatctattacaattgtagattcagcagatgtagaagttacgactacagatacaaaagctgcgttatctattcaagctgcattacaagcagctatcgtggttataataagtatttctatagcaga

SEQ ID NO: 785 - DNA, 2252 bp, Bacillus thuringiensis
atactgcaagtaattcttctgtccgctgagcaacttcattggcatctattcctcttaacaaccccatatatgttaataattcgcgaccagtaagtctttctggtaaagccaatccatctggtaatactccaatcaacgttttagcttgttttggattactccaaacatcaatcccaaaaactttaacgtttccgccatccggtcgtaacaaaccaacagccattgataaagatgtagtttttcctgctccgttaggtccaacaactccataaaaagaaccacttggaatagttaaatcaatacaatttactgcaataaattcaccgaatcgcttatgtaatttcgaaagttgtagcgcaggagcggatttctcaaattcggtattcaatgaaatcgattcatcagttttcataaaacagactccttttttactactatattctttgtaaacaaaatccaataattttactcatttaattacaatactgaagcattaatttatttagcaattcattgttattagctgacaccttttacgtattccataataattgcctgtctatcgtgtatctttgtcacttcaaatacgtttggaactggcagcccgcatgaataagcatatttttgtttttttgcttcattcatagactctgtacctggaagatattctttaaataacttcacaatcttattatcatacagataaatttccgctgtatttcctttagccattggctcacctaagttcaagtttcaccctccttaaaccatatagtattctacacccctattttaaattcactgcaatgttaggaaatccttctactcacataaatcctattattacaaaaatctctgaaatgctaaaagaaaagtacgtatcgaaaacagccatataatttttcagcataattatagggcgactttaatgatgttgataattttttgtttcgtttgacttaaataattgttatttttagtagaaattaatataccaatcgggattttagaattaaagtccttaatcttaaaagatagtatttcttcattcaaaattgtacctttcgggataattcctatcacattttcaaaaagcatttctggaatgaggtttaaagcactacaattataaactcttttaaaaaataaattatttttcgctaggagagaacttacagattgatacgaataacaattactttctcctacaataactggataatctataatatcaaatgcttcaacggattctttatgtaacaaaggatgctcgggattattcactataaattcaatctgttcatcacataggggggtgaatagtacctttgatttattttcattatttccgcacaccgcaaaatcaatcttattatgttctatcatttctgataaaagtgctgtatttcccactacaaaatcacaatgtatatatggtttttcagcatttaaaaactttaatattattggtattaaccttttagcaacggattctaataggcctattctcaaactccctttttcttcattactaatacgttgtgcttgagttatagaatattcccaatgtgttactaagttttctacttcctctgcaaaaagttttccttcttctgttaatcttgcatcccatcctctttcaaataacagaaaaccaatttcattttccagcttttttatatgtgttgttactgttgattgtgcatagtttaattgtttagcagcttgtgaaaacgttccttcttcaataatttttttaaatgtaagtaactctttcatttccatttcatacaccatcttcatcgattttattgataattcgttaatatattttcaattatacaaatggaaatattggaagtaaaataaaatcaaaaggaaaggagtcctctattatgccatttgtcactgtttatcatcctgaaaaattatccgataataagttattaaaaaatgtaagcaatcaaattcaccattcgttaattgaacatttcaatattcccgaaaatgattattttcaaatgtttttaccttatccttctcatcaacttttttataattcatcttatcttttagaaggttcattaaaacgatccaataatatgatttatatttctattacatgtggacctgggagaacaattaatcaaaaaaaagatttatataaagctatagccactagtacagctaatactttacaaatctctactgctgatgttttcattacactacacgagacacctatggagaaa

SEQ ID NO: 786 - DNA, 2107 bp, Bacillus thuringiensis
ataacagcattctcaccaatataaaaattcaattcttgcaaagcataactatttggagttttgtaaactttcgttgctgattggcttgttataaatgttttcgcatctttaccaacatttatatttatagaatagaaatctccttttaaatagcctccaccagaattcataatatagtaatatgctctaccatactcatccaaatatattggctgcgttacttttaaggcatctttatgataaaccttaataggtacggttttatgtctcttttccatcatatcaatgtttaagacacctgtaggggatttcattttttcagtccttctaacataatgttctgtctcatccaatttattaattcttgtaaaccttcctcatccttcaaatttgtaaaaaagtatggtttattatgtcggtaatttttcgtatcctgctccataactccaagattagctcctacataaggtgccaaatccgttttattaattacaaatacatcagatttgatcattccttgtccacctttacgcggaatcttttctccctgtgccacatcaataatataaattgaaaaatccactagctccggactaaatgtggcagctaaattatcacccccgctttcaataaaaataatatctaaattattatgtctaatcatgagttcttcaattgcttcaaaattcatagaagcgtcctctcgaattgctgtatgcgggcacccccctgtctctacaccaataattctatcttctgataaaacacctgttttcaataaaatctttgcatcttctttcgtataaatatcgtttgtaattgctgcaatttcataatctgtatttagatgttttgttaacttttcaactaacatggttttcccagcacctaccggaccaccgataccaattttaataggctttatcattttattcttcctccctatgacatgaagacccttacatttacatcttcatgttgcatttgatttatttcgaattcaggatcattcaatccaaaatcttctaatgaaagtatttgaattctatcaatagattcgcagattaattcatggcattcttgtaatagtttttgaccatctgtttgtccaagaggaatggctctcacaccgttttgaattatacttccaacacttgagtataagaaaactaagagcgtttcttctattgtcattttcaattccgcccctaatattccgtatacaatactcggatgaccttgtaatttattacccataatattttctttatatatatttaaatttacaaacgagaacaattcacacaataatttagaagtacttttactaatcattctatttgcttttctacattcaaaaggcaatgtttgtgctgttattaaatcatctaaaaatgtaatttgttctccctcattattcttaatggcttcgtaagtatatttgcaaattaagccgtccgtgtatgttaattggacttttacatatcgattaacccatttgaaaaacccgtctttatttgtaacttgtccctcttgaataaatgtttctaatccaaaagagtgactaaaacttcctgttgggaagttcgaatcactaatttggagtaggttaagtaggttaaatatgtttgtgcgaagcatgcttgaacggttttggtaatactctattttctttttgataaggaacaccttcctttttaagtaaatcttctactaagtagtcgttcgccaaaatcatgcacccttcatcgaattgtgctggtaaatgtctattccctaagttatgagcaataatccccatttcttttattgattttggagtaattacaattacctcttctggtaatacttcaatatacacaattcgattttcatcttcatataaaatatcaccgttctttaatgtttctccactatctaaagacaccccaatttcaaaaccagattctgaatataatttctgaactctcttcagtaaaagctcactagaaattaatatcttatcaagatgcttttttgtgtttgagaaatcattcatattgaatacgttgatattaattctttaataatcattctatctcccccgttatatcaaaataaaaaatat

SEQ ID NO: 787 - DNA, 1605 bp, Bacillus thuringiensis
tgtgccgcttatttcatatgactgagatagatcgtcctctaatatatctttaacttttagtaccatgtttgtattggtatttgtgccgttgctcagcaaggagacggctgttcgttcatttggcagtatgactacttcggttctgaaatttggattgcccccagtgtgttctataatcgtttgttcggcatttacggaccaacctgccgcataatacataccgttgacagccgaaacagacatatcaccctatgtgatttttcgataaccgtgtgaaatatttcgggtatgtcctgcacgatacccatctgtatgcccatccaacgagccatatcttttgtattagaaatgatgtagcctgcgggtttattcccagcataatccggagctttaaatggagttgtcataaaaaaggaagaacggtagccctgtgccaactgtccagtagcttgagcatcttctttataaacatacgtctggtgaagacctagcggctgaaatacctgttccttcataaagtcttcatagctttgtcgcgacacaatctcaataaccaaacccaatacgtcataattaacggttccatagttatactgttcaccgggagggaacgccaattcagcatcaacgagcatttccacagtcttttgcaacatatccggtgtattgccttgtggaatattttgaagatgcctaatatttgttagaccactggtatggtgaagaaagttatttagtgtaagactttgcatatcaacaggtttcccttgatactttaatgtaaaccaaggtaaatatttttggacagggtcagtcattgagagcagcccttgctcttccaatagcataatacccataccggtaaaagctttactgaccgaggctaactcatagagtgtattttcacttgcagacacccccttttcacggtctgcataccctgaagaaaagtagaacacttcatcatcagcaagtattgagattgacattcccggcacacctgatatacgacaggcatcatctagcaacgcttgtattgccgcaaattgcgaatctgacaacgcataactttgtggtgcgaatcctgagaataatataaatatcgttaatacaaaaacaataatctttttcaaaaactctccctttcggaaaattataagagaataatataaatgacctccttttacaactacgaaactaatttttaatgtatctttctattcacctatataatatcaaataattgcgaatagttacacttgaacgaacagatggatgtaatatgaaacaactttaaagagccttgctacgtagaatgtagtaaggctcttagctttttaataatcaaaattcaataactttattatcattatacaacagccccactaagcgtattaacacttaatgaggccactttattcacactattaattatggaacgtcggtttatagaacgaacgattatcaagtgcaaagacacgctctgtgtattcgcctggttttgtgcgtcctaatgcgcggtccatcatgttcatttttgcatctaagttatcgatgtaatgcaaaatttctgcttcttttactaatggtggttaagggctaccc

SEQ ID NO: 788 - DNA, 2536 bp, Bacillus thuringiensis
tttcatatgatccaatctttaaactcccaactgcatccatttttccttatctgtcctagcttttttatctaagttactttcactcactttaatagttgttcgcatctcttcaaatttataatcttttgttattatatattcaatgttaaacgcatccatattaaatccttccgttaattttttcatatctccattaattttttgtaacgtatctaccgcttcttttccctttaattcaagtgtaagtttatatgtgtctccatctttctttgctttcattttcttagccaaagcttccggtaaatctaactcattaagtaaatttttactgaccattacatcatttacattaaattgattattaggtatcgtaactaactctcctgtatcaggggttttcacttgagcagcgacctttccatctacttcatacgttacaatatctgtaccacttattttcatttcagccctagaattcttcagtttcggctccatttgtattttcattttaatttcttctgattggccgctccccttcattgacataagagatgtcaatgtaagatattcctcttgttttaatccgtcagctgcttttttaaaaatatctttcgctactaactctttttctttttttacagatactgttttaggtccacttgttttttcactgctacaaccagttgttaaacctactattagcgccaaactagatattacaaccattttcttcatactgattctccccatttcccacttaaaaatattttcatcccatgtatagtaaatcaactgaaataaatatatatacaataattatttaacctctaaacgaaaccagttattcaatccgtatactaatgtaactaaagctcctatcacaccaaaaacaacaatatttataccaattgacgaaccaaataaaacagccatcattgacaccatcagtaatagcatagcaatactatttatcttaatttctactacatcgccatcctttactttcttttctttacttccaaaaaagaattgttttactttaatattcgcttcatctaattcaaaaggaagcgtatattcttcgttattctcaagtttcattactacttcgttatctacctttacagcaactcttgctgctcctcccattacccctgttgctcttattactttaatactcatgctaaatctcctctccccctatgacttctccatgtcattcatttttgtaattcttctcttatgaaatccttgaatgtaaaacaaaaaatgtatttgtatgacaccgaaatcttttacgctatacacccatttctcgttaaacaaaatattccaacagaaattataacaagttcctacaaatttttttgtcaaattttgtcgcgtttacaaaaaaagagactcttacatatagtaaaagtcttttctatcattaccgtggctgtaacgataacattttcccttctattcccgctgtattcagtgtagtcgtatgataaatcatctatttgatcatgataccaatcccttctaaaaggataaaaatcctcttccccctaattcgcttctattatgaaagaaccttttgaaacattgaaaaacccccttcattttcctaccaatgaaggggtttttcttatcgttcgctacgccaactttcattatgcccaagatttgaatctgtcgctacttgcacatcatataacatttcactaaagaagcgtttatctacttcttttggtacaatgcgtctttcatcatcaatctcatcgtattcatatgaaccacgattcactgtacctgctttataaaattgaatgtcaaatacacatacatcttcttcatcttcataaccaatcggtgctccgctaaatgacaattgcactcctaatccggtacgagtatcttctttgtaaaatgtataatatacaccgccatcttgaacagacccacggatccatccaagcttcgtcatcttaccgaataacgaacgaccatttagtaaaataccgccaaatctctcaatagcactctcatcattctcttctactacaaacactggacgctcaatttgtaggaacggctgaacaattcccgcactttctaattgctctttccataattccttctccgccccagacaattctaacggatgaacgaaaccaataacagtgccagatgaaagttcataactcttcccgtcaattgtacagaacacgccaccttctgcataacggaatgccttcagcaacttcccttccttatactcaccccaaatgagtgaaatagaaaattgcttcataattggattatccataaatacagacttccatgcattatgtgaccaataacgctttaatgaaagtgccgtttccaatcgttgtttttgcatggaaagagtatttcggagttccttctttaaagaggctaattcttttttagcctcttcagccttttctacatcatcttttgcattcggctttggaagtgacttcatacgttttccttcttctgtctctaattcaatttttgactc

SEQ ID NO: 789 - DNA, 1828 bp, Bacillus thuringiensis
attttttatattatcagcaatggttatttaaatttttacaatatagcaagccatataatataactgtaattccatcctggactgctgaaaatgtacgttgtgcccaatcaacgttctaatttaaccgtaatgatggtcaacactaccttgtcccggttctggaatccaaaacgtatgtgttaacaagtttcgtaacgtaatgtttttatctgctgaaaacgatgggatatatttatttacattgtcttcaatgttcaacttccctttttcttttagttgcataatagatattgcaacaactgttttcgtaatagagccaatgcgatatttcgttcttggcgttgttagtacttgatctttcacattcgcataaccgtagccttttcgtaaaatgacatgacctttacttgctacaagaacactcccattaaatcctttatcttttaagtactgatctagttttccagctgcaatttcataacgctttttctcattcgcatcaatttcctgcttaacatctttttgcttactatttacattagaaaatgcctttgcatcatatttttttcctttatttgcatgtattagtgtaacaacacttccacaaaaaacagcaaaaataaagaaaatgattaaccatttctttaacatactaggagccctcttttatctagtttcacttaacgtacatccattctattttatatcttttaattatcaagtatattataatattatttaatattcactctgttaaaactagattcctttttctcactttcaattttgactactctctattgtatttctttcttgcaaaatttccaacatacaatcggatgcattacaatataatttcaaattcttttgtaacatttgttacatactaaaaagaatggagatgtatatgaaaaacaccgataaacgcaatcgtttagatgataagatgtttcattatcggataacaaaaaataacatgttattaattgaatattacggaaaacagattatggcattaaaaggaaatgatgctgaaaaatttttaaataaaataaatcatgcaaataacgataaagaaaaacagctaattatggctaaaattacaggtaatttcaaaagaggtaatgaacgaaattgaaaacgaatctcatttacattttgattatacaacaaataaaaaaagaaatgtcgctcattcaacatttctttagactttcttcataaaaaatttacattgctaacattccttcattttctatacttcctatataagctaaccgctgaaatagttagtaatacaactatacataaccacgcatacgtatatcccttcttatctacaatataaccaaataaagcaggcgcagcaataatggcaatttgatttaatgtaagtgcaaaactcactgtcatccctaccgattcttcacttgctgattccgcaacttcagttataaaaagactaaaccatccaattgaaaagaaccctaacaatgcacttacaccatacaatacattcgttattgtatgtatgctcattactaatattagaatgaagaaaatagaaatacaaacagttataaataagagggtacgccgatttcccttataaaacaaatcactagtagctgctaatataaccctaccaaccattccagaaaagaacataacggaaaatacttttccagctaaaattggcgtgattgattgttccaatactaaaaattttataaagtgtgcaactaacaccatttgcaatgaaatcatacaaatgccagttatataaattgcatacaattcttttttacacatcacttctttaactgca

SEQ ID NO: 790 - DNA, 2268 bp, Bacillus thuringiensis
ataatatcaaattctaaatttcgaaatggtggagcaactttattttatactactttcacttttgttttattaccaacaatgtcactgccttgctttaactgctccgaacgacgtacttcgagacggacagtggaataaaacttcaacgctctaccaccaggtgtcgtctcgggattcccaagtgaaacgcccactttctctctaagttgagtcaaaaatatagctattactccattgttagatactgctactgatatctacctgaaagcttgccccatcagccttgcttgcagcccaacatgtgatgctcccatatcaccatcaatttctgcctgtggtactagagctgctacagagtctactacaataatttcaacagcgctacttcttactaacgcttccgctatctctaacgcctcttctcccgtattcggttgtgacacaaacaactcatcaatatttacacctaacttttctgcatatacaggatcaagcgcatgttccgcatcaataaatgccgcagttccaccttgtttttgaacttctgcaattgcatgtaatgctagtgttgtctttcctgaagattcgggaccaaagatttcagtaatgcgccctttcggatatccaccaacacctaaagcattatctaatccaacagagccacttgacacaacagatattttttgttcaggtcgctcacccagtttcataacagcacctttgccaaaatctttttcaattttcttcagagcctcttctaatgctttctcttttcctttagttgtattttcagttgctgccatatgaattgctcctttcaagaacattcgtttgtataaattatagaacaatcgttctgttccgtcaataaattagaaacgaacatttacagttgttgcatgaaattggtatgatttacttaatttaagggggatgattatatgaaggttgtccaattaatatttagaggatttcgtttaatcggtagaattattaatccaatactaaaggcattatctaaaagtaaattttaaatatcatagcaataaaaaaaacgcccatttttgcactgcaccaacttgttagacgcaattaacacaatagtgcaaccaaaatgaaaaaaatagttatgaaaggaaaacagatgtgtaaactcaaagaatatgacctggcatatatttgttactattctgagagaatagagttttcagccattgctgctggattttcacaaccggtgtcaactaaggtaatacatcatattgttcaagaattaaataatcagggactatttgatttttacaagagtacctatgaggaaatgttagaagaatgaggagagtggctacatatgttaacgaaatcgcaatacgaacgtttcgcagcagataagcaatgtatcgaacgtgcattaaccatgtggaaagaatggatgtgcaaaaaaaagacttatacagatgaacttgctgctcaaggtacgatgtacgttgtcaatcatatgaaattacgagatcatcaagtttctgtaatcttcgatttttttgatgagtatttaactttattagatcacggagaagaacaagcagaagctttttataaaaccattatgaggatgtaataacagagggttctctcacgaataactaaaaaagagtatattcataaaaaataaaggtggttaatacaatgaaaactacgaattgtgggggaatatcttagtaatacttgccctactctatgcgctgttatatactcttattgagaacacacttctgtagttcccttttggtgtcttacaagaattgtagttttgtcatctttcttttggattgaaacacaggaaaagatacttcataatgaggtggctttttctttttccaataggttgttaaaaaccacatctctttaccatactaacaatacagttgctatactgctatctattcaactttcgaggtgatacagcacgaaaaaaatatcaaatcgtttattagtgttttctctcccagtgggcaacaatacaaagaaaagtttattgaaatttacgcaccaacagttgagcatgcacaacacggaatagaaactgaattaaaaagaagaatgggcgacctataccaatggcaaatagacgttcaacacatagaaggtgaacaactgtcgatattctcaacaactggacgagataaaaaagaagatgcacaatgactatccgtgtaaagacttgtttatacaacccacacgttgtgacagatcgggctattgccacac

SEQ ID NO: 791 - DNA, 1878 bp, Bacillus thuringiensis
tatgcggagcattttgaaaaagagtttgaaatttcgcttcaagcatttggaattgaagtagaatttatttatcaacatgatgaatatagaagtggaaggtataacaaaaatattttagaggctttgtataaacgaaaagaaatatatgatattttaatggattttaaaactggagagtgtagtgaagaagagcgaaacaatttttatccagctacattatattgtgagaggtgtggaaaagatacaacaactattacacattttgatgaagtattaaaaacagtccggtatgaatgtgaatgcggaaatgaaaaagaattatccgtattaaatacaaataaaatgaaactaaactggaaaatcgattggccgatgagatggatgatagaggatgttatttttgaaccgggtggaagagatcactcatcagaaacgggtagttataatgtatcaaaagaaattgcaaggaaaatattcaatcgtgaagcgcctcattacgttgcttacgatttcattggtattaaagggaatcatgaaaaaatgtctagttcttcagggaatagcattacaccaagcgatttattgaaagtgtatataccagaagtaattctctttatgtttgccaaatacaaaccaggcgctgcttttcatattgggttggatgaagatgtgattcgtaattatacagagtatgaacgattgaaagatagctatgaaaataaaacgctcaaaaatgaagatttatttgatgcaattaaactctctaaagttgataggcagtttaaagaatatccgagatttaatcaagtagcaggaacgttaccgctattaaattttgattcatctattttacaagatacattagaaaaaatagatagaagttatacattagatgctatgatagcgatatgtaaccgcgcagagtattggataaaaaactttcaatctgaaaaattaattgcggtaaatcgagagagaaatacagagttttacaacacattagatgaaagacagaaagaatggttagtaaaagtttgcaatatacttcgttctaacaaagattactctaacttaatggagcaattgtattcgatttgccatcatgacaataaaaaaataatgaaagaaaatcaaaaacaattatttattattatttataagctcattatgaatcagtctagtggcccacgtatatcgttattaatacatgtggtgggcatcgaaaaattcatctcattactagatttctaaaataaagctaaaagaaacgcaagtacttagacctctaagtacttgcgtttcaaattttgctagcgtgaatacatttttggacattcatcaccactcggttcataaaaacaatggcttttaaactgtcctacaaatggctgattataccattcaggtggacaagctccaactggacggaaataccaaagagcccatcgtgcaggccagcgccattcaccttgtaaaacttttcgtgcaatttctttttctgattcacgagcgcgttgataaaaatatccatattgtactgcttcaaatccgccggggctttgatatacagcgtcgcgtacggtacggaggttggttaaaatctaagcaatcacaaaatacacggtttactacaacgcattcaactaacttcttaccttggcgaccttcgccttcagcttcagcacgaattaaacgagctagtaaatcaacatcactttcgttgtatggaataaggggcatagtgataccacctttctgttatagtaaagagtgtatgttataaaacaatctgcgtgcttttttacataaaaataacatttaattttaagaggagcttgtataaaaagagctaattagtaatagtagataaatataaaa

SEQ ID NO: 792 - DNA, 1850 bp, Bacillus thuringiensis
actctattatataaaaaatcaacctattaatagatggaaatcaagtttttattaaaagatatgtagcaatcgtatacatacaaaaaaaatcatttcgtatatcgatttgcatagctaaacgccgcataagcatctggcttaatttttgcagttaatcccatcgctcgaattttttctgtcatatctaaaataaattcttttgttaaaccatcattcccaatgtctaaatgaatttccattatgaatccagccccatcttgagcataaggatgcaataactcccatattgtttgtatatgagtaggcgtaaatagacatgcgatttcttgactaaactgcgtttctaaatatattttctcacgtaaggttgccggcttatcttttactgatctatggtgtaaacagccccaggcaccttttccaacacgatgaatatggattgctgtaataaacctcgtatccttttgatgcgcttgtgagtctgtcccaatggataatcgatataaatttcgcggatccttttcaatgaaactacaaatacggttaaagaccatatcaaaatttaaatgtctctctgaaacattgtaaaatttatgtgcaccgtccacagagtcacgtcctttcaattagacagacttttcgtattctcattgtatgggacaaaaactaaaattataacttcctatcctttattcgtttcaatatttcgaattacaaagtgacaaacttggcacgtataaattacattttgattagattgagccgttaatacatgaataatctcagcagaactttgacaattaggacaaatcacaactggtaaacgttccatacgataacctcctagttatatttctcccgctatttgcagaacccagcgattgtgagaagtttagcttcacatattcacccggttgacgggactcattttccacatggataagcaaacttgcacggattaaaatttcattttaataccattgtaggaaaaataaaaaacttctatacattccactagaaagtaatagaactaaaaaaggtactgccacatggcagtaccttttttatatgtatcaagaaatgatatcgtaaatctcaattgcaaccatgtcgatattatcgaattgatacacttgaggtttttcaccttgttgatacacttctaactcatacatttcacttttatcgaaaaatttcacgctacatttgcgctcaccgttcacttcaaaatagcgttgtgctacttcaccgctttcagcttgttcttgtagactaacaagtcgagttaaaattccttggagtagagacatgaaatctctcctttctctgatcttcctaccaataggttttacagctatactcattctatccgtcataacagaaaaaatgttccacactctaggataaaggttattggccagaaactcaactaaaaatttgtcgaaatgcgaaggaaaaaacagaaagaacatatttccccttctttattgcggtttttatactggaagaatataataaaaaacagaaaaaaggaggaataacaatgaaaaaaattgaggtttatacacaacccgattgtccgccctgtgttattgtgaaagaatttttgaagcataataacgttgcatatgaagaatttgacgtaaaaaaagacgctgctgctcgcaatcgtcttttatacgactatgattcttattcaactccaacagtcgtaattgatggcgaagtagttgcagggtttcaaattgaaaagttacaacaactactcaattagaataggaataggtaaatacctattcctattcttatcccgtatttgtgggtagtaaaactcctaccccaaatttagc

SEQ ID NO: 793 - DNA, 1756 bp, Bacillus thuringiensis
gaatagttcatactatcaccacggaatgctccgataatgttatcggtaacggcccccgctacctatgctagatgtaattgagccatcttttaggaagatttcatatacagtacctgtgtacattgtcagtcctcttgctaaaaacggattgaatatcgtattttcatttattccgagagcgattaaatattgctgtaattgttgcaattcgtttacgccatcggcaacgagttggttattgaaagcttctttaaagtcaacaattgtaagctttagacaagataatacagtattacatattgtatcagccatttcttcagaaattccgcgctctaatacatcttttcgtacaccatcaatcccaatcttttcgattttgtctaatgataaaatgacgtcatttgttaattcagtagggatgttaatggcctgaagaataccatttaacaattttcggttattatattggatcgatatctctaagtttaatgttcggaacagctcaaacgccatgctcatgagttccgcttcagccatgactgattctacaccgacaatatcaacgtcgcattgtataaattcacgaaatcttccttgtttaattggcccatctcgaaatactttcccaatttcataacgtttaaaagggaggcggaggttcgggttcattgccacaacttttgcgaatggaatagttaaatcgtatcgtaaggcaatatcacgttttccttgatcttgaagtgtatatatttcttttaatatttcatcaccaccgccgtacttgtaagacataagctcatacatatttaacgtcggcgtttctaaaggtttgcatccgtatcgtccaaacgtatcttcacaagctcttttaattttatttcgcagcacttgctcctctggtaaatagtctttcgttccttttacatttctcatttccatcataatcactccttttttaaattaaaaaaagctatgcaggtataaaaatacccacatagctttatgaacgcttcgtgggtcaacaggaaaagccctgtacccacgaagaaaaatttttcttcggatacacggcgttacgtatgatgatgaagttggaaagaagtattaacatttcgcatgacaaatctctccttaacataagtttttccaaattatatcagatgatttttgaattatcaatatttttagttttgaaatatacgtgaagttatgtaggagaaatggaaaagggtgtataataaaacttaataatatgaaataaccttttaaggagaacgttatgaaaaaagataaaacaaatgcgatgcgaatattagataaagaaaaaattgaatattcgatgatgtcatatgatccagacgatggaaaaattgatggcgtatcagtagctgagaaaattggacgagaagtgagagaagtatataaaacgttaattgctcaagggaatagtaaaaattatcatgtgtttatcattccggtagatgaggaactaaatttaaaagctgccgcaaaagcagtaagtgaaaagaaaattgaaatgattcctgttaaagatattacgaaagtgtcaggatacattcgcggcggttgttcaccagttggaatgaaaaagctattttctacatgtattgatgaaagtgcccaatcacttgaaacgatgatagtgagtggcgggaaaattggtatacaaattgagcttaaagtagaggacttggcgaaagtgacgagagcgcagtttggtgaagtaacgaaataa

SEQ ID NO: 794 - DNA, 2203 bp, Bacillus thuringiensis
tagtgagtatttaagaaatgtcgatacagatgtagcgtttccgcaatcgttacaagaaatagcaagtgatgagttattaaaaggacggagatcgaatagtgtttctttcatggtaagaacagttcaagaagatcgcttaattggttttgtggcgattcatggtatagagtggaataacaaaacaggtttattagccattggtataggagatgcgaatgatagagcaagaggatatgggaaagaagcaatacatcttattctaaagtatgctttctatgaattgaatttacaccgcatcggtctcgatgttatttcgtataataaacctgccattgcattgtataaaaagatgggttttcaaatggaaggctgtatgagagaagcggttcaaagagatggaaagtgttttgaccgtatgattatggggatattgcgggatgaatggatagagctgcaaggttagaaagtacattcgaaattatatatgtagtatgcaggagatataatggtaattggcgaaaatttacagtgtgttgattgaatttataaggagtcatgtaaaatgaatttagaaaaggcaaaaccagtaaatgaagaggtcgccgaattaaaagaacttattaaagagttacacggaagtgtgcaccaacttcaaagtgaagtgcagcaactaaggcacgaaagaccagttgttgaagtgagaaaaggtgttcaattatcaccaacaattgtcggacaaattggtggtatgattttaggtggtttagcaattatcggtatattttggtgatgaaaaaaggtttgcagcacggatgctgcaaaccttttgtatttgacgatataatttcatgcaatacaacttttacattaaataacgtaaatatatataagcatgtgataacaagagtgcaacaatagttaatggtaaaccaatttttaagaagtccatataagagaagccatgtccttcacgttttgcaataccagcaacgactacgtttgcagatgcaccgattagtgttccatttcctcctaagcaagctccaagagataacgcccaccatagtacttcgatttgcggagaatcgacagatagtccgagtcctgtagctaagtcttgaataagaggaatcatcgttgcgacaaatgggatgttgtcgattgtcgcagatgcgatgccagatacccataaaataagtatagctgcgaatccgatgtcaccgtttgttacgtcgattacttctcttgcaagtgaagagataagtccgatatcaattaacccgccaacgagaacaaataatccggcgaagaagaaaatggttacccattcaacatgggcaaatacatcttcaatatcatgttctttcacgccgattaacataagaagtgtagcgcctgtcatcgcgataacagcagcgtctacatgaataatcgaatgaagtacgaagcctaaaatagttagtcctaaaatcgaaatagattttaaaaggaggctttgatctttaatgtaatctttttcgtttaatgccattagtttttcgatttgttcaggtgttgtttttagtttgttacgatacatgaagtaaataatgccaagtgtcacgatagaaataataattacgattggagctaagttaagtaaaaaggcgttaaagtctaaatgcttgtttgctgatccaatcataatattaggtggatcaccgattaatgttgctgttccgcctatatttgaaaacagcacttctgaaatcaaataaggcacaggatttacttttaaaatacgtgtaatggataatgtaacaggaacgattaataaaacagtcgttacattgtccaaaaatgctgatccgacagcagttaatagggatagtaataataaaatgcgaatcggttttccaccagctgcttttgccgctttaatggccacaaattcaaagacgcctgattgactcgtaatatgtacgagaatcatcatcccaattaaaagggtgatcgtttcccattgaatatgtgatgtgaaagcagtatgtaaatctacaactccaaaaataatcataatagcagcaccgaatagtgcgattacagcacgattcaatttctcagaaatgataaatccgtacgtgattaagaatacggcaattgcaaaataatattgacaatatgctgcttcatgtgctgactgctccaatcatgtcaccttctt

SEQ ID NO: 795 - DNA, 2528 bp, Bacillus thuringiensis
  unsure (1)...(2528): unsure at all n locations
gtatcgtattatatattccatggcttacttaatgttaaaacttcagccatctctttactttttaaacgtcccttttttcggttttccgcgcgttctaaaccggttgtgtgtaaccaatgttcttcttcagtttcaggaagtacttgtggtacggatgaaggttttccatcttttattgccacaaatgtaatgaagcaagtagcagcaattctacgctcgcctgctaataagttttctgcgattacttttacgaaaacttccattgaagatttccctgtataacatacaaatgcttcataacaaacagaatcagcttggtgaattggagttaaaaaatcaactgaatcaatagatgctgttacgcaatgtttacgactatgtcttgcagccgcaattgaagcaatactatcaatttctgctaataatttccctccaaaaagtgtttggtgattatttaaatcgttaggaaaaacacgtgttgtcttaattgctttagattctcgcatgaatttcttttccatatattcagcccctatagtctgttttcaatcagaataatatgtgtaagcagattactcatattagatatttaatgaagtaaagtgtattccaaaagaggattatttaaacttctgtatttgtattcatgtaactgaaagaaaatttattttatctaaaatgtagtgtaaaagaggattcgcttacattgcaagtaaaaagtaatgactatgtatttgtcatagaaattccctatcagccgtgtccccattcatgatagaatcgttttgttatgaatggaaatagaggtgcaatggacatatgaatcatatacaaacaaatttttcatctttcttcaataaaattacaatcggtgcgatgctcgcattttttgtttatagttgttgggcagcatttgagacaagtaagcaattttttggaggaagtacaacaagtgtaacaatcatattagcaattttcgtcatacttattttgttagtggcatcaattctacaatatcgttttacagataaacaatttcttatttttcttataagtatatctatagttgtgagggttagtatgctgttatttgtagatgctccaataattggtgatatgaaagtgatgtatgagtctgcaaagcagattgcaattggtaataatatagggactgtaactcatttgccttttattatatatgagtcggtaattattcgtatatttggtgattcattattcgctttacaactatttaatgtgctattttgcacaggaacagcattatttatttatcgtattgcgggaatggtttttggagaagaatgcggtcgtattgcttctatcttttatgctctgtatattccaaatatattcatgagttccgtattaactcctgaatcacttgcaatatttttattttattttgcttgttacatacttttatataaaggattagatcatccttatatgtgggtgttttcagcgattttatttgcatttagtaatatggttttcccaatgggattatttcttcctatttttattacggtatatgtattattaatcgaagtatttcaatcagcaacgaaacaaaaggtgtggctaaaaatgatagggatacttattctattttatagtgcccattttagtgtgttttatggaattaaggcaatgggattgtcacaatatacgatttcaaatgagacgtatgttcaatctgttttaattggaaagacgcaacatgaagaaaaaatatcgaaaaatcaaagtgtaacagagcatattgatcaaaagttaaaagagattgagggagaaagatttaaacttttagagccgatgataaatcagttttcagatgaaggggtaaattctattcttttcaaatgtgaaaaactgatatatatagccgtaacattgtttatgactatagctctattacacttccttattaagaaacaacaaaatgagggatatatgttgntcttatttttaattagtggctacgtattgttaaagctctttcaagtagatatggcatattacaatgtaattatgccgtcattgttcattttgcagagctttggtgtttatatgagttatgtgtattgtcaaaaaatatttttcagaaaataaaaagaatccattctggattctttttttgatggaagatgaaatttagtagtcagtgcagatgaaaagtatgcctgacttgaatttgatcccgctattttccaggcagtaagacccccacctcaaaatcagcgaaagcaaagaagttaggtggggggcgggctgcccgtaaaagcccgattggtgagggctgataatcaacgggggatgaacaaaacctccgttgattaaagtttcactttatcttatcgatttagttctagttgtaaattatcggctgttagagccatttgtgaggaatcatcttgaattcctttcattacttgtgaaatagcttgtagctcgtgttcaatattcttaatctgttcttttgagttagacatatcttttacaatttc

SEQ ID NO: 796 - DNA, 2868 bp, Bacillus thuringiensis
gtgattcggattactgcataggatcgtttccctcacctctactctcttggtacataattcctaataaaactgctgttttctctcctaaattatatttttctaattcttttttcaaggtagattcatattgcaatacacgtttttcggtggctagcgctttatttttttgaatattggttttatgattaaaatatagcattccaagtattattcctaagcctaaaatactaataaggaacacttttataatttgttttttacttgtatccttcatatattcctcctcgtataaaaaatttaatttttcaaaggtaattggttatttacaaactatgtaatgaacatctatctcccgccctttttagactcaaacatcaatactttaaggttttaagtttaatataaaaatttaaagataaggtaaagataagataaagataagataaagggcattttttatacgtactttaaaagatattggtacaaaggggtatgtggggaaatttgttgatataaatggatttagtaataatggaaaggttaacgtacaaattattaataatggaggtatcattccagatgatttaccctatcttttcaatatgctttatataaaaactacaacataacatataataaaaaaacggcgaaccctcgacgtaggagaatccaccatcacaaataaatgattatttcacacctagtttttcttttactttcttaggaagctcatcttcctgcacttcctcccaagctgttacaccttttttatctaaatgatatacacgtaggaatgcttctttacgaagattcttttgtgcgataaattctaactctttttctttaccttccttatcaaaacccgataatgtatattcatactcctttcccatcactttaccatccatagattttgaaactcctccttttccatccatattaatttgaacgtaatattcacctttaccaatacggttgatatcacaccaaactaaaacacttgcaaatacaacttccttattttttacgtacctgtatatttttatctttttactcacttttatttttctttcttaactaacttatttaagataatctcatataaattacttaacgaattaatgctatttgcgacataaaaaaagagaggcgtctgccccctcttagaagtgaaattcaacttgctgttcttttgtaattgtctcatcccctcaggattaactgtgtcgctaaagagtaacttagctgatataatctcctcaagcttactcttaatgaatagacctacgctaccttctttcttcaccttcccatagaatttgttagcattctcatctttctcctaactaagatcttttacttttactaatttcatatgagaaatcccctccaaatgtacacactaagaatgagatttgatagaagatacttgtctacattttaacttttcctattaaaactggaatatttggtaaaatgtattaaacacgcaaataacttgatatcgtatctcatgattttaataatgattctgtttttcattgtagtaaggttgtttatctcatattgaattacctttcatttttcttacaggttcgcaatatttttgaaaagacagtttataaagccgagaattattattttttaagagatagcattgaggagtttttcatatgcactgtactatacggtactagattcccgtacagatttcatttacaattcattgtattttctttaccatttaccaagttaaaatggaacaaatttattacttagagtgtctattatgtgtatccctaaaaatatgaaaggacttattattccccaaagtaaagtgatgtaaaaaagtgtgtattgagatacttcatttaaatgttacgagtttaatactttcacgggtaaactataaaaaaagaaacaccctaaacagcaactgttcattcatataaacgctttggttctgcttagcctgttaaaattcaacttcagaagtatcggtatccaacacccgctttaattaacatcggtatttaaaataccaaaacaaaatccatatatcgttgaaagaggttgaaaattcatgtacgttttaaacaagttctttacctacaaaaagattgtacccgtcgtattactttcatgtgtaacactaatagggtgttctaatagtaatactccatctgaaccacctaagcaaacaaagcaaacaaagcaaacaaaacaaataaagcaaattaaacaagaaaatacaggtcatgattcttttgctaagcttgaaaaagaatataatgctaagcttggtatttatgctctggatacaggtacaaatcaaactattgcttatcattcaaatgatcgttttgcatttgcctctacatctaaatcattagcagcgggagctcttttacgtcagaactcaatagaagctcttgatgaagggattacgtatacgcgtgaagacctttctaattataatccaattacaaaaaagcatgtgtatacaggaatgacgttaaaagaacttgcagatgcttctgttcgatatagtgacagtacggcacataatttaattcttaaaaagttaggtggtccatccgcatttgaaaaaatcttgagagaaacgggagatacggttactaaatctgaacgatttgaacctgaattaaatgaagtacatcctggagaaacgcgcgataccagtacaccagaagcgatcgctaagacacttcaatcatttacattaggatctgcacttgcaacagagaaacgtgaattattagtagattggatgaagagaaatacgactggagataagttgaattcggccgggcgtaccaaaaggatgtggaagtagctgataaaaca

SEQ ID NO: 797 - DNA, 2143 bp, Bacillus thuringiensis
tagtatgaacaggaatattattggcggaaatcttgttagaatctgcaaaggccggtgttaatccgaatgtaagtccacatcctagtgttaaagttgttaccgttgttacgaatgtttgttttttgttaaacatggtatatcctccttatattttattcttacactatccactttcaatttacatacatataaaaccttttaatattaagatgcttaacaattctgtcacaattatcctataaatgttaatattatctattaatggaattggatttgtgttataattcactaggtgaactattattgttcatttcatctcttgatgaatgtatgcccttccttaagtataaagatgttcgattgtattggtgaagagaggatatatccctcttcttttttattaatatgagatttttagggaatgaacagaaaaagaaccctatggggttctttttctaggcatattaacagtaaggagagtattgaaatactattttcaaatatttacaaggagaaaaatttgaaaaagcttatcatgtcattgcttttacatacatgtaatataaagttaattgataatatttaaactcattattactaatattcaattaagatagttagcactacattgatagtgttaattagcttgattggtgtggaatgtgatatgaagcataagtttgccgcaaacttgtgctttcaggatttgaagaatattcttaatatgaattttaaagaaaatataaaattttactagacgtgagaaaaaagaattgaaaatatcctttaaaataagatatattttgttcaaaaaattagaggacaccaattaattaaagcggtaaaaaacgttttaattaatcggtgtcctttttgttttaaaaagagaatatattttctcaacaggacaaatggtaattagctataagtattaattataaggataactggaaaatagaaattaataataaatgagaatgcaaaatgataacattaatatctgaaagaaatctatctgaaatccacgaagacgatgtagatgtattaaaagtaatggcacatcctgttcgattacaaattgtaaatgaattaatgcaccataaagtatgcaatgttacacagttaacggaaatattaagactcccccaatccactgtttcacaacatttatcaaaattgaggggaaccgtacttcaatcagaaagaagaggattagagatgcattattatatagataatgctaaggcacgtcagattgttgaaattttagatttgtaggttaataatacataaaaggtttcctgttacaaggcaagaaaccttttttatatgtataactaattgtgtgataatatcatactgtagaaactacctaacaataattaaatttaacagcttattttatcttgccacacacaatttaacacgatatataggtataaacgtacaaagaagggttttaaatagaaattagatataacaatggataatggtaagtgtattaaagaaattacagaattaatgaaataaaaaataataaatagttgttgtaaaggcttattctgataataaaaggaattagatacattaaattcaactatgagttttttactaaaaatatgtaggtgaagagtataagtaacataatccttttgttgctgatggacgaaaagccttcatggatttctttaaggaggattttgttaaaaaccctaattcctctgcagagattaaacgtgtagtagctgaaggggatacagttgctcttcatgtacattgtcgtactaattctcaagataagggagttgctatagtcggtatatttcgtaacaaggatggaaagattgtcgagcactgggatgtaattcaagagattccaagtgaagcagctaataataatactatgttttaagtagaaaatatagtggataattgttaatttgttagggatgtataaggtctagaaattaagattatttataataaatgaaaggagatgccctacgtatggcactagggcatctctctctgttttaataaggttaaatttattagtattcttaaagtgcctattgcatgtacttttttattaccgtatactaatttagtattagactactgtcttagtttgaatgaagagggt

SEQ ID NO: 798 - DNA, 1695 bp, Bacillus thuringiensis
ttcaaaccagatacaacgattttcagcacatcaaattataattatgaaacattatgtgagagattacgtgaatctgcattcttattaaaaggaatgaaaatttcaataaaagatgaacgaaatgatttagaggatgtatttcattatgaaacgggaattgaagctttcgtttcatatttaaacgaagaaaaagattccattcatccagttgtatatttcactggtgaacaaaatggaattgaagcagaactagcatttcaatttaacgatggctactcagaaaacattttatcgtttgtaaataacgtacgtacaaaagatggtggaacacacgaagctggatttaaaacagcgatgacgcgtgtgtttaacgagtatgctcgtaaagtagcactattaaaagaaaaagataaaaacttagaaggcacagatattcgtgaaggtgtagcggctatcgtttcggtacgtgtaccagaagaagtgcttcagtttgaagggcaaacgaaagggaaactaggtacaagtgaagcgcgttcttcaattgatgccattgtatctgagcatttagcatactttttagaagaaaatcctgatgtagctacacttcttgtgagaaaagcaattaaagcagcacaagcccgtgaagcagcccgtaaagcaagagaagaagcgcgtagtggtaagaaaaagaaaaaatcagaaggtacgttaagcgggaaattaacacctgcacaatcacgtaacccgcaaaaaaatgaactgtacctagtagagggtgactctgccggtggttctgcgaaacaaggacgagaccgacgtttccaggccgtattaccgttacgtggtaaagtaattaatacagaaaaagcaaagcttgctgatatctttaaaaatgaagagattaatacaatcatttatgcgattggcggcggtgtaggaaatgaatttgatgttgaagatattaactacgataaagttgtaattatgaccgatgccgatacggatggggctcatattcaagtattgttattaacgttcttctacagatatatgaagccacttatcgaagctggtaaagtgtttatcgcacttcctcctttatacaaagtaagtaaaggaaaaggtaagagtgaggtaattgaatacgcttggtcagatgaggaattagacggtgtaacgaaaaaagttggaaaaggctatatgttacaacgttataaaggacttggtgaaatgaatgcggatcaattatgggaaacaacaatgaatcctgaaacgcgtacattaattcgcgtgaaaattgatgatgcagcaagagcagagcgtcgcgttacaacattaatgggcgataaagtagaaccgcgccgtaaatggattgaacgtaatgtacagtttggtatgcaagaagaaggaaatattttagaaaatgaaatgattatggagacggaggtggaataacatgcaagcagagaagtttcatgacctcccgcttgaagacgtgttaggtgatcgctttgcacgttatagtaaatatattattcaagatcgtgcacttccagatgcacgtgatggcttaaagccagtacaaagacgtattttatattctatgtatgtagaagggaatggacatgataaagcgtttcgtaaatcagcttaaacagtaggtaatgttatcgggaattatcatccacatggaga

SEQ ID NO: 799 - DNA, 2078 bp, Bacillus thuringiensis
  unsure (1)...(2078): unsure at all n locations
gccacggtggtcagtattgtaggacatccctatcgaattaaagatcattttagcaaagaaaatgattgattttgtacatgcttaaacaagcgaaaatgtacatgtttatcttgacatttacacaaaagcacgttctattgtagaacgcgcttttcctgaatgagtctatactaatatttcaaaccattttacatgtacattatcattataacacataactgacaaaaaataacgaaaaatcaaattatttaaaggggatttatttgacttttaataatttctcttgaaatagggtagtatgtaaaaagaagcttttctatttaagagagcttcttttcttccaaattatgttcatattctttaactcttctataaaatgtattactcttcatgcctactctttgcattgcttctactgcagtaattttatgatttttccattcttgataagcttctttaaaattatcatcaatttcaacttttttgcggccaaatttaactcctttttgaagtgcaattgtaattccttctttttgtcgttcgcggattctttttctttcatcttcagccatatagcttaataactgtaaaattaaatctgaaataagagtttcaattccatttaaatctttatatttcatagtgttaagaagtggcatatctaacacaacgatatcaatctttttttctttaattaattcttgccattcatctaaaatcatttgtttatttcttcccaagcgatctaaggattgaatatataaaacatcgccgtttctcaacatacgtttcataagttgatattcaggacgtttaaaatcttttccacttgctctttctataaagatgtattcttcaggaatacttatctctgctgcggttgcgagttgtctctcgatagattgatctttactacttactctaatataaaagaatttcctcattatgtattccttcccccatttcaaatcacacacaatctatatttataaaaatttgttggttataagatataattattatattttaatgtcaaattctatacaactctcatgacatatttcaaaaataattatgttataattgtgaaacattaaaaactactcaaactcaccgtgtcaaaaagtatactttttgacacggtgtaatctattataattataattcataaggagatgtagaaaacgattaaatatgaatattcaaaaaagattaactattttaactacagatgaaataaatcaactttatagtagacctctttttacaactaaagagcgcgtacaatatttttctctttctcaaatggaaactgaattgttatatactttacgttcaataaaatctaagatttattttattcttcaacttggatactttaagtcaaagcacttattttttcaatttaacctatgtgaagtggaagaagatattcaatatattcttaaagttcatttcaataatgctgacttctcagattttggatctattgataaaaaaactaggctaaatcaacaacaacttattcttaagcgctttaattattatctttgtgattcacaatctcgactagatttaaaagaacaagctcgtagagctgcagctataagtgggaaaccgatttttatttttcgcgaacttataaattatttaactactaaacgaattattattcctggttatagctttatacaagaggttataggaaatgctattacatatgaacaaaaccgccttataagggttatacaaaaacagctatccgaggcggataaacagcatttaaaagaattattatataatccttctggtttatataagattactcgaatcaaacatgaacctaaagactttagtatgaatgaaattaaacgggaaattgaatatgggaaagaaatgtatcctctttttcaactggccaattcaattttgccacaactaanaatttctcatgaaagtattaaatattacgctttcttagtagaatattattccgtatataaattaaaaaggtttaatggatcccctggtaatctttatttatggggctttattttcatcgataccaaagaatgaat

SEQ ID NO: 800 - DNA, 1738 bp, Bacillus thuringiensis
agctaagaaggggtaccgaaaatttctgtcatatatggaatcttcttttagaccacttctgggtaagtcgaaagatgtcgcagcatgatctaagtaaatgcgttccattaaatcacattctttccaaatcgtttcacaaggaattaaatgtaaaacatatagcccccgtgattttcttcctcataacgtactaaatcttctaacgttgtactatctaacacttcttgcaccgcatcacgaacacgcatccataattggcgttgtgctggttcttcttcttctatcatttctacaacactaatcggaccctctaatacacggattacatctccagctgtaatgttagccggctgatctgatagtacatatcccccatatgctccccgcgtactctttactagacgcgcgttacgaagtggtgaaattaattgctctaagtaatgttccgataagtcatgtgcctgcgcaattgattttaatgaaatcggaccttcaccaaacttttttgcaagatcaatcataattgttaagccatagcggcctttcgttgaaattttcatctattttgcacctcttttcaaattttcacttctattggttatatcttatttataaaaagaacacaatttaaaatcctatgaaattatagcataatatagtattataagaaatttcaacttgtgtatcaaaatgataacataaaatcgcattgaaaaactcgggaattattacaattgaaagaaaaatgaaaatattatcatttatttttcccataaaacagcatcctatttcaaatttcgtagaaaaaaatgatacgatagaacgagattatatattaagggagacggtccaaatgaaacaaccactcgcacatcgaatgcgccctacaaatattcaagaaattattgggcaacaacatttagttggtgaaggaaagattttatggcgaatggtccaagccaatcattttcaatctatgattttatacggtcctccaggtacaggaaaaacatccattgccagtgcaattgctggaagtaccggtaccccgtttcgtctattgaatgctgttactcacaataaaaaagatatggaagttgtcgtacaagaagcgaagatgcatcgacacctcgttttaattttagatgaagttcaccgtctagataaagcaaagcaagactttctattacctcacttagaaagcggacttcttactttaattggtgcaacgacaagtaatccattccatgcaataaactccgctattcgaagcaggtgtcaaattttcgaattacacgcactaacagaagatgatattttaattgggttaaaaagagctttagaagataaagaaaaaggccttggagaatatgctgtaacggtaacagatgaagcactacatcactttgcaaacgcctctggtggtgatatgcgttccgcttataacgcacttgagcttgctgtattatctagctttactacagacgatcaagcggctgaaatcacactcgagattgcagaagaatgcttacaaaagaagagcttcgttcacgacaaaggcggcgatgctcattatgacgtattatcagcatttcaaaaatcagtgcgcggaagtgatgtaaatgcagcgctccattatttagcacgccttattgaagcaggtgatttacaaagtattggcagacgcccttttattatggcttatgaagatattggacttgctagcccacaagctggg

SEQ ID NO: 801 - DNA, 1819 bp, Bacillus thuringiensis
caggtgaagaagaggaatcttatggtatgaaccaaaacagtattttcttcagaatgttcggtgtcttctggggaacagttgcaatggtcgaattaatggatatcgcattctctgtagatagtgtacttgctgcatttggtgtatctaatgaagtttggattttattattaggcggaatgctaggtattttaatgatgcgtggtattgccggtgtattcttgaaattattagagcgtattccagagcttgaaacgacagcatacattttaatcttaattattgcatcgaaaatgttactgtctttaatcgagattgagattagtcatacactattctttattattttagttgtagcatttggagcaacatttataattcactacatgaagaattctggacaagctaaagaagaagttgcagctactaaagaagataataaataattgaaatgggtttgctcgttttgcgagcgcccattttttataacaaaaaatagtttataatagaagaaggacttagaaaaaacgtaactgtttttggaggtgaactgttgtgttttcacgttttacacttcaaccatatgcattaaaagatgaatcagatttaaagcaatttgaaacgcttttagaaaaacgtccacaatatgaactgacagagaatgagatgaaatttagttatatagcatgtcgaatccttggcgttcctaatgatgtagatgaatattttaatgaactgtttgattatagtgaagcgaaaggaatcgaagttttacacgaacaaaatttaaacaaagtgattgattcggaaaagcttcgtcatattcaagaagtgttcggattacatcaagaagcaccaaatggtctgacagtaaataggttagttgcacacttatctgggaaacaacttttaccgaaagtagacaatcctgatttacagcattacatacatacgacgtttatttcactattgaaattatatgagaaacaacataatcagtcgttaaagacagaaggcttccgtcgtttcttaatcgacataattaaactaagcgaaaattatgtagcgaagtggtttactacgattaattataagaaacagatgccgcgtatcgtttggtatggtgatgcacaggaaagccgtatatatttcttatactttcttattatgctcggttgtgatgtgctttattatcacccagaaggaaaagatggatttgagaatgttgatgaagagggaaggacctttattgtgtctcatccaggccgtatttctcttgaaccatttccagatcgccgccgcgagcgtgtggcaacagtagcgtatcaagcttcaaaagaaattgagcaagtacttcaccacgataattcactgctgtacaagccgtggcaattccgttcctatacgcctgtagctcgtacactaaaaacaacatatgatgagctctttttaattacgaaagaaaaggcgtttgtacgcccgacattctttgttgaaaataaacatatttatatcccttctttatttgcgaaaatatcaggcgtttcaaagaatgataaagagtattttcaacgattaaaggctgttacatcatttgataacagtatactagttaatacattcccatttacgaaagagcaaaaagcaaacttccaatatcattatcgagatgcattagaccgtggggggaaattacatcctgatctaattatgaatagccattggtggccgcataagcgtttaccggaaggtttacaacatgggattgcagaagcgattatccatacgtgtgaaagtgaaatgtgcaaaccaattgcgaaag

SEQ ID NO: 802 - DNA, 1790 bp, Bacillus thuringiensis
gtttacaactattctaattacgatggcaattactttgaatacgtttttttataaataatatgcaggtttctactacacaaacgtgtttttattttttacatctgtattagtaagcattgacctactgttatattattccctttttcacttattttttctcttagaataatatgtaaacgatttaattctctttagtttttctctcttcgtaacaaaaatatacaaactactcttccttttttaggtaaatacctatacatttctaccctctcttccatacattatagtaaccgcagtattagcgggaaatgataaaggaggtcatctcatgtacggatactcatattgctatccaacttgttcatatccttcctacggttatggcggttcttgtggcgggtctggacgcggcttcgccttaatcgttgtgttgtttattcttttaattatcgttggtgctgcttgcattcgctaatgtaaaacgaaacaactatggaaagaaaaagacggctttgctgtctttttctttttatcacatacataactactctataatagaacaatttccaaaatgccttccctttcttgccgatgactttttccatctcctttggtagactaaagaggaaaggagagattacatatgcttacaatgaaagatgttattcgcgaaggagatcctattttgcgcaacgttgcagaagaggtgtcattaccggcaagcgaagaagatacaactaccttaaaagaaatgattgaattcgtaataaatagccaagatcctgaaatggctgaaaaatatagtttacgccctggaatcggattagcggctccgcaaatcggtgtttcaaaaaaaatgattgcagttcatgtaaccgatgcggatggtacattatatagccatgcattattcaatccaaaaatcattagccattctgttgaacgtacatatttacagggtggtgaaggctgtctgtctgtagaccgcgaagtacctggttatgttcctcgttatacaagaattacagtaaaagcaacttctattaacggagaagaagtaaaattacgtttaaaaggtttaccagcaatcgtattccaacacgagattgatcatttaaatggcgttatgttctatgaccatatcaataaagaaaatccttttgccgctcctgatgattccaaacctctagagcgataataataaaaagggggaagttaatcttccgcctttttattatgaaatgggttccatattcacttatagcaatccagcccactttagtccatgatatataccgtcttcattaacatcctttgtcacatgatttgcaagttttttcaagtcttcatggccatttcccatcacaatacctgtgccaacggcttcgatcatttctaaatcatttaagccatctccaaatgcatacacttgatcacgattaaaacctaacttttcaatgtatttctcaattccttttgccttagaaccaccattcggaatgatatccattgaatatgcatgccaacgaataaaatgaaaatctggataatgattaataaacttttcctcttcatttacttcacaaaaaagtagtgtttgataaatattacgttcctcataaaaattaggctcatatgctggatgctcaaagtttaagcttccaaagccttctttcacataatcatgatattccactgatgctctcatatcttgatggtcaagatatacaagtggatatccttcttgttttgcaaactgagtaaacctatgtaaagcatctggatgtaac

SEQ ID NO: 803 - DNA, 1410 bp, Bacillus thuringiensis
cgctcctaaatacgtaatcattttcaattcgtttttcgtaatagacagaactaagtcttctaatctttctgttgagaatgtagacacttcttgctggacaatttccgcaaggtgtagattgtttagtatactctctacgttttctgttccccactttaagcctttcgttactgcacttggaaccactttttcaataattgtttctcgaactggttcacatacttgctgaacagattgatttaaaaacttactcactgtttcctctactttaactgctgacagcacggagcttacaatcatttctttctctacaaatgcttctaattcttttacatctcttccttttaacttttcccactctttttgcagtacgtcagttaaaagctgctttgtagcatcttgccctaaaaacttaataacttctggctgcacacgatccacaacacttacatttcctaaaaacatcccaactaagttaagtagcgttccacgagaagcaaagaaatcatcaatcatttttgaaagacgcgctttcccttcttcactttcaaaaaagctaattcctcgctctaaaataaacgccgaggcattcggaatcgcattctctatcttttcatgtacagaatgaggtaaagcctgttcccatgtatatgtataatactctgctaaaaatgcatgaattttttctgtaatcacatgttcgatttttcgagtcgcttcttcttctacatgtgctacattccatttttctaacatatatcgcagtgattgttcattcgtaattactttatccacttccacttgcgcccagtgaattaaacctttttgaaactcttcatttgttagcttttttccgattccttctggtgttaacaaatgttctacaaccatttttcctaattgaacagcaagttcatcacgccgcttcggaattaaccctggtgtaaatggaacttgaaactttccgatataaataggacgatgaggacgaaataacatttttatcgctaaatgattcgtatatcctccaataattgctccgagtcctgtcgtcgttaacatatttaaccatatattcattacaatcaacctttcacttctccaaaactatagcatatcatcatacggacaaaagtataatggtataaaaacgtatttgcaatatatagcttcgcctattatgcaaatagtagtaaaggagtgatttcgttggttctcggccttttaacttctaaacttcattatgagcaaacgtattacaccgaaatcgctaaacgcgctcggctttatcataatgttcgttgcccagtttacgccattttgtattgatcctaaaacagaccttgtttctggtcttatttacgatacagatacaggaaaatggaaaaagcaaacattccctattccttc

SEQ ID NO: 804 - DNA, 1818 bp, Bacillus thuringiensis
tttccccaattgcatttttcacatcttgcagcgcaccgttccttgtttgcttataaagtacttctatcttttctggctttgcactatacagctgctgcattttcttttttgcttcagtatagttatttgcaatatattcatttcctcaatagtttagctttggatcttttcgtatttgctgatatgccgtcgtttttcgtactacctgccgcaattttatttgtcagtgtactataataatttgttgtagcttgcggatagtctccacggttccactcatgatttcttgcgatttgttcatctgataaattgaaatacgaatacgttacgcggccctgctcatctggcaccggatcatcgaatgttgtatcaaggtgataccaattgttttcgattttcactaaattccaagcatgaggttgtccgtccccagttcctgtcacgaaatgattttcaattcctgcttcttttaataattgataagttaatagtgcgtaaccttggcaaaccgcagaacgatttacaagtgcttcatatgctgtgtaagctttataagacgtatcataagaaacatgctttactacgtaatcatgaatcgccttcactttttcgtgatcatccattccaacttgagtgatagaagaaacgattgctttcgcttgtttcatgacatattccgtctgttctttcgtttcacgatatgtaatcttaagcgtaaacgtataatttccaggtgatccagaaagtccatatgaaacattcgatctattattatttgtatactcattcttacttgccacttctttatatgcgttaaaaagtgtattcatcacttcgtctgtattattatttttcgttttatatggcagtgtaatatttgtctcgtatgtattaatacgcttttgtacttcctctttaaacgctgttaataatgccgcatctcctgtatctttcacatcagcatttttatacttcaaagttttatataaaaactgcgcatactgttcacgtgttactgtgccatacggttcaaaattcccgttccctgtgccatctgcgattccatttgactgcaccgcactaattgcattttctgcccaaaatggatttggaacatccttaaaggtatgtttttgttttgccgcaagatggaaagcattcgtaagaatttgtgccatttctgcacgattcacagaagctttcggtctaaattggccattttcatcacctttaaaaactcctaaatttgttaaagttaatacctcttctgggaacattgtagaactttgattaatatcaccgtaaggatttttaaacgtagacccatcctttaatacgtaacgagttccatcattactaaacgagccgccttgtttatttggtactaacactcgataaattaaagccgcaacttgctcccttgtcgcaacatctccaaaaccaaatatcccatttccataaccggaaataatatttttactcgctaaatctttaatcgcaggatatgaccaatgtgatgtcggcacatcagaaaaaacacccacttcagcagcttttacatcgctgccatttgtatataacaacgcaccaccaataagtgataatgatgtaattgattttaatagttttgtatacataatgtcttctcccaatacgctctctatttttgatggtttatgtcgaaaaatctaaaaatatgacaaaatatattatacaattaaaactttttaagggatatattaaattttaaaatatgcaaaaattcatattgttataaggattcatagtgatattatgttattttacttgggatatata

SEQ ID NO: 805 - DNA, 1641 bp, Bacillus thuringiensis
cgggcatgaggaccatattggcggaataccatattttttaaaacaactaaatgtaccaatctatgcaacaaagttaacgttaggtttaattgaaattaaattaaaggaacacaatcttcaaaatgatacggaattaatcgttattcattcagaatcagaaattgattgtggttctattaaggcaaccttttttaaaacgaaccacagtattccggattgtctcggtattgtttttcatacaccagaaggtactgtagtacatacaggtgattttaaatttgatttaacaccagtaaataatcaacatcctgatattcataaaatggctaaaataggaagtgaaggtgtactagctttattatctgaaagcacaaatgcagaacgcccaggttttactccatcagaaaggtcagtaggagaacgggtagaggaaatatttatgaaagcaaatagaaaagtaattatttctacatttgcttctaatgtgaatcgtgttcagcaaatagttgaagcttgcataaaaacaaatcgaaaattggctttgctcgggagaagtatggtaaatgtagtagaagttgctctagagaaagggtatttacatattccagacggcatgttgattgaagcgagtgagataaatcgtttagatccaaagcaggtagcgatactttgtacaggaagtcaaggagaaccgatggcagctttagcgcgtttagcgagtggaaactatagacaagttgatgttttaccagaagatacggttattatagctgcgactccgattccaggaaatgaacgtaacgtttcaagaattatagataatctatttgctttaggagcaaaagtaatttatggatcaggtagttctactggagtccatgtatctggtcatgcgtatcaagaagaattgaaattaatgctcactttaatgaaacctaaatattttatcccaattcatggagagtttagaatgctacatcaccatagtttgttagcagaatcaattggtattgaaaaggaaaatatctttatcgtacgtaatggagatgttgtagatattagtaatgaagtggcaattcaatctagaagaatacaggcaggaaatatatatgtagatggattaggaattggagatgttggaaatgcattattacgtgatcgtaaacaactttcagaagatggaatgctccggatgcccattacttgcaccaagtggagggagacacaatatcaggtcctgatatcatattctcgatggatgctgtctgatgatcacgattcaaaagagtatccaagacaatgaactaaattagctagtattacaattgatatttcaggagcatgagaatgtgaatcgctggtgtatgtggcaaagggaggtcagagagccggtagggaagcttctatatacaaatacgaaacgaaagccgatgattcttcctatgctaatggaggtttactagtgaataaagaattctcgtatgggactactcttttgttttgtggacaaaatgaacatataatgcagtagatagatatggagggaaataaatgatgttattaactaaacgttttacaattggagacatggcacacatgcataatatctcacaatctacattgacgtattatgatgaaaaa

SEQ ID NO: 806 - DNA, 1790 bp, Bacillus thuringiensis
gatgattaaggagtgttatacttggcagaattattacaaggtaaaaatgctttaattacaggagcaggtagagggattggtcgcgctgtagcaatcgcattagcgaaagaaggcgtaaatgtaggcttattagctcgttcagaagaaaacttaaaagctgtagcaaaagaagtagaagcagaaggtgtaaaagctgttatcgcaactgctgatgtttcttcatgcgaagaagtaacaactgcgattgaaacgttaaaaaatggtttaggatctatcgatattttaattaataacgctggtatttctaaattcggtaagtttttagaactagacgttgctgattgggaaaaaatcattcaagtaaacttaatgggtgtatactatgcaactcgtgcagctttaccgagcatgattgaacaacaatctggtgatatcattaacatttcatctacagcaggacaaaaaggtgcacctgtaacaagtgcatatagtgcttctaaatttggtgtccttggcttaacagaatcgttagcgatggaagttcgcaaacataacattcgtgtaacagctttaactccaagtacagtagcaactgatatggctgtagatttaggattaactgatggaaaccctgataaagtaatgcaagcagaagatattgcagaatttatcgtagcgcagctgaaattaaataaacgtacatttattaaatctgctgggctttggtctactaatccataggaattaaatttaactttaaaagaagggatatctattctgtaaggggtagatgtcccttctttattttttgtattcgagacagaattttcggtataattaaaagtgaatggtagaaagcattgggaaattgaaagggatggcagttgtaaaagagtgatgtaaggaggaaaaagggatgaaaaagaagtttcaaaaattataacatgtatcgtgtataacgagattagctcgtggacctccaatatacataacactatattatatattaaaaaattggaggatataagtagatgagaactgaaaaagaaatgttagacgtaattataaatatagcaaaagaggatgaaagaattcgagcagttatcatgaatggatcgcgtgtaaatccaaatgtgaaaagagattgttttcaagactatgatattatgtatgttgtaaatgatatacaatcttttacgtctaatcataattgggttcatagatttggagaaataatgatagtacaaatgccagaagaaatgtcgttagttcaaccagatgaagatgggaagtttccatatttaatgcagttcatggatgggaatcggattgatttaacgctagttccagttgagttaataaaaaagttcgttggacaagatagtttaagtaaactgcttcttgataaagataattgtatggaaggattcccgccagcaagcgataaagattacttaataaaaaagcctacagaaaaagagtttttggattgctgtaatgaattttggtggtgtagtacgaatgtggcaaaagggctatggagagaagagctttcttatgcaaaaggaatgcttgaaggaccagtgcgagatatgttcatcgtaatgctagaatggcatattggtatgaaaacagactttacagttaatacagggaagtttggaaagcatttcgagcaatatattgaagaagatatgtgggagcaatttaaaaggacattttctaatgcagaatatgaaaacatatgggagtcattctttgtcatgggtgaaaaatttagggaagtggcg

SEQ ID NO: 807 - DNA, 1416 bp, Bacillus thuringiensis
  unsure (1)...(1416): unsure at all n locations
tttactacgtttattaatcgcctcatttatacttttgttattttcatttatatacaaactacgattaccggatttaaaggatatcccagcattttttatatttggtgctttagggtttactatttatcacatcgcattaaattacggcgaaaaaacagtcaatgctggatctgcaagtttaataatttcagtcactccaatagtgacggcaatttttgcttctgtttttttgaatgaaaaaatgaaattaaatggctggatcggtggtgtaatgagttttgcaggaattgccttaatttcatttagccaaggcgacgctattcaattaaatagcgggggattatttatattattagcggcgatttcagaaagtctatttttcgttttccaaacatcttacttaaaaaaatacggtttcttaccatttaccatatatacaattttttctagtactgtatgtatgcttattttcttacccggagtttatcaagaaatattagcagctcctcttgaagttaacttgagtgttatatatttaggtgtctttccaacagtactcccgtatattgcattggcctatattatatctcgtgctggtgcttctgaagcaacaagttctctatatttaacgccaataactgcgtgtttcattgcttggatatggttaggagaagtgccaactttagtttcaataattggcggtggaattactatacttggaattgtgattgctcatataccagtattaagaaaagaaaaacataggaatttagtaaataatcaatccgtataatgtaattcaataatgattttatgatacttttttatatagtttctttcttatgttgataaatataatattttgtatttcagttaaatattgtatgttacattttatgtagtaagcattttaaaaggagctgacaacataatgaatggaaaaagaaaaattttcacatgtatttctattgtaggaatcggactagctagtttttctaattctagtttcgcagcaagtgtaacggacaattcagtacaaaattctattcccgtagttaatcaacaagtagctgctgcaaaggaaatgaaaccatttccgcagcaagttaattatgcaggtgttataaaaccgaatcatgttacacaggaaagtttaaatgcttctgtaagaagttactacgataattggaaaaagaaatatttgaaaaatgatttatcttctttacctggtggttattacataaaaggagagattacaggtgatgcagatgggtttaagccacttggaacttcagaaggtcaagggtatgggatgataattacagtattaatggctggttatgattcgaatgctcaaaaaatctatgacnggttatttaaaacagcaagaacttttaaaagttctcaaaatcctaa

SEQ ID NO: 808 - DNA, 2378 bp, Bacillus thuringiensis
cgcaatctcttgattactttttccctctgcattttttaacaaaatctcaaactctctttcggggaaatcatgatgcaaagggggctctttcttttgacgcatacgggacatcattttcccggtaactttcggctctaatactgtttctccatcataagtagctcgtacagcatcagcaatatcacttgctcttgatgtttttaataagtagctggtcgccccagcctcaataacaggatacaatttttcgtcatctaaaaagcttgttacaactacaatttttgcttctggccattcttgaataatagcgcgtgttgcttcgacaccgtccatctcatccataacaaggtccattaaaataatatccggccttaattgcaatgctaattgtgatccttttcttccattctcagcttcccctactacttcaatatctggctgtgtagataaatatgccgatacacccatacgaaccatttcatgatcatcgacaagcaatacttttatcatacttctccccctctctcaatcataatcggtacttttacttctatttgtgtacctttggccgggaaactaagtaccttaagtgtcccaccaatttcatgaacacgctcttgcatcgatcttaggccatatgaaccagccttattaacccctacttcaaacccaacgccgtcatcaatgatttttaaaatcgcatattgatcaatttttcgaaggcgcacttctgttttctttgccttcgcgtgtcgcaacgtgtttgatagcgcctcttgcacaatacggaataaatgatcttctacacctttttttaattctattggctcaataagccattcaattttcatatgttgttttcgcgataattccgttaataattcctctataccttctgtcagtttcttaccttccaattgtacaggacgtaaatgaaggagcaatgctctcatttctgattgagcatttacaaccatattttcaacaagttgcaattgtttttttgtcacatctggaaattcagttatttgttcattaatcgctgacatcatcatcgacattgcgaaaagctgctgacttactgaatcatgcaactcccttgctaaacgatgcctttcttgagaaatcgcttcttgtctcatctcttcattccaatgagctcgttcattcgttactttttgaaagagtccagcttgctcctctaatcgacgagccagaacgattacttttcgttccacttcatgaaattcatcatctgcagtaaacgaaacatcgctcggaaaattccctcgctctacttcaaatagaaacgtatttaatccttgtatacgctgctctatatagtaaccgattgcatatcctacaattcccccgataagtaaacttgtagtcataataaacaagccaattggaacagaagcgatggattccttccataataaatcatacacttgttgctcgcttttccatacatatacaattgtacaaatgagtgcgatactaacagaggacaacatagaataacgaatatacatccacgaaatatttttttgtttcttcattatactttcctcacttccgtgtcgcctacgacaagcgaagaaataattttaatacgtcgaggagcctctttatactgctctgttctaaatgtaacattgcggttaaaccctgtctcttcataacctggcaagagcacacgcccgacaataacagaatgatttaaagaaagttcaatatcatatggcacatataaacgaatattaccaacgacacctcgaataacaattaccgtttccccttctggaatcatagcagttgttaaatctatttccacatcacaagcaccatattgaacattaatatcctcaagttcataaatatgatccatcattcgcacattgcctacaaacatattttttaaatatggttctgtacgatatatttgcttctcttcgtctatcatccctttttctttaatttcaaccttcattgctttttgctgatgcccttgttgaatcaattgataccaattaaagctaaacaagcagatacgacaagatccaagcctgctcatgaaaataagaagaatacaaatacgataccaccaacaaataaaaatacatttccccgtacataacgattctttttacgataatgccttccaaacataagcataataaatgcaaaaatgagaccacctggttcgaaatgtccaagtatcatatcaagaaaaagaccgaacccaaatatgatgaggagcatccccattaattgtgtctttgaaaaatgtttcttcatttcagctccccccttcttgtcacatatacatagaagaaaaggcattgctttccaacaccttttaacacaaacactat

SEQ ID NO: 809 - DNA, 1783 bp, Bacillus thuringiensis
ctggtctatggaaggagaatctaccatccttcaaaggttagaattaatgaaacaacaggagaccaatgtcttacagctcattcaagacactgaaaaaaacttaaaaaagatacaacaaaaaattgctaaatatgagaatgaaataacttcagcaaatgctattaaaaaataaaaaaatcaccttctacatattgtagaaggtgatttttattttatgatgcttgctttcctttatctgcatcatctacataccagatgaatttgcctgtatatccgtaaataactgctaaaattaacgatacgaagcttaaccacataaacggaacgtatgagaacgttgctacacctaaaataccagccataaaaataccattatcagaccatggaaccatacctgaagttaacgttccacctacttctgagttacgcgctaatacacgacggtctatttttaatttatcatagctatcttccataatttttggtgttaaaattagtgatacatacatcgcacaaccaaatatattagctaagaatgccacgattaatgtagacaatgttacattacctgcagaatttaatttcttctcaaattttgatacgattacttttaaaacacctagtttttcaagtaatccaccaaatcctaaaccgaaaataataacggctactgagccaagcatgccgttaattccaccacggtttaataacttgtcaacaaactcaacaccagattgaattgagaatccgttataagctgttccaatcgcctctccaaagttcatcccttggaaaagggttgcccaaattgcaccaattaaagctcccattgcaattgttggcatagacggtttcttcatcgctaatagaacgataacaatgaccgccggaacaagcatccatattttaatatcaaattgctttaataaagcttcttttaaaaattctactcgattcaaatctacattatcgccgccatacatccaaccagctacagtaaacataatactagtaataatataagctggaacatctaatacgagcatagctcgaacgtgagcaataacatctactttcgccatagaagctgcaagaactgtgctatcagaaagtggtgataatttgtcgccgaaataagctcctgaaagaactgcaccagcaacaagcggaagtggtaaaccaagtccttcaccaatcgccatcatagcaatacctgctgttcccactgttccccaagacgttcctgttgcgatagaagttatagaacaaataattaatgttgctaataggaatatgctagggtgaataaattctaatccataatagattaatgttggtactaccccaccagcaatccatgttccaattaaagcacctactgcaactaaaatcagtatcgcttctaatccgttagaaatccctttcgtaattgcatcttgcaattcttgataacgaaatcctaatcttaatccaagcgcaattactaaaaaccatgaaataaatagcgctaattgaattgggagatcaaaaatcgtttggaaggaaaagacaacagcaagaaatagtaataaaagaactatgatttctagcatcgatggtaatcttacacttttcatttttttctctccttacaagtcgataacatgacgtatgtcgtcttacatgtatgtaatatacaattagcgaagacaaaacaaaattttcatattatttcgatttaattttccagtataatatattcacaaccctttctattgtaaagtagattacgtttttcgcaatg

SEQ ID NO: 810 - DNA, 1941 bp, Bacillus thuringiensis
gcaccgacgcaaccatctgtgtgtgttatggtaggcgccgaccatcacctccccgtacaaagccaattgagtacagaagatattaagtatggatattgtacggagttcatggtgaaattagaggctgaaaaggtgaaagagcataatttctctgaacaaaaattccgtgaagatattagtgtatatggtgattctctactagttgtgtctgatgatgaaattgtaaaagttcatatccatgcagaacatcctggagacgctatgaactacgggcaaaaatacggtagtttaattaagattaaagtagaaaatatgcgtgaacagcatactgctttattagatgaacctactatggttcctgaacaaccagctcaatcgaaagaaaaacaaccatatggtatcgtaactgtagctatggggtctggtattaaaactttatttgagagcatcggcgcaacgaaagttatcgaaggtggtcaaacgatgaatccaagtacggaggatatcgtgaaggcaattgaagaagcaaatgctgaaaaaatcattattttaccgaataacggaaatattgtaatggcagcagaacaagcggcatcagttgtagatcaagaagttattgttgttcgttcgaaaacagttcctcaaggtatggcagcaatgttagcatttaacccagttggaacgttagaagagaatgaagaaaacatgcaagaagctttatctcatgtgaaaacaggtcaaattacgtatgctgtacgtgatacggaaattgatggtgtagcaattcaaaaagatgatttcatgtgtattgcagatgggaaaattgtatctacaaatgctgaaaaagtaggagctgcgaagcaattactagaagcgcttattgatgaagattctgaaatcgtaacgattctacaaggtgaagatgcaactgacgaagaagtagcggagttagttgaatttgtagaagagaaatttgaagatgcagaagtagaagtgcatgctggaaaccaaccagtgtattctttcatcttctctgtagaataagataagattcgttttgaaaataaatggattacttacttgctaatggataagaagtagtaatatgaaggttattactagtttttattcaaaaggctagcatattgaagagagaaaagagccttgctgctaatagtgaggctcttttttacttgttttatataagggatttgagtagtttctcttagaatgcctatgatagaatatataaggtgaaagagagcgattacagatgctaattggtactcaaataaaatgcaataaagaaaataatgtgacggggtgtgagaatcttgaatgatgttgtacaagttcctgttacggatgtaaaggggataggaggagaaacatctgagttactacatgagatgggtatttatacagtttctcatctattagaacattttccgtaccgttatgaagattatgcgatgaaagatcttgctgaagtaaagcatgatgaacgtgtaacggttgaagggaagattcatagtgctcctttgctgcaatattatggtaagaagaaatcgcgtttaacagttcgtgttctcgtcggtcgttatttaattacggcggtatgttttaataggccttactataagcaaaaattaaagttagatgaaacggtaacgattactggtaaatgggatcaacatcgtcaaacaattgctgtatcagaacttcattttgggccggttgtacgtcaacaagaagtggaacctgtttattcagtaaaggggaaacttacagtaaaacagatgcgtcgttttattgctcaagcgttaaaggaatatggagattctatagtcgaagtgttaccggatggtttgttagggcgatataaattattaccaagatatgaagcgcttagggcattgcattttccggatcacgaattcg

SEQ ID NO: 811 - DNA, 1437 bp, Bacillus thuringiensis
tgtaatgatttcaatttccaaaaaacttatttaagtgattataaataagaaaacgcttacgtgatgaaatagaaggtcttccttatatatgggaggtcttctttcgtgtgtaatagatgttaaaaaataaaatgtgtatgaaaaaagatagagcgccatactactaatacaaggaagggagggagaaatatgacgaatcgtaacggtagtaaagggagcggtaatcaaggatcaccaaagtccggccagtttaatcaggaatttagcactgaatttgaaactggtaatgataataaagggaaagaatatcgttctaaaaaagggagtaaatcaaaaaaggagtgaattaattcactccttttttgatttacgatgctgccgattgatccgtattatatttttcttctgattttgcgacaatcattgcgcaaattgcatcgccagaaatgtttacagctgttctagacatatctagaatacggtcaataccgataattaaagcgataccttctactggtagatttacttgatttaaaaccattgtaagcattacaagtccaacaccaggtacaccagcagtaccgatactagcgagtacagcagttaatacgaccatagctaattgcggtaatgtaagttcaactccgtatacttgagcgataaatacagtggctactccttgcataatggcagtaccatccatattaatagttgcccctagtggttgtacaaatgagcttatcgcttttggaacgccaagcttatcttgtgctgttttcattgcaaatggaagcgatgcattagagctagatgtactaaatccaattgccattactggcccgaaatgtttaaagaaacgaacaatactttcttttgctaatatctttaataagccaccatatacaaagaccccgtgaataatgagtactaacataacgacaatcatatacttgaacatcgcagcgacgcctgcaagccccattttaccaacggatgaagcgagcaaaccgaatgttccaattggggctaatttcataacgagattaacaagatacatcattaattcgttgccctgttcaagtaatgaatggataccttgaactcgttttcctaaaatagctataccgagtccaatcaatacggcaaaggcaatgatttgtaacatgtttccgtcagccatcgcttttgctgggttatctggtacgatatttagcaatgtgtcaacgaaagatgtttcagtttttgcaccttcatacttaagaccttctgttttaaaattaccgccagctcctggttttataataagtgcaaatgtaaccgctatagagatggcaaccgcagttgttacgagaaagaatgaaattgattttaaaccgattcttccaagttggttcggatctccaaggccggccgcaccaagtccgatagaaataaaca

SEQ ID NO: 812 - DNA, 1599 bp, Bacillus thuringiensis
taagcccttccgatttggaaaccatttaattaaattagatagtgatgtaatataagctgttccatccgcataaccaggcatcaacgccagctaataaatataatagtggtaaggaagaaacttgtgaactaagtattaagccgagtcctaaaacaattcctgcagtagcaataagtttccgaagtcctaattttttctgcaattttgctgcaaataaagttgagaatgataaagaaaaacttgttatagagaaagttatcgctactgaattaagattccatccaaacttacttacaaggggttgattaaataaactccatgtataaattgttccaaggccaatttgaacaatgattgtacctagaacaattagtaacggatttatagaagtttgtttcatactaactgtccccttcttttatcttgacatagattttcacagttagtatatccatcgtaaattgcaagatactgtacggaaaatggtaattaagttcatatacacaaaaagacacttcataaagaagtgtcttttgcaggttatatcagatgtttctaaagaaagctttgttaagataagccattttcgaatgcttatgtatatatgttatcaaataatttcttatatgtgatgagacttaagacgtatttttcattcatcatatagtcggatgaaaaattaatattcgatttcatcaaaatccttcggctgcggtacagtttgcatattagctgcatctttaggatcgctataaattgcattttgctctgtatttacatcttttatattttgttttttatttttgttcactttatctttcacttacaatcactcctttttgttataggagtaattatgccctattaccgttactaaatgtatcagcgactaaattactaaattcacgtaaataatataagtaattatcaccgccgtagttatatcttttgttatacatttttgcaacaactacattatattcaggtattactaaaatagtcggtccagtaatccctaatatttgatatgacccttttggaacacgttcaccaagttcgcttaattgtgcaggttcattttgaacgaaccaaaacaagccattttgtggtagctctttatttacatatgttggactctgcaaactcgtagcgatttttataacttcttttggaacaatttgcttaccgtttatcacaccttgatttaaatgaagattgccccaataagcaaattctctagctgagacaaacagatttttttcagtaccgtcatctaccgtaccaatttcactagtcgcgtcttcatttggattattaacaacgtcaactaaattttcatctcgctgaactctccaacctgtttcttgaaaattagcaggcttaaaaacacgctcctttaacaattcaggaaaacttttgttatatagctgataaataagacgtgtcatcattcttacattaatatctctatatgcccatgcttgtcccggttcaaattcacgaaaaattgtcccgtcattcatttctttctaatccgtgcgaatgtgttaccaaatgtcttatcgttgctttaccaagcaatgcaggattaaagtcttt

SEQ ID NO: 813 - DNA, 1644 bp, Bacillus thuringiensis
aatccgtgattgagtagccccactcgttatcataccaagcaagtactttcactttacgatcacccattaccattgtagataaaccatcaataatagctgagtgtgtatttgtattaaagtcgatagatactaaaggctcttcgctgaattctacaataccttttaacgcaccgtttgcaacagttttgaatgcatcgttaatggcttcaactgtcacatcgcgttttacatctactactaaatcaacaagagacacgtttggtgttggtacacgaagtgccataccatgaagttttccgtttaaatgtggaagaacttttgctagcgctttcgcagcacctgtcgttgtcggaatgattgattgtccgcaagcacgtgctcttcttaaatctttatgtgggttatcaatatttttttggtcatttgtataggcgtgaactgtcgtcattaaaccgttttcaattccaaactgctcatctaacaccttcacaacaggcgctaaacagtttgttgtacaagatgcatttgaaataacagtatgttttgtaatatctaattggtcttcgttcacaccaactacaattgttacatcttcatttttaccaggcgctgttaaaattacttttttcgctccagcttcaacgtgaagaattgctttttcttttgaattaaatttaccagttgcttcaattacaacttcaacacctaaatctgtccaaggcaattcctttggatcgcggttgtttaaaaggcgaatcattttcccatcaactaataagtgatcttcaaatgcttctactgttccgtcaaacttgccatgaactgtatcatatttaattaagtgtgctaacgtttcagatggatagcttgcattgattgctacaatttcgaatgcgctttcttttattgcttgacgaaataccattctcccaatacgtccaaatccattaattgccacacgagtcataatatgttatcccccttgaatgcgttatactatttatctccaatcccaataatagtataacacaaaaaggggatatgtcactaagcattttcattaatttcacaattttttagtcaataatgttccacttctttaaaattacctgcaattgtgttttcgttcccataattgtgccatcattatttatcacttcatctgcatttttcactttttcttctaacggcatttgagattgaatacgagctgttgcttcttcttctgaaaagttatttcgtttcattaaacgttctaattgcgtatgcggcttaaccgctacaactaaaattcggtcaacgagacttgttaatttgctttcaaataagagaggaatatctaacacaaccgcttgcataccttcttttatgtacatttccttttgcctattcatttcctcacgcactgcaggatgaacaattttatttaactccaatcgtttttcttcattatagaaaacgacacttcctagttttggacgatctagttctccatcttcttgtaacactttccgttccaaatacttctactattttggtatatgctgggtttcctcgctctacaacttctcgtgcaataatatttgcattaataactggggtgtccattaacgaaacatttgagacactgtactttttccactt

SEQ ID NO: 814 - DNA, 1942 bp, Bacillus thuringiensis
agaggcatttcatatttcagtaacatctttatttttccatcacgtattttaaagtcaattgggttaatactagctgcatgaatttctgcgagcacttcatgttgatttatttcaggagtaggtacctctgccatgcgcattggaacttttccgtacttatcaattatcattgctttcatttcttatacctccaaattttaataaaagttgtgcaatagtttctcaatatctaacacaagattttttaatacacctaattttgtacgtatatcaatataataaaagttttttgtaccttcttttcgcattaaaataataccggcttctcgtaaaatccttaggtgatgtgataccgctggccgagaaaggtgtgtttgtttcgtaatttctcctacacgtaatccggtttgacattccgtttccatgagaactaacaaaatagcttgacgtgtttcatcgccaattgccaataatactttttgagaatcaataaaatctttttttataacatttaattgttcttgtttattcatttcaatcactttacctccaaaaaattagtcgaaaggtttaagatgatgaaccattacttcgatacggtaatgctacatgattgttgcatgaggtgcaatattgagaaagaaaatcgagacgaatgaattttttattgttgaaaattatagggagatagaaaagggattggaaggattacataacacaatagatgaagttttaaaaacaaaaaatgatgtaacaataaaataagcggtcgtaaccttgtataatccataaggttacggccgcttataatgtttgtattatttttgatttttacgatagaacatggttcaacgtaaattacattcttttgttttacactttcatacagacacaattcaggtggattatagatgtatgaaaaggtaaaaggaattttggggcgtaatctatctatatgataattcaaaatgaaatataagtctatattttaatgttttttttgattatatttatgtcactgagctcagaacaatgatgtggagggtaaatatatgaaatcgaatgatgtaccagttttaattgttggagggggattatctgggttagcgtctgcgttatttcttgcaaaacataatattgagtacttacttattgaaaggcatccgtctactgccattcatccgaaagcaggcggtcttactttacgtacaatggagttatttcgagaattaggcttggaacaaagaattaaattggcaggtaaagcattagagaactgcagaggaagaatagcggttcatacaatagctgaggcgaataaagaagaattggaacaaatgagagcgacgcaatacggaaacgatgaagagttacttcaaaaaatagaaaagattagtccatcaaaacaaactgcgtgttatcaaattattttagaagagatgatgttacaagaagcgaaaatattaggcgagcaactatctttttatcatgaattagtttcatttgaacaaaatgaaaacggggtaaaagcaacgattcgaaatcgtgaaacagaaaaagaaagtgtcatacattgtgactatgtaattgcagcggatggagcgaaaagtaaaatacgtgagcagttagggattaaaactgagggtcgtggaaccattggtggctattatatgaatatttattttgaagctgatttaagtgagtttatacaaggagatgcactcggtttttcgatggtacttcatccgcaggttcttggtgcacttatcccggttgataacgtaaaaaaatggatttatcatgtagcctacgatccattaaaaggagaggggctagaggccttctctatagcacgttgtgaaccaattattccaatagcaattgcaagtacaaatgaaaataaaatattaagtgttttccgtggacacagccgaatcacgaa

SEQ ID NO: 815 - DNA, 1435 bp, Bacillus thuringiensis
ttttttattagtcgatgtatttgagtgataaccgctataatgctctaatacgactttattattttttataatacaaattgctgtagcagaactatgatttttttcttttatattctctacccaagaaatcaacttatcatatgtatacaaataaatcccccttaatacacatcaaaattacagtatgaaagaaaagtataaacagtatttacacctttctttcatataaaatattaatgatgtactatatttaaataatccaccagttccagcaattaaagcaaccaaaacatccggcacaacctacgcaaccaccacatctgccaccgccgcaaccgccacagcgtccaccacaacctccgcatccgccacaacgacgtgcatcgccttggatgtaataatatggatattggctttgttgttgatcccaatacacaacattaccagtttgataatcattaaggtttaatgtttgtaattcatgttgaaactgattcattacgaacccctccatttataaatataaatttcgcccaaacgttaaagtttatatatttttgtaaacaaaatagaaacaagactatagactaaatgcgtacatcaacaaaatatgaacttacactaggtgatgtaccttgtttttcagcctattttctttatatttattcgatggacgtatttactataaataaagtgatttaaaaattactaatccaacaatttagtagttcatcacttaactttctttctagtaattccttcactaaaggcattggcatgatttcataatgatttaaggcttctttattataatctattcagtgaaatgctaaatgagactcgctcgatttcggtgttaagtccgtatgtaaatcttgtgactctacttcaaaaatgtgattaatttcatgatggagcacttctttatcttgccattgattttctatgactcctaaaaattgttgtatactacagtttactccaagttcttctcttaactctcttattaatgcattctctactgattctccaatttcaacatggccaccaggtaaaaaataatgatggccaatatattcagcaactaataatttttcatcttttatcatgactgctcgtacaatatgatggaatttacttttcaattgatattcctcctagttattcaatgtatagttgctcaaaatagtcatttagtattggtataatataaatcataggtgtttcatacggatgcatatcattaataacttcaagagcatcttttacaagttctcgtttacactttatttcaactttacattcttgcccttcgcatattcgaccaatttctccattaaaaggagatgcctcgtctaaaggtctccaatatcctttcactgaactataggaaagacaatggtcatattcgcccgttttacatgctccaatttta

SEQ ID NO: 816 - DNA, 1955 bp, Bacillus thuringiensis
  unsure (1)...(1955): unsure at all n locations
gctgcaacgtacattgattatttagaagctattattccagttgtaaaacaaattggtcataagcatagaagtttaggtattaaagcagagcattacccgattgtaggtacatgtttactgcgtgccattaaagaggtcgcaggtgcacctgatgaagttttaaacgcatggggagaagcatatggtgtcattgctgatgcattcattagcattgaagcagagatgtatgaagaagctgcacataaagaaggtggatggaaagacttccgcaactttgtgattgttaaaaaagtgaaggaaagcgatgttattacgtcattttatttgaaacctgaagatggagggaaagtttcttcattcatcccaggtcaatatgtaacggttcaaatcaatattgaaggtgagacatatacacataatcgtcaatacagtttatccgatgctcctgggaaagaatattatcgtattagtgtaaaaaaagaaaaaggtgtagatacaccagacggtaaagtgtctaattacttacatgaacatgtaaaagaaggagatgttttaccagtaagtgcaccagcgggagatttcgtgttaaatatggattcaacattaccagttgtactaattagtggtggagtagggattacaccgatgatgagtatgttaaatacgttaattgagcaagattcaaaacgtaatgtatattttgttcatgcagcaataaatagtaatacacatgcaatgaaagaagacgttaaggcagtagaaaatgaatatgaacaagttaaagcatatacttgttattctgcaccgactgaaaaagatttagaaatgaagaactttgataaagaaggtttcattgaaagtgaatggttaaaaactattattccgacaactgaagcagagttttatttctgtggtccagtagcatttatgaagcatataaatgctgcactaactgatttaggtgtgaaacaagagcatattcattatgaatttttcggcccagcaacaagcttacaataagcaaaaaaacgaggtatttattttacctcgttttttatttgttctcgtaataaacggtttactgtttcacgacgtatacctatcagttgaccaatttcggtttgtgttaatatttcatatataggaatgtcacctaaatatagggtgaaccattcttgtaaacgatgaagacgttctttcggagagacggttgtcaattgatcaattcgttgttgcatcattcttaatttagattgcaattgcatagcgatgttagcatacgattcgggatttgcttgaagtctctcgtaccattcactactagtgatcggttccacttctgtttttattaaagcgatagctgtaccgtgatattctttcggtgaaattaaagaatgatgaggtatcgtttcacctggaacgataatgttgaataaaaatggtgttccgtcttcttctagccgaactacttttaataagcctgtttttataaagtataaaggaccgtcctcgccttgacggaatagtacatctcctttgtgtagaatcaatgttagccccccattaatatgtttctatttcttctattttagcgtatatgtatatagacaatatgctatttcaacagcaatttcattgacgaaatgtatgctattacagtagtatactatttagtgtgtaatagtactagcaatgaatacgctgtagggggtttagtatattgttagatgcgatgagaatgacggatatgagaattccggcgaatgctatcattcatgtagaagagatgaaaggtggagtcgttttatccgttgaagtagacggccaaattatttatacgatggcttatgatgaagaaacagatagctatgctgaattatatgatcgaaacgataagagggcgtgccaagtacatgaagacttcatggggtggntacttcttcattaaaaaagat

SEQ ID NO: 817 - DNA, 903 bp, Bacillus thuringiensis
aaagtaaagatgttactgaaatatgaaatgcctctaattcttggtaatgacttttccggtgtcatcgtgaaggttggatcgcaagtaactcgttttaaagtcggcgatgcaatatatgcacgtccaagaaaaaataagatcggtactttcgcggaatatatagccattcatgaggatgatatagctttaaaaccaaaaaatttaagttttgaggaagcggcgtcgattccactcgttggcttaacatcctatcaagcactacatgatattatgcatttacaaaaaggacaaaaaatattaattcacgctgggtctggtggtgttggtactttcgcaattcagttagcaaaaataatgggcgctaccgttacaacaactgctagtgaagctggttctgatttagtaaagtctcttggcgcagatcaaattattaattacaaaacagaaaaatttgaagaaatactcaaaaattatgatgcagtatttgatacaatcggcggaacaacacttgaaaaatcattcaatattataaaaagcggaggaaacattgtttccgtttcaggtatgccgaatgctcgcttcggtaaagaatttggttcaggcttctttaaaactctcttattttcattagccagcaaaaaacttactgcacttgaaaaaaagcataatgctcaatattcatttttatttatgaagccaagcggggatcaattacgtactattgcaaactatattgaagccggaaaaatcaaaccggtaatcgatcgagttttcccttttgaagatgctcaaaaagcaatggaatattcagagtctggaagagcaaaaggaaaaataattgcaaaaattaataataataaaaaccttcatttttttatatggaggtttcaaatttgctgttaa

SEQ ID NO: 818 - DNA, 2707 bp, Bacillus thuringiensis
taatactagggggatttttgcgtaaaaaacagggaataagtgatagaatctttctaaacaaaagtcatatttagtaattgacgagaacaagattctattcattaacaaatgtaatattatgttttgttttaaatcaggaggatattaaaatgaaaaaaatattaaaactcgattatctattgctccttcctctattcataacatgtactttaggcattatcatgatgtatagtgcaagctccattgtcgctgtccaacattacggttataacagtagacattttgttgattctcaattaacaaagctacttttaggaacaataggattaataatttgtgctttactcccatatgaaatatggaaaaaacgaatagtctcaatctgtattatgattggggggatttttttattaattatggttttatggaaaggaaaagtggtaaataatgctcaatcatggatctttggaatacagccagctgaatttcttaaattaggaacaatacttgtaacagcccgtttttttgcattgcgacaagaacaagctaaaaataactggagtggtatcggaaaacttttattttttttagctacaattttttttcttatctttaaacaaccaaatttaggatctgcacttttaatattaggtataggttttagcatatttctttgttcaggaataaatataaatctactaatcaaaagaactaccatcggttctattttatggttacctattttatattatttgattcaatatagtttatcagcagttcaaaagacacgtattactacgattttcaatccctttcttgatgcgcaaggaaatggatatcagcttgtaaactcttttattgccattggctctggaggaatcactggtcgtggatttggaaatagcatacaaaaaacagggtatcttccggaaccacatactgattttataatggcaatagtttctgaagaactaggatttattggtgtatttattctattggtgggagttttgactatggtacttcgctccttaaaaattgcacaattatgtgtagatccattcggcagttttatagcaattggtataggatgtatgattggtatgcaatcagttgtaaatttaggtggtattacgggactatttcctcttacaggtactccatttccatttgtaagttttggtggaagttctttaatggtcaatttaatagcaataggaatattgcttaatatctcaattttcaataaaataagacattctcctttttaaaatctattgtactatagtcatttttgttacatttagagagattatacaggctttcataatgatttgatcaaactgtagatttcttaattttagacgaacatttaaaatattttatagcatagaatagacagtatacagtagacaccactaatatctactaggtgaataaaaaagaaggagaaaataaatgactctaaatataaatagagtattcccacgtaattggtatgctgtgagttatgcaaaagatataaaaaagattccagtaaaaaaaagagttgctggcaaagattttgtattatatcgggatgaaaaagacgaagttcaggccctatcaccttactgccctcatcgtggcgctgacttatcactgggacaagtagtaaatggtaaactagtctgtccctaccatggttgggagttcgatagttgtggtacttgtgtaagaattccatcccaacccaataaacctatcccgaaatttgctcataccctctcataccctgtaaaagaaaagattgggttgatttggatatatcctgataatgaggaaactccacctgaatggcaaacttttcatgtaatggagaacactccttttaaactctctttcttccacgccacttggaatgcacaccttactcgatcaatcgaatctgtgctggatattgctcatcttgcttatgtacataaaaaaacgattggtagaaaaacaaaagccgaatcaaccaattataagctggagggaacactggatcagtttatattctcaaatggtgatgcttaccttgaatacaaattcccacatcagtggatgcttcacagtggcaaacaggagaatgagtcatttattcagtacattacgtttacaccaattgatgaagaagagacattaattatgggatataccggaaggacatttttaaagtacttccctttactagaccaaattttagctaaatttagtttaagagtactaaaagaggatcaaattattgtagaaagtcaacatcctagacctataccagaagctttaaaaatggaggcccatgttcatgcagatatggctcaagttcagtttagaaaacgttggtttcagtttttacaaaatgggtcttgtttttcacttgattcaaggcacgtaacgcagtattaaatataggtgtagtgatgttgatagacgtggatgctaccccatcgccatcaagctaaaattttatagtaccccctgaacccaattatgtactaacttgtaacaaaaaatcccttcaaaaaaagaaaggcgcctatgcacctttcttttgtatatcattctcactctcttagcattcagaattccttatgaatcactttaatgcgtcattgttcggacctaattactcttaaaaaagctatactttggatccttacttttaagaacatattttctgttatta

SEQ ID NO: 819 - DNA, 2325 bp, Bacillus thuringiensis
ttcgttgaagaagattttgatgaaattggacgtttccaagcagagcgtttaatagaagaaatggttaaattagttggaccatttgcatacaatcaagcaattggagatgcaagaaagcttgtaagtgagaaattaacgaatatcgaagaagatttatacgtgttagagaagaatgaaggaaaataaaaaaagagcccatcggctctttttttatttgattgatagcaaaaaaacatagggaaaacacggaaaagacattgaaaatacaccttttatttttagaatattcttagttttaaaatacttcagaaaggaagattgtaatgagattaacgccaagagaaattgataaactgctagtagttgttgcggctgatttagcttatcgacgaaaggagagggggcttaagttaaactatccagaaagtatcgctattattacgtatgaaattttggaaggagcaagagatggtaaaaatgtagcggaattaatggaacttggaaaaaacattttaagtgctgaagatgttatggatggtattgcagacatgatatcagatattcaagttgaggcaacttttcctgatggaacaaaattagtaactattcatcagccaattcattaaaggaagtgaatgttatgattccagggcaatatatccttgcgaaagaagacatagtgtgtaatggaaataaaaaagcaatgaaagtcaaagtaataaatcagggagatagacccattcaaattggatctcattaccacttttatgaagtgaatgaggcattaaaattcaatcgcagtgtagcaattggacaacatttaaatattccagcaggtacagcggtaagatttgagcctggagatgaaaaaacgattgaactagttccatattcaggggaacaagaagtatatggatttaaaaataaagtggatggcgatattcaatcttacacaaaaagagggagatagcatgagttttaagatgtcacgtaaacaatatgctgatttatatggtccaactacaggagattctattcgtttagcggatacacaattattcgcacatgttgatcgaaatgccactgtatatggtgatgaagctgtctttggtggaggaaaatcaattagggatggtatgggacaaaattcacaacttacaagagaacagggggttgtggatgttgttattacgaatgcaattattattgattatacgggagtatataaagcggatattggtataaaagatgggaagatttcagcaattggtaagagtggtaatccttcagttatggataatattgatatcatcattggaacatcaacggaagtaatttctggtgagcggaaaatcgttacagctggaggtattgatacacatgtgcatttcatatccccacaacaaattgatacggcattggcttcaggtataacaactttaattggtgggggaacaggaccggcagaagggactaaggcaactacaataacacctggatcttggaatttaagaaaaatgctagaagcagcagaagcttttcctataaatcttggatttttagggaaaggaaatagttcaagtttacctgccctggaagaacaaatatttgcaggggctatcggattgaaaatccatgaagattggggagcaacttcgtcagcaattaatcactcgttacagattgctgataaatatgatattcaagtcgctattcatacggatacgttaaacgaatgtggttttgtggaagaaacgataaaagctattgataatcgtgttattcatacgtaccacactgaaggagctggaggtgggcatgcaccagatattataaagattgctgcgctgaataatattttaccatcatcaacgaacccgaccttgccatatacagtgaatacgctggatgaacatttagatatgctcatggtatgtcatcatttaaaagcgaatattccagaagatgtaatgtttgcagattcaaggattcgaaaagaaacaatcgcggcagaggatattttgcaagatttaggggttttcagcatgattagctctgactcacaggcgatgggaagggttggagaggttattattcgcaattggcaaaccgccgataaaatgaaaaagcagattggtagtttagagggagataaagaatataacgataataatagaattcaacgttatatagctaagtatacaattaatccagctattacacatgggatttcagaatacgtgggctctattgaaataggaaagtatgcagaccttgtaatatgggatccacaatttttcggtgttaagcaaaaaatggttttga

SEQ ID NO: 820 - DNA, 2641 bp, Bacillus thuringiensis
  unsure (1)...(2641): unsure at all n locations
aacagaaatttattttaacagaatatagaggtttattctggttgtttgaacgtagttaaagaaagaatatcacatactatcaattttaataaaaactatctgtggctttcacttctttattttattcacaaatagttccagtagctattccggttggagcgacacctactgggacattagtgataacagtattcgtagcaatatcaataacggaaacagtattactagcttgatttgtaacatatgctcgagtgccatcaggtatgatggctacttgatcaggggataaaccaacagaaattgtatcaatcacagtatttgtcgccacatttattaccgatacattattgctaactttatttacaacgtaaataaggtttccacccggtgtaatatctatgccaacaggttcggtacctacgttaattgtattaataactgcattggtagcggtgttaataacagaaaccgtattgctgttttgattcgtgacatacgcacgagtaccatctagtgtaaacacgattattctaggacgaatgccaacagggatggtatcaataactgtgttggtagcagtattaatgacagaaattgtgttgcttaattcgtttgcaacatatgcaagggcaccatttggggaaacagtaattccttgtggagcgatgccaacaggaatggtattaataactgtgtttgttgccgcattaatgacagaaacagtattattgccatgatttccaacataaacagttgtgttatttggagaaacagctacacctattgggttagttccaacaggaatggtagcgataacggcattagtagcagtatcaataacggaaacggtattagaaaaaatattagtaacataggcacgagctccatttggtgaaacggttacttcaagtggtgcattacctacagtaattgtatcaactactatatttgttccggtgttaattacagatactgtatcatttgtagggtcatctatgagtcctgcatttgtagcatatactaggaaattacatgcaggtccggttggcccggtaggtccggtaggtccagtcggtcccggtggacaatcacaatctccattaggtcctggtggtccttcaggtccttgaataccttgcacaccttgaggtccagtaggtcccggtggtccttccggcccttgaatacctgacacaccttgaggtccagtggttcccggtggtccttccggcccttgaatacctggcacaccctgaggtccagtggatccttccggcccttccggtccttgaattccttgtacaccttgaggtccagtgggtcccggtggtccgggaattcccattccggtccctgaaccagtaggtcccggtggtcccggaggcccttgaatcccttgtacgccttgaagtccttgaggtcccggtggtccttccggcccctgaatccctggcacgccttgagatccttccggtccttccggcccttccggtccctgaatcccttgcacaccttgaggtccttccggtccttctggtccttccggcccctgaattccttgcacaccttgagaaccctgagcgcctctaggtccaggaaatcctctaggtccagtggctccagtcggccccggtattccgatgttacttaatagcgaactatttaagattccttgtaaaattaagttgaatgtttgctgtaataaggggtccgatatatttgaacaacttataagtgaagacaagctttggaatagaaattggaataatgctgagatttgagtgagggatgcagtaggtaaggaattaattaattgatttatagttcttataactaaatttctatttggtgtatttggttgtactgttattaataaatcatttaatgcctgtaatgctgattggagtatttgtatagttgttggatttggtgttgtgaaaaaagaaaggatggcttgatttaattgatttattatttgtaataattcttgttgttgagaattcgagaaaaaaacaggtgtacagcaattactttgatcacaaggggatatagaaataaagcagggttgctgaaatttatcacacggatttttggaatttgattttcgattatatctcataaatacctccttttaaaaattgaatattaagtaatttttggtaaattattagcaactgactttgtaggtatatgtttaatgtgaaatgttttttccttcaaagtatatgccaataaaatagaggtgttcatatgggatatataaccaatacttggttgttaggaggatgttgtaatcataggaaagaaaatgaaggttacaaagtttataggcaagcgattgtattttaaaaaagcgttattgtaataaaatttgaagtttattaaaaagaaggaatgaaggaagatgtaaaagattttgaaagatccataaaaagaattcagtaaaacactgaattcttgacacgtatttttatttgttaatccatttagaaataataggaattttgttgtgcctattaaaatatgtactggtggtaattataacatgaaatggattgtantagaataatgcataaaaaagaacaagtaataaattaaacaaaagctntattttattatagataaataggtgactcagcaa

SEQ ID NO: 821 - DNA, 2283 bp, Bacillus thuringiensis
ataaataaacagaagtgatggcccaaaagtagtttgaaggataaacataataaacattgttaaactacttaacaaatcggtaccgatgacaagccattttcgattgacgcggtcagctacagcaccagcaattggtccacagattagccttggaatcgatccacaaataagcgtagttgcaaaccccattcctgaacccgttgtctttaatacgtataatcccattgcaaacgtataaataccggctcctagcaaagacgtcattttcccaatcatcattaaaataatatttctcgttgcaatcttcattcttgaatcattttgtcctatacttatatcccccatttttgacactctccccttaaaagttaaattgtgttaaacttattatataattaactttccaatttttacaacaaaaagtttaatgacatttaactttctaactataaaggagcaattatatggctactctcggtgaaaaaattaaaacgttacgaaaagaaaaaaagcttactcaaactgatctagcaggttcagaactcacaaaaagtatgctaagtcaaattgaaaatggaaaagctacaccttctatgaaaacactacaatatatcgctgacaaacttgaatgtgaaacgagttttttattagaagaagatgatgtagaaattgtaggactcattcaacaaacggagaaactaataaaagcaaacaagtacgatgaagtatatgaggttttactaccgatcgttcaaaaagagctacctcccactttgaatactgctcgtttatataaacagtttgtaacagctgcggctaaaatgaaagattacaatattgaatattacgttgaaaaggctacttctatttttgagaaatatacgttataccgggatagtacggaaacaaaattaaaattatcctttacgatattcacacgtaaaaaatatgctgaatgtttacaacttatagctagtatccgaaatgactatgaagagaaacatttagaaatggatctcattatacatatcgaattatatttatatgaagcaattatttttcttgcatgtggtgattacgaacaatgtgaaagtgtcattttagatgcacttgcattttcaaaaaaacatcaagtgtattataaaacagatgaattttatcgtattttatcttatcaaaaagtaatcacggctgataaagaacaatatttacattacataaaaaaatcagagcaattcgccatttttacagaagataatttctctgcggcggttattgatcttttaaaagctttctactacaacacaattgctaatgaatatacaattgcattagaacatttagaacaatttcgagaaaaattaaaagatgagccaatttttcaagatgatggatcatattatcttgaaaaaggaaaagctttgtatggtttaaaacaatacgaagaagctttaaaaacattgcaacgcgctatcataccagattatataaaccatccacttgatcacgcacggcttacaacagctggggcatatcgcgctctttgttatgtgaaacttaatgataaaaaaagagctcttgaagaagtaacagaagcatatgaaatcgtacaggcctatcctgattccatcttcacttcatttattaaagaaacattacaaataatacaaaaactttaagaatgtctctaaatggtatattattcctcttttttagcaaagataataatgatgggaggaatataaatgaatatacaacgtgcaatagagctttctatgtcagcagaacaagccaatgtcaattttcaaggcatgcctgttatgattcaacacgtcgatgaaagcaatgaaaccgcccgcatatatgaagtaaaaaacccaggacgcgaattaactgttccagttaatagcttagaggaaatataagaaatgccacttctcttttgaagtggcatttttcttctttcagattccttattataattttcttcaactctttattttacatgagctgaaaaaataagaattttgtacttcttttcgttttgtgacctgctaaaatacaaactatggattaattattcgtgctatacattaaggaggaagaataatggcatctaatttagaacaaacccagccttattatgcagttatatcctcttctaatttatcaaataatacaagtgactataataccgccgccgaatttaagtagaccctcgcagagtaccaacctggcatttttagatatagaaagtgcgcgaggtaattctggactcggaat

SEQ ID NO: 822 - DNA, 2028 bp, Bacillus thuringiensis
cgccaacttttattaatatcgcttgtcctgataagtcttgattatagattccatttcctgtctggaaccctttttgaatgaccccacgactcactcctggatatttcttattaatcgcctcatgtaaagctgtcgctaattgtaagtttttttcatagtttttatttcctttccctactacaaatgcaagctttgcatatgatttatctccaattgtttttgtcgttacattctttcgggcactatcacgatgcaaatcaaaaaagtattgaagatctttatttccagccatagcttgctgcacaatttctcgtgacatcttatacgaactattactgtttaaacctttacttattaacttttgaccaacatcactcttatcgttagtagctccaatcccttctccttctagttgttcacggaaacgatctcctaatatagaaatattcgatacagaactcgttgctttattcggatccgggtcattcgttaagttaagtaaaggtaaataagattcccagctatgtgtatgataaataaacgcaacttgtctcttcccggtcgtttgggacggctgttttttctctttactcgtatcttgtttaggtgcttgtccagttccactagtccgttccttcactacttcttcaagaggaacactcgactctatcggtaagttagaataatttgtaccctcacccgcaataacaatttctgtatcgtacttaccaaaccccgggagctctttcccgacgaaactgcgtacatcattaaagcgaatatttgtagccatagaaaagagaaaagaagaaattgaaaaatcttgattcaaatttcgatactcctgtgtaaaataatgattctcttttccaagtacatacatgtaaccattcatcgataactcatttaaccaattatataaatacgttgactttgtctctttcatagaggttaccatcagactaataagaaaaaaagtcgctagcattgtagtaataacaaataaaactaacttacgcatatttgtaaacttcataaaaaaaaagccccgattcatactatcacctctctattttaagttatgtacaagccctagagaatagaccgttaaaattccggctatattgttaatgaggtgaaatgaattgaagctattaataggaatattaccaatcgctctatcattcattttttatttgtccgctaagcaaccaaaaatctctattgtgctacatatttctgcgtacttggcactgtatgtactcggtacaattatttccattaatatatacgatgttttaatacaagatttagttttcatgacgagcattcatggaattttactgaatccatttttccttattgcaggagcgtatataggaacatacactgtgtacctacttttgtctcacattattatgaaaataaaaaatggagcgtaatgaaatgcaaccaccatttatctgtcatacatgcaaaaaaagaattgtgagaaagaaagaccttattacagccacatggtacttccgcttttatttatttcacagtgattgttttaaacgacagcaagtgtttatctcacgatttctccctgtgaatacacttttcaatttctttcttattatatatggaattatttttggcagtattcttatgattacagaaccatctattatttggctgactttcttttttcccattttttatcggtttctttcttattattatgttgaacgttttttctctacataacgcgcagactgacctctcggaatacttaaacattcccactcattttcttttaacatcttcccaatgtaaataatcttgaccaatatgcaatgcataatgagcaatttgcctttcaattgcttgcatgacagtatgtgcttcaccgcgaatgtataccgtcttcaataagtggtccggcgttaaagtattcatcgtattaaaaacatatttccatccttcttgccaagctataagggattttttttttgagtgatagcatcctttaaaatcaccatc

SEQ ID NO: 823 - DNA, 1139 bp, Bacillus thuringiensis
aatttaaacgtgttccgttctaactttcatatttacgctcaagttattgatgatgtgaatggtgtaacgttagtaagtgcatctactcttgataaagaccttgctcttaacggtactagcaatattgaagctgctacgaaagttggagaatcagttgctaagcgtgctgtagagaaaggcgttaaagaagtagtatttgatcgcggtggttacttataccatggccgtgttaaagctctagctgaagctgctcgtgaggctggattacaattttaatggtcaaaggagggaaaattgatgcatcgcattgacccaagtaaattagaacttgaagaacgtgtagttacgataaatcgtgtcgcgaaagttgttaagggtggtcgtcgtttccgctttgctgcactagttgtagttggcgataaaaacggtcatgttggattcggtactggtaaagcacaagaggtaccagacgcaatccgtaaagctatcgaagacgctaagaaaaacttaatcgctgtaccattagttggtacaacaattccacacacaatcaacggtcattttggcgctggtgaagtattcttaaaacctgctgctgagggtactggtgttattgctggtggacctgttcgtgcggtccttgaattagctggtgtacaagatattctttcgaaatctcttggttctaacacaccaatcaacatgattcgcgctactgtgaacggattaagcgaacttaagcgcgctgaagatgttgcaaaattacgcggtaaatctgtagaagagctactaggttaaggagggaaaacaaatggcgaaaaagttagaaattaccctcactcgtagtgtaattggtcgtccacaagatcaacgtgcgacggtagaagctttaggtcttaaaaagttgaattcaactgtagttaaggaagaaactcctgctattcttggtatgatcaacaaagtttctcaccttgtaactgtaaaagaagcttaaggataactcattaatataaggaggtgcctgggaatgaaacttcatgaattaaaacctgcagaaggttctcgtaaagtacgtaaccgtgtcggtcgaggcatcggttctggtacggtaaaactgctggtaaaggtcataaaggaca

SEQ ID NO: 824 - DNA, 1609 bp, Bacillus thuringiensis
atccgaattcggattttacataaagaaggccttgttgtttttcatacgatacatgtatagcttctaatcccttttcattctctactgtatcttcaatcgttaaattacggaaaccgtattctttcttaatatcacttagctgtccttttacgactgcttcaccttttttcaaaatacatacatgttggcaaaaagcctctacttgttccatacgatgacttgataaaataatcgtctttccgctctgtacttgttcttcaataatactagctaacatcccagcattaactggatcaaggccgctgaatggttcatctaaaatgagaagttccggattatgaagaagagcagcaattaattggattttttgctgattcccttttgaaagctctccagccgttttaaatttatattctggtatcgctaaacgctctaaccagtgatcaatagcgtgatccacttctttcttcgacattccttctaatctaccaaaatatcgcagctgatctattactctactttttgtatataaacctctttcttctggtaaatacccaattgttacaccactatttccaaatgcttttccatcccatgtaatcgaaccttcattaggcgttaataatccgagaagcattttgattgttgttgttttccctgcaccatttcgtccaagtaaccctagtacttcaccttttggtaacgaaatttgcaaaccgttaactgcttttgattccccaaattgtttcgttaagttttgaatttgtaaactcaagtataaagcctcccctttagtatcattcgtactctctttcaaagactatgtttattcaagacaaaatatagcaccgcgcttcatcctcttatatgtaaacatcgtcattaatccatcatttgttctatttagttaaaattgtaaataacaaagttctttttgtcaattataattgtcattacgacaataaaaattgtcaaaacaactattattattttgctcatctttctaatataggacatactactatatatacaaaagacaatatgcaaatgttcatataaaaatattatattttaatatataatataaaatgattttctaacatcaaggaggatacatatgaagatgaagaggggcattaccactttattatctgtagcggttctatctacatcacttgtagcatgttcaggaacaccagagaaaacagtggcaaaagaagagaaagtaaaattaacagaacaacaattaatggctgatttatggtatcaaacagccggtgaaacgaaagcactttactaccaagggtacaacattggtcaattaaagcttgatacaattcttgcaaaagggacagagaaaaaacctgctatcgtgcttgatttagacgaaactgttttagataacagtcctcatcaagcaatgagcgtaaaaacaggcaaaggctatccttacaaatgggatgattggattaacaaagctgaggctgaagcccttccaggcgcaattgatttcttaaaatatacagagtctaaaggtgtagatatttactacatctcaaatcgtaaaacgaatcaactagatgcgacaattaaaaatcttgagcgtgta

SEQ ID NO: 825 - DNA, 1422 bp, Bacillus thuringiensis
atttcttccggaatatcgtcatcagtatcaagtccagatgttccgccactttcatctatcaatatagctacatgtgttctttctttttgcatttttaataacaattcatgaattggaatagattcgataactaaaataattggtctcatatagtgctaggcatgtcatgattattgtcaacgtatctgttgtacaacatcagtgtggaatatctttaagaattctcagtgactaatatgctaggtctttgtcgccatcaacaactggataccttgtatatttttcacgagacattttttgcaaagcttcttcagcaggcatctctttacttataatattcatttcagttcgaggtaccattatttcttttgcaatgcgatcatcaaattcaaaaattttattcacatatttatattcagattgattaatctcaccatttttataactttctgaaactaacaaccgtaattcttcttctgaatgaacctcatcatgtcccttcggcggtttcagccctagcagcttcgtaatgattcgagctgaaccatttaatagccaaatgaatgggaatgcaatacgataaaagaaaattaacggcttagaaacaagtaaactcacttgttcagatttttgaattgcaaatgtttttggggccaattcacctattacaacatgtaaaaaagtaattaacaaaaacactaaaattacagcaaaaatgtctgctagttgagtagagatattccaatttgcaaaaagcgtatcaaacatttgctttaacgcaggtttaccaaaccacccaattcctaaagctgtaacagtaattcccagctgacaagcagataaatattcgtctaagtttgtaatgactgttttgaccgatgttgcacgattatttccttctgcaattaaatagtcaattcgtgaacttctcactttaacaattgcaaattctgctgcaacgaaaaatgccgttaaagcaattaaaacaatcactatacttatactatatatgtccaaatacttttccttacttactttgtaagcaaggaagccacctcctacttaattttattcaagtgaagtaagcattctaatactctaacaaaattctacattagcaaccacctttttatatattatatgcatacataaaaaagatatttatcattatgataatctaattcatttacaatcgtcaaattattctaaatgttacgataaaacatttttatttaaacgaactattcttctcaactcaatttcgtgaaaaaacactttctttgccgattccacacttcttttgtcgcactagaagggaacttacttcatagctcgaaatcattcaacaggatatatataggagggattattttggaatataaaacaccatttatcgcaaagaaattaggtgttagcccaatc

SEQ ID NO: 826 - DNA, 1872 bp, Bacillus thuringiensis
ttagatttatacgtagctggctccatatggcttactttacttattacatgtatgctctctttggctggactaacattaggtacgttggtatcggcatacgcaaataatgaatttcaaatgattcaatttataccgcttgttattgtgccacaaatcttcttttctggattgtttccaatggaatctatgaataagtggctacaaatgttagggaaagtatttccactcacatacggcgctgacgcaatgagacaagtgatgattcggaatcaagggtttacagagattgcattagatcttactgtattattacttttttcactattatttgcagtaggaaatgtatttgctttaaagaaacatcgcaaaatataataatgacaaaaaggagctttataaatgcagaaggattggctggaggaattaatagctgcaactaatacggataaacgaaatgaacgtcaaatgcgaatattagaggcggctgttgatatgtttggagaaaaaggatacgcttcaacttcaacaagtgaaattgcaaagcgtgctggtgtagcggaaggaaccatcttccgctactataagacgaaaaaagatttattactagcggtcgtaatgccaactttaactaagttcgttgcaccatttttcgtacaaacctttgcaaaagaaatatttaaatcagagtatgaatcgtatgaaggacttttaagagttgtaattcataatagatttaaatttgctcaaaaacactttcctatgataaaaatattaattcaagaagtaccatttcaaccagaactaaaaaatgaaatacagcaattagtagaaacagaactgttttcacatttcaaaaagttgattgtgaaatttcaagaagaaggagagattattgagataccaccatcttccgtactacgtcttactttatcagctgtattaggtttattattaacacgatttttattattacctgaagaaaaatggaatgatgaagcagaaattgaaaatacgattcaatttatattgtatggattaactccacgaatttaatcgtcgaagtgtgaattacatatattactttttaagtaaaaataaatcgcctttaaaaaggcgatttattttcgttatatatttttgataaataagtacttgtttattaaaaacattctaaatcagcgtgtttctttgtctcttcttctaagacctaataatcctgctagtcctaataaaccaagccaagcccaattattatttctatcacgattatcatttaaatcatttgttgtatttacatttcgagttcttacatcattattaactctgtctaaattattgtcatttactcgagttgaaatatcagtgttattcactctattcatattatttccatcgtattcagcttgcgcagatgtacctaaaaacataatagagagtgctaaaacacttaaaatagatgataatttctttttcataacaattccctcctttcttaatcattaatttctccggagcatctgtgtattattcatttcacaatatctaaaccagtataatagggcgcacatttattgaaaatagagttgaatgattgttaatatattattggatatatatttctcataaaaataaatgaatcaaactttgcttaaaatgttaatcctagtacaatttatagtatacggactagcactaaggaggtaatgagatgcggcaatttgcaaaacctacaatcgtcgtaagtaaatgtttagaatttgatgcttgtcgatataatggagagatgattccagatgtaacaatacgaaatttgcagccatttgttacatttatacctgtatgaacagaagtggagattggattgggaactcc

SEQ ID NO: 827 - DNA, 1811 bp, Bacillus thuringiensis
caattacattcgtatgtagtcaaagcacagctgaagcttctaccattcatacagtaaaaaagaacgatacactttggggcattagtaaacaatacggagtttcaatacaatccattaaacaggctaataataaaggaaacgatcaaacctttattggcgaacagttacatattccagggtccgtgaaatcaaatgaaatcactgttcctcaaaacgccaagcctgcgaacatttctggacaaattatttatcaagtacaaccgggagattcattagaaacgatagcaaggcgttacaatgtcactgtccaatctataaaacaaattaacaatacaatcggaaacaagctttatacaggacaacatttaaaaatcaactcaagtatttcacaaaaagaaaaagacttaatggcacgcttagttaccgctgaagcaggtggcgaatcctataaaggaaaagtagcagtagcgaaagttatactaaatcgtgtaaatgcaaaaggttttccaaatacaataacaggcgttatttatgaacctattaaatacggatatgcatttactcctgttacagatggaagaattaatcagcctgcaagcgcagaagcaaaaatggctgtagaagaggctatctccacaaatggagtacattctgactggctttatttctacaatccaaaaacatcaacagacaagtggattacgacacgtcagacagtagcagtaattggtaatcatgtgtttgctaaataagatttaaaatcattaacagacctcttcacttaaaaggtctgttttttttctatgtaagatgttattaatcatatgacatagttattttttaaactatttcttctttcaaataaaaatttttgtatttactccgccactcgtagaaattaataaagcatcaagttcaaaaactcccactttattaataaaagctatttcttaacttcataaaattgttatacactagaaaaataaaaaacaaactattcgttagcaggtggaagaatatgtatgatgttacaattatcggcgctggagtaagtagcatttttatggcttattcactagctaaaagtaacaaaaaagttttaattcttgataaaggtaaagcgctagaagatcgccattgtcctttagacgaaggaaaagtgtgtaattgtactacatgtgataaatatttcgggtttggtggtttaggaaaatctgaagggaaatttaattatacaaacggatttggcggagaacttgagaaaaaagtcggtaaagagggttttatacaactcatggctgaagtagatgaaattctatgtcagtttggtggaagttcggtttcaaaatattctactgaaaattcaagtctcactaagagagctgaagcgtgtggtttacaaatgctaacaacagaagtaagacatcttggtactacactttccagtaacatttttcagcagctctatgaatttttactgacgaaaataaagatccaatttcatatagatgtacaacatattctgaaacaggaagatcattttacaatagagacaaatcaaggaacagttcaaactaagcaacttgtatttgcaactgggcgctctggggccgattggttaaaagaaatatgcagttccctaaatatttctcaggagcaaacacgtgtagatttaggaattagagtagaaatgaaagaacatcaattacgttctatattaaaagatacttttgaaacaaaactttcttatcaaggtgagcatttcacagcaactacttactgtatgaatccacaaggccgcatcattcgaa

SEQ ID NO: 828 - DNA, 2235 bp, Bacillus thuringiensis
  unsure (1)...(2235): unsure at all n locations
ataagagatgaaacaattgtagttggcactgaacgtttacgcattccgaaatataatgggattaaactcatccccgcagttgcaatggctaaaggaactagttttattccttcttgcaccaattgatctactgtgaatgaatgaggaagaattgaaaaacaactatctatcccaaagaaaattcctactactaaaatgttagatacaataactgttataaatgttactatcgctgtaatagccaacttactagccatcattttctttcgattaatgggataagaaaacatgagtagtattgttttatttttatattcgtcaattattaaccttgctattaatacactaccaaaaataataaatgttgctcttactactgtactagccattaacaaaatcatctgcggatctcttatttctggatctccttctatttgtgcaatgaaactaacaaagattaataatgccagtataataatatttgcaataactgctcccctcacataccatccaaacttaaatttcttcaattctaacttcataagacgtagcatgatattcctccttcctccttggacttaatcaatataaatgactcctgtttcacttaaaatcttcgcttcattttttgcatcaccaatcgttcctacttttattttgtctgtatttttatctttcttaagtccttttaaatccactattacgtcagccgaattacttttagccataagcttcaatgatgcagggacacctttataccgtacgccaatatcacctgattttgtttctataaataatgattttccttctgtcatatctttcagtaatacttccccagatgttgatgtgatgttcatatttgagttacttacatttgttatatagttatcaccagtcgtagactttatatttaattcttgtactgaactaccttttaaaactaactctccactttgcgatataaattcacctttctcggctgatagtcctgtaatcatttcatctccagacttgccttttgtcatgatattttttactactatatctcttattttcacatcacccgatttattatttactacaattttatctatttctttcttcggaatagctatagatatactatttttcttcctaaacgtgaaaccattaaaaaatctgttcatcttttgtttttgcttaatcacaattttattttcatcattttctattttgacaggatctatctctttatctgcttgttcaccttgagcgaaaattactattttattagcgtctgtacttttaaattcaagattccagttttcattatctacttctatttcttttatattatttatctcaaaagacttttctttcttaaaatctttcccctgaaataccttaataccaaaaactacactagcaattgtaatgaataatattgcaattactattatctttttcaccattcataccccagttcattgttgttttaagcttgcttcacaccacatcaatcttatcgattttacgatatgaaagataactgatgaaaattcctaataaacagagcactattgggatagctataaaattaaacagacttacttgaccgtttccaggaccaaagttactactaattagcattccgattattactgcagaagtaattgttgtgggtgtcgatttctttctcatcccaaaaaataaaggaattaaacttataccagatatcataaatgcacttataaaagtagttggaacgatagatattatttcacctatcgtagctggtgtttcaatcagtcccatcattggactcacaaaatatacaagcaaactgatactgaaagtagcgataatcgtgctcacaaaacaaaaacaaaaaacaattgttaatttcgccctcattagcattttcctttgcagcgggtacataaacgataattgcatcgttttgttcttatactcatcaattactaaacgtgataaaatgaccgaactaaaaataatgaatgttatcctaataaaagtgtttattaaaaccatttgttgcgtgaagtcaaagaagagcacgtctccctcggctttcattcccaacgccataaggcttactgcagcgaaaattgctataatacaaattgctaccccttaaagtaactagatatttatgtttcttccattcgagcttcattaatctaagcatacaaaccactcctccattctttatataactgtctntatgctgctaac

SEQ ID NO: 829 - DNA, 2507 bp, Bacillus thuringiensis
ttctcttattaattcgttcattcttttttcatcttttgataacattatttccataaagttcatattaacgtgataaaaattagattctacaattccaatccactcaattggcagtaaattatcctcatacatattagaggaagtacttttccctctttctaacccccaaaaccctattagggataatactatacatgcaatacttgatatagttattaatatgtttagttttgtaccaatcttactgtttcttaataattccaattcactttctccattctaatatatagtttaagtaatgtattttataccaagaatccaaaaattacgatgtttattttgtaatatgtaattttgcatatcgtccactactgattcaaaataacctaacattgtaattttcgttttccaaaaattcatgatcatgaacacatctcattaattcttgaacttcttacccaaaatatccgcatatactgtggcaccagggaaaaccatcactggtatgatatataaattacgcttccatacaagactagcttaaaaatatttttcttattgctcatttttctattccccctctattagaagtactcctagcacatcacactaataaaaacgataatattaaaaaataaggaaagacataatacgtatgtctttcctctaaaattgtaatactcaatatgctcttggctctatttgattttccatttaaatcctcacatatctttctttataatatctcctaactccatccaatttgtaatacgcgggatattgagatattgattgtaagaagtagtttttgcatatacatttatcggttttcctattaacgtttctaaaacagccggcttatcatcaaagaaatagtttaattttatttcttgataaagtgtattttttcttcatccttcattccatagaaaaagcgatcttcatgtaccggaaatcctttttctattaaccatttttttgtttgctctccatgctctttaggtcgcgccgttatatagtaaatttcatgtccctgtctttctaattcttgcaatgtctctacagcatacggaaacggtgaacaagaagtataataaatctcatccagcaaactattccacatatgaccgccttcctcggaagtcatgccaaatgcttcatgaatttcaattgtttttaaagaatggaatacatccaaccctacttttttgtttaatttcttattatataaatgaaaagcatgctgccttaaatcaattagtgtatcatcgatatcaaatccaaacttcactcttcatcgctcctttctgcaatccatttatcggaacatataagtagtttttattccccttattgctcatctttccgatatgctggatagccaataaatctataatcttttccaatctgggtaaatgatatatccttaaattcaattgcatctttcattttagtaataccagtcccctctacaaaactaggcgccaatctacctccaataattttaggtgcgaaatataaaataattttatccattagtttattttcaataaacgaagcatttacttctccaccaccttcaataagcagggaggaaactcctttttgtcctaaaacatcaagcatttcatgtaagtttatatgcttttctccgctagtaacaaatactttaactcctgcattttctaatgctttctttttttcctctgcatgattacttgttgtaaatatccaggtaggagcttctctatctgtaacaacgttagcttccatcggtatgcgtaatgtcgagtccaatattactcgaattggatttcggccatttggaatacgcgttgtcaatgatggattatccttttgaacagtattcgctcctactaaaatagccgcattttcgtttcgtatttggtgtacttcttgtcttgcttctgtagatgtaatccacttactatccgataaagacgtagcgattttcccatctaatgtaactcctgatttaatcgttacaaatgggcgctttgtcaaaatatatttattaaagacttcattcatttttttagattcttcttcacacactcctacaagtacttcaatacctgcatcttgtagaattttaattccacgtccagaaacaagcgggttgggatcaagtgtagcaactactaccttcttaattcctgcttgtacaattgcttcagcacaaggccctgttctaccatgatgagaacaaggttcaagagttacataaattgtaccaccacgtgcctgttctccagccatacgtatcgcatgtatttcggcatgtggttctccggccttcatatgtgctccgacccctacaattcgattatcatttacaattacagatccaaccaatggatttggagtcgcttgtcccttcatagccttggcattttctagtgctagcttcatatacaattcatgctcaagcatttaagttgtcccctttaaaatgttcagaacgctgaatcttccgtttgcaaata

SEQ ID NO: 830 - DNA, 2299 bp, Bacillus thuringiensis
aaaagtagataactcatgttctttttcattaaacaactgcctgcttttataccctcataggattttcactcaattaacccgaatatataaataacaattctcacaaggagtaactttatatgaatctattcgaacacgaaacataaaaccgttccactttaataagaggtcctccctttttcttttctcatcatatcatccattaaaaaaataggaggacataattatgaaacgtgatccattatttttaactttattagaaagtgcaaatacacattttagcggttgggatttttctttcatttcagaaacgggtcgaatgaagagcgagcctttatcgtggtcgtacggcagtactgcttttcagcttatgcaacgtgcagaatcaatgctcgatatgggtactggcggcggagagtttttatctatgttacaaccgttcccgtcaactatattcgctactgagggctacgctccaaatgtgccaattgctcgaaagaaattagagcctttaggggttgccgttgtagaagtgaccgatgatactgctttgccatttcaagatggtcaatttaatttaattataaatcaacatgaatcgtatgctgcttctgaggtaaacagaattctttctccaagtggcgtttttcttacacaacaagttggcggtcttgattgcgcggaacttaatgagcagtttggctcaccactaaatagcgaatttgcaagttggtctctcgaaaccgcatgcagtgagttaaagcaaaatggatttactatcttagatgcaaaagaggaattccctttccaacgcttttatgacattggcgctatcgtctattatttaaaagcgattccgtggcaaattcctgattttactgttgaaaggtattgtgaggaattatatcgtatacatgaaatcatcttacaaaaaggttattttgatgtgaagcaacatcgttttatgattaaggcgatttgtagctaacaaaaagaggtggcaaagccacctcctttttgctccgtttacatatgttctctactctttcataataagaaaagttatatcatgcatattacaattatgaccaatgaattgtatttctgaaacatataatcacctcgcatatatgatgagagcaaaaacgtgatttttcactttcctcttctattgagaaatgagttgtttttcatatcgcttgttcgcatcatcttctgtcaaacatgcagttgtgtaatgaataatattccggttatcatacgtaaacatatgttctaacttattttcttctgttaatactgtcggtaagtattttggtaaattgctaactactcctctattatcaccatctaatatccaatcaatttctttccattctaatagaccttcagccgtacgtaatggtgtattcatttgcattccatctggcaaatcagcaacgaacacatacattccttcactagcctggggctcatctttacctttaaaaccaacagtccctttatacgttacacttgaaagttctatgcccgtttcctcaaatgtttctctaattattccttcgtatggcgtttcattatcttctatttttcctccaacaccattccacatccccatattcggctttttatttctatttaatagcagtattttatcgctttttctaataaagcaaattgtgtatttgtacatacgatcatttcctttcattttccacatgagttatttggcttattttcaagtatcgacgagtctaaacataaatttttcatatcatttaatccaaaaggttttttaaagaaaataaagtgaaactttaataagtggggttttgctcctctcccacttattctattattttcatttttgaaaaaggataatatacaaattccaccttgccaattatgttatcttcttcaatatatcctaagccatttcgactatctctacttacttcgcggttatctcccattacaaataacttatttggcggaatttttgtcttttgaaagttataaaacacttgtgtgttgttaaataaatctttgtttgtatatggttcttcttgctttttatcgttcacatatacctttccgttcgttatgttaattacatcaccaggaagccctattacacgtttcacataatatttcgattcatccgcttcctttataatgacaatttctccgtgttgtaaattagaaagacgtactactgctttatttacaaatacgtagtcttcttcatataaagtcggctgcatcgattccccttccaccttacataaagtaaaagaat

SEQ ID NO: 831 - DNA, 1927 bp, Bacillus thuringiensis
aaatatccaatagttggtttaatactaaatttagctaatcttaaagcacccattgttgggaataggataaatgccaaagaagttaaaatagaaggtgttgctatcgtatgaaataaaagcgcaggagcgacgccgaaactaacaatatcagctaaggaatccaattctacgccaaactcactgttcacttttaattttcttgtaattcttccatcaagaaaatctaaaacagctgaaaagaaaatgagaatggaggctgctcctaaatattcactcatattcaaggtgattgagaaaacaccgcacaataaatttccaatcgtaaataaattcggtataacttttacaagctgattaaacaagtttgttcctcctaaattaattaaacttcacatttctgtagcaatttctatatattcttccgttattcttaaaaatatatgaccactgtattactgtaagctaattaaatttcgataagagaaaaattgatttcttaaatgttccactggtttataaaaatgtttaatcattttcagtacgcgttattgaatattagcacttgatagttgatatttcgtgtagtcagggattttccggttctggtgcaaaaaattcaaggtaattaaaaataatctctaaaaaggagacataatgatactattattttaaaaaggttcgtggttggtatcgaatataaaaaaatagaatttttatacaaaaatcacccgaaagggtgccttttgtacctcttaaaatgactgaagatgtgtttactggagttcattaggtagttagaggttgatagactatctttaacgaaaatgttgagtaattcatcttcattatatatcaatttaataatgattggggatttagaaagttccatggaaagtacatatcaacctgattggaagattggaaatttaataactagtgatacattttacttaactcaacattttggtgcgcaaatgaaaatttttaaagtccacacaaatggtaccctagaacgattccaaacaatagaaccagaattcaaataaaatttttgcaggatcaattaaattcattccttgttatgcaaacacatttttagcggaactaacttcttcactattttgcgctggaaagactttataaaaaatggttacgttttctgatcttgaaataaccctctcaaattgcaatcctgctttttctaaaagctttactgcatcaacaatagaagtaattgctacaaaagtttttcaaataaaatttataaaagcttgataggcaataccaagggaaaataccgtagctaccatatgtgcagtccatttaggcatatttaaatttaatacggtattgtataacattccatatacgatacaaatgattaatatgaatgcaatgaattgaagaactaataaaaatagcggttgttccatttattctcatttcctttgtttaatatattaatataatttactcgggtgtgaaagtttcacttctatgaatttccaaaaatgtgatatgaaaggaatagtgataatcataagaattactgcaaaactataatggaactaaaagtattatgacaagattagtaaaatagtaaagaaggcgcaacgtttgtactaaatcctctgttaaggtaggctctactacattcgccatattttcacctccaaacatacttggtatatccttatcataacttattttttgaattgcgaaaatattattttttcccactattatccaaaaacattatacttccatgatatacttatactgatagaattcgcattgaggtgacgaaatgagagtcaaatgtatgatttgtgataaaagagatatgttagatgatgaaaatcctatggcaaaaaaactgcgtaatcgcccctattcatacatatatgcgcatggcaaatgttcggaa

SEQ ID NO: 832 - DNA, 1680 bp, Bacillus thuringiensis
accgcaacgcagtgcattgggttttcagcaattaatactggtacttttagttcttctgctagaagcatgtcgataccgtgtagtaaagctccaccgcctgttagaataacaccgcggtcgatgatatctgcagataattctggtggtgtgcgctctaatacaccttttgcagcttgtacaataacagctgcattttcttttaatgcttctgtaatttcttcagagcatactgtaattgtacgtggtaagcctgttaccatgtcacgtccgcgaatttcaagttcttcgctacgtgcacctgggaatactgtaccaactttaattttaatatcttctgaagtacgttctccgattaatagcttatacttacgtttaatatagtttaagatctccatatcaaacttatcgccagccattttgatagaggaagaggtaacaatatcacccatagatagtacagcgatatctgttgtacctccaccaatatcaacaaccatgttaccgcttggttggaagatttccataccagcaccaactgcggctacttttggttcttcttctaaaaatactgttttaccacctgaacgttcagcagcttcacgaattgctttttgttctactgatgtaatatttgttggacaacaaattaaaatacgaggttttgaaaagaagctctttacgtccaatttgttaatgaaatactttaacattgcttctgtaatttcaaagtctgcgattacaccatctttaagtggacgaattgctacaatattaccaggcgtacgtcccaccatgcttctcgcttcttcacctactgctaatactttaccactattacgatcaattgccacaacagatggctcatttaatacaatacccttacctttaacatgaattaatacgttagccgtacctaggtcaattccgatatctcgcgcaaacattcccgttttttcctcctcgatattcaaaatcaggttacacccgaattcttttcacctaatttctgattttatcataaatttaacagaaacgtaatattcgcaaaaagaattcttctgaaaaatattaccgaatgtgaacggaatgtttgctactgtaacattattgacgtacaggcttctctacatcttcttttctatacttttgttttgttgcttctccccctcttaaatgacgaatagacttatgataatcaagaatttctttcacttcatttgcgagctctggattaatttctggtagacgttctgttaaatctttatggactgtactctttgataccccaaattcctttgcaatgacacgcactgtctttcttgtctccacgatatacttaccaatcttgatagttctctctttgatgtaatcgtgcacaccactcgcctccctaatttggatgtgagaagggtgaaatgagcctcgctgcatacgactaagaagtaagtgtgagtgctgtttgtaagcgttaaacattcttggatttataatgaaatgattcacgatttctcacctcaaacactctctttgctttggtttataccattgtattgcccgcactactgatatatgctacatgttcactatttttgcggactaagttaagaaaaattacgtttttttgtgagaaatacgttaaaactgactattatagccgaaaaaaatgacaccttatatata

SEQ ID NO: 833 - DNA, 2652 bp, Bacillus thuringiensis
ttcacttttttctttcggaatttattttcaagttgcttgaaatccaaaaactttacctccatttaaatagttaatccatttattatatcttgttccttcattttaaacataattgtgctcaaataaaaataaacctgtcagccataatgaactgacaggtttatttttataatttcgtacgaacattccaaagctctgggaagaattgttgatcaagtactcgctttaaataagaaacaccggaggatccacctgtacccattttatgtccaataattctttctactgttttcatatgacggaaacgccattgttgtagccagtcttcaatatcaatcaatttttcagcaagctgatataaattccaatattttttcacatccgcatacacttctaaccatgctgcttctactgttgcatcttcttcataaggctgcgtaatatcacggtttaacacatctttatgaatagggaatccttcttttactaatgcttgaatcgcgacatcatatagacttggtgcatgtagcgctttatgaagtcgtgcatgtaattctggatccttttcataaatttttaatgcatgtggcgttttatagccaagtgcatactcaatcatacgatattgatacgattgaaaacctgaagcttgaccgagtgaatcacgaaactcaatatattctgatggtgttaatgtcgcaagaatatcccaagattgaataatttgagactgaatttttgatacacgtgctaacattttaaaagctggttgtaatttatcttgtttaatagattcaatcgccgcatttagctcatgtaaaatgagcttcatccaaagctcacttgcttggtgaataacgataaataacatttcatcatgatggtctgataatcttttttgagaagatagtaaactatctaattgtaaatattccccatacgtcatattctctttaaaatccgtatgaatccctttttccataattactttttcattttctttcatattagccaaacgccccttttatatgattctacttatattggtctaataacggctcgaaccggacttccatccgcatcagttaatgcaagtggtaatgcaatcaattcataatcaccgtctgctacatgatctagtacgacattttctaaaatatgaattccatgtttaaataattgatgatgcgctgctaattctttatcatctagcggatcaactgatggtacatctactccgattaaacgaatacctttctccgaaagaaaaggtgctatgtctgcacgtaaatgagggatcacatctggaaattcttcagcttttccatgtgaagatgtacgtaataataatcgttctacaccttctaaatgaaagctttctaattcctttttcccgatgctttcaagattagaaacgtcaataatccgtgctgggccaacataaacttgaacatctaaatccaatactttctttccatcattatcaaaatgaaatggtgcatcaatatgagtgcctgtatgaatactcatcgttaactttccaacatttaccgagccactttcttcttttgaccatgaaacttcatatgagaacggtgtgtctcctggccacgttgcaatatcattatttagcggttgtgaaatatcaatccactctgatgttttcatgcttatgccacaacctctcgcttattttcaaactgtttatactcttcttctttcataattttctttaatatttgtacagatttccacacttcttcatatgtgttatataaagcgaccggcgccagtcttactccattaggtgctcggaaatcagggataactccatttgcttttagcgctttacaaatacgtgctgcttctgcatgttctaaatatatgtgcccgccacgtttttcatcctctaatggatttccaattgtaaatccgaaatcttttaattcgtgatcaattaaattcagcatatatcttgtaatatgtaaagatttttcgcgtaaacgttcaataccagcatctttaaacatttcaagagaaccaattaaaggtgctgtacttaatacgtgcggtgtaccaatttgataagcacctgcatgatcggcagctgttaatgtatgctccatatcaaactgtttatcttttctagaactaaaccatccagacaatcctggcagtctattaaaatgtttactatttacataaaggcctgcaacactacccggtcctgcatttaaatattaataattgcaccaaacagcaaaatcgacatcccaatctttaaaatgatgcgaaatagatcctattgaatggcataaatcaaatccaatgtgaatgccgcgtttatgagcttccgttgttaaacgtttcatatcaagaatttgaccacttctatataaaacagaaggtaataaaattaaagcgatatcatcttccagcgcatggataatatcttcttcagaaagtgttctaccatctcggcttttcactcttactaaatgctcctctggatctaatccttttaaacgaatttgactttgaagtgcataaatatctgatgggaaagtcaattcatccgcaagtatttttgcacgtattcctttcagctcatcaaccgtcgcaataacttggtgtatattaacagttgtggaa

SEQ ID NO: 834 - DNA, 2156 bp, Bacillus thuringiensis
tgaataaacttgcagtgtcgtctcgatttttttatggcctaatctttccgatatcaataatgggctatatcctaattcgattagaagagatgcgtgtgaatgtctaagatcgtgcacacgtatcttttttatatttgctttttttattcctcttcttaattcatataacacatagtacttagaacaatcaaataaaaaatcattatgtttaggtttgtataatttgtttttatattttacaatcaatgcacttagtgccaaagggatatgaataattcttttgctttttggtgttttgggaggatttatgacagtttcgccattcaccttttgaagtgattttgtaatggaaattgtgttgcttaataagtctatgtctttccattgcaaccctaataactccccggaacgaattcctgtccaaaaaagtatagagaatataactttactttcttttttttctaattgttcgtagaataaattgaattcctctaacgtccaaaaattcatagaatcagcttgcttttttcctatagagccgactacttttgaaggattggcagataatccgtaaaattttacagcgaaattgagtatcgcatttaattggttattaattgtttttagatatgtttggctaaacccttgagaaattagggtgttttgccatttacgtatatgcataggtttgatctcatttatggcgatttttgaaaagaatggtagtattcttgaattaataatatattttttattttcgaaagtatttggtctaatgcgatgaactatatcttccatgtataattcaactagactagcgaaactcatatcgctactttcattatgttttttatggaattctttttcccaggcgacagcatcgttcttttttttgaaaccacgtttttttttctgcttcttgtttccttcgtagtcgcggtaaacgatttttacatagcacgttcctctttctttgtctttatagataggcaacctttctcaactccttccaaataagttcaaaaattaaatgttttatatttcatgaaccgtttaggaactccataaacacttgcaatttgttctatggtgtatccagaacggagataatgataaacttcatcatcaggcatcaataattcaacagcaaaagtatttgcttctacttctaatttatctgtggaaaagagtgtctgcttattaagaaaagcggtatcttcttcagtgtgtctaacagcatgacctaattcatgagcacagacatagagttggtaaaattcttctagagtgcaattgatatgaataatttgaacgcgccgacagtaaagataatatccgtagatatgttgcaggtcttcaaatattaattcgatgtttctttctttagctattttaaatggattgtttgtgccgtgttcttttactagatctagtgcgtgttgttttatgttatccttcaacccaaagtcccccttaatttctatatttcttaggagtgaattttttcttagctatttctcgtgctaaaagcatcgaacgttcaagtgaatcttttaataccatctttgtggcttcgtcaagtggttcgccatcgaaagcggcaaaaccatttttgtcatcacccaatccatctaacattttttctaattggttagcaatgtcttttttgtctttttcagttatttgatagtattttccgatcctggtgtttttttcgataagtttatctacatcgtaccccattaaccaagcaagggtttataccaaattgttttgctataacttctatagtagttagttttggtgccattttaccactacaatatcgggatacggtggctgcagaaagattaattctttccgaaagagtataaattgtttggttattctcaagcatgatttctttcaatctgataggaaatatttctttatttaaaagttgcttttgttccattttgtaacaaccccctttttcgattagtataaacaagtttgttacaaaacgcaacagcaacaaaggtgaaattgacaaaaatgttacgaaacgtattgacagttgttttttttaagggcattctagggatgtgttacgcaacgtaacaataactgcaatttattagaaaattatggggtgattatatgaacaaaagacgtat

SEQ ID NO: 835 - DNA, 1566 bp, Bacillus thuringiensis
tactggattgcgtttttactgtcaagatgttttcgatatcggtttgagtttccctttacactttccacagacatatctttttgtatttatttgacgccttcttacatattgaagtgaacactccatacattcatacttataaatctttttttccttctcttcattaatcatttgtttacaaaaacgtggtgcctcaactttctttaacaactcacggaaatccctgtccctgtgcttataccctcttcctgcaatatgtaagtgataatgacaaagctcatgtttaataatcccgactaactcttcttcaccatacacttcgtaatatcgataattcagttcgatattatgactcttcaataaataacgcccaccagttgtacgtaatctattgttaaacactgctttatgtaagaacggcatctcaaagtattgtagtgacacttcttccactagtcgctgaatttcttgctcatccactctcattcctcctaaacaaaaaaatatttttacacttttctcccttcttatacatatattaaatagtacatatacccatcctcatgtaagaagcgtggtttctaaaaacaaaacatgaatagaaatccactcaccaacctctcatcaatagcattttagatttttgagagcaggattaaacaaggagggattcctatgcctacgtggctaaaaaaacaaatgcaacgtgcatatttcgaaaaaaaccggtatcaaattaaattattaaatgaatgctggttttattatagcaaaatacatcaaagctcataatccattacactttttattccataaaaaaaagagcagtttcatctgctctcttctcttactattcaatcggcaacatagatagtgcaacgcgtcctttttttgtatcaatatcatctacccatacttttacaatttgccctactgatacaacatctaacggatgctttacaaactgtttgctaagtttagaaatatgtactaaaccatcttgctttacgccaacatcaacaaaagcaccaaaatcaacaacgttacgaactgttccttctaattccataccacgttttaaatcttctaatttcaaaatcccttttttcagaagtggtttaggcaactcatccctcatatctctttctggactaataagtgcatctataatatcaactaacgtcggctccccaactcctgtttcttgagataacttagaaatctctacttcttccaatctcttttgtaattgcggttgtcctacgtcatctatcgataaccctagactcttcaataacaattcaacattcttatattgctctggatgaatacctgttcgatctaatggattcgctccttctagtatacgtaagaaacctatacattgttcatacgtctttgcacctaaacgcgggattttctttaattccgtgcgcttcgtgaatttcccatcttcttctctctttgccacaatatttttcgcaacagttttcgataaacctgaaacatattggaacaatgcaaccgaagccgatttacataaaccccaacttggttacagcttgt

SEQ ID NO: 836 - DNA, 2222 bp, Bacillus thuringiensis
agcgataatcttcttttcgccatgaaacaaatatagaaccttcgccgatgaactgaataaatttctctataatttgagggaatttttctacacccattaaatcttttttcgtaataccggttaattttgttgtatgacgagttaatcgtgcacttggttttactaactccgaaaattcttcaattatcttcattgtacctatttctatttttacagctccgatatcaactatttctgatggatcttctgatttatacggtctgaaattcctttcaatatcaaacacaatgaaatgtgtagcgtttttcaatttatttacctctttctaaattgcttttcacacaaacactttattttcagtatttatttattcatgtactttatacaaaaatactccgaataaataaatgaaaattcagtcttgttatgatatgtaagtaggaggacatctataaaagtgcaaaaaaaaagaagggcgagcccttcttttttcaaaaattacttcttgtttacgttagtagcttgaggtccacggttaccttgttctacttcgaaagtaacttcttgaccttcttctaaagttttgaagccttcgccttggatagctgagaaatgaacgaatacatcgtctccgccttcaacttcgatgaaaccgaaacctttttcgctgttgaaccatttaactttacctgtttgcatgtcatgtacctcctaaataaaaatgaaactatgaatccacatgaaaaggtggatataaaggacatgaatgtataacaagcttacagcctttaattcaacgtgctttatttccgtaccacattatgtagctcaatagtgatttcactatatcacgctatatccaaaacgtcaaatgagaacactttcattccaccatttttttataattttaatataatgttgaatttccatattcatattttagcccggtatttgcggacagcttgattggcgggagctgataatcagttttggtttgttccactttatttgaaaattaacaaaactaaagtattctaatcctattaaattctgtacaatataagtatctattacatacgaggtgaaaaaaatgcaagcacatgaaatcgagtataaattatacggcgatgatatgcagtttgttgaaattgagttagatccagaagaaagcgttatcgcacaagctggcgcaatgatgatgatggaagattacatcgaaatggaaacaatcttcggtgatggttctggcccatctggaggtttattcggaaaattaatgggcgctggtaagcgtcttgttacaggcgaaagcatgtttatgactgtatttacaaatacaggtcacgggaagcgtcacgtatcctttgctgctccttatccgggtaaaattattcctgtagatttaacagaatatcaaggaaaagtagtttgtcaaaaagatgcatttatatgtgctgcaaaaggcgtttctatcggaatcgagtttacgaaaaaaatcggaactggtttcttcggcggtgaaggtttcatcatgcagaaacttgaaggtgacggtcttgctttcatgcacgcaggtggaactgtatataaacgtgaattaaaacctggtgagaaacttcgcattgatacaggttgtctcgttgctatgacaaaagacattaactatgatgtcgagttcgttggaaaagtaaaaacagctctatttggcggcgaaggtttattcttcgcaacgttagaaggacctggaacagtttggattcagtccttaacacttagccgattagcagcacgccttacaagcccagcagcgcaaagtactggcgaaggtagtgtattaggtggccttggtcgtttattagatgggaaagagtaaactgtgcccttatgtgggcatggccacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgtcacaggcactcttatga

SEQ ID NO: 837 - DNA, 1704 bp, Bacillus thuringiensis
gactcagagaaatgaaaacgaaaataatagaatttcaaccacatttaggtggaaaaatacatgtgtatccggaaaaaatgatttgggatgtaggaggactattaccagttacaggtgataagttaattgaacaacttgtacagcaagggttaacatttaagccagaagttgtattagatacaaaagtggaatcaattattcgtaatcaagatggtacttttacattaaaaacaagtactggggaagaacacttttcaaaaacagttatcgtcgcaacaggaagtggtatattgaaaccgcaaaagttatctattgagggtgctgagcgatttgaagtatcgaatttaaattatacagttaaatctttaaagcgtttcaaaggtaaaacagttattatttccggtggaggcaattctgctgttgattgggcaaatgaattagaaccaattgcggaaaaagtgtatttaacctatagaaaagaagaattatctggtcatgaagcacaagtaaaacaacttatgaacagctcagcggagtgtttctttaatacatcgattacaaaattaattgctggtgataatcatgaagcaatcgaatatgtagaattaacaaatcatgaaacaggtgaggtttctcatttacctattgatgaagttattattaatcatggatatgaacgcgacattacattattagaaaatagtgagttagacgttgcaattatagataattattatattgcaggtaatgcaaatagtgagtcttcagtagatggattatatgctgctggagatattttaaagcacgaagggaaactacatttaattgcaggtgcattccaagatgctggaaatgctgtgaataaagccaaacaatttatccaaccagatgcaagtgagtacggaatggtttcttctcataatgaagtatttaagaagagaaatcgcgaactgattaagcagataatgaaataataaggaacaagtatacccccacgtatttctctattcaaatggatgagagatgtacgtgggggttttcctgtttactatattttctatcattataatgacaccggtttcatcagttcgtatgatatgaactttttattggtaaagcatcctagaaaacaatttagctatgttttgcttacgcagaacatggctaaattacgctgtccctttagcgcgttcattaggaaatggcatatttagtatggaagcaatatattgttttccatgcattcgagctaatgattctaatatttggcgaacacgttttgtaagatgaccttgttttttgatggcttcacaatatgcgtcatagaaggcatatttagcccaaaggaaatcatcttgttggaataagaaatgatttttgtaccattcaccaattgtatgataacaattgttttcatgtattgctgtgctttgagaaagaaaacgatcagataaagatacatttaaatgagaaattgtgttttctgtttcaacttgtagtggtttttctaacattgtaatgatgtgacgagtagccatatgttaactctcctttgtgtaaatgggtaataccattctatatttaaaaaattcttactatataatactatacaatatatggaatgcatctacctgctttttgaactgcatttacaaaatcttttttatttgtttacaaaaataaagtaaagtaagatacagtata

SEQ ID NO: 838 - DNA, 2512 bp, Bacillus thuringiensis
ttagcatccatacatgctgttctaatgtttttttaattgctaacagcatgtcagctgatgtgtttcttcagcttcacccgcaacttccataccttcttttaattcttgaataagtgcagaataatcattcactaaatgttgcaccatttcttctgcagattctttgcttgtcccttcactgacactagatgttgcgagatattctttcattgtcgctaatggtttaccttctaaagctaaaatacgttctgctaactcatcaatatacgttccagcctcattataaaactcttcaaatttctcatgtaatgtaaagaagtgtggccctgtcacataccagtgataattatgtaatttaacatataacacattccagtttgctacctgcttgtttaatacttcaacaacatttgttttcgtactcatacaatcactcctcttatcattttgtaatgtttatcttttaataacttaattacattttaccatacattccctttcctttcgaacaattggcttatatgtaacaaagttttaacacctttaatgcttccctaatatcatttaattcatgtattttttcaaccacttcatacgtctaattgtccaagctcatacatatgcataatagtacatcaagctcatcatagtagaaagagggataacatggacaatcaacaatggcaagtagcaaagaaagtagctgctacttatatcggaactgtcgttggagctggatttgctactggacgagaaattgttgaattcattacagtgaatggattatacgggacaattggcatatgtgtaagtggattttttgttattaggcttggcacaaagattgatgtgactttcatcacaaaccggggcattttccagcgcaagaatttagcaaatatttattcgaggatgtatttgtgaatgttgtaaacacattattataactcgttttatttggcgtaacgagcgttttgttatcaggggctggtgcagtatttgtagagcctcttcgcttaccatggccacacggtattctcattacagttatcgcttgtctcattataagtagccgcgggttacaaggtgtttttgaagtaaatacacttgtcgtacctattatgatgatttttattatcggacttgctattacaaccttttttcacggtacacctcctattaataacactattcctgcagagagctggaatatgaaatggattactagccctattacatatgtcgccttaaacctttctctcgcccaaagtgttctcgtcccattagccagtgaagtaaaggatcgaaaagccattttttggggtgggattttaggtggtgctggactttctttaattttattatgcagccatttagcaatcttatcagtcgatcaattttatcaatataacatcccaatggctgaagtcataagaagatttaatgcaacttttcacttcttcttcgttctcattattttcggtgaagttttcacaactttagttggtaatgtgttcggaatgacaaaacagatgcaatctattactgggtggaaaaatcacaatattattttcttcattttactaattagttattgctttagttacatcggttacagtgacttacttcacattctatatcctatcatcggatgggtaagtattgttatacttccaatcattgcgtttaaacaacttcaaaaaacataaaaaagcatccatgttattggatgcttttttatgttcattcacaatcatcacatacttcccagtacggtcccatttctaatgctaaatacggctttaactgcaaccgaatcattcgactaggcatgcgttctaaaacaaattgaataccttcttcatcttcgtctaattcaacttttgaaatcgtaattttttgcatagtcgtaatgggaattccatctttatataaagtgattttcacctcatcgtattcattaaaatacaattcgacactcatttgatttttcagtatttcatcaccaattttaaatgtatcattttgttcttggattatatatttccatccgcctctatcttctttcggagctgtttgaaataatgtctccaaatcctcgtatagcataagataacccctctcttactaaaaaacgatgagtattttatataccctttatctctatcactatccatagctattgtaccatatatcaccgttcttaccgtattcatttgcttcatacacacttataaaataactaattctatctccattattatgtatattacctcattactccatacactcttacaagttcaaataacgacagactttaatccatgcaaatattgtctactctccgcttttattagctcacagcattcacacttttacatatagtaagactaccacaaataaaaaaggagagtgacttataccactccccttaaaagaacttccctatagctgctaaaactaatacgattattaaaattgcaaataataatgagacaatgaaactaaaaat

SEQ ID NO: 839 - DNA, 1778 bp, Bacillus thuringiensis
ttcgtgattcgatccaactgatgatggcggacaattttttgaccgtggtccatcttatcgtaccgctattttttatcataacgaaacacaaaaagggcttgctgaaaaatcaaaacaagctcttacagaaagcggtatgtttaaagatccaatcgtgactgaaattcgccctgctgcacctttttacgcagcagaggaataccaccaacatttctataaaaagaatccagagaaatatgctactgagcaaaaggaatctggtcgtgaagactttattaaagaaaattggcaaaaaaaataataaaaacgcatcgtgcttttttaatacgatgcgtttttatttttgataaaagtaccatacaatgatgagaacaaccgctgttaatgcccaaagcgctacttcatttttcactctactctttttcttagtcatttcatctcctcctaatagcaatacaacgtattcaagatttcctctgtttcattgtccaccttatatacataaatacatccttaccaatccttataacaagaccaccaataattccgattgcaattgaaattactaacatctgtccaaagctaaaagaatttgtgtacgttatgtagagaacgatacatataagtaaaacatccggtaaagaaagcaaaaactttttaagcatttctttatctcctctatactttatttatatcttctactgtaattttgaaatatagtttgttcaaaaattccatttagaccctcattttatgaaaaataataagaatcccttttcaaaagagattcttattcagtagatttaagtttaattattttctacatatcctattccataattactcctaaaatagaataatattactaatcatttattgtaaattgactatttgccaggcaaccgaatgtcgcgccagctacctacatcgcattggccaaattcattattacctaccgcgactaccgtgccgtctgattttagtccgactgtatgtgcacaaccagccgctatcgctacaatatcgcgccaatcgcttacgttacattgaccatactcattccagcccactgccaccacggtaccgtctgattttagtccaattgtatgattcgtaccaactgctattgctacaatatttatccagccacttacatcacactggttatgtttatcattccccactgcgactgcttcaatatctcgccagccacttgcattacattccccttctttattccggcccactgctactaccgtgccatccgatttaaggccaacagtatgacaacgccccgccgctatcatatctttgggccatcgcttcactttttctttcgataaaaggtaatccatgttttacctccttgcatataagcaactgtatcataatagatatttttatcaaatttcattataaatctacatttacaaagaaagcttattttacttcttcaaaaaataaaaacctccagtttaaatactagaggttttctcgttatttcttcaagcggtcaataaaatcgttcaatttatctagcgatttcatattctgattgcaagctacaccatctttgcaaatgtagtttccctttttaacgaaagttcctggtacatcgcctttaatttcaactaaaaacattcctacttcttcatgcccatgacataatgaacaaatgctttttttatttaaactttggaacgttccttgcagaccaacaaatttatttttatcatttttcgctataataaatttcctgcttgatcccttatcaatcc

SEQ ID NO: 840 - DNA, 1995 bp, Bacillus thuringiensis
ggatcattgaatggatcaagaaaaactgaaaaacgtgccttttgatatccacttaatttataattagccaaaaaatatagagctggaatccatactatagaagttaaaacaattcgtttaatccataaattaatccttactcctgaacaaagaaacataatccctactgttcctgcaattaacaaatcggtacctaaatcattttgctttaaaattaaaaacattgccattccaacaaaaccaagtgtaagtcccgaccctttaaaaacaggtgtatttgtttcttgtctccttgcaaaaaagcgagctaatataataataatcgataatttaacaaattcagcgggctgtatacctaatatccaaccttttgcaccatttatttccttaccaaaaatcaaggctgctgctagtaaagcaatactccctagccccatcgccgataaaattattcgttttctccaaaacttataaggtaacgaagctacaattactaacaataccgttccaatagctaaagttattaattgttttttaaaaaagtaatttgccggccagttatgcctcgaaatcgcaacaatggaactagaactatataccattattactcccagcacacataagataacaagaggaagtaataatgaataatccattgatttccatacttttttcatttcatttcctctttctgtttcaatttaattattgttgtattccatatgtacattgattcttcctgctttattatacaaataaaaagctcaaactaatttagtttgagcccccttatttgaacccgttattgttgtttgtttgtaaatgcttcatgaagtgcagataactcacgttcgagctcacctaacattgctttcccttgttcttctgcaataagaccaaggcgaaccgcaaaatcgacctcgcgggatagtccaaacatttgtgtgtctaacacttcttcatataatggacattgcggcattgtaagatggtccatttgcaccttaataagtcttaaaatcttctctgcatccgcttgtagaagggctagtgccttttcctgatgatttgctactgtctcagacgccaaattgattccctccgtttccgtcctactctcctctatcctatctattaatattagcgatagttttaataaattgcaatagaaacattttttgtgacaacagtgtctaatactattatactgaaaagtgggagtataacacaaatgggggaacaacaatgagcgaaattttatttattaacggaaaagtacgttttccaatcactattgatccaactgtttggatctttgatgatcgaaaagtagatttgacaacttactttgatgaaactagagaaaacacgtctgaactagaaacttatttaaaaaacacttcagaacattgggatcgcgaaatccgtgatggtgccgcttttcctccaatacaacaaagtgtgaagaaatataaaaaagaacagctgattactggaacatttggtataccatttcatccatttcttgctaacgctgaaattttagaggacgctaggcaagttgaaattgaaacggtagatcatacaatgacacttccattagaaactgtcaaaaatgctatactaggcttttcaaaagaaggaaaaccattaaaagaagacgggcctgttcatctctatttcaatgatggatctaatcaacaaaatccaatccgtaacatccgtaaatttacaattatttaaagaaaaggagtgagcttaagctcactcctttttacaataaatctgctgctagttgagctaaattagatcgctcccctttaacaaacttcacatgaccactaatacgctgttctttaaacttctctacaacatatgttaagccattattatattcatctaaatatgggtgatcaatttgctgaggattctccatcaatacaatcttactctttttccctaccctaggtaaatatcggtttcactttatgcttt

SEQ ID NO: 841 - DNA, 1488 bp, Bacillus thuringiensis
acaagaaaaatgattttacataactggaattattttattgtttggtgttgcacttttagaacttgtagcaccaaaagtaattggaatcgttgtagatgaaattaatgatggaacattgacgaccgataagttactaaaatgggttgtactattagtaattgtaggcattacgatgtacatattacgttacatatggcgtattatgattttcgggtcttcattaaaattagctcgccaattacgaaaaaatttatatgaacattttacaaagatgagtccatctttctatcagtcaaatcgaacaggtgatttaatggcacatgcgaccaatgatattcaagcgatccagcaaactgctggagcaggtgttttgacgcttgttgactcattagctgtcggaggatgtgtactcgtagcgatgggttttacaattagctggaagttaacattattaagtttaattccaatgccgattgtagctatttcgacaaattattatggaactttattacataaaaggtttcataaagcacagcaatcgttttcggaaatcaatgataaagtgcaagagagtatgagtggaatgaaagtgattcgctcgcttggacaagagaaagaagatttgcaggcgtttcgaagaaaatcagaagatgttgtaaataaaaatgtgttagttgcacgtattgattcgttatttgatccgacaatctctcttatcgttggattttcttttttaatcgcagtatgttatggatcggtattagttgtaagaggtgaattaacagtaggtgatctcgttacatttacgacatatttaggtaccctcgtttggccaatgttagcgtttggatggttattcaatattatggagcgtgggcgtgcttcatatgaccgtgtagaaaaaattctttcacaaaaatcagatgtagtaaatagcgaaaaagctgtacagacaatagcgagcggtaatgtttcgtttgccgttgattcattttcgtataagaaaaatgaattgttacatttaaacgatattcactttgatttgaagaagggcgaaacgctaggagttgtaggacgtacaggcgcagggaaaacaactttattaaaatgtttaatccgtgagtatgatcattttaatggtgaattaaaaattggggagcgagatattcgagatataacacttcatggtgtccgttctgccatttcatacgtgccgcaagatcattttttattctcagcaagtattggtgagaatattgcctttggaaaggcggatgctacatataatgaaattacccaagctgcagagattgcttgtattcataatgacatcctccaattttcagaaggatatgaaacagtagtaggggaaagaggtgtttcgttatctggtggccaaaaacagcgaatctctattgctcgtgctttattaacaaatgctagaattttaattgtggatgattgtttttcagcagtagatgcaaaaac

SEQ ID NO: 842 - DNA, 2983 bp, Bacillus thuringiensis
atcatccctcttcgtcaactagttagtatttagacaagtacgttggtaaaacattttgcatttctgctaattggtgaacactaactaactattttggtgtagcctttgccagaaaaagcattgtatgaagagcataatttgtagctttagaatatttcataaatacagctcctattgtagacttcatgtatctacaataactttatttttttattatgtcaaacgtttgtaatactccatacaacattatttcttcacaagtaatacatctgccgcgaaaatcgtcacttctctaaatggagagtcaaataaaacacctagtttaaaaccatcttcagtaagagctatttcatgatataaccaccaagcattttcaaagttttccggcatagaacactttgttactcctataaaggttacttcaagtaagtcatttgattatttaaaagtggatgaacaaaatgttaattcatttgcaaaattaaatgatcaggataagaaaaatatccaaattactatggtattaccagagcaaaatgaaaatagggattggctagcttacggttttactagtcgtgaaacattagatgcgtatattgaaaaggataaaaaagcaattaaaaataaaattaatcctttaggtagcggtgctggtagtactgatttttatgaacataaagataaaggtggccaatatatttactggagcagcggattttaaaactttaccatctagctggaatgacagaatttttttctgtaagtcaagcgtcaccttctgcaagttattcaacgacactttgggagcacacttcaacacaaggatatggaaaaggcgttttatttaaacacgctgattggtacggtaaaactgctaatttagctgctgattggaacgatattacttcagcgattgaaattaaatagtaataagacatttaatttcttctataaaaattcaaaccactattctctctttcatttagagaatagtggtttatcatatttctatttaagcatgtacagcatgtcctactgcttgcattaacgcttcatgaatcgcctcagataaagttggatgtgctgcaatataatctctcattatatcagcggtaacttctgtatgaatcattacagttccttgtccaatcagatcagtggcatgaggaccaataatacaaatccctacaatttcttggtatttaggttccacaatgacttttactttacccattagttcgccaataataagcgctttttcggttgctgtaaaaggaaattctccaatttgtatgtcaccgtactgctctcttgcatctttttctgttaaaccgacactagcaatttctggagctgtataaatacagcgaggtacagcatggtagtttacttttacatcttctccactcgcgtgtaatgctgctgtcgttccttcatggaaggcaacgtgagcaagctgaattccaccgatcacatcaccagctgcgtaaatatgtgatacgttcgtttgcatatgttcgttcacagcaatccctttatttgaaaactgaacccctgctttttctaaatctaattgttgtacacgtggttttcggccgacagaaatgagaacatattccgggttagcttcttggatactaccttcatattcaaatgaagcttgcttcttataattatttaatccttttaaagcagctcctgtaaatatttctacgccatcactttctaatttctctcttaaaatatgtgcgatatcttcatcttcacctggtaataattgcggtgccatttcaacaatcgtaacttttgtcccaaggcgactataaatacttgcaaactcgcatcctattacaccaccgccaacgattaacaatgaagatggtacactctcaagagacatcgcatggctactatttaaaatccattttccatcaaacggagcgaatggtaattctgtaggttcggaaccagctgcgataataaacctctctccatccactacttcttctttatttccttgtacaactcgcacacgatgatccgtttcgaatttcgcttttccttttacaactttaattttatttttcttcattaaatattgtattccttggacgagttgcattacgatttgtgatttccttgcctgtatttgatcccaatcaattgatatacttcctgtattaagcgtaaccccataatcattcgcttttctcacaatgtcatgcacttctgcactttctaacaatgatttcgtcggcatacacccaacatttaaacacgttccgccaaggtcagcttcatcaataagagtgacctcttttccattttgagccgcggtaattgccgctacatatccagctggtccgcctccaattacaactaatttactcattctctcaccttctctttataaaagaattgttataggttcttctaaataatatttaattgtgcgtaaaaatgcagctgctggtgcaccgtctagtacacgatgatcgaatgttaaacttaaaggtaacatactaccttttttaaattttttccctttatatacaggaacatgttcaattgcgccaatacctaaaataccagtctcaggtgtatttaatacaggtgtgaaatattcaataccaaagctacctaaattactaattgtaaatgtcgttccgtgcatatcatcactacttaagctacctgctcgcgccttttgtgccatatccttaatctctttagacaactctactaaagataaattatttgcaaagcgaatagctggaacgactaatcctttttctaatgcgactgctatgcctaaatgcacatgttcaaattgatgaatggcatcatctatatatgcgctgttcatttctttatgctctctaagcgctaatacaacagcacgagaaacgaaatccgtaatggtaggtttgttttcgtattcgttttgcacaactttcgctatgtctttatgtaatgcaaccta

SEQ ID NO: 843 - DNA, 1784 bp, Bacillus thuringiensis
aaagaaaagaagcctattttttccgatttatttttagatgcagtagcaaatgaaattaatcagttatatggtaaacgtgaacaggaaataaatttgacagatagaacgaaaagaaataaataatttgtcatacaaaaaaataaaaaagatagcaatacacttatatattgctatcttttttattttttcatacatctaattctattacagatctgttaaaggtcatctcttcatacacctttaaattttgatatatagtgcctaataatggtgccgctatagaaaattgctctgctacatccagtaaatatccttgcaagtgcttcccttcaataaacgaacccttctccatatcacgttgcatcgatgacttcatatcatacgaaattttatcaattgttttcatatgttcctgggcaatattaacctttattggagctcctaatactttcataatttgtacagattcctcaaatacattacggataaaatcacggccgccttcactttcacgaattggtccaattggtgcacgcattaacgttgtcacaccggacattacagtaataaataaatatttatgccacatatcttgcgtaatattttcacttaaaacaaaactagatttcgtacctgcaaatgctttagaaatatgctttactctctctgaattttgagacttaatttctccaaacacaagtctgttggcagcgctagtttgtacaatttctccttgatcgtttaacgtcgtctcgataaagcataaaccgccaagtactttttcttcaccgaattctttttgtaatagcgataaatgagcgataccatttaacaatggaatgattacagtattttcgccaacaaacggcttcaaatcttgaattgcctcgtttaagtgatacgcttttgttgaaaataaaatgacatcaaatggagaagttctctcttctttcgttattaaattcggttggaaagagaaatccccgttaacacttcggattacaagtcctctttcctctaattgttttttccgtttactacgaacaagaaatgtaacatcttctcccttttcgactaatctgccaccaaaaaatcctccgactccaccagcgcctaatactaaaatccgcatacagcatcccccttttcaaaatacaattttataacttttagtatacataacattatacatgtcctctgctaaataagctgaattttcactctcaatcgagtataaaacagtggttattttcaaataaatttgggcatgttgtttctatagcatatatggaaaggaaacaatgtagatggaggcaatacaagcaattgaggaaaaagatgtagcaacagctatatttcaatttatattcccgttttcgtttaaagctggatatgaacaaaatatgttccctttcttacaaaaaaacgatttccgtccttttcggctcgatcatctctatgatgaaaatacatattatggggagtttaaagtttcacatcaaaatatggaagcatactatctttcatttacaaataaaattctctttcctcactcagagcatcaaaagggcttgcaacgttattcaaaggaccttaacttaactggacatttaacaacaaaccttatttcaatcccattcaagatacactctattgatgtaacactttgtccttatgaacttggcttcttaacaatttcgaacagaagtaaacactgctccaagcatgactttatctgaagcaatcgaattcgctgctcgcttccgtgtacttgaaactaaaat

SEQ ID NO: 844 - DNA, 1265 bp, Bacillus thuringiensis
taatacaagtacaaatgtaccaataaattcagcgtttgctttttttaacataatttacctcctattaatgcgcatgaaacgtattataacataagttttagtataaagagccaatgaaatactattctgataaggcgaaatagggggacaataaaaaagagtatggttcatctctatagaaccatactctttttttatgctgattttttctgtttaacgactggaacagaacggtttaaaatactatttgcaaccattcctaacatgataataatcattccgatgagagaaagtcctccagggagtgaaccatttaagaaaatgatttcaccaagcacggtaaagaccatcgttccagcttgtgttgcttcaacagctccaagtagagagaggttatcttttgctaagtcagtagcaaagaaaaatgtcatcgttgcaataacaccggaacataatgctaacagaaatccttgaagcatttggttggatgttggaatgccagtagtagaaaatccgtatataccaagcaagattgttataggaagacttccaattgccattcctaatacacgttggaacgtatcaaggcgtccaccaacaagctccatcatttttcggttaccgaacggatataagaaagcggctaatacgacaggtaaaaaacctgaaatgaactgagtcattgtaatatggcctgcggcagttgtttgcatacaaattacaccaagtaaaataaataatgcaacatataagctacgaagtggaatttttccacgtacaagtttcgtacctgattttgtttctattttcacgaaaaatagtggtgatagtagtaaaccagctaaaatcgtaacttgccaagttccagcaacgagccaagctggagaaaagacagctgcgaaacttaataaagaataaaaaccaataccggcaacagaaccccatccgatccatgccaatggatgtttttttaactcttcccataatcccctaaagtttttgcgaaataaaacgataaggaataaaataggaagagcaaataaaaaacggaaggaagctgtccaagcccagctcgttccagatacattcattgctctattaataataaaggttgcagaaaaaaaggccgatgataaaagacctaataaaattgcgcgcatgaagtataacactcctttcgaaaataaataattatgtatagtatgatatacttttaattattaaaaggaaactatttatactttaaggtggttttatatttgaaa

SEQ ID NO: 845 - DNA, 1197 bp, Bacillus thuringiensis
aagaaaacaaatttttatataatccatattatttgttggaaagaggagaaaagagaacagagaatatgatttatgtttctattacatgtggaccgggaagaacagtgcaacagaaaaaagatttgtatcaatcggtatccttaaaaattacggaatattccgatgttaaaacttcggatatttttattacattaaatgagacagctgctgaaaactggtcatttggtcaaggaatagcacaaatggtgaaaataaagggagaaaaaaatgaacttattgaagtacatattaaaaagaaaatgagagaaatgtcacctgcatttgctcattatagtgaaaagatattatttgaggaagtgtggcgggatgccactttaacattaagagaaagaagcttgtgtactgtgtcagcactaatcagtctcggtaatacagaacaattacaatttcatctgaagctagctaaacaaaatggggttatggagaatgaattggttgcattaataacacatatggctttttacgttggttggccaaaagctatggcagctttaaatatagtaatgaatgaaaggcaaagttaagaataatgataagtaagaattcatgtttatatgaattcttacttatcattatttatgcaatactctatcgatatatttattacattttttcttgcttttttatcacttgcgtagtaaagtgatagtaagatgaacgctaggaagtgacaaaacatgcgtgataatacgataggatcattaatatggttacgtttaatacgatttacgaaccaaagtaatcaaatgtcaaatgagtttttaaaacgttttgatttaacgacagctcaatttgatgtgcttttgcaaatacgtacgtatcagccactaacacaaatggagttagctgaaaaggtaactgttacacaaggtggtatttctcgaatgttaactcgtcttgagaaagaaggatatattgtacgaaaacaagattggaaaacgaaaacaattagtcttacagagcaaggggaatcggccttagagaaagcattgccagagcaacttgcatttcaatcttcgttttttgatgatgtattaaatgaagaagagcagaaaatattatacgagctaatgacgaaagttcataagcatagtgaaaaaaaagaattaccgcaggagtaattttttttacactatc

SEQ ID NO: 846 - DNA, 2646 bp, Bacillus thuringiensis
ttagtaaattaattgcaccatttacaccgtttgtcgcgaaagacattcatctaaatttaaaggaagcagcgttcatttagctgattatccagttgtaaatgaatcactacttcaaccgaaattagaagcggaaatggatgctgttttacaagttgttgaacttggaagaagtaaccgtaatcagcattctttaaaagtaaaacagccgctagcagaacttgtattacttgagcataacgagaatgatatggattgggaatcttatcgtgatatcgttatggatgagttaaatgtaaaagcattccatgttgaactcgatgaaacaaaatacacatcatatcaattgaagcttaattttaaaacagcggggccgaaattcggtaaaaatgtgaatgcagtgaatggttggctaaaacaattatcacaagaagaagtacaaaactttgtatcaacaggaagagcagtttacgaagcaacaccaggagaagaagtagttgtaactgctgaagatgtgttagttgagaaagttgcaaaatcaggattctctaatacgactaacggacaatatacagttatgttagatacgaatgtaacggaagaattgttgcaagaaggagtagcgcgtgaattcattcgtgcggttcaagaatatcgtaaacagttgaatttaccagttaatttacgagtcgatgttattcttgatacagaagtagagctacagcgaacgttaacgaaccataaagatttattggaagaaaacttactcgttaaacaatttacatttggtcacttaacgaacgaagacgatgaactttctttaggtgaaacgaaagttcgaattaaattaagcgcggctcattaaaggaaaaggaagttggaataattccaacttcctttttgtatgatggaaatttatccggctaatttcctcataatccattcgataggacctctagaaaatttctttctccataacacactaattaaaatgctgaaaatgaaaaatgcagtagcaaataataaaacgaatagtagtgattgattttccattctatttaatagaattaatgtcccaataccgataaatacatgactgacataatgagttaatgttaattgtcctgtttgcacaatggaagtgacaaaccaattatttctatatttttcagcgatatagaggcaaatgattaatatagcaatagaggatcctgtagcagataaaatatataatacatttggtaagatgggtcctgtattaaataaaaatgtggcggtctctctgccgatgtatggaataaaaaagtgtgtaagtccttttgataaaagttctgtcaatattgtgattgtaataccgagtaagagtaatcttttttttatttttttattatgaagatctaacctgccaattaacataccgattaagaagaacgagaaccaagggaaaatagggtgatagccattaaagaataagttgcgaagaaaaccctttattgtccagaagtctacataatttataaatggagttggacctacccaaccctcgaaagtattgaaagtaagctgaagagattgtgcgaacaataaaataatgatagaaagaaaaagtaatagttttttgcgtactgtcatgagtaatgcagcaacgaaaaggtaaacaccatagtagtgtaatatatccccagtccactccattacatatagtagtaatcctaaaataaataagaaaagtgatcgtttccatatggtctttcggctattagaaatttttatttgttcattgctagcaacggctgacctagtcattaaagttataccgatgccagcaagtataacaaacaaagcagaggctctaccttcaaatagtgacatgaaggttattaaaaaagggggaccatttccttctgcacctgttatcaccatgaaattaacaagtagcataccaaacatcgcccaagctctagcaaaatctaagccgataatgcgtttttttgtattcacttcaaccccttctttcaaaaatgttatttacagcttcaatccaaatttgtttataatctatctttgcatcaatcatcataaaatttccgatattatcaagcactaatgctaacatatgagcttttgaaactagatttttattttcaattaattgaagttcatttgcttttataaggagtacttcaaatccatgtaagtattctgtttgcacagttagtaatcgatctttgtacatcttgtttcttgaagatagtaatacatattcttgtaacactcggttaaaataagggtcgtttcgctgttcatcaattattttaaggccaattgcaatacatttttcaataaaatttgattttgtaaactcttctgtatggaaataagaagagaactgcatagctttacataattcagtaaaaatacattcaattaaagcatctttagacttaaagtagtaataatagatgggttttgcgataccaacctcctcaccaatcatcgtataagttgttttaacaataccggacgtagcaaaaaggcgataacttgcttccattattgaagagagggtttcttcacttttacttatatagaaccttctaaaaaaggttatttaaatgtatcacttacaagtgatttttcaacctaccg

SEQ ID NO: 847 - DNA, 2576 bp, Bacillus thuringiensis
gatcccactttaacacatctgcatggacatcaaattgttttaatatttcatgttctgttcgtacatccgcgtcacccattaataaaaaatccgcttttccatatcgcacctttaaaacaattgaggattcattattttcatcttttgatttcccgttgtttaatacttgtatagaaacatgtggatccagcggtatatattggccttcctttactgaaacgaaaggtatccctctttttttaatattattccgatacgtatgataagtaagagaactatatgtttttccgctatctaatataagcgataccggtatttgctctacaattggaattaaccctcctatatgatccatatcgggatgcgtactgacaattacatctagatgattaatccctttctcaattaatttctgaataataacctctcctgcttcataaggtcctccatcaattaacattgtttgtccatttggcattataataagtgttgcgtcaccttgccccacttttaaaaagctcactttcattttactaagatgttgccgatgcatatgtaaaggagacgtagtatgaatggacatcatataccttttagctgatgcgctatttaaagaaaaacataataaaacagaaactaataataaaataatccgcatacttctcataactcgtctccttttttcatttagtatggcactgtaaataattgatatacaaaaaaagcttagcaaaatgctaagcttttatttcgatatctcttgtaaggaaccgaagaataaatccgcttcattcatttgttcattctcttcagaaagcggtggtaaatcatctaatgttttcaatccaaatgtgtccaaaaattcttttgttgttccgtataaaataggacgccctggtccttctgctcttcccatttcttttataagtaaatgtgaaaccaacgtttgtaacgccttatcggttttaactcctctaatctcttccatttcagtccttgtgattggttggcgatatgcaacaatcgctaaagtttcgagggcagcttgtgagagtgaagcagctgttggtgtatctattaatttttgataatatgaagcatgttctttctttgtagcaaaacgatatacttttgcatactgtacaatttgcaaaccacggtttgcaccttcacattcttgttgcatttcttctaaaatattaattacttcattcatttcaatttcaagaactttcgctatttgttctggataaatcccttcatcaccagaaacaaataaaaggccttcaataattgacttttgttctttcctatccatttcacgagctccttccttctattttcccataaaaatacacatcaaaaaaccgaatcacaattaatgcgttcggttcaatattttttctcttgttccaaacgatacattaaaacatagcatgagataaaatgtttctatcccattttcacatacttgctctatgcagatttattagagcttgatacgaaaatttcatcaaaattatgttcttgctcaattatgatttgttgatttttcataagttccagaactgctaaaaatgttacaaccattatttcacgttcatcatcaacaaacaaatcgtaaaaactttggcgaccaccctttatttttaactgctttaaaatatcagtcattcgctgttcaattggtatttcttgacgagtaatacgtgttgttacaggtttttttgcctttttacggcgcattaatttttgaaatgctgctagcatatcatataacgtaacatcaagaggtaagcttgtctcctcttcttgttgcaacgatgtaaagtcaattggtggacgtgtatatagctgtgctctttcttgttctctttcttttaactcagtagcaacttgcttatatttcttatattcaattaacctctccatcaattcttgacgaggatcatctataaaatcatcaccgttatcaagtacatcttcttcatgtttcggcaacaacatcttacttttaatttgtaataacgttgcagccattactaaatactcacttgcaacatctaattgaagttctttcatcgtatgcacataagataaatattgctctgtaatatctgctacaggaatattatatatatcaatttcataacgatgtattaaatgtaacaatagatctaacggcccttcaaaagcctctactttaaaattatattgcacaaagcatcccaccacattttttctataacaacataagtatagagcatactcatgttctatccaacctttttaagaaatttaattaaaaatagaccgatgcctatgtcatcatgcccaccacttcatatgatatcagtgtagtaagaacaatgtaggaggtcaaaaagctatgggtcacgttgattgtggttgtagcggtgggttcgcattacttgttgcacagtttattttactaattattgtacgagcagcttgcttctgctaatatgaacaataacggctagggggaaccctcctagtcgtttattgttcatatttgtatgatacccttatatgtataaccgttagataagagc

SEQ ID NO: 848 - DNA, 1570 bp, Bacillus thuringiensis
atagaacgtacgcggaacgttgcagagaatgcatttgttcttggacgtaagtgagcgattgtacgtaagtattcaaacgtatgacgtttcttttgaagtgggtaatcagaatctgataaaccctcgatatcaattttttctgctttaatttcaaatggttgcttcgctcccggcgttgcaattactttaccttctactttaactgaagagctaagtggaagttttgcaatttctttgaagttctctaattctgtatcgaaaacgatttgaacgcttttaaagaagctaccgtcgtttaattcgatgaaaccaaatgcttttgaatcacgtaagttacgaatccaccctgatacttgtactgtttgatctgcatacttttctgtatctctatacagactttttactaatgtgttttccatagtgaaattctcctttgctcatatatttaaatacaaaaaaacctttcatccataaagggacgaaaggttaaacttcgcggtaccacccaatttgtcataaagaccaactttaactcgtatgtaatacatacttcccggtttgtaacaggccggattcccgtctaagtctactcttgaatacaaaattcaatttcggttagcaactccaaggtgttcttcacatataccgcctcatcaggctctcaccgtccctgactcgctttggattatagtatatactacttttccttatcatcgtctttcattttgttaaactaaaattaatgtactacattcgagagaaagatgcaaggtgtcggaaaatatatgagcgatttttgtaatatatcgacttaccgacagtgtccgacaaccaatccaataaaaaaattgccggaatgaatccggcaattttctaattacttacgtaactccgcaccgaatttctcttctaccgttgttagtacacggttatgtgcttctgttacttcttcgtctgttaatgtacgttctgcatcgaagtaagtcatagagaatgcaagtgatttcttgccttcttccattttttcaccttcgtataagtcgaatagtgttacgtctttcagaagttctccgccagcttcagcaatgacttgcttcatttcaccagcttttgtttcttttgttactacaacagccatgtcacgtgtcatagatgggaaacgtggaattgctgagtagtaagtttcctcagcgtctgcaccgaatacttttacaagagataattcaaatacgaatgtatttttcacatctaattgtttttctgcttctgggtgcaattgaccgatgaaaccaattacttcgccatctaatacgatgtcagctgtacggcctgggtgcataccttcacgttttgctggtgcatatgtgatttgatttgaaacgccaagcacgtcgaatagtccttctagtacacctttcacaacgaagaagtctactactttcttctcaccttgccatgcatggtgaagagcaagacctgtcataacacctgcaagatgttgttcttctttcggaagttctccttcttctgtcggtaagaagatagaacctacttcgtataaagcaccgct

SEQ ID NO: 849 - DNA, 1352 bp, Bacillus thuringiensis
cggcccaattggaaaaggataagcaatcgcaacagtagatggtgaagttgcatgtgaggcagaaattacatttgcgattggtgataaaaaagaatagatagtactgaaaaatctccttgtgaaaagacaaggggattttttaatttctgctatataacgatgaaacaataatatacaaactaatcagaaaataacttgtaaatagatggaaattaccatatacttactttagtatttatctagaaaacaggataagtgataaaggtaataaagaaataagggcattgtcatattgttaaggtacttaagtaagacaaattagaatgttattgattatgatgagatatggggaaatcagcaaaaatattaattagacgtatgaaatcgagcataagagagagaaaagggaaatgtcgcatttcacaaaaggagattatgaatatgttcgggagaaagaaaagaaaaccattacgacaattaattacacataaagagcctaaatcgcgtattacagaacaataccgtaacattcgtacaaacattgagtttacatctgtagataatcatgttcgttctattattgttacttcggcagatccaggtgatgggaaaacaacgacaatctcaaacttagcagttgttttcggacaacaaggaaagaaagttttattaattggagctgacttgcggaagccgacgatacaaaacttatttgccattcatagttcaaatggattaacgaacttattatcaggacaagcaaaacttatgcaatgcattcaaaaaacagatatagagaacgtatacttaatggcagcaggtccaatcccgccaaacccagcagaactattagggagccgggcaatggacgaggcattgctagaagcatataacatgtttgatattatattaatcgacacaccacctgtgcttgcggttacggatgcacaaatactagcgaacaaatgtgatggaatcgtactcgttgtacgaagtgaaaagacggaaaaagataaaatcgtaaaagcgaaacaaatattagataaagcatcaggcaaaatacttggagtcgttttgaatgataaaagagaagaaaaagagcagtatggttattactaaaatagaaacaggccaacaagaaatacttgttggctttttttgtattcttaaatttatttctcaagttacatagcataaaaagcatgatatgataaataatttggagaatcattggaatgtgttgtcatatttaagattattttgtaagattatacttgtttcttgtgaccaaatatagaacttaattatttaaaaataaaaatggtagattatatgttataatttttcctatg

SEQ ID NO: 850 - DNA, 2540 bp, Bacillus thuringiensis
gtaacaccgatttctttcacaatcgactttgtattacgccaatctgggaaattcgagcaagccataaatttcccgtatttacccattttaaagaccattgggtgattacataattcacaatcttccccagctggttcatctttaatttccacttcacgcatttctttttccgctttttctaaacgcggttcaaaacctacgtagaaatcatcaacaatttttacccaattcgcatttccttcttctacttcatcaaggctttgctccatattggcagtaaattcaatgttaataatttctgggaaaaactctaaaataagttcaattactatttcaccaagttcagtcggaacgaagcgtttattatccaagcctacatacccacgcttttgaatcgtttcaagtgtaggtacatatgtcgacggtcttccaattccaagttcttcaagtgttcttactaggcgagcctctgtatagcgcggaggaggttgtgtaaaatgttgctttggttctaaatcctttgaaaatacagtttcccctacttctaaaggcggcaacatcttatccttttcttcagcaccatcatcttttgactctacatacactttcataaatcccgggaactttacaaccgatccacttgcacggaactgaacattgttattaatgagtctcgctgtcacagtatccattatagcagacgccatttgacttgcaacaaatcgctcccaaatcaatttatataatcgaagttgatcacgacctaagaaactttttagttcctctggctttctcattaccgaagtaggacgaattgcctcatgcgcatcttgtgcatttgactttttcgtttctttcttcttttctgttcctatgtattccgtaccatacgcttcagtgatgtaagtacgagcctctgtttgagctgtttctgagatacgtgttgaatcagttctcatatacgtaataagacctacagttccttgttttccaagatctatcccttcatacaattgctgtgcaagcatcattgttttctttgctcgcatgtttaacttacgggctgcttcttgttgcaaggaagatgttgtaaacggtaatgcagggttacgttttcgctctttgcgcgttacattttcaactgaaaacgcattgtctttcatctgttcaattatttcattcacttgcgtttcatttgttaattgaactttttcaccatctacaccggaaaaagcttggctacaaatgtgtctttttccttttacaaattctgttttaattgtccagaattcttcaggttcaaagttttgaatttccctttcacgctcgatgattaaacgaactgctacagattgtacacgtcctgcacttaatcctttttttactttcttccataataaaggactaatattgtaaccaacaagacgatcaagtatacgtcttgcttgttgtgcatccactaaatccatattaattgcacgaggatgtttaaatgattctttgatcgcatctttcgtaatctcattaaacacaacccgacaatctgattcaacgtccacatttaacgtattcgctaaatgccaagcaatcgcttccccttcacggtctggatcggccgcgagatagactttctttgcttttttggccgctgattttaaatcttttaagacgggacctttaccacgaatggtaatatacttcggggtgaagttgttctttacttctatccccatttgactttttggcaaatcgcgaacatgtcccatagacgcgacaactttgtattttttccctaaatatttctcaatggtcttcgccttacaaggcgactccacgattacgaggaaatctgacatgctagtgcctccttaagaggaggattcaagtcttcattaatcttattgatttctcttgtttttgtcaatcaagaatgaatataccatacagtgccaatctaccatttgtcaataattgtttaataaaaacataaaaatataaggttaatttaaaatctcttccaagatatcttctgcatttcttactagttttgctccttgctgaataagatgattcgttcccgatgccccctctataaatataggtccaggaagcgcaaatacctctctactttgctctaacgcaaggtccgcagtaataagtgttccacttctcgatttcgcttctacaactaaaacacctttacttataccactaataatccggtttctttttggaaaataccattttttcggtgcatagtgcggcggatactctgtcaataacaatatatattccttccacatttcatataaaggtctattttctttcggatacataaaagacaatccatgccctaatatcgcaatagtcgggcaatgatgtcttactgtaatctcatgagacattgtatctatcccttttgcaaacccactgacaataagccactctctttctaaaaagggtgtaaaataaacttcaaactctcatgaccatataatgatggttctctcgttccaacaactgctaatttatttacttta

SEQ ID NO: 851 - DNA, 2132 bp, Bacillus thuringiensis
cttcggtacagcatctcaattacatcacaattcgcctaaagatttattatgtaattcagtataattttctaaagtagcatttaaattgtttacgtatgtcgcatggtgctttccatgatgaatggcaagtgtattgctatcaatatgtggctctagttcatcatagtcatatgaaagctttggcaattgaaatgaagacataacattccctcctttcgacttaaaaagttggtctaggtaaaaatactttacctgagtcaaaaatacacccattttccatataagtcaatagtaattccattaattttctgaaaaatattacaataaaagtaacactctcactttcatttgtgactcctatcctttttgcttatactgtaaagtagcagggttttgttgaaatagaaggagattgtttatgagtaaaacgaaacaattaatagaggaagcaagtaattttattacgatttgttataaggagcttcataaagaacaattgatagcagaacgtataaaagaaattcaaattgagatagagaagacagggacatatgagcatacatttgaagaacttgttcatggttcacgaatggcatggcgtaacagtaatagatgtattggaagactattttggagtaagatgcacatattagatgcgcgcgaagtaaatgatgaagagggtgtatataatgcattaattcatcatattaaatatgcaacgaacgacggaaaagttaaaccaaccattacgatttttaagcaatatcaaggtgaagaaaataatataagaatttataatcaccaattgattcgatatgcaggatataaaacagaaacgggagtgattggtgattctcattccgctacatttacggacttttgtcaggagcttggttggcaaggagagggtacgaattacgatgtattgccacttgtgttttctatagatggaaaagcgcctatatataaagaaattccgagagaagaagtaaaagaagtgccaattgaacacccagaataccctatttcatcacttggagtaaaatggtatggtgttccaatgatttcagatatgcgtttagaaattggcggtatttcttatacagccgctccgttcaatggatggtatatgggaacagaaattggggcgcgcaacttagcagatcatgatcgttataatttacttccggctgttgcggagatgatggatttagatacatcgagaaacggtaccttatggaaagataaggcgctaattgagttgaatattgccgtactacactcctttaaaaaacaaggagttagtattgttgatcaccatactgctgcacaacaatttcagcaatttgagaagcaagaagctgcttgtggtcgtgttgtaacaggtaattgggtatggcttattccaccattatctccagctaccacccacatttatcataaaccgtatccgaatgaaattttgaagccaaatttctttcataaatgatatttagtgtagtttttttctgtgaaatataatttttttaattactgttatgtagcaaatggaagcctttactctcggttatttttggaagaggctttttgaaccaaggagttccttatgttataatcaaatttctgtttcgaagaccttatagaaatataaggtcttttgttttgcttttttatgtaagaggaagagattctttctttttaataagggatttggcatatttttagggacaacataagtatgtgggaagtcgataaaatgttatgcatatataattattgtgttttggttttaaacaataaaacataataaagttgtttttttagattgctgaggaaggaggaagtgtaaatgaggatgaagagtcgaaaaactgattggcctgtatttattattagtggtgggtcacttttattatttgtaattgccatttttttgatcagggattatgtatagagtgcgattaataaaagtttcgcttttttcaattaattattttcgggccttctgggcaagttttattatttagggacctttattggttccatttttttttgggttcctccaaattatgggagagtctacgcctggaggattagaaaaaccctgagatttgtacggccattattggctt

SEQ ID NO: 852 - DNA, 2160 bp, Bacillus thuringiensis
aagccctctgtttttattttccagagggctttcatcttagtatgcttctaaaaactcagtaacttgctcttctgtttttgcgttagcactatgtaagtggcctagcttctcaccgttttggtatacaagtaaacttggaatacccattacttgatactcttcagcgatacttggaaactcatctttattaatagaataccattcaaatttattgaactcttccattacatctccgataaagttgtccatacgtacgcaatctgggcaccatgtagtaaagaacttaacaactactggctcctcgcttgcgatgatgtctttgaattcttgttctgttttaatttctttcataagtaaaactcctttcaatatcacacgaatttatatgcaaaattcgcatttgcaaacatgttgcaaacttattatttgttttttagttttgtagttcgttcacacttataaaattgtatgtaacatggctgcgctactaagtgtgaaaataacggaacctcacttttctttataagctttttccaggattgtgtcaaatttttgaattttatacagaaattaaagaagccgacactttgattaagtatgggcagagtgactaaaattaatcgcttattaatttcgaataaatatttaaatcgataagctttccagctgatttttcgctttttctcagagtaccttcaaaagtaaagtttaatttttctaatacttttatggaatttacatttgctggttcaacttttacaaaaattgaatcaggttagaaattatatggttgtaatgggaattgagggatatgaataaaaaaattgtatcccgcattaacgggcagtaagacccccactgattaaagtttcactttattagggatttgccttaaacatttattacagtcaagaatatttataataatatgaactaaaaaaggtccaatttttgtaatgttggaggggattattgtggacataactcaaagcgtggcaagaatagtgattaatgggaaagacctttctttcacttcagttcaaacctctgcatggaatcatggacctgtaaatgatttaatcattacgacgaatcagagggtgaatgagctttttcaattcatgtggtcacaagtaccggttacgatgtcgatatattttcttcaaggggcggatttacttaggttcgttagggttgctggaatcgatgagcgtgtaacaggagaatatgtatatcatttcatttggtaataagaagaattcaaagtagtctagcagctactgttttattttgtcatttgaatataagcgagcggactagcattatagtacccaatgaaataaagaatcataatataatgtgtaacaaattatacggaagtgagttgaaaattatgttttattcatatattaattctgaagctggcatgcgaccagcgtatggtacgtctataacgtatagtggagcacaaagtacagtccaagctattcagcaagcattacaaatgcaacaacaaatgcagcagcaaggagtacaaccatattactcatccgtagagtatttttatccagtacatcatgttacaccgtacggaagttcttttcttactattccatatggaactatatacaacttataactagtaaggaatgaagtggtttatataaataagggtgcagattaatagcgcccttatgaataagaaaaatagctagtccaaaccttataaatcaatcttacataatatgtagtaataagtttgaaaggggaattagtatgtcttgttattactactgtaagtattgtaaggagtataaaaagaagcatcatgattgttgtaagaacactagtaagtgtcatgataataaggacaatcttgttagagcatcggcatttagagctagaaatactgtgaatcaaaatgttcctgctaatacttttgtgaaagtgttatttcaaaatgaacaatttgatttagcgaatgagtataatccagcaacatctatttttacgccgaagactaaaggagtatattctattattggaacgattggtttctttccaaacgatccaactttaaattatagagcgcgtgtacaaattcgtgtgaatggaaacgcagcgatagctatcgataatgacttttttggtccaataagt

SEQ ID NO: 853 - DNA, 2096 bp, Bacillus thuringiensis
ctacatttttaggtgatgcaattaaaggggcaatcgtagtttctattgcaaaatacctttttggacattctacatttgtaatgttagctttactagctgttttactgggacatatttatccaattgtatttaaaggcaagggcggaaaaggcatatcaacatttattggaggattaatcgcatttgattatttgatagcgcttactcttgttgctgttttcattatattttatttaatttttaaagggtttactaagccagggttaattacaattgcttgtttaccagtttgcatgattttgtattcttattctattattacgactattttaagtgcttttatcattgtgcttattttatatgtaaatcgagactgaaacgaaattttaataagtggagtaaatctccacttataatttttattaaatacataaaggagataagccatggggttaatttataaagttgctgatcaagatcgggaatttgaacgtatacataaattgaattataaaacatttgtagaagaaattccgcaacatgaagaaacgaaagagcgtgttcgtatagatcgctttcatgatgaaaatacatatttaatttgtttagatgaggatagattagtaggtatggtcgcagtgcggggaaaacgaccattctcgttagattataaaatctcaaatttagatatttatttgcaagagcatggagaaaaagtgtatgaaattcgtttactttcagtagaacgtgaatatagaaatggaagagcgttgttaggattaattcgttttctacatcgttatttgcttctaaatggatatgaattagcactcatttctgcaacaacacgtgaactacctttatatgagcaaatgggattcaaatcttttcatacgttagttggtacagaagaagcagccttccaccaatgtatgttactcctgctatgttaaaaagtcaagtgttgtaggattatgacgaaagaatatacgtttttacctggtccagtagatattgaagagaatgttcgaaaggcattttctacgcggcctatttcgcatcgctctaagtcatttcaagtgacaatggacaatgtgaaaaaacggttacttcacatgacaaaagcaaaacatgtacagcttatgttaggaacagggacgttagcaaatgatgcgattgctttacagttacgttctttaaaagggaaaggactaatattaacaaatggagaatttggaaatagattagttggacatgcaaaacgagcacaattacattttgatacgtataaaaaagaaatgggagagccgtttatttataacgaattagaagaaataataataactggaaattatgaatggctttggtttgttcatcatgaaacatctactggaatgttaaacgatttagacgagctaaatactctttgtaacgagaatcaaatgaaactatgtgtagattgtataagttcaattggagcaataccattagacttgaaggatgtgtattttgcaagtggtgttagcggtaaagcgattaaatcatatacaggaatttctttcgtttttcataaccacattgtaaaaataaacgaggctgtgccggcctatatggacattggcatgtatgaagaaaatgaaagcattccatactcacaatcatggaatttaatttatgcattgcaagaagcgttgaagagatttgaagatgaaaaggcatttgtaaaaattaaagagacatacgattatgttgaagaagttattactgatatgggtttaaagcttgtttcaactaaagaacacgccgcaccaattatacttactattgtattgagcgaagagcattcttctaaagtagtaggcgatgcattagcattacaaggatacgttgttcattatgagtcatcttatttacaaaagaataattggattcaaattgcatgtttaaatcattataaagaacgcgatatgaagaggatgttaaattgtttgcaaatatgtttatttcagagtggggtacatatataaagattttctcttttcgtataaaggagctacgacttacgaaaacttagaaatagaactttggaagaggtg

SEQ ID NO: 854 - DNA, 1664 bp, Bacillus thuringiensis
tactgttccccttggtacacattttttacaatgccataattagttcctggacctttacgaacacgcaatacatccgctttaatggtaactactcctaccccatcattgactgtttgtgcagttgtcggtgtactttctccactataaccaatatatgatgaatcattataaatccactgatcgccaccaaggtttaaccagccgtttgattgtccccataccttgtaggactctcctttccctaattgacgaataatcccgtatccagtacctggacctttacgaagattaacgctatttcctccgatatatgcaatacctgtttcaccactgaaagatggagtaggagttaggttaattagactactacctccattatatgcatgttgaaccctttcaataaagttattccaacgcccctctgccaacatacgatgaggacagtactttccactccatgattggtgtgtacgaactttatgaattggaatattgtactgtttcattagttgagctacaacgatagttgcattgtcttccgctttataatatctatctccaccgcttaaagagtagcaaatttcaaccccaatagatttacgattaccattcccgttaccgtcgccagtatgccaggcgttacgctctaaaggaattccttgtacagcttccttatcatctaccgcgatatgaaacgatacttggttgtcattacgaatcatataagctacttcgttttctgctgtagcatcgttgtacgtattgtggactgtaatgaattctggattcattgtatacggacactttgtaccatatttacttgggtcaactaatttttttctaatttccattattgaacatctccctttttctcttcttgtttttgttttccacccaaaatttcaactgcatttgttaaagctgaaggcaaaggtactcccatacgccctgcattttctaaaagtgaaagcaactcatttccaataaagaaaaagatcgtcgcttcacgaatagcgctattgcttcctagtgccgaatctagttgagctgccgctcctaccaaaagaaaaagcaccacctttttggcgatgcctttgaaacccactttactttttaattctccgttatatcctgctgcaatcatgccagttaaataatcaataactgccatcgtcactaagattttcaatgttgtatcccatcctcccaagaaatacccgcaaaagccaccgaaagtggcaataaaggtttttaataatacctcaatacgacccatcttttcatctcctcgtatgattaagttaggtttttagggacgggatgtacctataaatccaagggtatctatttttatgagatactaatatttgtagatagagtgttgccgaccatctccctgaatctttgtattcgtaaaaaagagcggtacctctgtctaataagtagtttacgaatgagttggatgttgatgaccattggtcattcttcgtatctcttacgaggtagtagcgcttattagttcaggggaggaaagcactatctaacactaattattagggggtgtaagctatgttcatttaggtattgatatcgctaaacaaaacattatgcgtccattttcgatcaaacgggaaaacctattataagccatttcttttcagaat

SEQ ID NO: 855 - DNA, 3056 bp, Bacillus thuringiensis
gtcacaagtttttgatgtacgctcatatcatgcagaactaaattgattacattacaagaaattgaaaaagcattaggaaaaccatcttcagttaaagagaatggtgaagataaaatatatgtatacaaagtaaataaccagtatgagctgaaatttgtcattccaaaatcgactggtaaggtagatcatatttctgtattttcaccagaggatagtattaataaaatggcaggataagaaattaagtgatttcaaaaacacctcactttccttaagtgaggtgtttttagttgtaaataaggaacgtctcctgccatataaaacatactttcatacgcgaaatacttcacttttgttttttaatattcatccaataagaaatattgatctactgaaaaagtagtaacctataaattatgtgtaggctggttcatgatttttttacgttctaaattttgaacaaacagtgcttgaacaatacctccaattaataagaaactagcacaaatataaaacagcatacttccatttaacttacttaataaaactgcacccataactggtccgcacgttcgagatatatcccagtgtataccgtaaattgaaaaatataaaccacgtttattgtgaggtgcaatttctgaaacgaatcgtaataagtggtttagagcaatactttctccaatgactaaaaagagtaaggtgaagaataacgacaatatcgtcgttgaagaactaaagccaactgcagctattgtatagcaggcgtaagaaataaggatgattttcgccatagaaaatcgttcagaccattttacgaggaagatttgtagtatgatttccaaaatggctttgcatgttgaaataaatgcgagtatgaataagagattaggaaatacatgttctgcaaaaatacgataattcgtctcagtttgtgcataaaaaaagctaataggaagtgtagaaaccataagaccgaatatggcataatgtttaaaaataaattgctttggtgaacttgcctcaactgtttgtttcgacttactcataggtggaacggtttctgggagctgggtccaaacaacaacggcatatatcgtaagggttacactttgcacgataaataaatattctgggtgagtattataaaaacatgcaccgattaaagggccgattacggatccaattgctcccatcgtttgtaggagagcaaaaatttctgcttgctgctcttgttttgttaaatcagcaatttgtgcacgctgagctggaatgtataaggaacggccaataccattaatgacatataacagtgcaaatataaaaacagattgagcgaaaacgaaactgccgattgcaacaccttgtagtaataatccgagtaacataatcttttttcggccatatttatcagtaattcctccagcaataagtgtaaataaaatgtctgaaagtggctgtaatccgaaaattagcatagttattattacattgccgtttaacattttattgacgtaaataatcataatgagagctaacatagattcagtcgttcgggttaataattcaccacacaatctaataaaaataggtttattgtaacgaagtaagagataattcaatattaattcctcctttctatattgaaatgataagatgaaaggagagttggaaaaagggtagagactatagggaggatttttcaccttttagggggagtatgatgtttattttagatcaatacattgaactatggattgcttatggaaaaggaaaaaaagagggagaacgattggaagtaacagtgcaaaatatatctggtacattattttgtacagagcgcaatagtaaattaattataaaaaaattagatgagttaaattggatcaagtggtttccaggtcgcggcagaggaaatcggtctaagttaatattttaaaagcacccgatgtctttaattttagatagaggaaaagaaataatgaaaaaaggggatgtgaaaagcgcgcttatcttcgtggaacgctatagctcacattttccatcagtaaagggagaatatcattcctgggtggattcaatattttggacataaggttgaaatgacatctgaagggagaagagatgtactccggttgcaagtacaaatgaattgagatatcacattagatcctgtatacgctacaatgcgctcagaatgccatatggtaaaacatatattcgacacactcgtgtatgtagacggtaatacaaacattatagagccaagacttgcatttcactgggaatataatgacgctgaaaaaatatggacgttttacttacgaaaaggagttcactttcataatggaaaacaacttactgcacatgatgttatatactcgttgaatagatttataaagctggaaaataatgcacacgcatggatgttacaacacgttgaaagtatccgttcagtggatgactacgttttcgaaattcaattacatacagaaaatcgaatgtttttacatatgctaagtgcagaacagtgttctatcgtgaatgaagatgaagcaggagggctaattggaaccgggccttttcaattatataaaagtaatgaaaatctgttcattttagaaggacatcctttatattttcgtgaaagaccttttttagatcgtgttgagttgtggaatgtagaacaaggtgtaggtacatacgatgttttagtaaaggcgcagtataaagataaagaaaaacataataaagaattgtctcggcttgagtcgaacgtgacatatataacatgtaatcttacgaaagaaggaccaatgcaagatgagttatttcggaaagcgttatataacatcattcatggttatacaatcgttcaagaactcggcagagaacgtggagaagtggcaaaaaaactaatattagcaggtgaaagcattgtagagattgaggaagatgtagaaagtttaattaaaaggagtacttatcataatgaagtgctacaactctacacatttacaggacgagatcatgttgaagatgcacagtggatacaa

SEQ ID NO: 856 - DNA, 1545 bp, Bacillus thuringiensis
gccttgacatccttgttaagggaatgaccatccttctttacagaagataatttttgttgttccgtattaagtgtgatttgtttttctttaatcatttcttgttggttattcagagaatattgaaggacaaaaattataggtaatataaaagccaaagtagttataatacggcgtcttgttttttttatactaccttgttgggtattaggattcacttgctgtgagggtatattaggatttgattggtgtgatgatacttttgggatgtttcccattaaaatgcctccattactgattgtcgaatttaaaccgtttaatagtattataaatgttcaataaggattttagaagatattttaatataggtgagttttgtaaagtttaaacaaaatctttatttaaataaaagaaaccccgcttgtctctggggtttctgaaggcaatgaaagtactcgactaattaaagattccatgaattttttgctgaaaatactggtgaattcgtctgaagtaatgagggcatctaaagctttatacgtacgtgaagtaattaaaaatcgatttataagagttagcttgttttttcttaatagcccacctaatcagtaaagacatatgtctgttgaaatctttacgtgttcattgataaaaagctgattatattcagtcagctttttgtataatacattctagtatttatcggttccaaaagacatattctttcctttaagttggcatcgaaaatattaccaatttttccttttacaatggcaacaaataaagaaacatttacaacgacacttatttcgtttagaactccaatcatcatcacgatgacacttttctttagatttccaccaatcatcattacaatgtttttcctgagaactccaatcgtcatcacaatgacacttttctttagatttccaccaatcatcattacaatgctttttctgagaactccaattatcatcacaatgatgcttttctttagatttccaccaatcatcacaacaatgctttttctgagaactccagcaatcatttttccaggacatttatttctacctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaaactggaaaacctattactaagccatttccctttcagaatcataaagaaggcggacaagcactgttaaattggatgtaccaatatattgaggctcctacagaaatactgattggaatggaggcaacaggac

SEQ ID NO: 857 - DNA, 3190 bp, Bacillus thuringiensis
gcaggaagtgcttttccaaagaatggtaggggggtttggatggaggatttggtaaatgggtaggtagggcaagtgtgaagtatcggtttagttgtttttgcattaggggcaggggtatattgcacgattacgacgcgctttttgcaaatccgttattttaaagagaatgattaagctagtatttgaaggaaagagttcagagacgggaatatcatcttttcaggcattttgtttagccttatcaggaagagttggaattggtaatattgcaggggtagcgacagcaattgctttcggcggtcctggagctgtattttggatgtgggtaatggctttgttaggggcagcgagcgcgtttgtagaatcaacattatctcaagtatacaaaagtaaagtagggaatgaatatcgcggcggtactccatatttcattgagaaaggtttgaaaatgaaatggtttgcagtcattgtagcagtagttgtaacactttcatatggcgtgttattaccaggtattcaatctagtagtatcgcagttggatttgaaaactctaatggtattagcaaatatataactggtatatttttagtcgtgttactagcagcaattatttttggtggtgtaaagagaattgctggcgtttctcaaatgcttgttccatttatggcaattggttatgtaattgttacatgtatcatattaattgcgaatgtaacggagattccaagtatgtttgctttaattttctctagcgcatttggtgtaaatgaaatgtttggtggaattgttggtgcagctattgcatggggcgtaaaacgcgctgtattttcaaacgttgctggtgtcggagaagcgacgtatagttcggcagctgctgaagtatcgcatcccgcaaaacaaggattagttcaagcgttttccatatatatcgatacaattgtcgtatgtacagcgacagctcttatgattttaataacaggtatgtataatgttatacctgaagggaaaaccgccattgtacaaaacataggaaatgtggaagctggtccaatttatacacaacaagcagttgaaactgtgataacagggtttggtccaatatttatttcaattgcgattttcttttttgcatttacaacgttactcgcttattactatatcgctgaaacgacacttacttatttagatcgtcaactgaagtatggctggttaaaaccagttttgaaatttggatttttaattatggtttacatcggtagcgttgaatcagcgtcgcttttatggaatcttggagatttaggaatcggtagtatggcacggttaaacttaatcgcaatcttacttttaagtacaaccgcattaaatgtgttaacagattatgaaacgcagaaaaaagaagggaaagatccagtgtctaatcctaaatatgtggggattgaaggattaacattttgggaggaaagaagtacagaggttgaaagaaaaagttctagagaaaaagttattgtcgatgataatttaaaattataactcaaattaattgaaaattcttaatttaaaagaaggtatattgcctccatttcatcacatactacaataagtatggataatatgactggagggaataagatggaacatgagcaacatagttcgataaatgatattctacatcattataaagaaggtataggtagttttacaaatcaaattcctgaaatcgctgagacatataatgcgttcacgcaagcttgttttcaagagggttctttaacaaaaagagaaaaacaacttattgcattaggaattagtttagcaacgcaagatgagtattgtacaatttatcatacaaaaggttgtcttgatcaaggatgttcggataaagagattctggaagcatgtggtgtttcagcagcatttgctggcggagctgcgatgagtcaagcggtaactttagtgcaagagtgtttaacagaattgaaaaatcaaaagcattgaataaaaaaacgttttaaactttatgtttaaaacgttttttatgtgaaattaaatttaagtataaaaattatctaggatgggttcaatttatggttatacaataatggagaattttaaatttagtaggaatgagaaataaaaactatttatttagttttaaggttttgtaaaaagcttcaattgtttcatataatcaatagcttttgttttgtttttctgtttagaaacataatgtgcctcattaaaatctctatagtaactgttaactacttcttcagaaagagcaccgtcagatatagctcttttaaccgcgcagtttggttcatttgtatgtgaacagttagaaaatttacatctcatagaaatctcttttatatcttcatagccaaaatcaaaattcctctcaaggtttatcaagtcaaatcctattttactaataagaaatccctccacttttgaaagagtcttttagaaacatacatacaaattttatcgttttcaatttgtattcactttaatattctatatcttcataaatagatttttctacatcaggaagaactgtgtatatactcttaccgattaaagcttctaattctttcttaatcgcataaaaccctttccaatgtaaagatgtatgagatgttgtaccatgacgcaaaccaacagaaattaatcttctttccagcgtagtaaagccatccgcatcagcaagagcgtcacaaagagtaattactttattgtataagtcgtagttacaatgttcatttaatatttcaactaatcggcttctcatatggtcaggaacgagactccattctgctgcgatatctatatgttcatttttgcatgggaatgagtgtgtcacacaaataacagcgtttcctgtataccctaaatcattcatatacatataaccatcataggaatgaatgaccgatttggtaaaacctttgtatcttccgatatcatgcaaaagggcagcgttatatgctatgtcagcatctagcttgtacccttttttataagttctataattatgttttcagttgcatgagcaacatgtagtgaatgttcaaaccaagggcccgggttttgttcatatgcccattcgagtaattctttgcgtacattctatctaatatatatttcatatcgttatcctttcacaaaaaatcatatcttaactataaa

SEQ ID NO: 858 - DNA, 2057 bp, Bacillus thuringiensis
  unsure (1)...(2057): unsure at all n locations
tcaattttctaggtaaacaatttgcttctgcaccaaataagttccatgcattaacgagccatgatgaagttgtatatactcacggtgcattaaaagcattagctgcggatctaatgaagatcgctaacgatgtacgttggcttgcaagtggtccacgtagtggtcttggagaaattattattccagcaaatgaaccgggaagctctattatgccaggtaaagtaaatccaacgcaaagtgaagcgttaacgatggttgtagcgcaagtaatggggaatgatgcaacaatcggatttgctgcgagccaaggtaactttgagttaaatgtatttaaacctgttattgcttataacttcttacaatcagctcacttattagcggatgcaattgtttcgtttaatgacaattgtgcagttggtattgaagcagatgaagaagtaattaatgaaaatgtgaatcgctcactaatgcttgtaacagcgctaaacccacatatcggatatgaaaatgcagcgaaaattgcgaagcatgctcataaagaaggattaactttaaaagaagcagcattgcaatctgggctactaacagaagagcaatttgatgaaattgtagatccaaagaaaatgattgctccaaaagagtaatagaaaaagccagggttcttagtatagaatcttggcttttttgatgttcatttttatgtttcatctacttgcaatactacaagcttcaaaatatattatttgttagcaggcgtattcattactttcatctgtgggcagttctcttttaagagtgaaatgaatttttcttcttctagtggtatgaaagtggtcactgagtcaaataaattgtaatggatttctaattgttgtctagtccatttttttgaatgaagttttttaccagagtatttaacgtgacgaatatcttcaaatggaatttcagtatgaaaaatgaaaccgtgttttacaacaagagatgattccgttacgttgtagtgagagaaatagaatgaagaaagattcacgatatttagcagcatcatgagagtgaaaaaaatagaattttcattttggaagaataacgaaacgaaaaaaataattataaataatgtaatgaaaatgacgtggaatggattttttttcgctttaaatttccagttagtcacctcggtatacttgttctttaactaaaataaatcataacattgtgataaaacgtgtgaatatgcagncttgcatattcacacgttttattattcatgtaaaatttcttgatgggataaattcaaaagaagttttgtaatagtggagtggcataaagtgacttacaagaatagaaagatagcgttagtcataattagttgtatgatgattatgagtagttgtgctaataaatttgttgacgatagaaatcgaaagcatacatttgtacaagcaagtaaggttttagtagagactgtaaatagaatatataaaaagtaaaggatgttttcttatacgaaagcatcttttttgtagttaaaattgaatactgaagttttgtaatgagtgaataccagttccatattcactaatcgcatatgcgttctgtgccatttacttaacggtaaaccaagggtcttgaagaatattcatgttctattttacatcctataaaatgaatttgtataaacatattcgcttttcgttgtattaaatcctttcgatagatgtttttataaaagtttataaaatgggcaaacgaaacgttgaaatgtttgtttgtgttgtgataagatgatgaagtaataataaacgatatagcgatttgtttggtttttaaacaaacattttgaaggagtgtttagtatgagcgatatttcagagaagttttgggatgcgtcaatagaggaattaaagaaagggtatgtgtttaatgaagaaaaagaggggtacatttgcttagcttgtggtgaaacatttattaaaggtgttatttatcaagataatcaagttttgtatgaagcaaagaagttcgtccaattgcatattcaaaatgagcatacgatcacg

SEQ ID NO: 859 - DNA, 2548 bp, Bacillus thuringiensis
caccaagtgcacgtcaatagtcaaaaggagattcaaacaaaaaagactcaaatgtgaatcctgcagaaacgactccagattcagaaccgagtgcaccagacaccgcaccaaaaagtaataaaggaagctttatgaaaggtttattactaggggctctcggtcgttaactaatgggtagcttatttgcaaatatgggagctcttggttctgtattagcatttatggtaaatatgttagtaatggctggtatcgtaatgttagcagttcgtgcatttaaatacttcaaagaccaacgtaagaagaaggcagatgaagtagcatggaaacaataaaaatttctgaacaagagcttataaatgcgctttgtatatatatcgctgaaaaaagacaagtgggtccagaagatgtattagttgaactcatgtatgatgacgactaccgtttctctgcggaagtagaggtaaatggtcgccagcaaattttaattcaagcaaacttaatcgaagctttacgcttattgcttgacagagaatataatgtcaatccattcgcagcgagattacaacttgaattagatgatgaagaaggcatttacgcattagcgaaatttaataactcagatgagtagagaagagagctgttgagaataatctcagcagctctttttagtatgtgcatatgtagatgagtaatcacgccaaatttcattcatctttcgtctaccgatatctaccatcggattaaactgaattgcagatttctgacgaacaaagtgaacgttttgaatggcgtgagataattgttggtcgactatatcacgttttttgcttgcatatttagcaatagatagacctgcaactgttccttgcgccatcgcaatttttccgctttcaatgcctgtaatattgccagctacaaataaaccaggaagaggagtttccattgtttcggaatggagaggaacgtgtccacctaattctgaaatgtaatggaagggacaaccagctacagctgcaagttcggcaagtgggtataatcccccggcaatacaaacaaaatctgcttcatatattttctctgatccattaataacatttcctttagagtcaatattagcaacacgtacaccttcaacttgatctgttccgataatttcaagagctgctttccgaaggtgaagtggcgttccgtttattttcattccgctgtttggatagaatgttaatccagcttttcgaacccaatcatatttcataaagtggctacctattcgcaaaatagcagaaggagcgagatgtgctgcatttaaaagagagtttaaaacttcttcaggttcaccagctttttgacttaactcgcttttctcagggagtacaatatgatccactgtaattcccgctaattgcaattcacttaaaatggcgaaagacaaaatgttagcaccaataataattcctttttttccaacttgcacgcgatgaacatttgtcataacttgagctgctccaattgacatcactcctggaagtgtccagccaggaaggggaatagaatattccgcagctccagtagcaagtagtacgaaaggcgcttctaacgtaccgatattagtatgtacaaaccaattgttttcatctctatctaaattatagaccgaaacaccgcacctgatatgtactgaaagtgattctgcttcttcatgaagtcgcttcgattcttttattccgttccaccattctccagtaggctcttgatgcaactgtcctaacaatctcccgcccggcttcataaattcatcaataacgagcacttttagtccgaaacgagcacaagaaatagaagcagataatcccgctggccctgcaccaataataattacatcactcatcgttttttcaccatctctctcacgatattcggatgctgtttcccgctttcaacaaccatgttttcttctacaacagttaagcatgcgcgtacatttgtttgattatttactgtcatgcggcattcggaacagtgtccgatattacaataaatacctcgcggtgttccgctatcttcatgaactcttactgtcctaattccatttgctaacagggcagcagctatcgtttcatgttcatatgctccgtattgatgaccgttaaattgaaaggtaatacgctcactactttgtaaagtacctaaaatagggtgatgtgtaattctactcatttactttcacctaccgatccaaaagtaactgcacgtattggtggttgatattttaacggtagttcattaagagttacgtcaggattcgcattttcaatcattcgatctatcattattctgcatgtgcgaccaccgcaaaatcccatgccagcacgtgttcttagttttaattctcttgccgagcagttatattcagcaattgtcgattgaagttgcccatatgtaacctcttcacaacgaccaacgattaagttgtttttatttgtcatgtgtattcctcccctagttcggttttcacaaattatatatgcaaaaatcatgcccatataga

SEQ ID NO: 860 - DNA, 1568 bp, Bacillus thuringiensis
taggatctccatacacatttgcctctgctaactgcgtaacgtttcctacttctaaaaaaacaccacccatgaaatagattccttttacatttagcattaaatcattccataaattaaaagcaattgctaacgaggtagatcttcctacatcaacaattgtcaaatcttttccgtactttataagaatcgcagcaatactgccgaaattatatattggaatagataatacattttctggaacatggataggccctaatccttctgctccgtgaatttcaggatagtacgtagtaatttcttctgtaagtggttttgttgcaccactaatgacaggaatgtcttgtctatttgctaactgcaaaatatacgttgcattatgtgcagcatgtatatgctcaacatttccgtatccagttacaataccgacaatttcaatttcgggatgcagtaagccatacataatggcaaatgagtcatcaatacctgggtctccgaaaaataatactttttccaagaaatacgctcctctcacgaaaaaattgagtcattagtaactatgtatatgaaaaaagcaagtatatctatgcaaattttagaatggataatgttttacaaaatattaaaaaggaactagcgtatgctaattcctttcttgagtaaccattctcaaatttaattaattatcgtatccttcataaattgcatcatttatttgattttgtatttttgtatcatcaggtacaggtttccaccaatttcctgtaataaataacatagttaataaattataactatcactaaaataactttctctcttattcttcatccaatcccaaccgctatttacccacttttgattattgctacttgttatacttgcagcaataaacggtgaaacaaatacagcagttgaataactaccaatattagatccatttaattgataaccatccacaattttagaaggatttccattcgttttattttgaatccacgaagaaactttatcagaaatgactttacttcttttctcgccgtacatcgcatagtccattacaattctcaatggtacccgactagcattgtaataatatgcatttgtatattctgactcatctaagaagtctttaggtgcgggttgtggtgggttttttacaacgaaatctgaaataagtcctgtatttggagagtatgtattactaaattgcgtataaacatcgtacaaattattaataacagtaagccaagttttatcacctgtaaattcataaaatgctctaaggtgtgacatcatccaatcagatggtctcgtatcaagtgaacttttagaatcccaatctcctaaatttagtcggttattatttgtaacattactagctttaataccttttgtaatcatgtcttgtgcttctttcaaataattaactgttccattagatccccactgcttatgagcaagaagaagagaatacgcaatatctaaatcttcatcagtagcagaatcaaatgaccttgtgctttttactatctgcgacaacccatcccattaaattaggattttgagaact

SEQ ID NO: 861 - DNA, 2365 bp, Bacillus thuringiensis
atggttgctgttgcgcaagtaaaggatattacagcagagccgaagcgtttcgatgttaaagtgaagcaagttgatggttggtacatgtctgaagaaccaaaatcggcttgcgttcataaagatgaaagcggagacattgttgcgttctctccagtatgtaaccctttaggatgtacagttaactggaattcggacaaagcacatccgaatcaattcttttgcccatgtcacggggggcgttatacaaaagatgggattaacattaaaggtacgccaccccttgctccgcttgatgtgtacgagtctaaagtgaaagatggaacgctgtatctaggaaaagcgaagccaagagggggtgcaaagtagatgttaaataaaatttatgattgggtggatgaaagattggatattacaccaatatggcgtgatatcgctgatcatgaagtacctgaacatgtaaacccggcacatcacttttctgcattcgtctattgctttggaggacttacctttttcgttactgtattcaaattttatctggaatgtttttgacgatgtattatgtgcctgatattaaaaatgcttggaaatcagtttactatttacaaaatgaagttgcttatgggcaaattgttcgtggtatgcaccactggggtgctagtctcgtaattgtaatgatgtttttacatacactcagagttttcttccaaggtgcgtataaaaagccccgtgagttaaactggattgttggtgttcttattttctttgttatgttaggtcttggttttaccggatatttattgccgtgggatatgaaagctttatttgctacaaaagtagggattcaaattgcagagcaaacaccgctcattggtccttatattaaaacattactcgctggtcattccgaaattgttggcgctcaaacattaactcgcttctttgctattcacgtcttcttcttaccagcagcacttctaggtttaatggccttccacttcatcatgattcgcaaacaaggtatttccggtccactataagagattgctaaattaaaggggaaagaactaaaggagggagattatgcatcgcggcaaagggatgaagtttgtaggagattctcgggtaccagtagctcggaaaccaaatattccaaaagactattctgaatacccagggaaaacagaagcattttggccgaacttcttgttaaaagaatggatggttggtgcagtttttttaatcggttatttatgtttaacagtggcgcatccgtcgccgcttgagagaatggcggacccaacagatgctggatatataccacttccagattggtatttcttattcttgtatcagttattaaagtattcgtatgcttccggttcatttactgtaattggagcatttattatgccagggattgcgtttggagcattactgttagctccatttcttgatcgaggtccagaaagacgtccattgaagcgtcctgtggcaactggatttatgcttttagcaattgcatcgattatctttttaacttgggaatctgtagcacaccacgactgggaagctgcaaaaaaacaaggagcaattgtaaaaacagcgccagttgataaaaatgatgatggctataaattaatgcaaaaaaatacttgtttaacatgtcatggtgacaatttacaaggcggggcagcagcaccggcactgcaaaacttaactttaaagccagaagaaattgctaaaattgcgaaagagggaaaaggttcaatgcctaaaggtgtatttaaaggtacggatgaggaactgaagaagctttcggaattcgttgcaaagtataataaaaaataataaaaagctgactacaaaatttgtagtcagcttttctatttagttggatgaagtttgttataatagagtaggatttaatgaatgaattactttgcttgaaaggtgttggacatacggattggtgtacttgtatgcaatgttaagacaacgctcggtattattatttttattaattgttaacatattaggtacaatttacggatttatatggtacggaaatcaattgaaagaaacgtcacctatattttggccgtttgtaccagatagtcctatggcgagtctcttttttgtctttgttttaattgcttttttggcaaagagaaactggggattaatagaagcgttagcgattgtaactttaataaaatatggtatttgggctgttgttgtaaacgggattatgatttacgtaaaagggcctattggccttatgggctacatgttaatgctttcgcactttgcgatggcagtacaaggatttttatatgctccattctatcgtataaaaaaatgg

SEQ ID NO: 862 - DNA, 1923 bp, Bacillus thuringiensis
atatttttactcattcgtcgcttagtgtgcatttaaagagatttttagtggaagaaggagaaaataaaaatgtttgatcgtttgaaaaatggagaaaaaattgctccaatcgtaaaagaagtagagagtcagattacagaagtacataaacgtgcggatgaagtaattgaaagcaatcagtttcgtgtattagaaagttttcgtaaacataaaattagtgactcgcattttatcccgacaacaggttatggttatgatgatattggccgtgatacgttagaaaaagtgtatgctgatgtatttggggcggaagctggacttgttcgtccgcaaattatttcaggtactcacgctatctctacagcgttatttggtattttacgcccgggagatgagttattgtatatcactgggaaaccgtatgatacgttagaggaaattgttggtgtgcgtgggaaaggtgtaggttcatttaaagaatataatatcggttacaatgcagttccgctaactgaagctgggcttgttgattttgaggctgttgcagcagcgattcataataatacgaaaatgatcggtattcagcgctcgaaaggttatgctactcgtccatcgtttactatttctcaaattaaagagatgatcgcgtttgttaaagaaattaaacctgatgttgttgtgtttgtagataactgttatggcgagtttattgaagagcaagagccatgtcatgttggtgcagatttaatggcgggttcgcttattaaaaacccgggcggcggaattgttaaaactggtggttatattgtcgggaaagaacagtatgttgaagcgtgtgcatatcgtttaacatctccgggaattggcgcggaagctggagcgtctttatacagtctgcaagaaatgtatcaagggttcttcttagcgccacatgttgcaggacaagcgctgaaaggtgcaatttttacagctgcgtttttagaaaagttaggaatgaacacgtcaccagcgtggaatgcaccaagaacagacttaattcaatctgttcaatttgacgataaagaccgtatgattgccttctgccaagcgattcaatatgcatctccaattaattcgcattttactccgtatgcaaactatatgccaggctatgaagatgatgtaattatggctgcgggaacatttattcaaggtgcaagtattgaattgtctgctgatggtccaattcgtccgccttatgttgcttacgtccaaggtgggttaacttattcacatgtgaagattgcgatttgttctgcaattgatgcattaattgaaaaagaattattaacaatttcttaaggggaagctgtcgatttcggcagcttttttcgtataaaagtaatgatttatgcgattagaaaaagaatgaaaaaattcataaaaaaaattataaaaaatcatgtaagaaaagctaacatctattgacactaaacataacatagtataaaatgagaagcagttaaggcgaaggaggaactgaaaaatgaaagaagatagacgttctgccccgctgtttcctattggtattgttatggatttaacacaattgtctgcacgtcaaattcgctactatgaagagcataatcttgtttctccaacccgtacaaaggggaatcgtagattattttcatttaacgatgtagataagttgttagaaattaaagatttgttagatcaaggcttgaatatggctggtattaaacaagtgttactaatgaaagaaaatcaaacagaagcagtgaaagtaaaagaagaaacgaaagaaatttcaaaaactgagcttcgcaaaatacttcgagatgaactacaacatacaggtagattcaatcgaacttaatgcgacaagtgacattcaagatttttcactaagatactgatctg

SEQ ID NO: 863 - DNA, 2147 bp, Bacillus thuringiensis
atccctgtagtaagtacaaatcttgataaagtattccaatcactagttgaccgtgatgcagtcagtttttattactggctattagacaaagaatatagattcgtaattgaaataaatgatgaagaattgattaggattgggtttcgctaataactctaagcatatgaagctagttcccttcatttcttaatattttcttcgtcaccaccgctattattatcattatgaaactaatagcaaatataggtaaataaatttttcgtactgaatccttcaaacataaaaccatatacgacttgcccaattggtgccatacattgagataccgctgttataaatgccatcacttttcctagattttcatttggtgttttcttttggactacagtaatcacataaatggatacaattgtcataatcattgcgattagaagagaagaaagtataaagaggataaatggtggatagtatcctaaattaagaataaacggtgtaactgatagtgccactggcattactaataaagctatgataagcatccaattatataatgttttcatctgtaactttttagcaaagaaaccgattgacaatgcccctaatatggttgcaaaatcaattaatcccattccaattccatacatcgtatcgctactctgcatagttactcgtaacataataggtcctccaacaacaaataacggtgtcaaaattaagtttagtaaagttgcaagtaacatagccttcaaaataaaaggttgctttaaaacataaagaaaaccttttttcatatcttttacaattgtcggtatgatatggctttcttgcgctctttttataaaaggtattgtaataaacatttctaaaattgcagataaaaagaaagcaagacaacttgttattacgagcattttcaaaccaattatgccatataatattcctcctagtacaggtgcaactatattagataatgcttgcacaccatttatgataccgtttgcttgttctaactttttctctggaactaattgcggaatacttgccataacaactggtgagtacattgcactaatgactgctagtaaaaacataattgctccaatcaataaaatagataccgattcagttaataacaaaactataaaacttaatacaatagcagcgtttataaaatccaaaatgaccattacattacggcggttgaaacgatctgctatcgctccgccaagaggagctaacaaaaacgggatactcgttatggcatataaccctgcaaatatatcggcacgtcctgttatatctagcacatataaagacagtgcaaaacgtaatagtgttgaacctaaaatagtaataatttgaccacttaccattaagtgaaaatctttcaaggaagattgaatacttgctggcatcttcatcacatccttcatttagtctagaccgactgccggtctataacacccaaacagaaaaaagctatttctgtttcattaaaacctcgatcatataatcaaaggacccttctttcgctccaacagatacttccatcattttaatataagccttagctcttctcatcatttcttccggtttccactggaataaaccatcatcaaatatgacttgtgctgaagagagtaataattcaattgtttcttgtgggtatggagtagaaaatatgccttcttctattccttgctctaaaacttccgttaatacaggagataaatgtataatggattgcactaaacttttctgatgcatttctgcattatttggttgatggaattgttcaatcattttttctttgacatctcctgattttggtgattgttccattaaaattttaaataacttatctaaaacggggatatcgggattggagacaatccttttcgccttagtgacatcctctttaataatcctcataatgatttcatccattacttcctccttcgacttaaaataatgataaaacgtcccctttgctataccaatttcttttaaaatatcattcacggttgttttcgtataacctttcgtaagaaacaaacgctcagctgtttctaaaatttcctttctacactcctcaaactcctttacaattcgcatgtaagtttctccttcccatcagaccgactgtc

SEQ ID NO: 864 - DNA, 2206 bp, Bacillus thuringiensis
aaaaggtgtctacgttaatacgcttgacctatccattaaaaattggccagatgcatacttcagttgcaactttgaccgattaatggaagtaaaagcgaaatatgatccgaaaaatatttttaactttccgcaaagtattccgcttttttaaactatatattacacctaatatattaaaatataaaacatccattttttaaatgggtgttttataaataaagtttacataatataattattggttaattcttttactaaatatctattcaacaatccaaagtaacactttctcaaactcttttttggacaacatactttcgtttatatagccattcttttaattgtacttcatccaaagctccgttcccctctcatgatccttcacactatattcgctcgtttttcacaaaaggttcattttacatgaaaatttatttattacaataaaaatataaggtatatttttatgaaaaggaggaattcaagaatgaatacagaggataaaatttacgctgaaaaagtgttaaaaaatctctttatcggatcacaagttgatggattacaattatcccttctgaatctttagcaattttctatgaaacagttacatcttcaaagttcttcagaaaatctgatgagctgaatgagttagcttcaaaaattgtacaagctacagcagaacagaagtacatgatccattatggggtttaaatgtaattcaacaaatgcttaggatttctccgaagcattttttgtatgttactaatacatttattccttaaccatttagtcaatgcttgagcctatggtcccttcttttacaagtgagggcgcccctattaatctaaataagcgtcttattttcaatcttccagctaaaccatctcccatgcccttctgtttctccaaccgtttcacgatattcgtttccgttaatataataatcaatatgaaggtcacgatcccacatgttgttatacaggtggaatacatcacgttttgcgccaatttcttgtatttgtttttctaacttatgttttacttgttcttgtatttgatttgcgacgtgtgtatggaaaatacaaataacagcttcttcacttatttgttcaataatagatgataatagctctacaccgtctccttctattaattggacagattcatttttcactaaagatgcagcttgatcaaacatctcaaacctttctttatgctctggccaaattaaagcacgtaaccataaataatcttcctcattatgtaaatcattcacatgtaagtccagtccgattctttctacgacagatgggctttcttttagaaaatgcggcacattctcccctcttatttcagaagttacatgcacatttgaatctatatttccgtacatttcatccgtcccgtacgaataacgatattggtcccagaacagttgcaacccagaacttgtcccaatttcaattaacgctaacggcttcttcactttgttaaatatgtagcagaaacttgggtataagtatgcgcaccgtcttacttcatttgtttgaacgagtttcgtttgtaacaaagtaatgatttcttctcggtactctttacagaaatctttaaaatgattaaaagctttatctaaatttgtatcagcattttcaactaaactactataatacgtttttaaatgatgttctttccctgctagcaataaataatgtactgcacctaatagtaagtttgggactggttgacctatctgagcataggacgatagtgtaagtacttcctcatcttcagcaattttcattgataaatattcatataaatcacttgaccctttacattcctttattgaaaagtttcgaaataagtttgaaatttgttcttttgtacacattagagtccctcctttttatttttcagaataatcttaccattacggaaagaataatcccataaaaaggtactcgatttagtcacttaaggatacgtaagctttttcgagataattttaaactgtaatttttttctatttaccaccttaaaagagcttgttaaataagatttttagcgaataaaacgttaaatagtttaaaattatcagataacactagatattttagtctattaattattataatacagtatgagatggttatataattgagacaaaaaaagtatacacctaggtggggcctaggcggtgtttctc

SEQ ID NO: 865 - DNA, 2165 bp, Bacillus thuringiensis
agaaatataaattggaatgtttaaaaaatttatcgtaagatggagatagtaaatatttctattagttaatgaaatatattttctaatagaatacatcgtatttttacagtcaatctagttttcgtgacgagaatctgtaaaaacgggacaaccaagagtatgggagtggattttacatgtttaaaattcaagaagttcgcgaattaattaaattaattgatagctctaatattgatgaatttgaatacaaaaaagacggtacaacaatcaaaatgaaaaagcgtggtaatgaagttgttgctgtgcaagcacctgcagcaaaacaagctatgcaaccagtagcgcctgttgaagttgaaacgaaagtagcagcagcacaagcagaagcgccaaaacaagaagagaagaaggctgttcaaaatgaaaacctacataaaatcacatcaccgatggtaggtacattctattcttcttcttcttcttcgcctgatacacctccatatgtaagtgttggggatagagtatcgaaagattctatcgtgtgtattgtcgaggctatgaagttatttaacgaaattgatgctgatgtagagggcgaaattgttgaaattcttgttaataacggacagcttgttgagtatggacaaccgctatttcttgtaaaagcgtaataagggagtctttgtgatgataaaaaaagtattaatagccaatcgtggggaaattgctgtacgaattattcgtgcttgtaaagaaatggatattgaaacagttgcaatttattcagaagcagataaagagtcacttcacgtacagattgcagacgaggcgtattgtgtaggaccaacgatttcgaaagaaagctatttaaatttgacgaacattattagcgttgcgaagttaacaggctgcgatgctattcatccgggatacggatttttagcagagaatgcagatttcgcagaattatgccgtgaatgtaacttgatttttatcggtccaagtccagaagctatttcaaagatgggcacaaaagacgttgctcgtgatacaatgaaagaagcaggggttccgattgtaccaggttcacaagggattattaaaaataccgaagaagcgatcgagcttgctaatcaaattggatatccagttattattaaagcgactgcaggtggcggcggaaaaggtattcgtgttgcacgccatgaagaagagcttataaaaggaattcaaattacacagcaagaagctagtaccgcttttgggaaccctggtgtatacttagaaaagtacgttgaagatttccgccatgttgagattcaaataatggcagatacacacggaaatgccattcatttaggagagcgtgattgtacaattcagcgccgtttgcaaaaactactagaagaaagtccatcacctgcacttgatgaagatattcgcaagcagatgggtgaagcggcagttaaagcggcggtagcggttgattatacaggtgctggtacggttgagtttatttatgaatataaaacgaaaaccttttatttcatggagatgaatacgagaattcaggttgagcatccggttactgaaatggtaacgggaatggacttaattaaagagcaaattcttgttgcttcaggagaaaagttatcgttacagcaagaagaagtacaatttaatggttgggcaattgaatgtcgaattaatgcggaaaaccctgccaaaaaatttatgccatctccaggtaaagtagaaatgtacttaccaccaggaggatttggtattcgcgtcgattcagctgtatatccgggatattcaatcccacctttctatgattcgatggttgctaaattaattgttcacggaaaaacacgtgaagaggcaattgcaaaaatgaagcgcgcacttagtgaatttgtcattgaaggcgtacatacaacaatcccgttccatttgcaattgctagatcatcctgattttgtaaaaggtgagtttaatacgaaatttttggaagagcatgaacttgtgacgcagtgatacattaaaggaggtttttttcatggctgaacatatgttagatatgggtcaagatacaactcttggtaaagtagaaattgcaccagaagtaattgaagtaattgcaggtattgcagctgctgaag

SEQ ID NO: 866 - DNA, 1823 bp, Bacillus thuringiensis
tatttaaatgacattccaaggtgctgcatcaatacctttatgagtcatgatttttatattagaaaagatgttaggaatgtgatttaaatatttttggtcaccccatctattcatttcaacatcatattgattattgcaatattctaggcatttatctttccaccatgttaaaatttctttactattttgatcgttcttgaagcctactaaaccagcttggtatataccgtgtatgctttcaatttcagtagagcttctttgagggcaaaggaatacagagtacttccaccattcatcaagaatgatattaggtgctgtaaagaaatacatatcagcatcacaatatataatgtgatcaacttccggataaagactaaggacatgtagacataggggcgcttttaatgtccaacaatactcttgtaaacttctatcattttttatactgaggagttcatgattttcaatttcttgtaccggaattagtatggcgtgctttaattttaatttttctaatatttgataagttaaatcatccatacaacagatccatacagtaaatttagcgttgaaattttctaaggaataataagaggtcaatccttgaattaatcgttctttacttataatcatggaaaagttcataaaatgattggattgattcatttttcttcttaattgtgaatctttatataaagtttgagctttatttatatcttttttacttaaaaattgtttagtatctttattgaatttatcctttaattgctttaaaacaaattgaattctctctaaatacggagtgtaaatatggtttaatatattattgggtattgaaatttctcccaaagaccaaagatcaaaatcattttcagtaaagatagtaatacatgcaaaatggtaaacaactagtttgtcgttttcaataaatatatcgtttttagtcttgtcaattttataatcgttattatatatacagttccaaggtgcagcatttatacctaagttatttgaaatttttacttttggaaaatatatagggatataatctaaatacttttggtctccaaatttcccctcctcagcctcggcactgcaccaatctatacatttatttttccaccatcttacactttttagtccatagagatcattcttaaattcaattagaccagcctgatattttccatacattttttctacccaatcacgatctctttggggggttaggaaaatagaatggtcaccccattcctcaaaaataatattagggtcagagaaaaagcataaatcaccatcacaatatagaatagatggtaaatcataattgaccaataaatattctatcaagacagattttaaagtccaacaatattcatttacttttctttttctcttaattgcttttagttcacgatcttccaattcttcaacttgtaaaaggtttacattaattaaactcatttcttttaatagtgaatatgcaaaaggatctatacaacaaatccacaatgtgaatttttctgagtactgcattaatgattgctgtaaagcaataattttcaagacatactcactacctacaatgacgcagaaatgattatttagatcatgttgttgattatagaattggggatcaattcttttttgagtattttttttggagagatttgaagctttaattcctgttgaaagtgggttaactattttctcattagaggggatatacaatcgaggtaaacttatttttttatcattagagttcaatgctatttcagtcctctccactaaaatttattttgattccactttcattacaggtt

SEQ ID NO: 867 - DNA, 1210 bp, Bacillus thuringiensis
aaaaaggtattattaagcattgtaagcggagcttttttattattaggcgcatgtagcgtgagttcagataaagaggtaaaagcattagacgagaaaaagattactgtcggtgtaacaggtggaccacatgaacaaatttttgaaaaggtaaaagaagttgcagcaaaagatggtctcgaaattgatataaaagtatttaatgattatgtagcgccaaacgtatcattagatgaaaaaagccttgatgtaaatagttaccaaacgaaatcgtatttagatgtatttaaagctgaacgcaatatgaaattagctgaagtattttcaacagtaacattccctatgggcgtatattctaaagatataaaagatgtaaaagacttaaaagagggcgatgcaattgctgtaccaaatgacccaacaaatgaacttcgagctttaaaattatttgaaaaagcaggggttttaaaagttgatccaaaggctacagaaaaagcgactgcaaaagatgtaattgaaaatccaaaaaaattaaagattgtcgaattagaggcatctcaattaccaacgcaactaagtgaagtgaaagcagctgcaattaacacaaactttgcattaggtgcaaaattaagtccagcgaaagattctatcttccgcgaaggaaaagattcaccatatgtgaactgggtcgttgttcgtactgaaaataaagatgatgccgttgtaaataaattaaagaaagcttatcagtctaaggaagtaaaagagtttatcgagaaaaaatttgatggttcagttttaccatcttggtaggagctgacgataatgattgaattaaaaaacatatccaaagtatttacaacaaaaaaagggaatgttgaggctcttaagtctacttcccttaaagtagaaaaaggcgagatatttggaatcattgggtatagtggcgctggtaaaagtacattgattcgatgtgtaaatttattagaaaaaccaacgacaggaaatatcattgtaaacgaacaagacttaacaacgttatcgacaaaagaactagcaaaagcgagacaaaaaatcggaatgatcttccaaggattcaatttacttaaaactgttaccgtttatgaaaatatcgcattaccgttacggcttgctggcattccaaaagcagaaattgaaaaaagagtagaaaagtatttacgcattgtcgatc

SEQ ID NO: 868 - DNA, 2232 bp, Bacillus thuringiensis
cggtttagaagtaaatgatttagatgtaagtttattttttgtatatggaaggaccggtaattggtctgtaatcgtaccgattaaaaatcttaatgcatgtgagagaatgaaacctaataatgctgcatttccatcagttttaaaagaaatacctaatgcttctattcacccaatttgtctagaaacttatgatgaactagcacaaatgcacggccgtcatttttcatcagcttacgctgggacgattgaagatccagtgacaggaacagcttcaggtgtaatgggagcgtattatgtggagtatttagagaaaggttttgaacatgaattgggtttaatcgttgagcaaggacaggaaataaataaagatggtcgtgtaactgtttatgtaacgaaagggatagaaaacgaaaagttacaaatagatattgctgtaacagcggtgtatgtgaaagagttggaagcttcaatataaagtggaactttaatcagtggggtcttactgcccggtgaatagcgggataaaaagaaagcccggaatacatccggactttcattatctgttcaatacttcaatgtacgaagcatttccagttgttcttaaagcggagcggaaattattattttctaacgccttagcaacttgttgtaactgctgtgcatcatcatgatgaataagtaagctgtcagcaccgctttcctctatatgaatgtgttcgacatttccgattgcatcatgtacagcttttaaaaattcaggtttcatattgtcctcctatatgtatgtaacgttgtaatttagtatttccttatttatgaaatataaaagtaaatgaaaggagaaataaaaatgaatataaagcaatttaatgaacatataacatcactatttggagagcatcttcataaatatggcgatgatgaatatggttttacttatataagtaaagatgaatttcacaaaatcggttacacaacaaatttaacgttagaaactattgaagaagcgtatcgaaatggagtcgatatgatagttacacatcatgcgccgtggagttttttatttggtatggaagaggcatgtattgagaaattgaagcaatatgaaatgaatcatttttggattcatttgccgttagattttgtaaagtttggcacgtgtacatcgttatttaacgaaattaggatagatacaatactggaatattcaacctatgaggaagaagaactaccaggaataggagaatataaagaagccattcctttttcaaacttagttggaaaacttgaagaaaaaatggaagagaaagtgaagagctggagaaatcacgataaaccagtaaaacggattgcaatcttaaccggtgcaggaaataatacaaatttgattgaacgtgcattagaaaaaggatgtgacacgtacataacaggtgaaaaaacattatatacagtgcaacatgcgaaatttaaaggaattaatttaattgtaggtagtcatacgtttacagaagtgtttggtgtagaaagtttggctcataaattacaagacagagaccctgcaatagaaattattagagtatatgaagagcatttagagtgataaaatcacgttatcataaatggaatattgaagaaagtcattgtaataaaataaaattgttgtttgttatatcagggcgattgaaaggattttacttttgtttgtcaaatgatagtaaagttgtcttttgaattaaggaaatattcggagttgaagggtgagagaatggacatttcaataatcactgcacaactagttaaggaaaaagttatttcacattatccaaatagcgtaaaagcattaaacgggggaacgacaagtatctaaatatttgttagatgaacaatacgtataaagttgaatgaatcggatgtcatacgtgaagaagcttattttcttcagttttataaaaaggacgaattatttccaaagcttttatataaggaacctttaaatcgctatattgtttactcattccttgagggcacaacttcttgcaaactaggccataaacggagtgttcttagtaaacttgtaaaggaagttatcaataagtatgaagtagctacagaggttgatggctggggatggaaagaaagccccgttcaatcttggaacgaatctttaacggccaatgtgatgcaagctcatgtaaatgtaagacgttgcataagataaggaagagtatagaa

SEQ ID NO: 869 - DNA, 2266 bp, Bacillus thuringiensis
  unsure (1)...(2266): unsure at all n locations
ttcgagtctatttttagattcgtcatttttcgacaaaataccttatggacatatgataccaatcatttacatttccgtcaattcttaaattctatattttttaaaaagatttatagatttcttatttcttatatataatagattgagaggaaattccacaattatttacattattttctgaaaaaataataaattaaaagtggagattgtatatttttgtgaaatatgagcaatagatgataaagatatcgagcattaagacctaaatttaaaattaggttggcgtaaagaagataagttagatttgggctgctcgtaaaagcccaattaatgtgggctaataattagtagggaggaacaaaaaccctactgattaaagtttcactttatatatgagtttttgatatactgtttataaatacatatgaggttattcgggaggtccaaaacaatgacagaggaaaataagtccttttatattactaccccaatttattatccaagtggaaaattacacattggacatgcttatacgacagtagcaggagatgcgatggcacgatataagcgtatgcaaggttataatgtgcattatttaacaggaactgatgagcatggacagaagatccaaaagaaagcagaagagttaaatattacgccacaggcatatgttgataacattgttgcaggaattaaagggctttgggagaagatggatatttcttatgatgattttattcgtacaactgaagatcgtcataaagatgttgtcgaaaaaatctttaagcaattagtagatcaaggtgacatttatcttgatgaatatgaaggttggtattctgtacaagatgagacgttctatacagagcatcaattagtagatccaattatggaaggcgacaaagtagttggaggaaaaagcccagatagtggtcatgatgtagaacttgttcgtgaagaatcttatttctttagaatgggtaaatatgtcgacagactattaaagttctatgaagataatccacatttcattcagccggagtctcgtaaaaatgaaatgattaataattttattaaaccaggattagaagatttagcggtttctcgtacttcatttgactggggagttcgtgttcctggtaacccaaaacatgttatttacgtatgggttgacgcactatctaattatattacggcgttaggttatggaacagcaaatgaagagaaatataaaaaattctggcctgcagatgtgcatttagttgggaaagaaattgttcgtttccatacaatttattggccgataattttaatggcattagatttacctcttccgaagaaagtctttgctcatggctggattttaatgaaggatggaaagatgagtaagtcaaaaggaaacgtagtagatccagttacattaatcgatcgttacggattagatgcattacgttattacctacttcgtgaagttccatttggatctgatggtgtattcacaccagaaggatttgtggagcgtattaatttcgacttagcaaatgacttaggtaatttattaaatcgtacagtagctatgattgataagtattttaacggagaaatccctgcatttaaagaaaatgtgacggaatttgatgaaacgttagtagcgtttgcacaagatactttgaaaaaagtagaagaagcaatggagaatatggagttctctgtagcgttaggatctatttggcaactagttagtcgtacgaataaatatattgatgaaacacaaccatgggtattagcaaaagatgagaatgatcgtgaaaagttagcttctgtaatggctcatttagcagaagtacttcgtcaaacaggtattatgcttatgccattcttaacagtagcaccaagcaagatgtttgctcagcttggccttactgatgaagctcataaatcttgggaaagtctatctacaattggctgcattccagctggaacaaaagtagaaaaaggaaacccaattttccctcgtttagaaatggaagtggaagtagagtacattaaagaacaaatgaaaagctctgctcctaaagtagaagagaaaaaagaagaagaaccgaaggcagaagaaattacaattgatgatttctttaaagtagaataacgcgtagctgaagtactatctgctgaacctgtgaaaaaagcagacaagttgttaaaaattcaactagacttaggcacaganaagcgttcaagttgtttctggaattgcaaaatttta

SEQ ID NO: 870 - DNA, 2083 bp, Bacillus thuringiensis
aaatgttcaaatttatcaaagcgttatgtacatatttagttagcatttatagataattatatgttatgataaaagcaataaagtacatcatcctgactttattgtgtatgtttagcctatgtatgtcgtctgtattaaaaaataagaagtctcttaaaatgagacttcttatttttgtatcgagggggtattacagatgattaattactatcaaatatttttaattaccatggcaggtattgccttgtttttttatatacaacaagctggaaaaccaacgaaaagaaacaaatggaagtttttaattgtagtatttttattttactttttgaattatttattacttaaattttcatagataaatatagaggatttataaatatcgaatatattaaagaattataagttagcaaaagcaattagtaaagtatcatggtcacagttttgagccatgttagaatacaaagcaaaatggtatggaaaacaagtcattgtcgtatctaaaacattttcttccagacaattatgttcttgttgtgggtctcaaaataaagacgttaaaaatctcaacctacgtaaatgtgtttgcccttcatgtcaaacacatcatgataaggatattaacgcaagtatcaatctaaagaatgaagcgatcaagctgctaaccataaggactgcggagatagtctaatcaattagagttcgatagaactctttacttgaagcctgtagatgtagatgcttacgggatatatatgaaggaaaacgccaccttactgcaagtcctgtatattgacgataaggtcatgtggacacaactaaaaggatatgagatggataaacatgaacattaactgtcagatggtgatacttaagacgattagtaagctatagtttgtaacaagaagacatttaatgagtatttattttcaccaaaatacgggttttgtatggaatttcctgcaatgaattcaccatggataaggttgtctcatatcatgtaaagattgctttattaagattataaaagggtgtgaatgcattggaagatgtttatgtgaaaattgacagtttaaaagcagaacaaaaagaaattatgcgagatattcgtaatttagaaactcgtacaacaattaatgagaaagacatagctacaattaataagcaattagaaaagattagcataaatacaacttggattttacgaattattattagtgcaatcactatgtcggttttggggttaatattaaagggtatgatttaaaaataacagtacttattgagagatggacgagtatctctctttatttttatcattttagccaagatagtttttaaaacatgttataggtaattagtacaattaaatggaagacattaataattgtttagcaatggtaaagtagacgtatataatttaaaagagaacctatgcagcaatacaaataataatttgtatgtgaacgtaaaaaataccaagaccgtcctagaaaggagggggcttgatattttttagttaaaattacgattttttaagtgaatttcatattctgttaaccatactaatatcaagcactttaattcaatcgtttcaatttcgcaagtgttttcttcatctcccacatatcggtgggtggtctttgtataatcgaatcttatctctaaatcgcaattgttaccccattactatcaagttaaagttttataatgcccttaaaatgaaaaacacattattctactataacaatacaattttgtatgcaatattgcatatttatacgttatgcctctattagacattttttaatggtaccatagcaaggtgagagtctataagggttctccttaataggaggaaatatggaaagagtgcaaaaagtttacagtaatccaaaacttaaaagttggattaaacaggtattagctgtaggaggaataatagggtgctgctatttggtgttatatgttttctgtttcttagttatcatgtaaatattatacaattaaactagtagagtcttgcctagagaggtaaggcttttttattgtatctggagatgagcaaacaatataaaataca

SEQ ID NO: 871 - DNA, 2054 bp, Bacillus thuringiensis
atggatgtcataacgtttgggtaatcgctgcaacgccaatgttgtagaggaaagtccatgctcgcacggcctgagatggctgtagtgttcgtgcctagccaattcataagctagggtattctggctgtaaggctggtttaacggcagggaaaaaacctaagtcctttcggatatggtttgactacctttaaagtgccacagtgacgaagtccttgaagaaatgataggagtggaacgaggtaaaccccacgagcgagaaacccaaataatggtaggggaatcttttccaaggaaatgaacgacgggaaaggacaggttttataacctgtagatagatgattgccaccggagtacgaggcgtgggccgtttgtagtacaaaggaacagaacatggcttacagaacgttatgaaccaactatgaaataactcagctctcctttgttagaggagggctttttatttgtatgaagttataaagtatgagttaaaatggttaatgagaaaaattttcgtaaaatgtaatgattaataggaccaattgctattaattattgtttgaatatacataagaggtgaatgcaaatgggaaaagttactttaattgcaacagcggcaatgggtattgaagcgttagttgcccgagaagttcgcgatcttggttatgaatgtcaagtagaaaacagcaaagtaacatttgaagcagatgaaaaggcgatttgtcgcacgaatttatggttacgtactgcggaccgtgtaaaaattaaagttggcgaatttaaagcaacaacatttgatgagctatttgaaaaaacgaaagcattaaactggggagattatattccagagaatggcgaattccctgttattggtaaatctttaaaatctgaattattcagtgtttcggattgccaacgtatcgttaaaaaagctgtcgttgaaaaattaaaaacaacatataaacgtacaacttggtttgaagaagatggtccgttattccgtatcgagattgcaatgctaaaggatattgcaacattaacaattgatgcgagcggtgttggacttcataaacgtggataccgtatggatcaaggggaagctccgttaaaagaaacattagctgcgtctttaattaaattaacaaactggaagccagatcgtccatttgttgatccattctgtggatcaggtacaattccgattgaagcagcattaattggacaaaacattgcaccaggatttaaccgtggtttcgcatctgacgagtggggctgggtaggtaaacaaaactggcgtgaagctcgtcaagaagctgaagatttagcgaactatgatcaacaattacaaatcattggatccgatattgatcatcgtatgattcgagttgctcaagataacgcagaagaagtaggcttgggcgatttaattacatttaaacaaatgcaagtaaaagatttcacaacaaaagaggattatggctacgttgtaacgaatcctccatacggagaacgtttaagtgaaaaagcactcgttgaacaactgtacaaagaaatgggacaagtattccgcccattagatacatggtcagcgtatgtattaacaagctacgaagcatttgagaagtgttacggaaaagatgcgtcgaagaaacgtaaactgtttaacggatttatccgtacagattactatcagtacttcggaaaacgtccaccgcgtaattcatagtataaaactcctccagcgcgcatatactggctattatgtaatgcgtaaaggaggaagtgatatggataatttccaattatcaatgattcaaaaagctattcaccgtacgtatgatgagctcggaaaagaagtggatagtcaagatgcgattgtagatgaaatacaaaaagcacaagaagaatatttgtcagctctttcacatgaaacagcgattgataaaaggtatttaaagtcattaactatagaagaaaatggtcctttttcgaaaggaaaagttgattccgtgtatttatatgtatggcaacaagagaaagtagctgcacacatataa

SEQ ID NO: 872 - DNA, 1812 bp, Bacillus thuringiensis
tgccgtctgtaattgataacgaagataacacgccagttgcaacaatcaatgatgatgatgcagttatcttctataacttccgtccagaccgtgcaattcaaattgctcgtgtatttacaaacgaagacttccgtgagttcgatcgtggtgaaaaagtacctcacattccagaattcgtatgtatgacacacttcagtgaaactgtagatggttacgtggcattcaagccaatgaaccttgataacactttaggtgaagttgttgcgcaagcgggattaaagcaacttcgcatcgcggaaactgaaaagtatccgcacgttacattcttctttagcggtggtcgtgaggctgaattcccaggagaagagcgtatcttaattaactcaccgaaggttgcaacgtatgacttgaaacctgaaatgagcatttacgaagtaacggacgctttagtaaatgaaatcgaaaatgataaacatgatgttatcattcttaactttgcgaactgtgatatggttggccattctgggatgatggaaccaacaattaaagcagtagaagcaactgacgaatgtttaggaaaagttgtagaagcgattcttgcaaaagatggtgtagcacttattactgctgaccatggtaatgctgatcaggagttaactgctgatggcggtcctatgacagctcatacaactaacccggttcctttcatcgttacaaaaaatgatgtagagcttcgtgaaggtggtattttaggagatatcgctccaacaatgcttacacttttaaatgtggaacaaccgaaagaaatgacaggtaaaacaattattaaataatttgcttatataaaaaggagagaatttattatgtcaacaattattgatgtttatgctcgcgaagtccttgactctcgtggtaacccaactgtagaagtagaagtttacacagaaagcggcgctttcggacgcgctatcgtaccaagtggtgcatctactggtgagcacgaagcagtagaattacgtgacggtgacaaatctcgttaccttggtaaaggtgttgttaacgcagtaaacaacgttaacgaaattatcgctccagaaatcgctggtttcgatgtaactgaccaagctggtatcgaccgtgctatgatcgaattagatggcactccaaacaaaggtaaactaggcgctaacgctatccttggtgtatctatggcagtagctcacgcagcagctgacttggtaggtcttacattataccggtaccttggtggattcaatgcaaaacaattaccaactccaatgatgaacattatcaacggtggatctcacgctgataacaacgttgacttccaagagttcatgatcttaccagttggtgctccaacattcaaagaatcaatccgtatgggtgctgaagtattccatgcacttaaagctgtattacatgacaaaggtcttaacactgcagtaggtgacgaaggtggattcgctccaaaccttggttctaaccgtgaagctttagaagtaatcatcgaagctatcgaaaaagctggttacaaagctggcgagaacgtattcttaggaatggacgttgcttcttctgagttctacaacaaagaaactggtaaatatgaccttgcaggcgaaggccgtactggcttaacttctgcagaaatggttgatttctatgaagagctttgcaaagacttcccaatcatctctatcgaagatggtttagacgaaaacgactgggatggtcacaaattattaactgagcgtatcggtgataaagtacaattagttggtgacgatt

SEQ ID NO: 873 - DNA, 2142 bp, Bacillus thuringiensis
tagcaattttactctatacttgttgttggctttgcatacggtatcattagtcctacactcggttttttagctgatcacggatggattaaagtagatgcccaagcgatatcaattatgacagtattattgtttggtgctggaacggactattgtctatttttaatttcgagatatagagagtacttgttagaagaagaaagtaaatataaagcattacaacttgcgattaaagcttctggcggtgcaataataatgagtgcgttaactgttgtacttggattagggacattattacttgctcattatggtgcctttcatcgatttgcagtaccatttagtgttgctgtatttataatgggaatcgcggctttaacgattttaccagcactattattaattttcggtaggattgcatttttcccgtttataccgagaacaacttcaatgaatgaggagtttgcaagaaagaaaaagagggctgtaaaagttgaaaaatcaaaaggctcctttagtaaaaaacttggagatgtagtagtacgaagaccgtggacaataattatgctaactgtgtttgtattaggtggattggcttcgttcgtaccacgtattcaatacacatatgacttattagaatcgtttccaaaggatatgccttctcgtgaagggtttacgttaattagtgatcatttctcagctggtgaactagcaccagtaaaagtggttgttgatacgaaaggaaaagagcttcctattaaacaagaactagagaaattttctttcataaatacagtgaaagagccaaaagagggaaaagaaaataagcaaatacaaatgtatgaagtttctttagcggaaaatccatactcaattgaagcgttagatcaaattcctaaattgaaaagtaatgtagaaaaagtattaaaagatgctgggattagtaatgctgaagagcaattgtggattggtggagaaacagcttcattatatgatacaaagcaaattactgaacgtgatgaatcagtaattattccagtaatgattagcattatcgctttactattacttgtctacttacgatcggttgttgcgatgatttatttaattgtaactgtcgttttatcattcttctcagcgttaggagcaggatggatattgcttcattacggtatgggagcgccggccattcaaggtgcgataccgttgtacgcattcgtatttttagttgctttaggtgaagattataatatctttatggtttcagaaatatggaaaaacagaaagacacaaaatcacttggatgcagtaaaaaatggtgtaatacaaacaggtagtgttattacatcggcaggtttaattttagcaggaacttttgcagtgttaggtacacttccaattcaagtattagttcaatttggtattgtaactgcaattggcgtattactagatacgtttatcgtaagaccgttacttgtacccgcaattacagttgtgttaggccgatttgctttttggccaggtaaactttcaagaaagagtgaagaaatacaaaaggtggatgcatagttaaaaaagccaagggtattttccttggcttttttcaatgtagttaattaattttttgaagtcaaatcatcagctgcagcgtgatcagcatcttcaattgttgtttcgggcattccgtataagccgttcattgcttgttcttcaatagtaaggtttgcagtattattattttgaatagatgtagtattttcagtaacattttcttttttattcatatttttgttattcatgtatgtatcctccaaatttcatttgatttatctatagtatgtggatggatttcaagaaatatgtgaattgattcttacatatgttatataattaaataaataattagggtgaaatgtaaactgttaggagtgaacaattatggtgaagcaagggaaatagccttctaaaataaaaagaaaattttaggaggctattagaatgaagtttcatgtaattgatagagaagattggaatagagagcagtattttgagcattatttaaagttgaaatgtacatttagtatgactgttaatgttgatatcacgatgttaatagagaaagtatatcaaaagggaataaaattttat

SEQ ID NO: 874 - DNA, 2186 bp, Bacillus thuringiensis
acaaactgtctgacaatttgtgaacataaaatctgcaacccaaactttcccttttaaatcttttgtaccaaattgctttccatcttgatttgtaaattggaaggtttctaaatcccaatttaatggtttacgaagctttgaacctgattcactacatccagcaagtacaaagagacaaaatacaaccataagaccaattattttttgataacgcttcatttataaacctcttttctctatcctaaatttaaataggttatgtttataataacaaaagttaacactacgagaaaattgtttactacatttgttcacgaaatcgtacgaatttacgtatgttacttctttatttcaagcgaattactagacaaaatatatttttttactattatttctctaaataaaagtgataaaactaattttattgttacttttgtaaatacctctccctattttttaacaattccttaaacattaatccatgttttacactgtattccttaacaacatttcggtacaatacaaatacaacgattttaaatgaggtgatgttcatggcaaagcgctatgaaaatatggataatgttagtacaaaaaaatcaattcgctcttttttacgctggcgtaaagaacgaaagcaaaacaaaaaagatttttctttcttagtagaacaatcacccgttaaacaaagtgcatttttacaaagtaatgttgaaaaaacgactatcacatggattgggcattccacttttcttatccaaacgaatggacttaatatattaacagatccagtatgggctaataaattaaagctagttccaagacttacagaacctggactctctatagaagcactacctaaaattgatattgtccttatttcacatggtcattatgatcatttagatttttcaactcttcgtcagttgaatgatgatgttctatatcttgtacctattggattaaaaaaattatttactcgtaagaaatttaaacatgtagaagagtataaatggtgggaaagtacgataattaacgaagtttcttttcacttcgtacctgctcagcactggacgagaagattcttatttgatatgaatacgtctcactggggtggatggattattgataatgaaacgactatggaaaccatatatttttgtggcgacagtggctatttccaaggtttcaaagaaattggtgaacgctttttaattgatattgctcttatgcccattggcgcttatgaaccagaatggtttatgaaagtatctcatgtttcacctgaagaggccgtgcaagcttatttagatttaaacgctacacattttataccaatgcattacggagcttttgcactcgccgatgaagcacctcgtgaagcaataactagacttcgaaataattggaatttgcgcatgttaccgtgggaacaactgcatgtactctttttaggtcaaacttttatttatagtaacgcaacaaatgataagcaaataaacgaaaaaattgaaactttacatgtgtaacgtaatgactgattttctatatccaacatataatatagaaaatcctatagtgaaactttaattagtgggatttcttcatccccactgattatttgccttcaccgatcaagcttttacgggcagcccgctacctaacctctttgctccagctaaatttgaggtagagagttttactgtccgcaaatagcaggataaagggtgttttctatgaatgaatatttacagactcgctatatcattagcggtagtgcctgtgtagctcttcttatttcttactttctatttacataaaaaagctacttgaaatatattttcaagtagcttttttattactctgctaaatacataaatccgattgcgcccggacctgtatgagtactaataataggcgttgtatagaaaatttctgattgagcaaatccactcactttttcaaccgccgctttcatactttcagctaaaggaattgctttcgcatgcggaattgcaacagcttttacgacttttccagccgtatcttgctcaaataacttagctaatgtttttacaatttggccttggctacgaactttcgttacaggattataaacaccgtcttcaagactagcaattggctttatattaagtagcgaaccgataaacgcttttcctttaccg

SEQ ID NO: 875 - DNA, 1257 bp, Bacillus thuringiensis
gtatcttctttctttcaacatgttgtaaaaggacttgtaatcttactagctgtattaattgatcgcagaaaagaagcgtaatggagggacagttcatgaagaaatggttacttatactcgttgcatgtattatggtcattactgctggttgttcaatggaaccgccagaatgggcaaaggattctagcgataaaggtcgaaataaaactattaaagttggattctctgtttcaactttaaataatcccttttttgtaactttgaaaaagggtgcagaaaagaaagcgaaagatagtggcatcgaattaattgctgttgatgcacaaaatgatgcagcaaagcaaacgaacgatgttgaagatttaattcaaaagggtgtcgatgtagttgttattaatccgaccgattcagatgctgttgcttcagcagtaagtgcggcaaatgcagcaaatgttcctgttattacagtagaccgcgttgcgaattcaggtaaggttgtttctcacattgcttctaacaatatcgaaggtggtcaaatggctagtgattacattcgtgaattagttggcgaaggagcaaacgttgctgagttagaaggaatccctggatcttccgctgctcgtgaacgtgggaaaggattccataacgtagccgataagtctttaaaagtagttgcaaaacaagcagctgattttgatagagcgaaaggattatctgttatggaaaacattttgcaagcaaatggtgatattaaagccgtgtttgcgcataacgatgagatggcattaggtgcacttgaagcattgaagtctgctggaaaaacagatgtagtcgttgttggatttgatgcaacagacgatgcagtgaaagcggttaacgatgggcgtatggctgcaacagttgctcaaaaaccggaattaatcggggagaaggcgatgcaaacagcaaaagagataacacaaggtaaaaaagtggacaaatctattccgattgaattagagcttattaagaaaaataaataaatataaaatgaaaattaggaaggaagaacaacaaatgaaattctttattgatacagcaaacgttaacgaaattaaagaggcaaatgaattaggtgtattagctggagtaacgacaaatccatcacttgtagcaaaagaaggcgtagacttccacgaacgcattcgtgaaatttgcaacgttgtagaaggacctgtaagtgcagaagtaattagcttagaagctgataagatgatt

SEQ ID NO: 876 - DNA, 1994 bp, Bacillus thuringiensis
taaaatcttatttgttatgattattataattgttaactgtattaaataagggtgggattctatgataaaaaaagaaaacagtgtattttatatctccttcttgctaacaacattattcattatatggggaattaccccagcaagttggattcaaggctacgatttacaaagtgttacatcttctttaaactcatttatcctcaataaatttgggtggttttactctctacttatgactacaatgattattttggctgtttatttagcattttctaagtacggttctattcgtcttggtaaagatggagaaaagccaaaatataattatccatcttggctatccatgttgtttggggcaggaatgggaattggactcctcttttatggaatcgctgaaccgatttcacattttacagatccattaacaggaaaagcggggacagaggaaagtgccaaactcgctatgcaatattcatttttccactggggactctttccgtggtcactatacgcaatggtcgctttaacaattgcatatttcacattccgcaaacaaaaaggtagcactatcggggctacagttactccattatttaatcgatcgaaaaattctcgtatcggaaaaacagttgatattctagctgttttagccacagtatttggcattgtgccatctgttgggattggtgctcaacaaattgctggaggattaagctatttattcccttccattcataacactttacttactcagctcgtacttatagctatcttcgccgttttatatttaacgagtgcacaaactggcttagatcgtgggattaaatatttgagtaacttgaatttctctcttgcaggtattttactcatctctttcttacttttaggaccaactgtatttattatgaaatatttcacatctacactcggttcttatatcggcgctttacctagtatgggattaaatttaggagcatttaatgaaaaatcttcttcttggattgaaaactggactattttctattggggatggtggatttcttggtctccattcgtcggtacattcatcgctcgtatttctaaagggcgcacaataaaagaatttatttttggagttgtattagtcccgactcttatctgtacattttggtttgcagtatttggtggtaccgcaatccatatggaaatgttccaatcgcttggaatagctgatgaaattgcaaaaaatggtacagagattggattatttgctgttatttcacatctaccattctctacatttttaacgattatcgggttaattttagtagccacatttttcgttacttctgccgattcagcaacatttgttgtttcaatgcaaacgagtaacggaagtttatcaccgaaaaatagtttaaaacttatatggggattaacaatcgcgataattgccgctattttattacaagctggaggattaaatgcactacaaatcgcagctataattgctgcgctaccattttctattgtagtcgttcttatggttacttcactctttaaagagctacgaaaagaagatgttaatttgcaaacgaaagaagtgccgaaaaaaataaaaaaggttatgtaacgattggcgcctcaaatcacttctaaatccgtaataaaacccattcatatgaaatatcattttcatatgaatgggtttttcactctattatatagtgttgtaaacatgctttttcctcaaagcctactttcttgtacaatttcatcgcacgatcattattcgtattcaaacatagtactatctctctcatcccttggaaggagaaaatatactgaattgcaacttgtaataactgctctccgacaccttttccatttatatcccccttaaaaaagacattatcataagcctatttcaaaatgaaactgccatgataatgtcttttcaaaaacttatacaatttttttacatttaatcagatcacaccagctttattttttaa

SEQ ID NO: 877 - DNA, 1656 bp, Bacillus thuringiensis
cttgagccttagctgcttcacgagctttagctgcttcctgagctttaacttctgcttgagcttctgccgcttcacgagctttagttgcttcttgagctttagcttttgcttgagtttcagctacttcctgagctttaactgcttcacgaactttagctgtatcttgaacattagtcgttttttcaactttaactactggttgaactttaactggtgctttacctgttaagtaaggaacatgaacataagctgtttttccgttatattcaaattgaatccaatcattctgtacttggtgtgttgtttcaattacatcatcttttttcaacttaccaagaatctctgagtctgtgtttgctccagcacgtacgtttaatacgtttgctgttacgtagtaagtgtcttttgtatagtcagcgcttatgaaagcttctttaccgctattcaattgaacttttgaccaaccattttctgtatgtaaaacatttactttatatccatctaataattttcctacaacttttgattcagtagttgggttttctcgtacgtttagtacgtcagtcgttacgattgtttctgctttagcagatgttgtgaaaatcccaagaccaaaaaccgctgctgttgctatacccataaattttttcataatagcctccattgcatttgttttcgttgacctcattatagcaaccattattttcttatttgcgaaaaacataaaattacaaagctttcgtaacggggcattaatattctgtaacaattccataaatatcctgatagcgcttccttgttgttttttggcgtatcagggcatatgaaacacaaaatgagtagtatttcaattactgtaacgttaataatattacagtaatatttctaggtgatatctatagcgttacgaaagtagcatattttactgtttgaatggaaaattagttataaaacgataatctttttaggcgtgaaaatatataaatgaggtgaaatttaataaaatatcggtataattgttacaaaatcagtcgaagtatggaaaaaattacgccttgattttcgtctgttacatagtatttttgcaataatagaattagataatagccttagtacctataaataatgaagagtattaggatgatagttgtaacgtgaaacatatataatagaagaaactcaattcagtagataaataaaaaacgtaggagtgtaaactcctacgtttttgtttattcatatcgtaaacattcaattggatccagtttggcagctttgttagctggtagtaaaccgaatataataccgattaacatggagatacctactgcaagaagtccaagttcttttgagacaacgagtggccatccagcaaagattgagacgatccaagcgaagaaaataccgagcatgaatccgatgaaaccaccaagtcctgttaaaatacaagattcgattaagaattgtgttaatactttaccacgtgttgcaccaagtgctttacgaataccaatctcacgtgtacgttctgttacagatacgagcatgatgttcattacaccgataccaccaacaagtaaggagatagcagcaataccaccaaataccattttcatcataccgattgattcgtctagttgtttcgtaaattcacct

SEQ ID NO: 878 - DNA, 1645 bp, Bacillus thuringiensis
aacttaacgacttagtaaaagctatcgagttttaattcggcgtaactgctgctgctcctggggctgttgctggtggcgctggagaagctgctgctgagaaaactgaatttgatgtggaactaactagcgctggtgcacaaaaaatcaaagttatcaaagttgttcgtgaaatcactggtcttggcttaaaagaagctaaagaattagttgacaacactccaaaagtaatcaaagaagctgctgctaaagaagaagctgaagaaatcaaagctaaacttgaagaagttggcgctgctgtagaagttaagtaattaacttttgatgctttaaaaaaagctcgctctcatgcgagctttttttttaactgtaaagaaaagaggtggccatatggcagaccattatttttctaacgacccttctagtaaaagtgatcgtaagcgatgggagtttgcccttcgtggatctcgattcactttcttatctgaccatggggtgttctcgaaaaacgaagtggactttggttcccgtcttttaattgaagcgtttcaaatgccagatattaaaggtgatatattagacgtaggttgcggatacggtcctattggtttgtcgttagcgaaagagtttcaaggtcgtgaagttcacatggtggatgtgaacgagagggcacttgggcttgcgaaagaaaacgccgctaataacaaaatcgagaatatacgtatttttcaaagtagcgtctatgaaaatgtagatggtaagtatgctgctattctatctaaccctccaattcgtgcgggtaaagatatcgtacatgagattttagaaaaagctgtggagtatttagttccagatggagagctttggattgttattcaaaagaaacaaggtgcaccgtctgcgctaaaaaaactagaagaagtattttctgaagttgaggttgtagaaaagaaaaaaggatattatatcataaaatcaaaaaaacgttgacggttatttttggctatgttaacattatacaatgccaatatatgattttctgcgttgagaaagatgtatatttttgtttctcttggaaaagatagtaaaatcagcagattatgaaacagaatgatggttttcttatagaagccatttttcttttttgagcaggtagaaagactcaacgtatttatctttaagagaaagagactacgctaatagcagtagttgtatttatttgtgattttgcacaaatttttttgtgcatttataatactcatgatttgaggggtgaagcagttgacaggtcaactagttcaatacggacgccaccgccaacgaagaagttatgcccgtattagtgaagtattagagttaccaaatcttatcgaaattcaaacctcttcttatcagtggtttcttgatgagggtttgcgagaaatgttccaagacatttctccgattgaagactttacgggaaatctatcgcttgaatttatcgactacagcttaggtgaacctaaatactctgtagacgaatgcaaagagcgtgatgtgacgtatgcagcaccacttcgtgtaaaagtgcgtctaatcaacaaggaaactggtgaagtaaaagaacacgatgtgtttatgggagatttcccactcatgacagagactg

SEQ ID NO: 879 - DNA, 2056 bp, Bacillus thuringiensis
gcttcgttgatttcagctggtaactcagaacgctcagcgtgacgagtgtaagtagcttctaatttgtcagcatcgaaagttaagtattctggtacgaagttgttaacttcgatcgcttctttaacaacaacaaggctgttagatttttcgcgaacgctgatagtttgaccaggttttacacggtaagatgggatatctacgcgagcgccatcaaccatgatgtgaccgtggtttactaattggcgagctgcacgacgagtgcgagctaagcccatacggtaaactaagttgtcaagacgagcttcaagaaggatcatgaagttttcgccgtgcttaccaggcattttacctgcttggtcaaatgtgcgacggaattgacgctcagtcatgccgtacatgtgacgaagtttttgtttctcttgtaattgtaaaccgtattctgaaagtttcttacgttggttaggaccgtgaggacctggtgcgtaagggcgtttttctaattcttttcctgtgccgcttagagagattccaagacgacgagacagtttccaagctggacctgtataacgagccatagttgactcctcctttaaaaatgtttttatttacgtaaaataaaaacagacgtaatcgatatttacgggcattttgttttcatgtaccttcgctccagcagcagggagttacgagatacacctccgtagaggaacaaaatacaaacgataaactcacattacaaggctgcctttttattttacacaaacgctattatatcttttacccagagtttcgtcaagcgagtacgtttttgttttatgcatataaattttggaaattaatataagaaggaatttaaaacaatatagaagaagagatagaaacacaaataaagcgcttacataaaatgaaggaaaatgttcatcaaatttttatggatgaatatgcggcaataaaaacataagggggatgtttttatgaaaaagaagcatatggagacagcgttaattcatcacggttatacatctgaggaacataaaggaagtttaacaccacctttatttcaaacttctacatttacatttgagactgcgcagcaaggagaggcgagttttgcgggagtggatccatcttatatttactcacggcttggaaatccaactgtgaaattatttgaagaacgtatggcggtgttagaaggaggagaagaggcacttgccttcggatctggtatggcagctatttcagcgactttaatcggttttttaaaggctggagatcatattatttgttcaaatggattatacggatgcacgtacggttttttagaagtgttagaagaaaaatttatgattacgcattcgttttgtgatatggagacagaggttgatattgaaaataaaattcgcccaaatacaaagcttattttcgttgaaacaccaattaatccgacaatgaaattaattgatttaaaacaagtgattcgggttgcgaagcgaaaaggcttacttgttattgttgataatacgttttgttcaccttatttacaaaggccgcttgagcttggctgtgacgctgttgtgcatagtgcgacaaaatatattggtggtcacggtgacgttgtagcaggtgtaacaatttgtaaaacgaaagcattagctgaaaagattcgcccgatgcgaaaggatatcggcggtattatggcgccgtttgatgcgtggttattattacgtgggttaaagacgttagcagtaagaatggatcgtcattgtgataatgcagaaaaaattgtatcgttcttaagaaaacatgatgcggtagaaggtgtttggtatccagaaggggagttagcatctcgtcaaatgaaacgcgggggcggtgttatttctttttcagtaaaaggcggaaaagaagagacgcaagcgtttattaatgatcttcactttattacaattgcggtgagtttaggagatacagaaacgttaattcagcatccagcaacgatgacgcacgctgcgattccagcggaactaagaaaagaaatgggcattttcgataa

SEQ ID NO: 880 - DNA, 2290 bp, Bacillus thuringiensis
ggacccagaatgcgtgatttctgcgtatttttcacctatttttttttttaggatatcaaaagctcctgctcacggctgagggggagcttcaaatcattcatcaacacttaacgccctaacgattcgtattcgattatgcttttttcgtatctactactttaatatcttcagcataaatcttttctgcatagtctttaatgtttttccagctatctttcgcaatgtttaaatcttctttaatgaaaacaagatcgtttggactaattgaatccacattttgaagtaaagaattgtattttgatcccattgtataccattggtttgaaatgttttgcaacgctgtaattgcagtatcaatcgtatttgttaaatactcagtttgtgttttaatgttcgttaacccagctacttctaattgagcagttgtaatttgtccagttattttttgaatttcagcttgtgcattgtcaagttctttcttcactaatacgataccagctgtaccaccgcctacagctgctgcaccacctgcaattaatgcgactcctagcggtgttcctgcgcccgtagcaataactactgcaccaccaataattgcaattggtcctagagctgtcgcaacagatgaaccgataataattgcattatatttactaattgcttcattgtacgttgtaatttgattttgcagaagtggaatccctgcatcttgactagctaatatagatgtaatttgatttgcatcacccttgaagttttgcgtatccgacgtcattttatttcggaattttttcaagtcttctactaactgatccacttgcgctttattttcattaatactacttgataatctagttaggcctttcgtaagagtcgctttatcttttgcatctaccgcagcaactaaagtatcataatagttttggaattttgtattgtagttaatgatgttttgattcgttgaaataagctgtggctttaatacatctaaccattgcttcgcatttcctctagctgtatcttggtgctgaatcacttttccttttaaagctgcatcaacagtcgatacatttccaaagttaacattaccttgtttaataattgttaaagcatacagatccattactaaagcatttgaacctgttctttccattgcatctttcaaaccttctggtcctaatgaatattcttcatagttattataagcttttgctaccgcatgaactggagcttgtttcactgtactttcagctgcatacgtatgagccggcataatatttcctgctgcaaatactgccataagtgctgatagagccattactttatatggtttttttgtcatttttcttctctccctatatcgctaattatttttctatttaatgtacttcaacgtttgtaacgtaatcttcaaattgatttgtttgcttattcatttcatcacttacttttttaatttgattaaaatgtttttgaagtaaactactgtctgtatacgtgccttcttcaacatttgtttgaatttgaatcatattattatttaaaactttccaatccgttaataacgtttctaaagttgtaatttgacgatcaattaattctgtaaagctatttacttgatcttcaacgaatgtaatttgagtcgcctctgcttcagtttgtgataacttttgaataagtggcaataactctttttgcttttgctgaatgcgaaaagctgcttctctcgtttgactatctgcagcatttacaatttcattacttaaagtaccgatagaaacaaaatcgattgttttcgtttgtgcagtttgatttgtgattgtaaatacttgtttaccgatattaatagaacctttaattatttcttgaggtctattcaaaatagtagttagttcagcttgaatttccccttgaattcttttaatatcttctcttaatttcacaatatctccacttgatccttgcagtgtttttattgcttcatcggctttaattgataagttgttactatctttgtctaatactgttttaaatcgatttaactctaataaatcttgctccatactctcttggatgctctgtacttgcaattgtaattttccatatgcactcataaaatctgtttttgcttgctgatcttcatttacatttcctgctagttcatagagcttactataataactattgaatctagtgctgtatctcatcatctcttgatttaagtcaattagcttcggattatattcatcaatccactctcgtacattcgcctttgcaaacttttgatgat

SEQ ID NO: 881 - DNA, 2170 bp, Bacillus thuringiensis
agttatctatccaatatgcagattttgtcatgtggcagaaggaatggcaaaaagaggagagtttgaatcagcatcttcaatattggaaggaagaattatctggggaactaccggttttacaattaccgatggatcgtcctcgacctgcagttcaaacccatcgtggtgcaagtcagtccttaatagtggcgaattccttacaggaaaagctcaaagatttaagtttgcaagaaggatgcactttatttatgacattgatggcagcgtatcaaagcttcctttctcgttatacaggacaggacgacattatagttggaagccccatcgctaatcgaaatgtgaaagagattgagggatcaataggattttttgcaaatacgttagtttatcgagctgatttcagtggaaatccgacgttccaagaactattgtcgcagataagaaaaaaagcactaaaagcatacgagtatcaggacatcccatttgagaaagtggtagaatccgtaaaacctgaacggaatacaagtcattcaccaatattccaaactatgtttactttacagaatacgaaacaagagtttcttcagctatccgaaagacaaatggaactcatggaaagctatgtttctgttgccaaatttgatttgagtttatttgcttctgagacggaagaaggattatcactaacctttgaatataatactgatttgtttaatgatacaaccattaaacgtatggtaaatcattttgaacattggttaaatcaaattgcctcttatccaaaatgtttattatcagaattgaatatgttatcgaaagtggaatataagcaactactagaggaatggaatgaatcagccgttatagatatagaagatagtacgattcatacaatgtttgaagaacaagtgaaaaaaacaccagaagcaattgcagtagtgtgcgaagatgaagaactaacatatcgagagttggacgaacgctcgaatcagttggcacattatttacaaaaaaatggtgtaacatgcgaaacattggttgggatttgcgttacacgttcatccgagatgattgtcggtctcttaggaattatgaaggcgggaggagcatatgtcccaattgatccagcgtatccggaaagtcgactgcagtacattttagaagatgctcaaataaaggtactggtgacacaggaaaagttacaacaaaaaatggttatacctacattcgttaacgtcatttgtattgatcgtaatcgagcagaaatagaacaagaagttactacggtatgcacgagtgaagtgacgggtgataacttagcctatattatctatacttcaggttccacgggaaatccaaagggagtaatgattgagcacaggaatacagtaacaatgattcattgggcgcatcatacgtattctcgaaaggaattagcgggagtattagcttcaacttcactatcttttgatttatctgtttttgaagtatttgttcccttaacgatgggtggtaaggtgattgtcgctgaaaatgctctacatctagacaagttgtctaccaaaggtgtgactttggttaatactgtgccatcggcagcaaaggaactggttcgagcaaaaacaattccttcttcagtaaaggtaatgaatttggctggagaaccgttaccatatccgcttgttcaagatttatacgagagaagtacgattgagaaggtgttcaacttatatggaccgtctgaagatactacgtattccacgtatatggaattagaaaagggtgtcatgcatagggtaccaccaattggtaaaccaatcttcaatacagaagtatatgtattgagtgctgaacaaaaaatggttccaattggtgtagttggtgagttgtacattggtggatcagggttagcacgtggatatttaaaacgccctgacttaacgaaaaatcgatttataccgcatccgtttaaagaagacgagcgagtataccggactggagatctagtaaggtatttgccggatggaaatttggagtatgttggacgaattgatcctccggtgacccttcgtgggttccggattgtcctaggagaaatcgtaacggtattaccaaagcatacattagttcccgaagctattgtgatggtgatcgcgaatctcaagatccg

SEQ ID NO: 882 - DNA, 1852 bp, Bacillus thuringiensis
tgataacatatgatgctcgcaatgaacttacaaggcgatgtactaacgtatgcgcaaaactacttatctatcgtcggaggagccatcttcctacaagctattattaactcattagccgcaattatccgtgtacacggttttacaaagcaagcgatgtttatttcactcggaatgaatatgattcatatcgttggaaactacgtactcattttcgggaaatttggtttccctgagctcggtgtacaaggggctgcaatttcttccgctatcagtcgattgatcgcacttattgttttcttctggttactataccgcgttatggaatatcgtgtgaaattacaatattacttcactttatccaaagaatacattgggaaaattttaaaaattggcattccatctgcatttgaacaagtgatgtatcaagcttgtcaaatcgtcttcctttattacgcaacgtacttaggaacggaatcattagctgctagacaatacgctactaacatttccatgttcacttatttatttgcaattgcaattggtatgggaacagccattattattggccgcctcgttggtggtggcgaaaaagatgaagcatacgaacgcttgtggaaaagtgtaaaatgggcaattggtgtaactttatgtatggtcgctctcgttattacattccgtacacaattaatgggactgtttacagataatccgcacattatcgggttaggcgcaagtgttcttttactaagtgtactacttgaaacgggacgtacgatgaacatcgtcatcattaattcgcttcgtgcagctggtgatgcaaaatatcctgttttaatcggtgcattctctatggtgttaatgagtttaccactaggttactttttcgcctttcatttagatatggggctcgttggtatttggctagcaatcgccatcgacgaatggacacgtgccattattatgttcttccgctggaaaagtagagcatgggagcgttatgcacttgttaaacctgaagaacaagaggagaatgtttctgttcaagttcagtaattttgcatatggatatcactaatgatacatgagatttatatcggcgattctttaaatatatcgactgaccgacaaatgtatacaattcttttatatagtagaaaagagccatccttccataacagaagaatggctctttttcttattgataaatctctttatatttcttgtactccgcttccgaacatagtacgaaatgtcctgggcgaatttcacgcattgttggtgcttcactaccataattatgctgtgatggatcatatacgatacgtttacgattgcgctcataatctggatctggaagtggaatcgctgataatagtgatttcgtatatggatgaattggattcgcatataattcatcacttgttgttaactcaacgatttggccacggtacattacaccaatacggtcactaatgtattttaccattgataaatcatgggcgatgaataagtatgttaaacctttttctttttgtagctttttcagtaagtttacaacttgcgcctgaatcgatacgtcaagtgctgagatcggctcatcggcaatgataaattctgggtctacagcaagcgctcgagcgataccgatacgctgacgttgtccacctgagaattcgtgtgggaaacggtttgcgtgctctttatttaaaccaactgtgtttaatagttcatgaacacggtccatgcgctcttttttacttttcgctagtccgtgaatatcgataccttctgcaataatatcccctactgtcatcgagggtttaatgatgctatggatcttgaaaatatttgc

SEQ ID NO: 883 - DNA, 3163 bp, Bacillus thuringiensis
taagatttttatataatatatatatctataatttaacttttgtagtgaaatctatgactttattaataatcccatagaggtaacctgatatattcttttctttcccatatactcctgtttactattctcaagattagtaagtgtggcgcgtgtcttttccgtttgtgcttctccctctatatgagtaaactcaatacaatctcctactttgactgaaacggtttggctctcagcatcttgttgtctatttcctataatttctttattgtacaaaatattaccggataaattctggactttaatgcttgcatacgtattagtaaaataaggatggggtatacccgcttctaatttaagctgcattttttctgttgctttgttatattctattttcgcgatttctcgattattatatccctttaaagaccacctaaaatgatttccatctaaaaccgttgtttctggcattttttctactttcttcaagccttcttttgtaacttgatatcttgctgtttttccaatggtttcatttttgttattttcaaggttaattaaagttgctcgcgttttttcctttgttgcttctccttctatatgggtaaattcaatgtaatcccctaccttgacgggcacagtttggctttcagcattttgttgtttatttcccacgatttccttattgtacagaacgttaccagaagaattctggaccttaatactagcatacgtactagcaaaataggaatgtggtacacctgcttctagttttaccttcatctcttctaccgttttatcataatctacttttgcaatttctctatcactatatccttttaatgaccatgcaaacttgtttccttctaaaattgttgcttctggcattttttctattttcttcaggccttcctttgtaacttcgtatagggctttttttccaaagctctcttgtttactattatctacatttgtaagagtagctctatgtacaccttctagatgtgttaactctatataatcgcctactttgactggaactttctgcgattcagcattttgctgtttgtttccataaatctctttgttatagaccactttacctgatgtgttttgcactttaatacttgcatatgtactatcaaagtagtcatgtggtacacctgcttttagatcaatttgcatttcttctgttgatttatttaaatttactttcgcaaattcaaaatctccaatccctttcagcgaccatgcaaattcattaccttcaaaaatgtttggagattcatttttgatttgtacctttttctcaacagtttgatcaaatatatccgttaatacaatttttgcataagcatttgttggtaatgatatagattgactgattccattttgataagatttaatatcattaattacgttaataggttggcccgtcatattttcattgttataaatttcaattttccccttaaattgcggtgtactattttcttttagtttccaagatacatttaatttttcattttcataatatatagattggatatcaaaatctaattttcctatttcaggttgagtaggttgatttagcgtgaatatttttcctgccccaatagtagactgcgtattacctcctgctttgacccatacatattctgaagtagatcctccatcatattgataagtattatcatgcgttccagaaatactttgattattccaagaactccattgtttatcaactaattttcggctataaccatttttcaagcgcgcttctcgaacattctgtccactatcagcccagtcttcttgaaacattcctaaaccatgattaaatgcaacattagcaaccggaaagtccataattgcaatttgatgccatttattctttgttacatctttcatccattgtccaaatttagtatgaccattttcttgccatgaacgcattgtcattgtgtaccaattgtagtctttccaaccataagttgtttgaaccttcattcctgttccttctcctccaaagggtccagcttgcgaattcggagataagtattcggcctttattgcttctttagaggaaattggatcccataaggcaaaatgtaaagtacgttttccattttcatcaaacccactttgttgttgaaaaccagcatatcctccagcttcaccacctgcattccagttgtgtacagcccagtacgtataaggtggtgtctgaactggtgaccagtctatactaataatatctgaggcaggtatattttggggactcacataaactgctggagcagctgaatgtgttgcagctttagtgtgcaaaatagacgttccaaacatagaaaacatgctacatgctgcggtaattataataactttattaaatctttgctttgttttctgactaatcactaatctacatccttttctaatttttattattgaatactaacgtagtagagaaatctatcaaaattcaaacaacatccagtaattctttaaaatactggatgttgttctatctttacatctgattcttacatattaattgattgtaattgctttccataaaaatagtgcaactttccaattcaggtcaccatttcctcgatgagttcgaacaccttgatactctgtactgtgacggtctacctttatcctattagcatacgccctttttgtatcccatttttcataagatacattttgatctttggtttttacaagaagaatttcactttggattgatgtatttccagctgcatctacagccttcactgcatatttatattccttattaactgttaagttttgatcagtaaacgtcgttccttgtaccgtttgaatcaattgtccatcgcgtaatacctgatattcttttacacctacattatctgtagaaggattccattttagctctacactgttagaagtaaggttgcttgcatataatccttgtggctgtgtgggagcttctgtatctggtttcggattaacaatttgatttactttcttcagaccttcctttgtaacttcgtacatggctttttttccaaagctctcttgtttactattatctacatttgtgagagtagctctatgcacaccttctagatgtgttaactcaatataatctcctactttgactgaaactttt

SEQ ID NO: 884 - DNA, 1782 bp, Bacillus thuringiensis
gatcttccaaggagttgggttattacatattatttagtcacttcaagatgtgctcttaacttattcgttaaatcttgttttgctgcatccggaacatagtagtaccaaataccatcagcggctttgtggccgtcacctgggatttgaatttcttcactgttcttcaagcaatctttatagttcttttgcatatcaaacatttgatcttgcgttaagtttgttttcacgttcttttgaattgctgttaacacatcgccatagcttgttaaagaagagaaggttgcacctttcttaataacagcttgcatcacttgacgttgacgcatttgacgaccgaagtcgcctcgtgggtcttctttgcgcatacgtgtatatgctagagcttggtcacctgttaagtgaatattccctttctggaagtgtttcccttctagggagaattctaaatcattattaacatcgacaccgcctactgcatctacaatatctttaaatccttccatgtttacttcaatatagtaattgataggaacatttaagaatttttctactgtcgctacagacatgtctacgccaccaaatgcgtacgcatggttgattttatcacttttaccctttccaacgatttcagtatacgtatcacgaggaatacttactgttttcattgaattatttttagggtttaatgtaatgaccattaaagaatctgaacgtcctttatctccaccacgctcatctgcacctaatagtaaaattgaaacaggttcagatttattgattttttcttctggtttattaccttgatcgcgttttaatggtttatgaacttcatctaatgtttttgaaacagaagaatatatattataagcgtaagctcctccacctataattagtactcctataattcctaatatccaaaataggattttctttttcatgcttttaaccttctttcttcaggtaccgctatcaaattattataactacaaaatataaaatacattatacatgtaattcaatttttaagccaaactatattgataactcaatgaaagttttagcaacctataaccaattctctagttactaactttttgatatccagtcttattttcagactgccacctccaagaatctgcacacatttcttctaatccgcgtgttgcctcccagcctaattcacgctttgctttcgatgcatcagcaaaacatactgccacatcacctgggcgacgctctgtaattttataaggaactttcttacccgaaactttttcaaatgcttcaaccatctctagtacactatagcccatacctgtgcccaggttataagcatctactcctgttgtactcagtactttctcaagcgcctttacgtgaccatttgctaagtccacaacatggatgtaatcacggactcctgttccatctttcgttggatagtcatttccgaatacgcttaattcttttaacttacctactgctacttgcgttacatatggcattaagttatttgggattccatttggatcttctccgatacgcccactttcgtgtgcaccaaatggattgaaatagcgaagtaatgcgatactccattctgcatctgcaaatgctacatcacgcataatttgctcaatcattaatttcgtttgaccatatggatttgttgcacttaatggaaactcctccgtaatcggtgacgtttccgggataccatatacagttgcagatgaactaaagaatatcttctttacattatgtttctgcattacttcacat

SEQ ID NO: 885 - DNA, 1493 bp, Bacillus thuringiensis
gaaaaagctgatcaccctctcgttcgggaagcaaattttccgtactgccgaaaattaatacaggctggttgcaatatttatgcatttcaacaagggttttttcacgccaaaattattatagtggacgatgatatttgtgatatcggaacggcaaactttgatatgagaagtttatatattaaccatgaaataaactgcctgttatataataaacatttcattcaaacagtaaaaaataaatttcatgaagatctagagaatgcatccgtactttcatatagcgatgtaaacccgccttctcttatcaatagaggaaaggaatggattggaacaatatttgctttctttttataggaaagacaatgaataaaagaggtgtatctcatatgattatacggtttggatatgtctcacatgcaatggcactctgggactgttctcctgccaaaacaatgacgtttacaagctttaagaaacttagcaagcaagaacgagaagacaacctgtaccatgttataaagcaaaatttagagcacacaatacgtatccttcattacaatatagcgcatgaaatcccactatatcgcctatcgtcttccatcgtcccacttgcaacacatcccgaagtcgagtttgactatattggggtattcacacatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttatattcgcttagttctcttttgtgcttttgcaacagaagttggcgcatcttaaacatcgtggaagaacatataaaaatggcaatgagttttccatacacatggcattctaatcgctcttgtttgatagtttgccaatgatgaatttgaaatagagatttccacgttttaaatatgatttgtcgggtaaaagactggcgcggtatcagttgtgatccgtttccagcctctccccataagaactgctcgtgaggttttccctcaagcagctcaccccataaacttcatcaaaagggttatgagacctatcaaatggcagacactttcatcggaaactctctgcacttttcagggaaggactttccagtcccagtaaagccccagtacaccatagagatattcgttactccatctctgccatccgatgctacgtttcgtacgtcggttctttctcgtcacagggtgcgaattttattcttcgtatattcacgtacttact

SEQ ID NO: 886 - DNA, 2701 bp, Bacillus thuringiensis
acgaggacaatactcgccattttcggtaaaaacgtcagcgtttgctcttgaatttgcatcatcgccataatgacagcgatgataataacgacaatcatacttacgccggcaaccggcattaaaatcataacccctttataaaaaaaggtttgaaaaatatctataattggtgacgtattcatttatatgactcctatcacatagcatcaaacgcttcaggcgaccgttttaaacataatgtcgacgatttttgtatatccacctaaatatacgaaaacgagtattttaaacggtaaacttaaaatcatcggcggtaccatcatcatcccgaggtacattaaaagtgtactaataatcaaatctataaatacaaacgctaaataaatgaacatccctgttagtaaacctttttgaatttgcgttaacgtaaaggatggtacgagcgtaaatagtgaaagatctttcaaatctttcggcaactcttctccgcgtactttcagcatcatttttaaatcatgcttatacgtatgctttgacatatattctttcataataggagctgtcgtttccgcagcttgacttactgttattttctctttcgtcatcggatcccacacatcactcttcagttgcccgagtacaggctgcatcgtaaagagtgataaaaataatgcaagtccaacaagcacttggtttggtggtaaattcattaccccaagtccttgacgtgtaatccctagaacgatcataaaataagtaaaatgtgtaaataatagaacgatagaagaagataatgataaaagggtaacgagcgcaaatagttgtacacttgaattactcgtaaactcttttccattttcgaaattaataaaaccgttcggggctgcatacgctggatttacaaaaataattgaaaaaacgatagaaaatacgaaaataacggctaataatgataactgtttctttattctcatgatggatcctctacttttttcgtttcactcttcaccgcgtcttctagtgcttgttgaaactgatttcctgttccggttaattgcacagactgcacaccgttattactaataacagtgaacacttgctttccgtccacttcaaataaaaaggcactcgtttgatgatttaaataaacgccgtcttttacttgtatatggccattttcaccctgcttaaaaactgctgtttgcgcgtctttttcgtcatataatatgcaccgtagccgagcgcaccaaacagtaaaacgacttgaaataaggtcgtcatatacgacatatgactcctcctctactctttatcttgcatttgactttgcgctttcataagcgccgcttgtttcttatcagcttcaatttcagaaatgataataccgaatttctcgtccattacgattgcttcaccgatgccgactttcatattacttaaatacacatctactttatgtcctaagtttttctctacttcaagaacatcgccaacttttaactgctttacatcaccgagtgtaatagatgactttccaagctttacaccaagttcaatcgaaatatctgaaacagtatcaatatgtgcttaacctgcttcatttcgctttcctgcaaaatcttctaatcccattaatgacacgggagatacttcatgcttcatatggatcctcctactctacaaaacttttaaataggagcgccttacgcgttccatcttttacaataaaacaattaaatctatgctttccatctacataaccaagtaattcatccgaaactttcgtatgaagcggaattatatcgccttcttcaatttgttcaatctcactcattgtcattttctgctcaccaattgcaacgtgaacaggtttgtacacttgatttactttcatttccacttcagacatatactttttacgtttatctgaagaatgttcgacaatattttcagacgttaacttatccataatttcttcaacagataagaatggaattccgatacgcaccgtcgtattccaaaaatctgttttcatatttacgttaagtaatgaaatgatatcactcgctgtcgtaatctttaatgcattcggatctgtttctgtcgttacaaatttcggttcaatcgcaacaacactttcaaatgattgctctaaatttttacaaagaagcaagaatatattatcaagcgttaaaaactcaaacgctgttaacggtctgcgcatcgtaaagttacgcttactatctccgccaagccaacattcatgaatataaataacgaatgctaaatcaatctcaataacaatttctccaagctctggtaaaccgagatcaattacgcaatataaataataatctttcggcattttctccacatattcactcgtaaatggaacttgctcaactgttgaaggctctagttcaattggaatacgcatacgcgctgataacgtctgtgacgtctgttttccaaaagtagaagcaatcgcttgcaaactacgtaaatgctcaacaccgaacttctctggtctattaaaatcatactcttgaaatttctcttgctttcctgcttcttgtgcgaaagctggcatttcctcgccttcatttaccgccttcagcagggcatcaatttgctcttggcttaatttttcgccactcatgacaatccccttccctaccttttcaattcaacgatttcaacg

SEQ ID NO: 887 - DNA, 2390 bp, Bacillus thuringiensis
cattattcccaccagctggtttttaaaaaatcgctaatgattgtagtgaatcttctggtacatcactagcaagctcagcaattgcctcttcaattttcggtaatattacatctttaaactcatcttcaattactggaccaattttagtaccaaacttttgcatcgactgcttctctgcttcttgcattgcataagtaataaaagtatcggtggttaacctgtcattcgcttcttcatatgtgtaggacgtgctctccaaactttgttgcccagctgtgctcgtaggcttgtccgcagctttggcattatcaagtaatatggaaggaggcgtcactaaaccaaatgtaaacacggtaattagtgcgactaaggtttttctaaaccaatttggcatttatgttccctcccctttcactcattattttttatataacggtggtttcttctattatacaaaatgattgtaattattgcactttacaattttgttaacgttcacatatttttcacttgaatatgaaattgtaagatttcatacaataaaaatacaacaaaaataaggaggcgatcagatgactttagatgtcatgtattccgccgcaagtatactcgttttagtatattttatttatcaatgtgttacagactagaaaaagagccatcaatggctcttttttaatggtagaaatacaatccatacaatcaataaaataaaaacaatgccaccaatcacagctggcaataaataaaaccgggaaagtataactattccatataaaagtattgctggtagtagtaaataacgatctgccttccatcttaacaatagtaatttcccttcatcacaatatacacgaagaaacatcttattcgtaaattcagtccaataatcacgtgcatagcgagaaattgcaactacagcaaatacgagaacaatagccgcaatccaccttggagtcataattatacttacagtactgatacatacaatttgaatataaaatattcgtgcagtacttgtacggaaaaattctttcaaaaaagattcgacaatacgagaatcagcttttttccctaaaagtcttttagagcgaggaaatatccacggttttttattcgaactactcggtttagccgcatgaccaccaacttgcataattccgctcgtccagcgcatgctttcctccttttctttctcgatttctttaaaaaagaactttttataattcattttctcttttactaatacactacttaagaaaattactagaccgataaataaaattgaatacaatggatttttataaataaaaaataaactaattccaaaaaaggacacgctcatagaaaatactacattttttacaatccataaaacccatcgtttccccacatgtacatgaataaatctcgttaacaacgacaacataaatcgaaatatagtaaagaatacccaaaataataggacttgtatccctgttacttcgatactttccatcaacaccggtaacataataacgactacaattatattcgttatcgctattcgaacaaatgtgtacatcatgccatactggactaattttcgcatatgtgttgcatacgaaattaaaaataaactatccgcttgctcaaaaaatgaacgaactcctcttccatatgtaatcacataaaatgcgagtaatcctaatccgaaataaatcgtctcttccgttgataattcatttatccatagcgatcgataatagattcccataaatataagtgctggaataataatatataatgcgactgtccaatctgttaccgaacgtatagacttccatttccgctcaagttcatggcgtaatctcttataaaattgttgtttaatcatgttgttcacgccttacaattacatcaaagcagtctaataatgaactacccggcatttccgctaatatttgaatagattctaaatgtccatctgcgactaatgtaccttgtgaaatgagtaaaaatctttcacaaattttttcagcagtatctaatacgtgcgtacaaaataaaattcctgccccgcgctctttttctttatataaataatttaaaaactctttcgtagctaccggatctaaaccgataaaaggttcgtcaatgatataaaaatctggctcagttaaaaacgccaatattagcatcgatttttgtttcatgccttttgaaaattttgataaatactcatgtttatgcttattcattcgaaaagtatgtaataattgttccgctcgttcttcccaacttcccatttcacttccacgagctgccattaataattcaatatgttcccagagcgtcaagtaatcatagtatgttggatgttctggtacgtatgcatacggatttttctt

SEQ ID NO: 888 - DNA, 2083 bp, Bacillus thuringiensis
tcatcctgagccaggatcaaactctccaataaagttagtttgtctagcatctaaaataaaaattgacgtttcacgttgtttgtttcgttcagttttcaaagaactacttagccgctcatttgcgacttccttatgttaacactttcgttatttgatgtcaactaagtttttcatttcgtttgtcgcttgcgacgttattgtcatcggcgacttgttctatattacacctctaagctctaatcgtcaatatgtttttataaaaaatataaaaaggcttatttcttttaaaataagcctttttatcacatatcattctattcatttattatttttctataattggtaacgaaacgataaattgaataataccatccctatattccgctcgaatactaccaccttgtaactcaacaatacttttcgcaatcgctaaaccgagtcccgacccttccgttactctacttcgagattgatccttcttatagaaacgttcaaacaaattcgctaactcttctctcgtaaactcttcactatgattcgcaattacaatttgtatatccctacgctgcctttgaagagaaacttttatatctgcatcatctttactatacttaatcgcattcattagtaaattatcaaatacacgaaccatcttttccgaatcaatcgatgcataagcacgttcctcaggaaacttcttaacaaacgtaagtccatgttcttccgcctgcggtactaactcttctattaattgctcgagtagctcattcatacaaacttcctgtttttctaatacaacttgttcatttgttaacttcgtatactcaaataaatcttctattaaattttttaactgctccgactttgcaaaagcaattctcgtatactcatcgtgttgttctttattttcatatttagaatctcgaagtaatcgtaagtagcccataatagaagtcagcggtgtgcgtaaatcgtgagatacattcgtaataagctcattcttttgcttctctaatttacgttccttttctatattattcataagctcttctgccatattattaatattctcagttaaagctgcaatctcatcttcaccttttttctcaatgcggtacgctaagttgcctctttctatttcctttacaccttgtgccattgcttcaatctgcttcatctttctctttgttatatagaagaaagagaaaatgaatacaagaacaccaattaaaaacgggaatggcccttctttcgtgtcatacattacctctccctctggaattccgctaacaaacatgtacaaattctttccttcaatagtaataggtgaaaaagatataaactcttttcttgtactttcaaatacatttctaccatctgtataattaatcgcaaatgatgctgcattacgaatcgtattatgcaaatcgatttgctcttcttgcgcttgctttgttttatataaaactttaccactttcatcagtaaccaatatctttaaagctctagacccttgctctaaattttggttctccatttcgatcatatttgatatagcttctaatttattttcatgaaccgaactatttgccgctccttgagcttggtgattaatttgttccataccagcccgataatcgatagttgcttgacgattcgcattctcaaaaaatggcgcagctcccttcgctgacaaaactcctaataacgcacaagcagcaaaagtagtaatcaattgaatccttatactctttcgtacgctctttactaatttctcaattaattctcttattttccttatataagtaaacggattaaatatctttttcaatcttataccccactccccatactgtttttatatatctaggtttccttggattctcctcaatcttttcacgcactttccgaatgtgcaccattacagtattatcagactggaaagatcgttcgttccacaccttttcataaatttgctccgcactaaacaccatacctggatttctagctagcaattctaaaattgaaaatttccttcgaggttagtttcacttcttcttcctctacaacaactttatggggt

SEQ ID NO: 889 - DNA, 1914 bp, Bacillus thuringiensis
cccgcgataatatatagccgtattttctttattcggtacatgatgatggacattatcaatccaatcctttacctcttcaagagaatcaatttttcctacagcatacaaagcaactgccgctgccccaagcgcagatgcttcatgactttcaggtacaagcaattcttttcccatcatatcggacaacatttgtctccaaaatgcagattttgcaaaccctcctgaaactcgtatttcagtaagtggccctgtacaatccctgattgcgagtgctactgaatatacactcatacaaacaccttccatcactgcacgtataaaatgttctcgcttatgttgaagattgattccaaagaatgtaccacgagcatttgcattccagtaaggtgcgcgttctccagataagaaaggtaagaacaatagcccatccgctccagctggtacgctttctgcatatttaattaataaatcataaggatcaatgccgagctttcttgctacttcttgctctggactaccaaattcatcacgtaaccatctcagtaatattccgccgttattcgttggaccaccgattacccagtgctcatctgttaatgcgtaacaaaacgttctccctttctcatctgtatttatatttgatgagattgttcgaaccgcaccactcgttccaatcgtaattgcagccgcacccggtgatatcgcaccaactcctacatttgcaagaaccccatcacttgctccgatgacaattggtgtttctgcacttatccccatcttctgtgctaattctggcttcatacctgataaaatatatgtagttggtacaggggttgataatttttctggtgacatatgtaacatagttaaaacatctttatcccagtttaatgtttctaaattaaataaccccgtagcagaagcaatcgaataatcaactacgtagcgtgaaaataattggtaaatcacatactctttaaatggaatgaatttataggcacttgtatataactctggttcctcttctttcatccataacaatttagaaagtggtgacatcggatgaatcggtgtacctgtacgtctataaatttcatgcccattcatttgttgtaataatttttctgattgcttcgtacttcgattatctgcccaaatgatagaacgcgttaatggcgcaccattttcatctactgcaattaatgcgtgcatagctgtactaataccgattgaagaaatatcttctggtaatacattacctttttcaatggcaacgcttacacttttgtatacagcggcacatattacatcaggatcttgctcagcccatcctacattcggttgaataattgggtaatcgattgcatgtgatgcaatgacttttcctttttctgtgaacacaaccgtttttgtacttgtggtaccgatatcaatcccgattactctcccccttgtttccatgcgaatcttcccttcatttctagcaaaatacgatttagtaaaccgtttacatgaattagtatataaaatattttttcatttatcaagttgtaaaaagaaattttttttcatatcaaaaaataaatcccctcattccatttcacttatatactacatttagcttttccatggggtaaaattacgttatattcgttacgcaatacactctttcctctcattaacaacacatacatagtcctccatacgttctacttatttgcttgaagaaagagttgaaaagcaatattcatttttagcggtcacgtaacatcaccatccagccaagaaaagtaactaaccgcagaatgagaattctgggcattttgcttcttatttattgttttagggttcactaggtcttttatctttgataaacatagagcgtgggcccccctacttatcactttttttacc

SEQ ID NO: 890 - DNA, 1496 bp, Bacillus thuringiensis
cttttttttgaggtgtatcttaaaatcaagcgtagttatgactatttttcgcccgtaggggggagacaattgtgattcaaacgaaacaaaaaggcttgcaagaagttcttagtgcagccattaagcatgcaactgatgaaaaaatattggttagttttgtaaaacaaatagactggatggatccgcttctgttttatgcagcaggaaaaaggattgcattggaaaatagatgttattttgcagatccagctcagcatgtaatatttgctggaattggctctgttttcactatagcaaattcttctcacaaacgctttcaagcggctcgtgacgagtgggataaagtaaaagagaaagcatttgtacaaagagaaaaatatgaatttggaacaggtcctcttttatttggtggattttcatttgaccaagaaaaagagaaaacggacttatggaaagaattcgatgatacgacattttcactaccagcatttttattaactgtaaaaaatgaaaaagcatggttaacgatgaatacattcgtttcagcaacagattgtgcagaaactctttataacgaaattgtttctttagaagagaaaatttttggggagagtaaatgtgcattagaaggattgaaattaacagttacttctaaagtggaagtggatccgaaaggctggatgaaagccattaagaaagtgcaagatgagatgaagcagggtaacgtgcagaaggttgtattagcgagggagctaaaagtagaaatggatcatcatattgattctgctcttgttttagaagcacttcgcattgggcaaccggattgttacgtattttcttttgattataaaggagcatgcttcttaggagcgacgccagagaggttaattcgtaaagaagatgagaagtttacttcgatgtgtcttgctggttcaactggtcatggtcaatctatagaagaaagtaagcgaaatagtaatgcgcttcttcatgatgaaaagaatttagctgaacacggttatgttgtgaacatgatcaggtcggtattaaatgagcactgcgaatacgttaatattccggagagtccaggtctattaacaacgaaaaacttaattcatttatatacgcctgtagaggcaaaaggcactgcgagtcttttaacgatggtagaagaattacatccaacaccagctcttggcgggacacctcgtttggaagcgatgaaactgattcgtgatgttgaattgttagacagaggattatatggtgcaccgattggctggatagatgatgaaggaaatggtgaatttgcggttgcacttcgctgcggattattaaatggcgagaaagcatccttatttgccggttgcgggattgtaattgattcagtaccgcaacttgaatatgaagagacaagtttgaagtttaaaccgatgcttggtgctttggaggaattaatgaaatgaacaatcatatagaagcattatcatattttt

SEQ ID NO: 891 - DNA, 3034 bp, Bacillus thuringiensis
agaacgtaatgttttatgggagagattaagatgctgaaaagaccgcgtaattttaaaaagatgcttatattgccgtgtatgtgttctattacgttttatttaggatctcaaattatgacgcatacagaagcggcgttcattcatgaaacgaaagtagaagcgacgctttctacagcaattatatttccgaaaacagttaatacgttaaaagagcaatctgagaaacataaacagtttattgagcgtgagtatggaacgatgaagggaaaatcgaaagcaacttctattgaagaaataaaacaggcgatttctgtatggcaacaagggcgtgagaaaattgttgctgagaaggaagccctgcaaaatgtatatactgaaatagaagctccttaccatcaaatacaagaagaattaaaggtaaattaagatgagtcgatgcagcaagtgtccatatatgtaaatgaaggcttccgcagtatcaaagagaagcgtgactatattgagaaagaaattagcttgaaagctattgatgagcaaattcaggctcttcagcaacaattaaacgttgcaattgaagcggaaggacaaaagaaagccgaagaacagaagaaagtagaagaacagaagaaagccgaagaacagaagaaagtagaagaacagaagaaagcagaagaacagaagaaagtagaagaacagaagaaagccgaagaacagaagaaagtagaagaacagaagaaagcagaggaacagaagaaagtagaagaacagaagaaagcagaagaacagaagaaagtagaagaacagaagaaagcagaagaacagaagaaagcagaagaacagaaaaagctagaagagcaaaagaaagcggagtaactgctttagtgaaacagccggaaaacaagaatgtggtgtaagagagagtgaacgaataagcaagactagtaatatttatacgagtgtgagggaacgttagccctcacctctttgtttttcttttttcttatagtattaaatgatttgagtgtgaaaaaagttataaattatcattgtttttttctgaaaagtctaaatgatattgagaaataaaaataactgaaaatattaataaatatgtgttgtgtttatatagggttgttcgttataatgaacataaggtttttaaaaaagaacacatattagctaagctaatatagttttctttacatctcttattgaaaaataagtgataaaaatataaaaaaaagctagggggaattgattgtgagtctgaaaaagaaattaggtatgggagtcgcatcagcagcattggggttagctttaattggtggaggaacatttgcattctttagcgataaagaagtatcaaacaatacatttgcagctgggacgttagaccttacattaaaccctaagacgcttgtagatattaaagatttaaaaccaggggattctgttaagaaagagttcttattacaaaacagcggttcgttaactattaaagacgttaaattagcaacaaagtatactgttaaagatgcaaaaggtgataatgctggtgaagactttggtaagcacgttaaagtaaaattcctttggaactgggataaacaaagtgagcctgtatacgaaacaactttagcagacttacaaaaagttgatccagatcttttagctaaagatatctttgctcctgagtggggagaaaagggtggattagcagctggtacagaggattatctatgggtacaatttgaatttgtagatgatggaaaagaccaaaatatcttccaaggtgatacattgaatttagaatggacattcaatgctaaccaagaagctggggaagaaaaataataaaaaaagcgggtattcccgcttttttttataaagaaaaagaagtgctggttgtaagcacttctttctattattatttttgattttgcttccactttgtaaattcaagaaattcacgaaattgttctttggagacaccagagttcattgcatctttaacgagttgtgtccattcggagtctaggttagtttcctttgttgtttcatcatgaagtaaagtatcaactggaatttgtagaactgctgcgatcttttcaagaaactgaatggaagggtttttttgtaaatttcgttctatagaactaatgtaagatttagcaacgccagctttttcggcaagttcagttaatgaaatccctttttgtaaacgaaggcgttttatacgttctccaatcatatttgcgcacctttctatcaatatgtagttgtcttatgatgttattattataacataaacttcgttaaaaagaacaaacctattgagcctgactggatggcttcatacgttggaaaaattgctcgatgtcttgcatggcgataccggcatctagagcttcaagtattaaatcaatccattcttgatccagtgcgtctgtcttatctttgtacaaatgtaattcctccctaattatcggtcataattgctgctacagaatacatgataatgaaatccgattttgtgttttatatagtgaattatcaaatattgtgtagatgaaacaaagataaaatccccattaaactccctctatggaaattataaattgttcgataaaaactttcaatattttcagaaaacattgttgaattgtgatatattcgtatgctaactatgaaatttttacaaatatattaaaaacattacataatatgactaaatattgaaaaaatattgaatttttaataaaatttaatttgtaatacatattatttattaggggaggaaataagggatgaacaagaaaccgttcaaagttttgtcatcaatcgcattgacagctgtattaggcctttcattcggagctggcactcaatctgcatatgctgaaacgcctgtgaataaaacagctacgagcccagaggatgatcatttaattccggaagaacgctaagcagatgcaatataataacgtggggtaattgattcgaaggcttcagagacagatacaaagaaagcagt

SEQ ID NO: 892 - DNA, 3404 bp, Bacillus thuringiensis
ctgctattatgcatgcgggtttagtaaatgcttgttgtatcatgttaactagattttcacctgtttttcatgatgatattgcacaaataattttactaattttctctagcatttctgtcttgataggcacaggaattagcttagtccaagttgattataaacgtcagctagtaggttcaactattgcacaaatgggatttatgcttattcaatgtgcattaggcgcctatttagcggctgttattcatttaattttacatgggttgtttaaagctacactgtttttacaagctggttcttcagtgcaacgttttggggtagcgaatcagtctaatgaaaagatgtccaatttatggattagagtcgggcgtgttttaggattatttatagcaattactttctggtttatgacttctggagaggggtatcaactagctagtgcgttaatcttaggctggtcactatacttttcatggaaacagcttgttgtttttggagagggaagaatgggacgaattgctggcgtaattgttttgattggattttctctcatttactttaccgttcataattctctttataaatggttgcatactgatatttatcaaagtgttcaaccttcagctccagccgttatctttgttatatgtattttactatttagtagtgttactagtactttcgttactcgtcatcaatcttctactttattcgctgtactttatctttggttagttcgagtaggtgaggcgagaagaaaatcagtagaaagtcacccaagctatctgaaacattatgtatcaaagggaggtaattcgtgatgagcatatcgtcaatattaaagaaagatacaaacattgatatgcaagaaaataatataaatgatttagttgcatctgctagccgagttattgcaccactttggcctatctctacgtttgcagctcaccacccttggatgggacttgaaaagcaatcatttgaacaagtcgcaaattggctaaaagaagctcgtaatgtggatatgtatcctagtacttccatgattcattcggcaaaagcgaaaggtgagattgaggaatcatttttacaaagtagtttgtctcgttggctggattcacaatcttttcatattccgcgagagaaagtagagcgattttgccaagcggctttaaagttagaaaaattaccttctagtctattatcatcgccagaattaaataaattggcagaagaaatgagttatataaatacagcaaatatgaaagcctctgttatgcagccaataagttcgcttatagagaatcaaaatagtgaaaacctatctgatattcttaattatcatatcattaaatggtgtaaattatatcttgatgactccggatcaagttggacgatgccaaatcgagagaaaggtttttatcgtgcatggcaacaccttattacatttgatccagcgctcagtaaaaatgagcgtaaagttttaaaagattggccacaagatgccgaagtagctttagcgagagcgttatttgaactaggaatttctgaatctaacatacaagcttatcttgaagggcacttactttctttacctgggtgggcaggaatgatacgatggcgctcacaacaatcaattcaggaacaggggcttttaatagaatatttagcagttcgaatttctatggagctggctattgcaaaaccttatttatctttaaaaaatcaaaaggttgagaaaaaagtttcgatcgtcccacttatagcttcttggatctattgggggaatatttcaacacgggaatggtcacaaatgtctgcagctgaacaaagcgaattgttagcatttgcatatcgttttgatgaaaatattcgcaggaaactttggctggaagcttgggaacaaacgcatgcagagcaattaagagagaagattgcttctaaacaacgcgcaaccaatgataaaaagcgtgtattagctcaattagcattttgtattgatgtacgttcagaaccgtttcgtcgccacttagaaaaactaggtccgtttgaaacgtttggaatagctggtttctttgggttaccaattgcgactagtgaactaggtagtaatgacagccatccttccttgccagttatactgaaaccgaagcatcaaataaaagagcttacagatgaaaatgaatttaaatcttatgagcaacgtaagagggtaggcagttcggtgcgttatacatttaaaacgatgaaacagaacgtactgacaagtatggcgctacctgagttaagtggtcctttacttggtctacagatggtgacaagaagctttgtcccaagaggagttggtggtttcattcgtaaacttcgtaaaactatgttacaaaaacctgatacaacattctcgcttaatcatgttcatgacacaaaaggtgagatacctatcggttttacgaaagaagaaaaagtgaactatgtgcgtcaagctttaaaaatggtgggactgacagaaaaatttgctcctttagttgtaatgtgcggacatagtagtcaaagtacgaacaaccccttatgctgcagcacttgagtgtggtgcttgtggcggagcagcaggaggattcaatgcaagagtttttgcgactttatgtaatcttccagaagtgagagaggcgttgtttgctgaaggcattaacattcctaaggataccatttttgcagcagctgaacataaaacaacagtggacgaattggaatggatttacgtcccagaactttcgaaaactgcgcaagaagcgtttgattgtatcgagacgattatgccaaatgtgagccaacatgcaaatagagaacgtttaacgcaattacctaattttaaaacgaaaataaaaaatccgagtaaagaggcgcatcgatttgcaaaagatcgcagtgaaatacgtccagaatggggattagcgcgtaatgcatcttttattatcggacagcgtgaattaactcaagattgtgacttagaaggcagggctttccttcataattatgattggaaacaggatgaaagtggcgatatattagctaacattattgcaggaccaggaacagttgcacagtggataaatctacaatattacgcatcaactgtagctcctcattattatggtagtggaaataaaacaacccaaaccgtaacggcgggtctcggtgttatgcaagggaatgctagtgacctgttgccaggcttaccttggcaatcggttatgcagtcagatagtgagacgtatcattcaccacttcgtttactaattgtcattcaagcacctattgaatatatagaacgtttgttaaataatgatttcacatttcgagaaaaagttcaaaatggatgggttagacttgcaagtgtagatcca

SEQ ID NO: 893 - DNA, 2246 bp, Bacillus thuringiensis
tattatatcatcaattccgttatcgatatttatcattgtgtatgcccaagaatgtttactacgattaatcatatcggcaatattaatatgatgttccgctaagcatcctgtaatttgccctaccatattcgggacgttttgatgcataattgtaattcgtttctttccgatatacggcaattctacgtttggataatttactgagttacgaatatttcctgtctctaaatattcacgtaattgacgcgccgccattactgcacaattttcttccgattcagacgttgatgcgccaaggtgaggcgtcgctgttacatttttcatctttattacattttcattcgggaaatccgttacgtaatgtgtaataatatcttcttctaatgctttttgaagaaccttttcatctacaagttctcctctagagaaattaaatagacgcatccctcttttcatcttctctacagcgtgttccccaatgatccccttcgtttgattcgtaagaggaatatgcagtgtaatataatcacacgttgcaaaaatttcatcaaggctaaatgctctttgcacatgtgtagaaagacgccaagctgtttcaactgaaatataaggatcatatccgataacatccatgcctaacgctaacgcatcgttcgcaactaaagcaccgattgcgccaagtccgataacacctagacgtttccctgcaatttctgatccaacaaattgtttttttcctgattcaacaagctgtggtacttcttcaccctctaagtttttcgtccaacttacaccattaataatgttgcgtgaagacataataagactggcaataatgagttcctttactgcattagcatttgcccccggcgtgttaaatactacaattcctttttctgtacatcgctcgacaggaatattatttacaccagcgccagctcttgcaatcgcctttaagtcttttgaaaactcttcttgatgtaaagagtagctacgaagcaaaattccatctggatgattgattctatctcctactacataacgttcttcagtaaaaacttgcaaacctttttctgcaatttgatttaacgtttgaacacgaaacatatccccatctccctatctattctcaagctcaaattccttcatataatctactaatcgttttacgccgtgtgctggcatcgcattgtaaatactggcacgcataccgccaactgagcgatgtccttttaacgtaacaaggccgcgttccttcgctttttgtaaaaactcattgttaagttcttctgacggtgttgtaaatggaatgttcataagtgatcgatacgcaggatcaactggtgaagtaaacaatttagattcatctaaaaaatgataaataagtgaagatttcattctattttgttcttcaatcgcagatactccgccttgctctttcaaccactctagtacaagttttgttacgtaaatactaaaggatggcggtgtattatataaggagttatttttactgtaagtttcataatttaacattgtcggacaagagcgatctgctcccccaattaaatctctttttataatagcaatcgttaagcccgctggtcctaaatttttttgtgctcccgcgtatataagaccaaacttcgaaacatcatattgttctgacaaaatatttgaagacatatccgcaacgagcggcactctttctatatgtggaatatccacatattttgtcccctcaattgtattattcgttgtaatatgtacataatctagtttttcatcgcttagtaaaccgtccagtttaggaatcgtagtaaacttctcttgctcggaagaagcaatcacttgtacttccccaactttttcggcttcttgcagtgcctttttagaccatgagccagttagtacgtatccagcttttttatacgtattcattaagttcagtggtatcatagaaaattgtaatgacgcaccgccttgtaaaaataaaacatcatactcatcaggaatgctcattaattcacgaagtaagttactcgcttcctctataatactttgaaaataagaagatcgatgactcatttccataatagacatgcctgtcccgttataatttaaaagctccttttgcactttctctaaaactggcaaagggagtattgatggccctgctgaaaaattatagactctctccattaccctcataacctccctatttattatttggatatttttaaact

SEQ ID NO: 894 - DNA, 2326 bp, Bacillus thuringiensis
aattgtttaaactttacaaagtattcaccataataggttatgaaaataataattaaggaatgggaaatatttataattaactcaatttaacttttaaatttgaaaattaggaggttcataatgggtaaactattaaatttgtttcgtgatatgaaagtagcaaaaaagctattaatttcattctttgtaattttaattgcagccgtttctataatcgggggcatgtcttatcaaactgctaaaaagaattttgaatcacaaattacgagtagtgctaacgataatataaaaatattagataatttaatcaatcaaatgattgaagcaaaatttaacgatgtgaataactttgcacgagtaattcaagggaatatgtatcaaggggataatcaggatgagctaagaaagacattatctcagtatatcaatttaaatatagatgttgaacaagtgtatgttgccggtaatgataagaaatttgtacaggaaccaaatatacaaatggcagcagattatgatccaacaacacgaccttggtataaagatgcagtggcaaaacaaggtggtattgttgttagcgagccatataaggcaaaaggaaatggacatattgtcgtaacgattgcaaaacaaacagaagataaaaatggggttgttgcgctagatttaagtttagacaatttattaaaaacaacaaagttaatcaatattggtaaaaaaggatatgccttcattttagatggaaagcaaaaaatcattgctcatccacaagaaaaatcaggggataaagcagctgattcttgggcaaagaaaatttatgaagataatcatggtgcttttacatattcttatggtggtagtgaaaagaatatggtatttgctacaaacgtaaaaacaggttggaaaattggtgggacgatgtacgcaactgaagtaattgaagctgctcaacctgtattttataatatgttaattgttatgcttatttcgttagtagtaggtggagtacttatttattttgtgacactttcaattacgaagcctttaaagagactagttatcacttctaaagaaataagtgaaggggatttaacgcaaacaattgaaattcattctaatgatgaaattggtcaacttgcgaaaggttttaacgagatgacaaattcattacggacgttaattggaaggattaacacttcggcaggacatgttgcagcagcatcagaagaactaactgcaagtgtaagacaagcgagtgaagcaactgagcaaattacaacagcaatggatgaaatatcaagtggggcaacgacgcaaacaacaagtgtagaaaatggtgctatgttactgtttgatgtaacggaaggaattcagcatgtagcaaatagttcatcatctattaatatcgcttctgctcatactcgtgaaaaagcagaagatggtgggaaactagtaggaagaacagtaaaccagatgcagtctattgcagaatcggtttcacaatcagatgctgttatacagttattaaataataaatcaaaacaaattggtgatatattggaagtaattcaaaacattgcagatcaaacaaatcttctagctttaaatgcggcaattgaagcggcaagagctggtgaacatggaagaggttttgcaattgttgcagatgaagtacgtaaattggcagagcagtctagcatatcttccagtgaaattagtaaattaataggcgaaatacaagacgatatgggtaagacagtcaaatcaatgaatcatgtaaatgaagaagttcaatctggacttgttattgcaaatgaaacgaagcaaaattttgctgaaattttacaatctacaaatgaaatagctaatcaaattaagacgatggttgaaacggctaatggaatgtcaaaaggggcaaatgaagtatctatttcagtaggacaaattgcaatgacagcacaaaataatgcgacaagcacacaaaatgttgcggcttcagctgaagaacagctagcttcgatggaggaaattggatcagcggcgggtacgctatctcaaatggctgaagaattgcaagtattaattgagagatttaaagtttaatagagaacagactccccctagtagcattatgacactagagggtagtctgttttattatgtaaaatcaaatggagatgtaaacttcctttatgacgtttaaaatggtattttgcataatatttgtcgaaaaatagaggtgtttgttagctttgtgtataattattaacctatagaatactatttaaaggagagtattatgggagtgtattgggggacaaaaaga

SEQ ID NO: 895 - DNA, 2973 bp, Bacillus thuringiensis
acgtacggttgcagctattttagagaactaccaacaagaagatggtacaattataattccagaagttcttcgcccttatatggtaggaaaaacagttattaagtaaatttaaacattcatcggtatgagtgattggtaattatgagcgttgtcagtactgtaatgtaggaagggaaaagtaaaattttcctttcctcataatttattttagtagggttgactaactgtttttcttttgatattatatttgatgtcaatatggaggtatacccaagtctggctgaagggatcggtcttgaaaaccgacaggcggcgagagtcgcgcgagggttcgaatccctctacctcctccagatataattgacaacagcgcatataagtggagattggagaactcgttaccaacacgtaacgagtttttattttaaaaccaatcataaagtatggtgtaaggtaattttgtccttattacacactcatattccgatgattatcttcatagatatgaaaggagtcaacatggatcttattatacaaacgtttcctttagatggaaaaactttatattatgtacaatgtcctgtctgtaagaacaatagaattttaaacagtggtgcaaacgtatcacgcattattagtgatgatacattccgtaaactttgtggttgtacttgtgatgtaaaacaagctacgagtaaagtagaggcgccaaaacaagttaaaaaagcagctgtaaagaaagcggcggctccaaaacgtacaggtaaagtattaacggcagtaattaacgggaaagaaatgactgttaaagagattgctgaagcatacgatattagtacaagtacggttcgtcagcgcattaacgcaggaaaacctgagagtgaaattattgctccaacaaagaagaagtaatttaataggaaaacccgtgcatatgcacgggttttttattttacaagtttacgtgtttgttttaaaaaatggccaatttttttaatgattggttcgattgaatcaccatcttttaaaatatcgtactcattaatatttaagcgtaatacagggcatgaattaaagttgttaatccagttttcataacgtccatgcatttctttccagtactcaattggtgtttgctgttccattgggcgcccgcgttcttgaatacgatcgacaatatcatcgaaagaaccttctaagtaaattaataagtctggatgacggaagtaaggagtcatgaccatagcgtcaaataaacctttgtatgtttcataatcagtttccgtcattgttcctttttcatgatgcatctttgcgaaaattccagtgtcttcgtaaatggaacgatcttgaacaaaactgccaccatattcaaaaattcttttttgttccttaaatcgttctgctaaaaagtacacttgtaggtggaagctccaacgagtgaagtccgcatagaacttgtccaaatatggattggaatctactttttcaaatgatgtgcgataacctaaagcattagctaatgcagttgtcatagttgatttacccacacctaccgttccggcgatagtgattactgcgtcattgggtatatcatatttttgccttaaattcattattatttcgactcctttaagagagtattttgaagggcagataggatgacgattaaatcatcaggattttttacaaaatccatatcgtctccattaaatttcaatactggtatttccggatgatcttttttaaaagcatccattgctgtttcataatcttttgtgagctgcactaagtaatttggatccatgtttttttcaaattctcttccgcgcatggcgattcgcttttgcaatgtttctaggctagctgttaaataaacaatgacatttggcacaggcatatcttgtgtaaggatacgataaatttgcatgtatttgtcatattgggagtcttttaatgtgcgggatgcaaaaattaaatttttaaagatatggtaatccgctactactggtttcctttgattcaaatactttatgttaatgtcttctaattgtttgtatctattacaaagaaagaacatctctgtttgaaaactccattcgtcgatgtcttcatagaactttcctaaaaagggattttcatcaacaatctcttttagtaagtggagttgcatgtgagttgaaatttccttcgcaagtgaagtttttccaacaccaattggtccttcaaccgtgataaatggtactccggtcacgctgtttcctcctttcaatcagtgatttaccgtgactactaaaaacacaaaacagaattattgtagcacaagagggaagcgagcgggttaatttgatataaaaagttagaaaatagatatatgtattaattaaattttattttggttgatgatgttatagttgctttcaatgtagtttccattatttttaaagcatgtatattatcttggtcgttgttagaggcgatacaatcctctggtacatacaatgtataatttctcatatgagcatcattagctgtaaataggatacatatatttccggcaacccctgttaatattagattttctatttttaaataacctagtaatgaatttaaaggtgtttcataaaaagcggaataatgtggtttaataaaaatgtaatcatcagaacttggagcaatcttatggattatgttttcgctatattcatttgtacaatgagtaataagttggtcgatatcagatctccacagttgataatggtcattaacgtaaattataggacagccgaaggatttcatttttttctttaattgtaaaatagggtttgttataatttcacattttttagctagaatgggtccgtgggaaaattgaaagtcattaatcatatcgataatgagcaaggcggtatttttcatatgtaatcccctctcttttttttttagggtggattgaatttgtaaaagttattc

SEQ ID NO: 896 - DNA, 2371 bp, Bacillus thuringiensis
aggcaataaaactcatttgtcaactaggaaattccggatttaaaaaaggatggctaaatgccatcttttaatgtccagccccagggacaagtaaaagcgtggtgcaggatgtaaagcctatgaagaaaacaggttaatatgccccaaatacgtatatatacatacgctctgttaattttaaatagcttaaaagtacgaagaaacctgatggacctaaaaatagtagtgcggtctgttgcatatcccctacgtaaagcataaccgagaaaattccagtccaaaagccgagaacgcgaaacatgcgctccatgccatctccctccttttttaaaaaaagtaaacctcacctcattatagtttatttttcttactattgtaaatattcattcacataaaaagaagccaattattattggcttctttttatgtgagaaattaaattgttagtttataattacaagatttacatccatctaatagactatcatttcgagttaattccatgttagggaataggatttcaaaaattcctttcatcatatctccgtgcatgttacaaatttcagttggatgatgaacagcaacttctttaaatggacaattgtgtacatcatagaaaatttttgttccatctgcacttaattcaaatgcaggtgataagccagctgttgagaaagcttcttttgcaatttgaactttttgttccactgttaaagcatcttcactcacatttaaacgttgcatatgttgttgcattaattcagctccgaattgttttcctgtttcgtatagcgctttctcaccagcagcgccaaggctaagtaaagaattaaatgcgattcttgctaacaattgataatcacggaatggaaattgtaattggataacatcttcagataagacatataatctgctcggtcttccgccttttccagttttcttcgtttccgattttagcatatgaacatcttctaatttagataaatgtaaacgcgctacgtttggatgaatatcgaattcatctgcaatttcttgtaccgttacgtaactatgtttttgcgaaatatatttataaatgtaataacgagttgggtcagataatacacctgtaatttttaaagcttgttccatgaggatctccacctttatcactttatccaagataataacattataatacagataaacattattataggtaatttcagacaataattcggaaattgttcataatttcacaaacatatttttccttttccctctattgaaaatacaaaagtccaaatttttattgcgcatgttttcatgctatatacatagtgaggagggaaaagtgatgaatgggattgaaatttttgcgaatacaattttaaaagaagcgtgtagggtacaagcgtcagatttacatattgtgccccggcagaaggatgtagcagtgcaactacgtataggaaaagatttaatgacgagacagtgtattgaaaaggagtttggagaaaaactcgtctcacatttcaaatttttagcatctatggacataggagagaaacggaagccacagaatggttcgttgtatttgcaaattgatggacaagaagtgtatttacgcctttcaacacttccaacagtatatcaagaaagtctcgttattcgccttcatttacaagcatctgttcagcccttatcacatctttcgttatttccaagtacggcagcaaaactactctcgtttttacgctattcacaggggttactcgtgtttactggaccgactggatctgggaagacgacgacaatgtatgcattattagaagtaattagaaaaaagaaaacacgtcgcatcattacacttgaagatccggttgaaaaaagaagtgacgatgtattacaaattcaaataaatgaaaaagcgggtctcacatatgaaacaggattaaaggctattttacgtcatgatccagatattattttagtcggtgaaatccgggatgaggaaacagcaaaaatagctataagagcaagtttgacaggacatttagtaatgacaacgctgcatacgaatgatgcgaaaggagcaatcattcgtttcatggattatggtataacgaggcatgagattgaacagtctttattggctgtagctgcacagcgacttgtcgaattgaagtgtccgttttgcagaggaaagtgctcaactttatgtaaatcaatgaggcatgttaggcatgcaagcatttatgagctactatatggacatgagttaaaacaagcacttaaagaagcagatggagaatgtgttacttacaaacatgagactttagaatcgttaatacgaaaaggatatgctttaggctttcttgaagatgatgtt

SEQ ID NO: 897 - DNA, 2970 bp, Bacillus thuringiensis
aagttacctttcataagcgaaaataatgttcaaaattcaccgcttttatcaaagcgttattgagccatctgaactcataagagtgcctgtggcggcgtgtattgactgcatagtcgaccgagagaatcactcagtgttacgttgactgaccccagatacatatggtagctaattcatttcctgaaaactttcgttttctttttacaaaaacctaattctttagcgagttcttccaaaagagaaggggttaaatgacgatacagctcttcagaaaatagttgtaattcatcttgaattgaaagattcataaaaaatgtcatcctttctagctagctttttagaaagaataacgttttttgacacttgggggtagtgcaaattcttaagttgatgggcatgtgtgctttcccctcagatacattttgagtgagtcgataccaaagccaaaggtcattaatgatggaagcaagatcggcaatttctgaatttagtttacaagaaacttcgaagtcttcttcgttatttaaataatgttgttttttattaatatagtgctcaagttcttttatacgatcaggaattttcccgcgaacttgttcccattttagtaaaatagcatgttgcattttttcggggatttcttcccagtcttcttgtaaatgtggaatttcaattcctagatgttcatcgtataagaaatacttttccataagttcacccccgttttcctgcttatattgtacagaaaaacagaaagaagttcgacgaaattgtttgaaaaaatttgaaaatgactcttgatacattttgtgaaaggtgttaaagtgtgaattattataaaagaaaatgaatatttattctttaggaggatgcaaaatggagaagaaaaaagttgtattagcatattccggaggtcttgatacttccgttgcaattaaatggttacaagagaagaattatgatattatcgcgctttgtttagacttaggggaaggtaaagacttagcatttgtaaaagaaaaggcactttcagtaggtgcaattaaatcatatatgattgacgttcaagaagaatttgcaaacgaatatgcattgatggcgatgcaagcacacacattatacgaaggaaaataccctcttgtctctgcattatctcgtccgcttattgcgaagaaattagtagaaatcgcagaacaagaaggcgcaactgcagttgcacacggatgtacaggaaaaggaaatgaccaagttcgttttgaagtttctatccaagcattaaatccttacttagaagtgattgcgcctgtacgtgaatggaaatggtcacgtgaagaagaaattgcatatgcaaaagaaaacgatgtaccaattccgattaatttagatagcccgttttcaatcgatcaaaacttatggggacgcagcaacgaatgtggaattttagaagatccatgggcagcgccgccagaagatgcatatgagatgacattagcgttagaagatacaccgaataaaccagagtttgtagaaatcggatttgaagcgggcgtaccgactactttaaatggcactgcatattcacttgcagaattaattaaaacgttaaatgcgcttgctggaaaacacggcgttggacgtattgatcacgtagaaaatcgtcttgtcggtattaaatctcgtgaagtatacgaatgcccagcagcaatgacgttaatcactgcgcataaagagttggaagatttaacacacgtaaaagaagtagcgcattttaaaccagtgattgaacagaaaataacagaacttatttataacggtttatggttctcacctttaaaacaagcgcttcatgcatttttacaagaaacgcaaaagaatgtaacaggtacagtgcgtgtgaaattatttaaaggtcatgcgattgtagaaggacgtaaatctgaatactctttatacgatgaaaaattagcaacatatactgcccaggacgaatttaatcatgatgcagcagttggattcatttcattatttggtttaccgacgaaagtatacagccaagtgaatcaaaagaaggtggaagcgtgagcaaactttggggcggacgttttactgaagaagcggaagcgtgggttgaagagtttggagcatccatctctttcgatcaacaattagtaaatcaagatataaacgggagtattgcacacgtaacgatgctagcaaagcaaggcatcgttacgaaagaagaagcagagaaaataaaggtaggtcttcaatatttattgaaagaagcaaaagagaataagctacaatttttagtagaagcagaggatattcatttaaacatcgaaaaaatgttaattgaacaaattggcgaagtaggaggaaaacttcacactggccgaagtcgtaatgatcaagtagcgacagatatgcatttgtatttaaaagaaaaggtagaacatattataaaagctacaaaacaattgcaaactgttcttgttcatcaagcagaaaataatattgaaacgattatgcctggctatacgcatttgcaacgtgctcagccgatttcatttgctcatcatattctcgcttacttttggatgttagagcgtgatgtaaatcgttatgaagattcgttaaagcgtattaatatctccccattaggagcaggagcgctagctgggacgacattcccgattgaccgagaatatagtgcggagcttcttggatttaatggaatatatgaaaatagtttagatgcagtaagcgatcgtgatttcatcttggagtttttaagtaactcatctatgcttatgatgcacttatcgcgcttttgtgaagaacttattttatggagtagccaagagtttcaatttattgaaatgagcgatcaatacgcaactggaagcagcattatgccgcacaagaaaaacctcgatatggcggaactaatccgtggtaaaacaggca

SEQ ID NO: 898 - DNA, 3421 bp, Bacillus thuringiensis
tacagacgatgattggtatagagctcaagaacgcaaccagataaaattgaaatttagatcctaaaattccgtttaggtattgttttctagctatggcgatggattgtatcacaattctataaattaagttatatcaaacaccactcttgcctgttgttgcagacataatgatatcttttttattttgttaattggatagaagtgagtgggatgtcaaagccaatttctataaaataatttcatcaaaaaaaggggatttatatgcattttgaaagagatagatattttttgagatggcattggaagaagcagaaaaggcattaaaagaaaacacatatccagtaggagcagttattgttgatggaaataataatgtcattgcaagaggaagaaatagagtgcatccacaaaaagacataacagctcacgcagagatagacgctattcgcaatgcaggggaagcaatgtttgatgcaaaaataaaaaatgagaagtttactatttatagcacgttggaaccgtgtccaatgtgtacaggtggtattttattcgcaaaaatacagagagtagtctggttactaaatgatgacttaggttttggtggatataaaaagataaaaaatgctttagttttcgaagggaaatttaataaaatcgacatagtggaagaaccatttgaagacttaaaaacaagacaaaaagaacttatgagacaatgggagctaaatcccaataatattattaatttgcgtagggctataaaaaaatagttgtttctttcaattaaatcgggatactgccacattaccatcaatttaaaaaatatagtgaaattatatcgatttaacaatagaatatggaagaatctattacgaatagaaagccgtcctaaaagtattctaggatggttctttttgttgtgaggagataaagagtatggagaataaacagagtagaaatgagtatgtaagacgcatacataaggttcaagattatatagaatcaaacatagacagttcattatccattgaagagctagctgatatagcaggattttcgaagtatcattttcatcggatttttaaaggaatagttgatgagccattatctcggtatgtgaatcgcttgaaactagaaagggcaacacatctacttacatatcgcgcagacatgacgattacagatattgcgtatcacttcggattcacagattcagcagttttttcccgaacatttaaaagtcattacggtgtaagtccgtctcaatatcgaaacgataatagcaagaattgcaaagacgtaaggggaattcctcaatacaatgaatgtaagaaggttcgaggaaatgttgaaattgtaacagcggacgatataaacgtcgcatacataagacatacaggtacatataaagagttagctatagcttttccagaaatgatagaaaaattatttcgttacgcggcgaagaaaaactatcatgtatttgaggatacgaaagtattaaccatttaccacgatcatcatgaatttactgaggactatcatttaagaacaagtctatgtgtaacaatttcagatgaatccacagtagaaacgaacgacgttggaataatggtaataccttctggaaaatatgcagtaggacattttgaaatattccaagatgaatataaaggagcatgggatttcttatacggtgaatggctgccaaatagcggatataaaccgagagactcgtatccttttgaagtatatagaaataatccaaagcagcatccaaagcataaacatatagttgatatatatgtacctatcgaacctttttaatcataggttaaaggggaaagaataatgaaaactgctgaaaagttagatcagattataaaacaagaatatgaaaatatgaatggtatgttagtagtgcggaaaggtaatgttatttttgaaaaatattataacgattacggacaaaatgatacatttcatgtagcgtcagttacaaaaacgataatctctgcgctaattggaatatgtatagataagggctatataaaaagtgttgatcaaaaagtaatagagtttttccctgaatataaagtaaagtcatctgaagtaacagtgcgacacctacttacaatgacagctccatacccttttgtagactggcaggaaccgttagaagaattatgtacacaaccagactgggtacagtatacacttcatagaatggggaacggtggagagattggagcttttaaatattcatctgcaggagcgcatgtactatcagcaatgattacgaatgcaacagggaaaagtgcacgtgaatttgcgaatgagtacttatttcaaccactcggcatgagcgaaattccaaactacaatatgaaagcatttggattcgatgacttattcggaaaagatgtgaaaggatgggttcacgatccaaacggtatttcgacgggcggctggggactaacgttaacggttagggatatagctaagtttggacagctgtatttgaatgaaggtattcataatggaaaacaaatactatcaaaatcatggataaaagaatcaatagcgatgaattcaaatcaatatggttacttatggtggttacgagaagaagagggtgtctattcgtattgtgcaatgggtgatggtgggaatatgatttgttgtattccagagaaggaattggtggtggtgatggcttctgaagttgtgccagaaataaaggatagatggagattaatcaaagagtatatacttttaaaagagtaatggtgaacttgtagaaaaatttaaacgctccccgtaactttcctcaataaaaaatcgttaaacattaggaagggttattaatcacgaatgggggagaaccatgaaaattctaattctaggcggtacacgatttttaggaagagcatttgtagatgaggctttacagagagggcatgaaattacgttatttaaccgaggaacaaacaaagaaattttttctaatgtggagcagttaaccggtgacagaaataacgatgtatcaagtttaaaaaatcgaacgtgggatgttgtcatagacacatgtggattttctccacatcatattaggaatgttggagaagtgcttaaagataatattgaacactatatattcatctcaagcctttccgtatataaagattggattccgcatgacataaaagaagactatatattacaacctgaaccgacggaagagcaaataaaggctgtagagaatggtgaaatatctccttatgagcattatggtgcgctgaaagtattatgcgaaaaagaagcagagaagtattggccggggcgtgttttacacgtaagagcaggccttctttcaggaatgttcgctgatacccataaaaaaacaacctggattcagcgt

SEQ ID NO: 899 - DNA, 2619 bp, Bacillus thuringiensis
taagtataggaaaaaattcttatgaatttagaagtgaatttcttaagtttttcttaaataggtgtttaaaggagggataacattgtatggttattctttcgtgcaaatcgtattattttttatttatatcttcgtggcttttatgcaaaacacaacatttctagatgaaattagatctccttatatatattagaaaatgtattttgtgaattaattatgaatatattttattttaaaaaacatcccttgataaatacacagagttattgtaaagtgatgataattaaaatgtatattgtgtgaaaacgataaaaggaaagagtaaaagtagtttttcttttagagagtcggtcggtggtgtaaaccgaagatggggaaataaaccaaattaggttcaaagatggttcgtatgctgacattatttttatggctctttatataaaaataccgagtaaccactcattctaaggatgagtggttacttgcagtttgtttaaatagagaaatattgctaccaaggaagcaagtttatatatgcggttctcttccttttatggaagctagtattaaaattttgtataaatgggaagtaccaaaggaattgattcattatgaatcgtttagccctgttgcaattataggtgattaactaataccggataggattataatcataataatgtaaataaatagttttttgcgatatttcaatagtgaagtatcgtttttcattgtataactaaagcccagctatggattctgatgtaatgttgaaaaatgatcccaagtaatgatttgtctgttgcaatactaagtaactatgacgaatttgaatctaaaaagtatgctaataaaatagcggaatttttttaaaaaaaagtaaaaaacaatagagcttagatttgcaatgataaatgttttttcattagataattactttaccgataatcgagatgtttgcggatacatttattttttggatacataattatatttagagaatacccagttacagtatttgaatttttaataagaagggatgcgaaggaatgaactcacagagacaaggctatgtaggctggtggcaaggcgggcacggtggtggttggccgggtggacacggtggttggcaaggcggacacggtggttggcaaggtggacatggtggttggcaaggtggacatggtggttggcaaggcggacacggtggttggccgggtggacacggtggttggcaaggcggacatagtggttggcaaggtggacacggtggttggcaaggcggacacagtggttggcaaggcggacacggtggttggcaaggtgggcatggatattaaaaagaggctataaaatcattttttatgcaaagtttgtatatttagtatcgttgtatattttcatttgtatagtaagtatatagtgaaaacagcaaaaaattctgtgaagtaagaattccatccgaaaaattaaagcagcagaaatgtcaaaagaacaaaagacatcgctttttattattcaaggtgaaagagactatcaagttcaatcgaaaatcgaaatctctctatggaaagaacaatttaaagaacgagataacattgattatcgactatatccaaagttaaatcatttctttacagaaggggatggagaaataagtaaaccggatgaatattatagtcctgctaatattcttgagtatgttataaatgatattgctgcttgggtgcaaggaagatcgcaattaaattagcaactatatgttttaataaagactttctttctgtgattaaactagaaacattattagggtatatgttttttagcactcttttaaaaagagtgtttttttattttcctttgatttaattaacgaaaaaaatatcttgtactccttttgtaacttttttaaatcgaaattttctataaaacaataggcttgtcttccaaataaagcgttatttgtaacactgttatcaaagcaaagtgctcgtgacatttccttgatattcaaaaacattaataacctattatgtgaagttttttgaaaatttaggtttaacatctttaaaataggtgtattacatattacataacaactaaataagaaaataaaaaatctaagggaggaaaaatacgatgcataagaatgaaagaaaaccggtggtttatgaatatcaaaatgaacaggaagtagttatgaaagtaaaagagctagaattgcaagggattcaccaagatgacatttacgtcttaacacatgaaaaacatataacaaaaaagattgcggatgatacaaacacaaatacgattggagtaaaagaacaaggattgggcacaagtattatcaactttttctccaaaaaaggggacgagctccgaaatcaaatggaggaaatggggttgtcgaaggaggaagctaacttatatgaagaaaaactagatcaagggagaattttacttctagtaacagatgaaacactgacggcgagtgataggcagccgcaaaactatcattctctctaatagattgcaatatctgataaatagataagttaattattttaggttgtagcatggaagaaaataatagtataccaaggtgagaaatatgaaaca

SEQ ID NO: 900 - DNA, 2490 bp, Bacillus thuringiensis
aagtaattcatccaataaaaatttttgttctattcctatataaaaatttttatctgtaaacaacatatttgtttcgtatataaaaaaagaagttaataaaataagaaagataatcgttccaggcattgtaaatcccttttgctttctcatacgtttattcctatttcgctatatcgcataactacaccttcatatattttcccactagtatctttcacatttataatgagtacatgaggtgttagtttgtaagaaaccgttccaatattttgtaaaacgacttccctcccgcgcctatttacctttcttataagacgactattctctttttcatacgatacttcactcccattacgcgatcggaattgtaaaatactttctccattttcaaatgctagctgttctccagatgatacttcacgaaactccaattgcatttgccctaaatacacatcccactcccaatcatttaaccctttcgactgtttattttccatttcaatgaaatgtaggcggggaaagagcaaaaaaaatattgataatagaaacagacatacaatcatttctattaatgaaaaaccaaattctaatttattttttctcctacataaaagcattgttccatcattctgtctttcacatctttccacatggtacaaacttcattgcctccccaatatgtgtaatacacaattccatttatattcttttctattattcgcttttcttcatttccatacatatatatagctgcttctttttttaataatccagttgccttataacgaatttgtatattttttctttcttgcataactaatactgtttgcggtagtagtaacgatacagccatcattaaaacacttaacgatacaatcatttcagccattatggatcctttttgacatttcacgatacgtaaatctccctcttccaagctgaaatacaatttcatatttataatttctatacgaaattataatcgtaccacctctattaatatttccacttgggttatatgtcatcggatttggaaacgtatgcaaatcaatttgtatatcttcttcatactctcgcttgacgatataatactttgtacctgactcttttatagcatacatatttctatctttatgccaacgtaatgtgtagtgcttttgatggtttatcgctaattgctgcatatacaaaatatcatttgaaaactgtctcaaaaattgttcaactttttgtcgctcgtataaggaatgaacactaaaatacgtaactatacttaatacagaaataacaaataaaacgagtaacatttctaaaaaagtaaacccttgttgtttcacaatgccctaattgatactgtgccatcatctgatatatgaatagattcgccattcggacacttatcagttgtaatatacttttcatctgccagttcttttaacgatggaattttattatgttgtaattgatatacttgtatttgcgcttctatagatttcacgtaagctgcacacccttttccttggaccgatgaacgctgtgtaactacatttggaataattaatagtaataatatagttatgacaaccattactaatagcatctctaacagagtaaatccttcctcattctgcatacaaatgccccctaaatagaattcatcatttgaaacatcggcataatcatcgctaaatacataaggacaacgattcctccaatacatgtaaataaaataggctgaatgataactaacatatgtttaatttttcgttctatcttttccataataagatcgctatagtcacctaattcaatccctaaattgccatttgcttgtccatgcgtaataacataagaaagttctttctcgtaatacccacttttagcaatgatagattgtaactgttctcctccaattaattgtctttcaatccgattcgcttcatattgaaagaacggatgatatctttgctccatcattattgttaaagcttcgcatactgatagtccaccatttaataaaccactcaactgagtagcaaaataatgtgaatgctttaaaataagaaatgttttgatgagaggaatacgaagcatgatttttacctgtctaatatgtggaagtttcctaaaatacaacatgtataaactacatccaataataacagttaaaatagcggttaaaataatgtatggtagcagttttattgcacttaaaatttgttctgtaagtagtggtgtattagaaccgaacgaactataaaccatttcaacctgaggtaataaaatgaggttaaaaataaaaagcatgattagtagaaaaaacatcaagaacataggatactgcattattttcatcatgtctctcctatacttatctttcttataaagaagtacacttccttgttgcaaagcaaaagaaatatcaccatgttgctcggcataaaatagataacttaacatgtcctgatgaaactttaactgatgaaaaga

SEQ ID NO: 901 - DNA, 2593 bp, Bacillus thuringiensis
aatactgtttacaaaaacaaaaagaaggtgtcaccaagtcaaagttcgacttatgcaacatccctcttcccaaactatttatagcatatttattaatatttcaggtcttccccaattcatttcttcacaaacaaatctaagtttttcttcatccattgtgtgtaatccttcttctagtgaacatgaaattggaacttcacagtgaatttgggctaattgtaacgaaatatttaagttctctaaatcactttcaatcttcgtacgctgcgcttttgttaatgattctacattttctagtacagcggatactgttccgtgctcttgaataagcttatacgctgttttttcaccgataccttttacccctggataattatcacttgtatctcccatgaaagcttttgcgtggacgatttgccacggctctacacctttttcttccatgattttctccggtgtgtaatattcgtaatttccaattcctttacgcagaagcatgactgtaacgctcttatcaacaagttgaagtaaatccgtatcacctgttaaaatataaacttcagcttcattgcaatattgttttgcaagcgtaccgatacaatcatcggcttcgtagcctttcataccgataactggaatggataattttgcagtcatttcttgcactaaatcaaattgaggaattaattcttctggtggcgctgcacgatttgctttataattcgagaacgattctgttctaaatgtcgtacttcccatatcccagcatgtaacgatatgtgttggttcgatcgcttgcgtagctgttaataagtgtttcatataaccatgaatcccgttcgtaggggttccatcttgtcgtttcataaattgtccgtagacacttgttgcgtaaaaagcacgaaataatagtgccataccatcaactaataatacttttttcataattcctctcctattaaaaaaataataaccttacgttatcacgtaaggttatataaatagattaccattctacgtttttgctcaactttgtctattatacattgtttttgtatatttagcatcattaacacattaagacgttctactacaacaagtatgcaagatgcctgaatacgtattttttccagtagaaacaacgatagcttttgcatttccactaacaatatgcgaacctttaaaacatacattttcaagctcaagtggattataatctttcatccgttttaatggaataaaccgtttacgttcaaggtgatagcagctctcaaacttctctatattcgcttcgtttcccgttaacacagactcattcactaataaatcatctgcataaataatacgtacatcagctggcacagcatctccagccgaaagaaaaatcatatctccaggtacaagttcttgcacaggtatctccatcattttcagttcactatttagccctgtactactagaacattctactctagatacagtaatcgtttcacgttgtaattcatcacacacacgttgttttgaaaaacctggaatcatgccacctagcttcatcattacttctgcaagaagtgctctttttgaagttagttcatttcggccatatacttgaatacgtttttgtgcctctttcattgatagtccgtctcttgttgttttaaaatatgcaaatacagattttacatctcttgttgcaatttcaattaataaatctttatttttttggagcattgtttgttcttttattgattttttacttagtttatatgacgtgttacccacagttttgtttgcatataacatattatcgtctcctcctttacaacataggaagaaacgctttgtttctcaatttatccactttactgtgaaagtgtctcgcgctttataaacgctatattgtgataaatatagagggaggaacaaatcgtttcctgcctacatcatatatttttgatttgaagtatatgggtaacggaaccgagtcagaatttgacatgctcctcacctcctcgtttaattttatagtttataatatgaaattactcatagcttggtaacaaaaaagacccctacccttaagagagtagcggccattacatacacaaataaacgatttctaatataattagaaatctacggacctctccctcaccgagttttagcactgtatagcataggtacattaccagctacgttaagaaaaaccttaattcgatcattcctgttgacccattggcgtctctcgacatttttgggcagtagcatttctctatcaggagcctcacctaacagagacttattttcattacattgaaaatgttactcttatttaaaatagatgtcaaccgtagcctacaattttttcaaatggtatggcaaactaacgtatataaagtgaaactttaatcaggggggtttttgttcatccgccactgattattagccctcaccaatcgggctgcccggcaaatagcgggataaaataaaaaactttacgtttaaacgtaaagtttttaataagttatacaaccagcgattacaatcccaattgaaagcgataaaaacataagaaaaagaccgactgcttgat

SEQ ID NO: 902 - DNA, 2558 bp, Bacillus thuringiensis
taaaggattcttctattaataaaacatctccagcctgtaaaaaatctacggcacttaaaatagcatctcttacatcgaatctcccattatctcggatcactgaaattacttttgcctttgcttttggtgcaatcccaatgttcccaatcctattgtcagctgcagaaacaacaacctagaactgaagtaccgtgagaaagatcattactcatttttccagacataaattcaatattttgaccgactaaatcttcatgatttaataaccagccttcttccaaatctacaaaggttgctccttgaccatctcctcctttaattccccaagcataaggagcattaattcctaaaggtgcctcttcaagatatccctgtctcaaaaatctaggttcatcataaggattgattgataatacaggcaatctcgagctagttgttgtgtttatactcttattagaacgaaattgtattttactagaatcgttattggcagcatgtactgtatttgttacaaatgtcgtacctaccccagcaaaagttgtaattgcaagtgatgatatcaacatacctttaaaatttttcatctttccacctctagttttctattagaattaacatatttaataatgtgtatgaaccgaaaagctttttatcttattataaaaattaatagatttttataactttttgatttacataaaaactcctttcattcttgtaattcaatgtgtatatttcaaaataacaaactaactgtaactattatagttacacctttattgattttcaactacgaaatataaatttttaaaaataaatttatattactttaaaacagagctaaccttttacgcatataaaaaaaacaaaatatctgtgcaaattacagcggtgaataagtttatagactgcaaaaaaacaagaaaaagcaaaacactaagtgctttgctccttataaaattccttttaacttttcaccaattaacctcgctacatactcatagccttctggtccaaagtgtaatccatctttttcaccattttctacaaatcttttataatcccgttcttgaatcatttcagcgaatacgtttagaaaataacttcctgtttccctcgccactttctccaccacgtctgcatactgaccaagcactctatttgttctattacgctgtttttcttcatcaactggtgcaggactaatcagtagtactttatctgatgaaatatggttcacaatcttctctaagttttctttatatgcttgtaatgacacttgagaaaaagaaaccgcatcattcgtaccaagaaaaactgttacgaaatctggtttatatgatattacatcttcttcaatcctatttaacgcatcgaatgtattatcccctggaacacctgcattcactactttccacttcggaaacatctcttgcaaacgtggtgttaatctcggcattccatcaaaaaatgtttcatcagctgtaatactatctccaaagcatactaacgtttttattaagctactctccttttacgtatgaaacaactttccttctattgcttttatatatctttcagcagaacgttcaactgcctcatttgcattttcttttactactcgatgaaaagcattgtataaacgattaaactgtaacggcttcactcggttcaccatttcttccacttttctcgctggtaatggaattaagtttggatagctatacataaaacttacccaccgctcatccgctacaacttgaataatatcacctgttaacaaaatcccttttccatcattaccttcttcccaatgcaatacagaaccaccactaaaatgtcctccaagacgatgtacagtaatcccatccgctaattgtaaagactcaccagaccaataaataatacgactacttgggcgcatcacccattctttatcatcttcgtgtatataaattggtacatcaaatgtctctgcccattctacttgcgttgaataataatgaggatgagacaatgcaatcgcatctaatccaccaagctcttttattttcgcaattgtcgtttcatctaaatacgtaatacagtcccatagtaaacgatatgactctgttttcactataaatgccgtttgaccgatcgcaaatcctggttttgtcgtaatactataaagtccattttcctcttcgattattacatttttatatgtatcatctgtttgcaaattttctaaagtcgtccaagactgccctttcggattcacatattgcctctcttcatcacaaatatgacaactcaccggttcctctacactcgctgcatactgcacaccgcacgttgtacaaacgtaatttttcatcataattccccctatccctatatttttattaaactgatttttgttgataataatctacttttttattttcaattaataaacttataaaagtaagtaaataaacaactgtaactgacaatggaattacagtaaatcctttttcgcttctgcaacattcatctcactatctccccaaaaatatttgtgctataaagtcacc

SEQ ID NO: 903 - DNA, 2653 bp, Bacillus thuringiensis
  unsure (1)...(2653): unsure at all n locations
gcgttacttactgtaatcatttgtgtcctcctactaataccgcttatttcagcgttttctcaccgattgtcttaagaaatcgcatattacgactcaattattgtagactatagctattatatagtagaagatggatgaatagcaacggttgattacctttctacaatgaaatcggatagtttttgtccattcccctagctattgtatgtatatcatcgacctctttctcatataacctttcactgctcattctgtaatatatcggattcattttcatctgaaatattatataccgaaaaaactgtagagaaatcattccctacagtctcttcttatttcgnatttattattttctctttgtaactcttcattttactcgttaaccctattaacgccggtaataatatcggcatcacaattaaagctaatagaagaagtgcaacgccaactactgatgcaacttgtataagtgttaatacacctgatggaattaatgctgcaaatgtcccgcctaaaattagcgcagctgataatacaactcctcctatatgacgagatgcagttacaattttcgttaccgaatccccttctatctcgttatagcgcatcattacgaaaatactataatccactcctaaagcgacaatcataatgaagctaaagaatggaacattccagcttaatgaatctacatgtaatacatgtgcactaatttgttcgcttataccgagtgatgcgaagtacgctaatagtaatgagccaataataaatattatgtttagtaatgagcgtgtaattacgattaatacaatcgcaattccaattaacataattgtagctgtacgtaagaaatcttgccctgttacttcttttaaatcaacgtttctagctgttgttccgccaattgctgttttcgcatcatgtaattccgttccctttacagtgccatcgattgttttattgatttcttgaataattggcatcgcttcttttgaatacggatttacatctaaaatgatagtcattttagcaatttttctatcctgcgacatgtacgtgttcaatgctttttggaaatcttctccctctagcacttcttttggaatataaaacttctcagagctcttcgattcattgagctcccctaaatatttttgtgcgtcatgcaggccattacttacttttccaagcccttctgtacttttagataaaccggattgtaattgccccatcttttcttgcaggtctttaaggcccgttaaaagttgtccttgcccatcgtttattttcgttaatccagattgtaactcaactgatttatttgcaatttgttttgaacctgaagaaccttcatttaatccatttttaagatcggctgctcccttttgtaacttattaactccattgctcatttcttttaagccgttatccactttcagtaacgattgattcgcttctttaaatgaactcatcgccgttttgtgctgtgttgctaattgatttaattcatttgaaagtacgcttaatttcttttgagcctctttagcaattcctatcgtttgttgtatgtttggatcattcgctaattctggtttcgtttgaacgaaattggtcattaacatttcaatttgttcatatccctttttcgcaccatcaatcgcttgagaaatacttccgaagtattgatcgtaagagtttaaacctttttctaactgtgcataaccagcatgcagctgcgacgttgcattagatagaacatttatattttcgtttactgaagctaaaccactctcaatttgctgtgctccttgtgcaccgtcgtttatgccatttgataattgatgtaaagctgttcctaatgctgataccccgtttttcacctcgttcgttccatcaattaatttttgaacattcgcaagactatttgaatcattacttcccattttatttttcgcatctgttaatccatcattaatttcctttatgccaccatcggcatctcctaatcctgtattcaattctcccgcttgcttatttaaatataattcttttatcttctcaccagttggacgtgttggtgcatatacttctgacacacctttaactttcgaaattttatcagttaattcgtctaaaatttgtagagaagttccttcatccagctttttatcagattgaatgactaatgtactcggtgaagagaaaccaggcggaaaatgatcctctattacgttaatacccatcttggattcatacttattatccacttcaaataaatcattgtaattaagtgtattagagtattttaatacgaaaggaatcgatattacgaatacgatgattaaagcgacaaatggccttgctactgagtttttcgcaaagaatccccacaagcgactatcctcatgacctttaaatgttttaactggataaaacattccttttcctaaaagcaccatgaaaaatggatttaaagtcgttaatacgagtaataatactaaaacaccaattgctaccgctgaagtcgattgatataatttaaaacttgctaaagcaagtgatgcaaaaccaattagcaccgctattccgctatataatacagttttacctgctgatttgaatgtttctttcgtagctaaaaatgcattttctt

SEQ ID NO: 904 - DNA, 3312 bp, Bacillus thuringiensis
  unsure (1)...(3312): unsure at all n locations
tttgctgaatcccaaacccttcatatccattcttcctgaatacgtcatcaaatatctgtccaaaaactaactcccatctatgttctgcatttacaatctccttgtttctttgagatatatttactttataggacataataccttgaatttgcaatcttttattaatttcttttttatttcgttagcattttcgctatcagcaatttctaaatctactattcttgctttttcatcccatatagcagcactaaaaaaagattcctcctttaccgctgctgtagcaatatccatcactatagaatcttcacttttagcatcttcaatctcattctcacaggcacataataaagcaaatggaattaaaaatacaagtacctttgttccctttctcatgtagcacccctccacacattttcatttacgataaactttttactttgacatataaataccttctataattattaaatttaacattatttcacattttccccacttaacaagggaattacaattaataaatagaatatctctatgaataaataaaaagtgagggatatataatgcaacgtgtaaatacgattgatattagtaatgtactacaattggaaaaaactctttcgactttattaaataagatgatttcttcaaaactagaccttgaaaattggttaaaagagcagtcaaaagtaatttgggaaatcgaagaacaattaagattacattacatcgcctttcaatgtaatacggatgatgaagaaataaaggatacatttgaacatgatcaacaatttgtaaagccacttttaaagcggtaccaaaatttattggataataaatatttagagtcaccttttcgaatggaattagattctaacgtatatggtttattagatacaaaaataaaaaatgctcaaaagttattttgtgaggaaaatattgaattagaaatacaggaagacaaattagtcacagagtactttgaaatcactggaggattaagtgccatttgggacggagaagaaaaaacgataacagaattacaatcctatttacaagattcgaatcgtgacatccgtaaaaaggcaaaaactattatttctgaacaatttttatctgttgaaaaagaactccaaaacatattaaatcaattaattgaaattcgccatcaaaaagcaaaaaatattcaactagagaattatcgcgattatatgttcaaaaaatacgagcgttttgattattcagcgatagattgctatgaactagccgaatccatacgtaagtatgttgtgcctcttaaagataaaataatgctagagaaaaaagaaaaactgcaagtagatacacttcgcccttgggatgtatcagctgtaactccagatcaaaaagtacttaaacctattgcaaatgaaaatgatttaattgaaaagagcactcatatctttaataaactagatgttgaattttcagcacttttaaaccgaatgtataaacacaattgtcttgatttaacaagccgcaaaggaaaagcagctggtggcttttgtgagtacttaccagcttcacaattatcttatatttttatgaacttaaattatacacaagatgatattatcacttttatacatgaaatgggtcatagtattcataacgaactcataaagccattagaattacgacagtatatagaaattccagctgaaacagctgaactagccagtatgacaatggagttattctcgcttaattattgggataccttctatacagacaaaaaagatttaaaacaagcaaaaattaacttctttaaagatgttatttcatatttacctattatgcttattgtagatcaatttcaacactggctgtatgaaaatccaattcatacttctgaagaaagaaatgaaaaatacttacaacttcaaaaacattatcaatctagcgtcatacatattgatggctacgaaaactggatagcaacgagttggttacctgtactccatatttttgaagtaccattttattatattgaatacgcgattgcccaacttggggcattacaaatgtataaacaatataaagaggatcctaagcaaacactagaaaattataaaaaggcattatcactaggaagctcgcaatctataaaagaagtatatgatgcagccggtattcgttttgatttctctggtgaaaccattaaagaactaatgctatttgtagaaaaagaattagaattacttgagcaattataagaagaaaactacacctatattttaggtgtagttttcttcttcattttattaatcagttctatgtactgagtatcaccatatccgattgttggaaaaagataaaacaactttgttaataattcttgatttgataaacctttatttttagagatgaatttcattacgatattatcttcttttagcatttctaaatataaatctatagcttgatacattacaggtggtactttatgataagtctttttatggtttactaatacttcattgtatatagtagaataatcccccaattcaagttcaatttgatttactttaaattcatcctccctgaaactatttaagtatactttcccttcatagcacgactgctcaaggtatgaaagtaaagtaagtagattcatttggcaaaacatatcttcaccgaaccataaaacaatacatttatactttttcgcaaatagattttctaacggatctataactttttttgcataattttcgactgaactgttatgaccttctgctcttattttaataaactcttcatcaaaaacttgtgcagtaacgctatttacacacatggcctcgttaaatggggcataatcagactcacccattagctcctccgttttaaattcttcatacatcatttgaccattcaatatgttaagtacatctttatcaaatagctcactattcttattacgtaactgttcaacctctaattttctagaaatattcattttgaactccccttctttatttatattgagtttaacaaatgattgaataggcatgttgttcgttggtattctcttggattcattccaaaaatatttttacatattncaattagccgttcctatntatagtgcgatagaatattcatttgctggaaatgggaatatcattgactatgaacattctattacaaaagcactatntgaaggctaccaagaggaaaatgaactacccaaagagatgatagacaagttccattattattaaattaaagagattttgatatagcttatgcatatgatgggataagagaata

SEQ ID NO: 905 - DNA, 2431 bp, Bacillus thuringiensis
tcaatatttgtagtaatacctgggactactgggacatctgctgcttgcattgcgatacgtgattcgattttacttcccatcttcgtaatgatttcttctgaaggaccgataaatacgataccttcttctttgcaacgaaccggaaaagacggattctctgataataaaccataacccggatgaatcgcttctgcatttgtcttcttagctatttcaataattttttcaaggtttaaataactttcttgaacacgcggtccacctactaagtaagcttcatttgccatcttcacatgaagggcattttcatctgcttcagaataaatagcaacagtgcgtatgccaagtttttgacaagttttcataatacgaacagcaatttccccgcgattcgcaattaatattttttgaaacatagtgattcctcccttttatctacatcctaaatgtctagcaattacgagacgttgaatttcagaagttccttcaccaatttctaatagtttcgcatcacgaatatgtcgttcaacttcatattcacgcatataaccatatccaccatgaatctgtactgcttgattcgcaatacggcttgctgcttccgatgcaaatagttttgccattgccgcttctttgccgaaaggtttatcattatcttttaaccaagctgctttatgtactaaattgcgtgctagctctacttcagtcgccatatcagctaatttaaattgaatcgcttggaaattagagattgactttccaaattgttgacgttctttcgcatattgcaatgcacgttcaaaggctgattgcgcaataccaactgccaatgctgcgattgaaatacgtcctccatcaagtgtatataaaaattgtttaaaacctttatttacatcaccaagaatattttctttcggtacacgaacaccatcaagtacgatttcacaagtattagaagcgcgaacgcccattttatcgtaaggactagaaatcgttaatccttcactagtagtaggtacgataaatgctgaaatgcgttttctaccattctcttcaacaccgttgacagcggttacaataatggtatttgcatactctgcgtttgtaatccaacacttctcaccactgattacatactcatcgccatctagtaccgctttcgtttgagtaccacctgcatctgatccagcattcggctccgttaatccgaaggcacctaatgttttacctgacgccattggaactaaatacttttgtttttgttcttctgtaccgaaataataaattggagaagcacctaatgaaattgttgcagcatagcttaaaccagtgccaccacaagcgcgaccaatttcttcaactgctaacgcatacgatacagtatcgccacctgaacctccatactcttctgggaatgggatgcctaataatcctagttcgcccattttttgaaatgtttcatatggaaactctgcagttttgtcataatatacagctttcggtgcgatttccttttcagcaaagtcacgtaccatttctttaatcatttgtttttcgcgagttagagtaaattccattccgctacacaccccttatcgaatattgagtttcgacagcgtgcgagtttctactacaaacataacaacttaaaagacaagaatattagttagacaattgctataattctgtcataacttaattttaaaacagattctgtactaatgcacaaaaaaattcctacattgttctacaacaacataggagattttgtgtcgaattatgtaatttattgtttaataatctctaccttttcccgaatcagaaatttctactaatgcttcagggtatggttcgaaatacgtttgtcttaataaatacttttcatcaaatcgaatggcccatgattttagaattgtaagtaaactactaagtggtattttcttttctgcatacttttgtaacagttctataaaatgatctttttcttgtttttttagctttgttttaaagtatccaaaaatgtgctcgcatacatttacattcgatgtatagcggggggtgcgcataaataattcatataaagtcttctcatagttttcaaatacaacttcaatcttttcatttttgtgatttgcaattatacgccctaattccttttgtttcacttgattatatgccataaataaatatttattgtccgactgaaacgatacaaggtctttcatatttttattatgtttaatcattttgtaatatgcgattgtaaatagtcttgtaaagaaatgctctctaataataaaattcgacaatctgccttcctcttcaataggaagatgcgaaaatttttttactactgctccgccaaataagcccgatccttttccctttgccggcgctttttcaaaaccagaataaattataccatcacgcg

SEQ ID NO: 906 - DNA, 1915 bp, Bacillus thuringiensis
aaatggactcatttctggtacggacgattatatggtaggaccatttgaaccagctgaagtgattttccgtatgaaagctttattacgacgttatcaaatgctgagtgcagatattattacgttgcacggaacgacaattgatcgaaaaggtgtagaagtaaagtgtaacggtcaaacaattttgcttcctttaaaggaatttgagttattatcacaacttgctagttatcctggaagaacattttcaagagaagagctaattgaattagtatggggaatggattttgaaggagatgaacgaacagttgatgttcatgtgaaaaggctgcgagatcgtttctcaaaacgaacggatgattttcaaattacaacagtgcgcggcctcgggtataagttggagttgaaataagatgaaatcactatattctagatttgtatttatgacggtcggcattatgctacttagtagtattatcggctttttattaacgaacgtatattatcaagtgaagttaaaaccatataacagtgaaaagattttaaagtatgcggaagaagttaaatcgttatatgaaaagcaaagtgaagaaaatcaagagacgtatttgcattctattgcaaaattagggtatgagatttacattgttgatgatcaaaagaatggaaagcgtatcggtaatgcgtttcgtaagacgacaataagtgatgataccgttcataaagtattgcagggggagacatttaatggtgtttctacttatccaacgcgcctctttattacaggttttttcgataatgaattaattaatagcgtcggtgtcccagtacaacacggtgataaacagtacgctttattcattcgccctgacgttcaacaacaattcggcgagatgagaatttttctagcggtattattagggtttatcgtactattaagtattatttttatagcgattgcagcaggttacatcgttcgcccaatccgtaaatttacgaaggctacgcaaaaaattgcgagtggggaatatgaaattgaattagatgtaaaacgaaaagatgaaataggaacgttatctacaagcttccaaaagatgacgaagagtattaaagaactagatgaaatgagacaagaattcgtttcgaacgtttcacatgaatttcagtcgccactttcttccatacaaggtttttcaaagacgttgcaaacagaaaagatgagtgaggaagaaagaaatcattacttacaaattattgagggtgaaagtaagcgaatgtctagtttatgtaaacagttacttacgctcgcttcattagataaagaggaaaaggttctacaaataagagaattcaatctgcagaagcaaattaaagacgtcatttttatgcttgagtggaaatggcgggaaaaagatatcgccgttgaatttaatgtgccagatatcactataaaaggtgatgaaaacttacttcatcaagtttggagtaacattttcacgaatagcattaagttttcaaacgatggtggaacgattgagtttttcgtcgaagagttagagtctagtgtcattatttctatatcagacaacggaatcggtatggaaaaagaagaaatggatcgtatttttgaccgtttttacaaagtagatacagcaaggacgagaaacgtagaaggtagcggtttaggattgtcgattgtgcagaagattgttgaactgcatcatggaaacgtttcggtgtatagtacgaagggggaaggaacgaccgttcgggtggagcttccgaaatagatggaaagaaagaggctgtttcggaactgcctcttttttgtcgttttatgtcggcaagtcgatataatcggaaaatcgctgatatgatttgagctgcgccgatataattctatttgcgctggtatatt

SEQ ID NO: 907 - DNA, 3440 bp, Bacillus thuringiensis
gaattaggtgtgcctttattttatcgaaacggaaaaggtgtaactttaacttccaacggtgagattttattaacatacgccaaacaaattatccacttaatggatcaatctgttaaagcagttcaaagtaatgggatcgaaccaagaggcactttaaaaattggatgtacagaatctacaaccgctgtaagacttccatctatattaatggcctattatgagaaataacccaaaagtctaaattaatttttaaaatcaattacgaccggaacaaattaattaggcttgtactagaacgaaaactggacggagcgtttatagctggctctactcagcatgccgaacttcatacaaatatatttcgtgaagaagaattagttctcattagcaaaaagcctttatcttcctttaaagacataggagacatgaatttacttgcatttagtcacgggtgctattatagaaatttattagaagattggcttcaagaagaaggaatttcacctaagcgagtatttgagtttggaacaattgaagcgatactcgcatgtgtaaaatcaggtatgggcatagcaattatgatgaagtctattttaaatggtcataaacatgacatattattcaatcctttaccaaatagcttccaaaaagttcctactacttttattactagaaaagatatatatcactctgctgcattacaaaaatttatggagatgactcacaatccgtgaaaagaaaatacgtggtatgaaacgaaaaacaaacactatgataaagcgaattgaggaacatacaaaaatgttcccttctactttctataacgatgaatactggaatatgcctttaccagtttctcaagcttttatcgattcttgtaaaacgcctagaaaagtaaaacgattatgtattcaaaccttattaaatcaagcaaatcatttaataaatataaaacctagggatacacatacatatcgagttgttgttttgatttctataaataatttatgggattcgcaaatcattatatttaaaaatgaggactactttcataatttctttaatagagatagtgaatttcaaaaatggattcttctttcaaatgaaattgatttttgggagacatgggaaatttcagtttgtcattccttcaaaacgcttcactttcaagaaattatttatgatgcagatgaatgctatgaaaaagagattacgtttatcggggagttaaattaaaaagggtatacctaaaacactggtataccctttttcacttatttttcctttaatacactatgtaatcgatccggataatttgtaaacattcctgtagcaccccatttgattaacagtctcatatcgggtttctcattaattgtataagggtgaattaacagtccatttttcctagccattttcatatatgactcatcaataattagttctccgttatcattacgtaagtttggtccaataccagctgcatactttttaatttcttgaaaatcatcatttgttacacttttcggttcatgtgtaataccagaccattcaacaatttcattgttttcatttggataataccaaagcaattgaactaacggaatattttcattcatactatgaatctttttcaaactatctttactaaatgattgaatcataacacggctagaagacatgttttggcctactaaattatatttttgtaacaacgccaacaaattctcttccattcctggatacacatctggtgattttgtttcaatataatacttcatacttcttccatacttttggaagatttcttcaagagttggaaccttttgcccaacatactcttgcttagccttttctggatacgctttattaaaccatgatccagcatctaaactctttatttcgcttaacgttttatctcgtacttcgcctgttccatttgtagtgcgatcaactgctgtatcatgcattgcaattaattggccatcctttgttaattgaatatctaactctaaataatccgctttcatttttttcactagatcataagaagcaaaagtatgctcaggtgcatgtccacttgctccgcgatgtgcaatatttaaaaacttattcgtattccattcatgctttccttctgctttcgcatgaacagctcccccagcaaagatgcttcctgtcataaagaaaataactaaaacgctaataatctttctcatccttcaaacccttcctacgttgcaaatttcaacaagctaatgagatttacacgaaatagaagacacactttcattatttttataaacctatattaaaattccaatcttacaaatgttttctatattattaatatagaaaactagtattatcctatttaatttctatagccctccttttcacatgtaactccctattttgtacggagcattcaataaaaaaagccataaattatttagaatacactcctgtatccctaaataaatttatggcttttctcaaatatctccggcctctattaacttgtcgaatttaatcatatcaaacctattgaaatttgtgaatatttttttcagtacagtgaagtacataaaacaatatttctgtagttacttaaaaatcacataataaatttctcattacctcttccaatactatatctggatttactaccgttttttccgaacgccatccgataaagccatctggtctaattaatacagcacctccattctctataccatataatttgctaaaaatatcttctggaacaataaagtctccacttaagccaacacgatacccttttagatgtattcctaatttagctgaaacagcatgtgctgcctcagcccaagaactattttctactcctgtaagtaatacaaaactgttaccgaataagtctaatgtagaaactttcttcccctcatacgttccccataaatgtggcgctcgcgttccaggtcttccgttcaactctatgctatccattctatgcggagtgactgaatcatctataatcgcctctgaacaatactgatatccaactgtaacagctaaaccatccatattattcaaactgccttcctctctattcgcagcacgaaacagtaaactacttgcataagctgtcgttaattttgcaacagagtgtctctcctcatgatatgtttctaacaattttggttttgccttcccttttataacagccgctaatttccaagctagattgtgcgcatcttgtattcctgtatttgaaccaaatcctcctgttggcggcataatatgtgcagaatcgccaactaaaaaggttcgatttccttgaaatttcaccgctgtactttcggctgcttcccacggtaaaacacttaatatttttgattcaacatttgtacttccaattgctatttgaataatttgtttacaacgttctatagtga

SEQ ID NO: 908 - DNA, 2173 bp, Bacillus thuringiensis
ttttttatgggatttctatttgttattgcattcatattggcaacttttaatatatgttcttatcttgtagcgattgtatgtatggcattacttaatctcacttttgttattggggcatttcagcagaaacaatatacaagttttgtaatagcgcttgtaatgtcattttcctttagtattgtagcgattgtgttttatataaaataaaccatctcgatgtcgagatggtttattttgttatgtgtaaaaagtaaaaaaaggacgaacacatcgccctttttaccaaaacatactcgcgccagcaagtaatgttgttacaagcatagaaattagcatcacataaaccataactttttgagcttttttatgcatcgttatacctccttgcaaatcagtacaatttcattgtaacgagaaatgaaattatggacaaggggagagtgaggacaaaattcgggaggggattgcaaaatataacaggaaatttgagagtgtgtagagaatatagtaaaagggtatattgttaatttttagttgggcaagctgaagaatggagatacgatgatgaaaatatacgaaacagatcgtttatacttaagggaaattgatgagtcgtatgctgaaacagttcttcaatattacgacagaaatcgtgaatttttaaaagcttgggaagagtatagaccggatgatttttttacgctagattatcaaaagaaaaagttgcaaaaggatagaaaagagttcgaagaagggaaaatcatcagactatggatttttaaaaagggtgatgatacgaaaataattgggtgtatttcatttaatttaatcgttcgtggcatttatcaatcttgtgtactcagttataaattagataaagcagagttaaacaaagggtatacgacagaagcgcttagaaaagcaattcaagttgcttttggggaatttcagttacatcgtatagaagctccgattatgcctcgtaatttagcatctatacaagtagtaacgaagataggttttcaatatgaaggcgtatctaggaagatgttaatggtaaatggcgtgtgggaagatcatatgcgctgggtattgttaaatgagtaatagaaagcagatggttatctagacatgtaaaccatctgttttttgtcttgtatttcgaaacttttgcgaaattctgttataattaatagtgttacatacataatggtagtgcaggaggcgcagtcttatgattaatcaagaacgtttagtaaatgaatttatggaattagtacaagtagattctgaaacgaaatttgaagcagaaatctgcaaagtattaacgaagaaatttacagatttaggtgtagaagtatttgaagatgacacaatggctgtaactggtcatggtgcaggtaacttaatttgtactttaccagcaacaaaagatggtgttgatacaatttactttacttctcatatggatacagtagttcctggtaatggaattaagccttctattaaagatggatatatcgtatcagatggtacaacaattttaggtgcggatgataaagctggattagcatcaatgttcgaagcaatccgtgttttaaaagagaaaaatatccctcatggtaaaattgaatttattattacagtcggagaagaatcaggtcttgttggtgcaaaagcattagaccgtgagcgtattacagcgaaatatggctacgcattagatagcgatggaaaagttggtgaaatcgttgttgcagctccaacacaagcgaaagtgaacgcaattattcgcgggaaaacagctcacgctggtgtagcgccggagaaaggtgtatctgcaattactatcgcagcgaaagcaattgcgaagatgccacttggtcgcattgactctgaaacgactgcaaatattggacgttttgaaggtggtacacaaacgaatatcgtttgcgatcatgtacaaatctttgcagaagctcgttctttaatcaatgagaaaatggaagcacaagttgcgaaaatgaaagaagcatttgaaacaactgcaaaagaaatgggcgggcatgcagacgttgaagtaaacgttatgtacccaggatttaaatttgctgatggtgatcatgttgtagaagttgcaaaacgtgcagctgaaaaaattggtcgtacacct

SEQ ID NO: 909 - DNA, 2874 bp, Bacillus thuringiensis
aaaccatataagtgcccgatttatctgcctttaaccacattttgttcacattgtctgtatatgtatccattttccctgctaaagatggaacccaaaatgagtgtttaatatcggcacccttcaaatttaaatacacttttcttacctgtggggatgaccaaatcttgcgaagttactatcttttctgatttataagaaaattcccaccaataaagattcgctgttacatcaacaacgatagtatctttatcaatattctttttctccatcgcacttacatcagcaagtttgaatgtatatgtaactgttggaacagctaagattagtaaaagaataatcggaataactgtccatataatttctagcttgtgattcccttcaacttgctctggaatataatcttcctgacctttcttttgtcggaaacgcacaattacatataagaaaataatagtaactactagtactactcctaccatgattgcactcgccagtagaagtaaatcatattgcatttttgctacttctccttgcggaattaaagtagattgaaaggctttaccgcatccccctaacagtaaagccagcagtgaaacgaacgaaagcagtcgccactgtttcttcatacaaacaacccccactttccttgtgaattagattgtactttatagttaagtaaagtaaatctcaacgtaaagaaatccaattatgtcgttgtcttagaagaatgtaactacaatcattgatacaaataagattgttaaataatttagggaataaacaaacatttgcacggaccatttgatgtcatctttcttacggaagccataaaatcctaaaacgatccatccgatgttaagcagtgttgcaattaccataaatgttatccctagtccactcatataaaatggtagtggtaataaacatactgtccaaatcataatttggcgtttcgtaatttcaaatccatgaactacaggaagcattggaattcctgcatttcgatattcatcaacacgtttcattgctaatgcaaggaaatgtgggatttgccaaataaacataattaaaaataacatccaagcaattggatggcctaaagatggatcgattgctgcccatccaattaaaggaggaactgcaccagatatactacctacaacagtatttagtgtatactttctctttgtccataaactatatagaacaacatatgtgaaagcaccaataaatcccattaagactgccattggtgttgttaataataaaaatacaaaaccaagaagtaatatgactagtccaaatgtaagtgcaaatcctggtttatactttccagtaaccgttggacgggtctttgttctttccattaatggatcgatgtctcgatcaatgtagttgtttaaacaacatacccctgccataattaatcctgaaccaacgattgtaaagaataacttatccagattgtccattacacttaatccattaaagtgtaatgccaaccaaaatcctgtaaatacagtaagtgtatttgagtttacaatccccattttaacgagtgcttttaaatcttgtaaccgagttgtttccggtacacttgtaacagcggactcatcatgcagctcacttgttgcatggttcatcactctaaccccctcttaaaactttcatctttctttttgcgcctatttcaaatgaaataattcgcttctatatagcaatattattacagtagaaacattgttaacccattctactactaatctacgcccatactccaatatattaaatcatatttcccgaacattttgtgaagaaaacatgaactttttgtgtcgaatataaaaaacttcattctgacttgtccttatcataacatgatgttaccttctataataaactattttgtcctatttaacacgtattctccccatttcttttcaaaatagcctatttttcacccaaaattttccttgcgaaccctgtttttacacctattttctctccctttccttccccctccatttctttgctattttattattttttatatatcataggaactagcgcgttttattctatacataatggaatgaaaatatttcgcaataacttcatagcagaaagatggtgaaagagattgcaacgctttattaaatggttagcagtcattacaagccttgatttattaatagttttattaggaggcgctttagttacaaaaacaggttctggtcaaggttgtggtaaatcatggccactttgtaacggtgaatttgttccatctaatttatcaatggaaactattattgaacttagccaccgattaacatcaggatcagctggaattcttgtcactctactttgtattttgtcctggaaatattataaacatgtgcgtgaaacaaaaacgttagcaattttatccttcgtatttttagttgcacaagcattaatgggagcagcagcagttgtttggggacaaatgccagctgtacttgctatccatttcggtatttccttaatttcatttgcttctgtcattttattaacgtgtcttatctttgaaattgaccaaaaatttgatgcacgttcacttattatggacaaaaaaatgaaatttcatatttatggtgtaacaatttacagttatatcgtcgtttacacaggtgctttagtacgtcacgaacgagctagcttagcctgtccagactttcctttatgtagcaaaaacagacctatgccaactcaactacatgaatgggttcaaatgggccatagagttgcagcgatgttaatttttcgcttggatactatacgcgatgattctcgcttttcgccattacaagcagcaatctgtagtatattggggat

SEQ ID NO: 910 - DNA, 4081 bp, Bacillus thuringiensis
aagagatgttacttagtccttcggtaagtaatagtactgttgcccgacaccacctcgctcatgatactaattgtcccttgatgactttcgataattttataacttaacattaatccaataccagtccctttttcgttcgtactataaaaggttcacctaatctcttaattctttcttcaggtattcctattccttcatctattacatgaatgatgacaccatcatcatttatttcttttatgtgaattgaaatttccccaccatttggcatagcttcgattgaattttgcaaaatattaataaatacttgtttcaattgattttctgagcattcaataattatatctttgtcatccgtaaatagttcaacttgaatatttgtcataattgcttttgtattcattaacgatacgacatttttaaaaatttgataaatatttttcttttctgtatttatctcatctgttttagcaattgccagaaattcttgcaggatcgcttctatcctttcaatttcagagagcataagatcaaaatatttttcttgatcttctttattaatttgaaataactgtataaaacctttaattacagttaaaggatttcttacttcatgagccacgccagctgctaattgaccaattgctgcaagcgtatctgatttatttagcaattcttctgtcttttttctctctgtaatgtcgcgtacaataatcataattttatcatgtaataatggtaagcacctagcctcaaagaaattaatacttccattaagtgtgagtggatattctacaattacattcgttcctttttccttcacttgattaatggcttcctgaaactgctgtgctactgaagatggtaatacttcgtaaaacttttttcccataaaagcttctgcgggtacgtaaaactttgtaggagatcctgccttgtaatctataattgtgccatcatcttctgttaagaaacataaatctggtaaagctttaaaaattaattccagttcagatgtttgttgttttaactgctcttctatcgcttttaaatgtgtaatatctacaccaacagcccaataactatatcctgttacaggaaactgttctgatatattcgaccacattattgttttgatttcaccatttttacatgttaagtgcatttcccaatctctgaaattttttccacaagttaaaaatttcttttgtatttgatggcgataattataatcaggatacagtaattgcagtgcgttgggatttccaattatttcttcagcggtataacctgttacaatttcacattctcgattccacaaaacaaaatctccattataatcaagcgcatcgaccataacaggcatgttttgtaaaatcgtatgtagttcctcctctttccgagaaagcaacgttgtatttttactttgaaatacttttattgcgccatctaaaattaaacttgagagcatttcaaagtatttttgacaactgaaaatttcgctttttttggaccatacaacaaaagatcctaaatgttgattgtataagaaaatggggatttcaatctttggaagtttactcttttttatctcattcattccgaatgaaaaaacacactctttttcagcatcaagaagctgatgtgatatgttagttaatttataaaattgttctgccatggtttctattgtactcacatcaataagttccattagccgcgaattcattcctttttcacctcaatatgtaaaattaatacaaatctaaaattcatacttctccattatacgaagaaagctagtgaaggtatatagctgtagaataattattcgaacaaattttatttttcaattaaaataagaaaagaatatatatactgaatatacctttaattagtatatatttcgttgattcctcacttattgtctaggtaacttgaattccttcttacaattcactgaattttcacttgagagtcatacacgttactaatagcggtataaacatgcaataagtataaagttcataaaatattcacaatttttatgaaaaatataaacatttattccaatatattctatataataaaatgtaataaggcttctatgaatctcatagaataccttacccctaataaaaaagaaaaaagaatccatttggattcttttttcttttttaattacattacatatttatataaagcatgtgccacaccatgttcttcatttgataacgtttcgtatttacacattgcttttatttcttctactgcattccccattgcaattgatatgttcgctttttccatcatagaaacatcgtttagcccatcacctatcgctacagtgttttcaaccggaatattaagatgttctgctaaagtatataatccattccctttttgagcatctcgatgattaatctctaaattgtgccaatatgaagatgtaattgctaaatctgtattatgaagaaatgtttctttgagtttttttaatttctcaatttcataagaaaatggtaatagtttatgcacatgtatatctgtttctacaattggtttacaactttccgcactatgaaacgctgtatgctcaagatataatgctgcgattgtttctaactctttcaagtcgaaattttcttttgaattcttcacatgctcaatttcattacgtacactctctactccataatccggtacatacacacctttatcggtatagagctgataatataaaccattctcttcaaggtattctacaatttcaagtgcctgcatattttgaattggatatctcttcatcatttttttatctttatatataagagcaccattttccgcaatgattggacactctaaatcaacttctaacaataatcgctcaatgtcaacaattgaacgtcctgtacaaattgctacaacatggccagcttcttgacatgttcgaattgcttctgcattttctttacttatcattttattccccgaaagaagagttccatctaaatcaattgcgattaatttcattatttcttcaccactttctataaatacacgagttctaattaattattaggtatcgttttcatacaatcctcgtgaggtacttcttatttataatttatgaaaagcgtttcaggtcaagaaataattaaaaataaaatccaaagcttttctttttaaaaaagctttggattttaaactatgaattataactaatgtattttgtctcacacatgtacacatttttttcttcagttggtatatatactttaaacttttctaaccgttttccatagacatgaatcgtaataacgctttcatttttgctaatttcaagaatatgacaatccgctggtggaattactttatctgtttctccttctcccaaataaagatttcctgtatgtgttaaataaacaagtgaatttccaagttgtttcgtttgtataaagttctgcaccataatccttcctgaaaaaacgccttctactccccatgtgccgtcatgatcatgtaaaggtgtagattgtccatctttccatacgagagctagtacttcaaaacgtttgagcggatcttcatacaataaatgtcgtgcatattgagtcaaattggccttctgtttatctaacggaagccatgttttcttttctaaaagttcttctagtaacttttcaatgccacacactatttcttcttcaaataaaccggttaccataagatctgtaacacctttaataaacttttgaaatgatttacttacattacaagtcaacatatgaatcctcctctacgttttatacaattccatattaaggtgattaccgaaaactcacaattgagaaacaaaaaacaagatgcacaggtgtgcaccttgttaggattcggatttagctctcaagcgaataggtgaggatactaatgactggacattttccaatctacatgtgtctaaacagcaagatggagatggctatattttttcaaggcatttataatggcagctgatgcaatctcagcctctaatcggcacgtggtgctcctaggcaaatgcgaggacctttaccaaagg

SEQ ID NO: 911 - DNA, 3288 bp, Bacillus thuringiensis
caagtaatacttttttccctttttcagctacttttaacgtcggataagtgccatgttcaactgcaattaactcgtctgaaattaaaaactcaataaactcactgacctcttttacactacggttcgataaaagcccatacgttggtaaagtatgaaaattaaattcaataactttcttattcttcgacccagttaatacttgcgctatcatttgctttccaaagcgttggttcgttctaatcatgcatgataaaaccatttgtgattctcttgtcacatcgatgctctcgcgattgtctgtacaattaccacagcgtccacaatcttctttcggttcttctccaaagtattgcaaaatgaatgattgtaaacattgttctgtatgacagtaatcggtcatattttgcaatttttcaagttcatttgaaaaacgtgattctccagttgattgatcaattaaaaaacgctgtacttgtacatcttgagaagaatataacatatacatgtactatctaatccgtcacgaccagcacgtcctgcttcttgatagtaactttccatattttttggaagctgataatgaattacgtaacgaatattcgatttatcaatacccatcccgaatgcagatgttgctaccattacacttacttcatctcgtaaaaagagttcttgttgctcatttcgatcactatcactcataccagcatgatattttgatacagaaacacctgccttcatcaaatcttcatataactgatcgactacttttctagtagctgcatatataatcccggattccttttgattttgacgaatataatccgccaaatatgcatttcgatcttgccctttaatgacagaaaacgataagttctcacgctcaaacgttgtcataattgtattttcttgattaatttcaagtgtgttacaaatatcatcacgtacttgcggtgttgctgttgctgataatgctaatacggggggtttttgtggaagatagtctaatatgcgatgtatatgtaaataacttggacggaaatcatgtccccactgtgaaatacagtgtgcttcatcaatcgcaatcatagggattttcatatcaataagttgatcaacaaactccatcgaatcaagacgctcaggcgccacataaagtaacttgtaatgtccttgtttcgctaattgaattcgctgatttgcttctgcaatagatatagaactattaatatatgtagctgaaatgccattctgtaccaatgtatctacttgatccttcataagtgatattagaggcgatataaccaacgtcgttccttcaaatactaatgccggaatttgataacaaatcgacttaccgccacccgttggcataatacaaaccgtatctttcccatctagtacatttttaattgtttcatcttgtcctcttcgaaacgaagaataaccaaagtaggacgctaaaagttcttgtgctttagtaaacaaaaaagagtcacccgcttttctttatctttcatctacttctattatatcaatcacttatgcgacttgaaagggatgattagatgcttattgttttttcattattctatgtttcttcacttatttaatatgaattagcatcattattttatatgttttacaacatttataacgtaaatccagtacacaagaagaaagagtttcaatttaaatgttcattttatttccctttcttgaatactactaatcgtatacatataaattcaggaggttactatatgaaacatcgtaatatgagttccatcaaggcaaaaacgaaaacacaaaaactccaattctctaataatgatgcgtggaaatatgaatcatactataagtaccagccattattctcttataaaaagctttttaattttctttctcaactttttagacgttaatatatgtgcaaaaaatatatcattcacagaatttttctcaatattaaatgtatagacttactacaattcagttgttaccatatataataatctgttggataaaccccttaagttgacctgcttatattagcaggtctttttcatgattacatacttctgtgtacctcgatctcacttccaagtcttttctccattttataaccatatttagatcccaacaattaatgataatcataaattgttgggatttaaattgttcacatataattatgcaattcttctttctcaatacacaaaacacattttacttgttactataaaagtactccagatgagttttttgctcatcgacattatctagttattggggcctgccgcgggaagcaggtccctttgactgtatgaaggtcccaatttcatttggacacatttaccaggttttttcaaaagaattttatgataacattacgtagtcgagtccgacatctcggcaatacccttttgagggtctgcaacttcccttacagaccctcttttactttatattcaatttattcatatataccacaacaccattcattgaatttctccatttcaaattccctaaaaataatctaggacacgtaactaaaaataaatcttcatcatactttgagttatacatgttcaaaggagtgttactatttatgtattcttattggcaatcgtattactccccctaccataacccttatgtaaactatgatttatccgtacggaactaccgaattagtaaaaatgagaattttttaaaagggtatatgcgttctttatgggaacaacacgtcgcttggacgagattggctattataagtatagtatttaatttaccagatgttaatgttactgttggacgacttctacaaaacgcaacacatatgggactatcacttgaaccattttacggtgaggatgcagtgaaaaaatatagtgcattaattaaagatcacttagtaattgcagcggatcttgttaaagccgcaaaagctggtaatcaaaatgcagcggccgctatagagaaaaaatggtacgctaatggtgacgcaattattgaattccttaacaggatcaacccatatatagataaagaagaatttagaaaaatgttttatgaacattcagcactaacgaaagcagaagcacttgccttcctaaataaagattatgaagcaggagtaaaactttacgataaaattgaaaaagaagcattagaaatggctgacatgataacaaacgcaatcgtaaaacaattcccgcaagtatttcaataaagtgaaactttaatcagtgagggggttgttcatcccccactgattatcagctc

SEQ ID NO: 912 - DNA, 2188 bp, Bacillus thuringiensis
cggaccccacacgtcgtggtctacagcatccctccgctgctcaagacggtcgacgactaacttatgatcaaaaatcatgcctgtatagaggagggagagagggctacctgacaacgcctgaacggagcatactgattctttattgaagtccaagtttctttaaacggttatataaagtagcccttgttacaccaagttgttttgcgcattctaatttattcccatttaaaattcgtaaagccctttcaataacttttttctcatgctcatccatctcttcttgtaaagaaaggattgtattattgttgctgagtaatagggaatgggctgtatggttgtctaaagtttcagtcgtatgaaatggtaaatattcttgttttataattccgtctgttgcgaataccacaagccgttcaacaacgtttcgaagttcgcgaatattacctggccaattgtaatgaagcagttcatgcataatgcttgaaggtaagtcacgaattggtctgttatagttgattgaaaaatcgtttaagaaagaataggttaattcaataatatcctcgcgtctttcgcgcagcggtggaatctgcaagctaactacatttaagcggtaatataaatcttctcggaaagttccttttctcatttcttcttgtaaatcacgatttgtagcagcgataatacggaaatcaatattaatttctttttcaccaccaactcggtaatactttcgctcttgcagtacacgtaacagttttacttgcatatcaagtggcatttcacctatttcatcaagaaataaagtaccgccttgcgcgagttcaattttacctttttttcctttactatttgctccagaaaacgccccacgctcgtaaccgaataattcactttcaaataatgcttctggaattgccccgcagttaatcgaaatgaaaggcgccttcgctgcttcacttgcttcatgaattgctttcgcaaatacttcttttccaactccgctttccccaagtattaaaacagttgatttcaccgaacaaacttttctagctaattgtatcgttctttgtataacaggactttttccattcatcgcaaggaatggatcggattcatctttatactttgccacttcttgttctaaacggtgcatttcatgtgacatattaaatagtttttcatttaaagcgacttgatttgtaacatctgtttctgaaacgactgctcctataatttcatcattacaataaactggatttgaattaattaatacgaataaatcggggcgaggctgatggaactgagcgactatgctttttccatcatgtaaagattgtaaaatttccaagtctttataatcaaaaaaacgagtaatcggttgcccaataatctcattatggttgactgaaaatattttttcagcaccatctgtccaagttcgaacgcattctttactatcaattactgtaacagaagagtcagttgtttgtattacagtgtcataaaatgactgtagttcattgtaggacttataaagaaatggaatcatttgctgagaagttatacagcatatcggctcatcgttttcgttaaggatgataacagctaattcataagaaaaagcgtcaattaatgcagtgaatgagtcatctacataaataattgcgcaattatattcttctgtagtagaagggaggtaataaaacctttcgtttattttcttaatgcgatcaaggctacatgtatgattgattaaaacgctttccaaaaattcttgtatagtcggaaatgagaattccataatgtcctcctgttatgtataaaaattttgacagtgataaaaaaataatacacctatttactatgaatttaaaatatttttacaaataaaaatattttttataaaaattgtatatgtacagaattggcacgtcaattgcataaaaagaaagtgagagggctaggaaaggaggagtatattgtgaggcactgcgacgttttaattataggtggtggaataatagggtgttctatcgcttattacacttcaaaatacggaagagacgtaacaatcattgaaaaaggggaatttgtcagcgggacgtcttcacggtgtgatgggaatattttggccattgataaagacccgggatttgatagtcaaatgtctttagtaagtcaaaaatta

SEQ ID NO: 913 - DNA, 2803 bp, Bacillus thuringiensis
ttccaatccaatactttctctaaaaaataatcatctttcgtatttttaaagaaaaacttgaattttccagctactacatctaccgtaccttttcgatacttaagtaataataaatagttattttcccacacaagaatatctcccatacctgttgtaaaaattgggatagcttcttcataacggatataactttcctttaatatatctaaatatttttctgggtttattgctcttaagtatccatttaacatactcccaaacccatagcatttccataaatctattatttgatctggaactttccctgtatacttttcaataacctctgttgatggtttttcgaaagatataaaatcatttatattttccatagtatccccctactccgatttcaatctaacattaagatatgtcaattttttttcttcctctgataaggtgtcagcaactcgtctaatttccttatccacattaccaatcctgcttttccactgcgaacctattgatgaattaattctagaatcacccatgccagttatttttaatggatttccacccgcaatttgatctgggtcatgtaatgcagctttatcctttatccgctttaaagcttgctcttctgcttccctaaatgaaaaaccttcttccataaattcatcaattttatcttgcacagcttgttttcgtgttaatctttgagctgaatttgcttgttttgatctcccatatttaaaaattggttccgattctaaataaactcataaactgtcaattttcccagtccatcttcttggttttttaattgtcgtataaactcatcttcattatgtttccgattacgtttaaattcgattccaatttcgtcagtacgcgagctattattacccactccgctagttttattacttccttctaatttactatgcccatgagcaagttgataagcgtcatccttagttaccgtacttgcctttgaaaactttccagttacttctccaacagttgaaggaagcttcactcctattccagtatccaccatcctaaccgttactggaataggagtatttttcatagcatctagtgcattctttaaagtcttattttccctaggcgattgtaccacattatttctacgctaaaacacaaaaaagcacttgttgcctcaaatagacaatcaagtgctttaagtttcatctgtttttaagcagcataaatttgtaagttttgtagtaacagtatgacaccgtttatatgtggtaacaagtactaagttaaaacttacgagtttgtacgagttcgttagtttaactactttctttcgttgaactactaaaagaaaatttctattttcaataaaactacattctcgaactgtaatcaattgtaaatacctttttatcatctgatccttgaattcaaataaaaagtttttaatagaaataaaaaagcgcttgttgtctttcgtagacaatcaagtgctttaagtttcatctgtttttaagcagcataaatttgtaagttttgtagtaacagtatgaaactttttatacttcataacaaatactctctaaaaacttacgagtttgtacgagttcgttaatttaatatacattccatgcgtttatattcatcccacagtaaaatgtcatctcgcctaagctcgtacttctttttctattctatccttgcacgtaatactctatttaaagcagttacataaaaaccttgataagtattcaacttatcaaggttttagctctataacttataattttcccatagtttttttctcattatatgtgtctctaaatctgctaatctaacaggtatgggtaaccgactttctttattaataagcctcatgacaatttcagtacttgtctctaaatcaatccagttaccacatgaaataaaaatgggttttacacttttggttgttcttaaagctcgaccatatatttcattattaatgataatatccgtatacgatccctcttgattttcaggcatagtaaaatctacacctttaatctttaaataacttttcgctacaccaattgttggtttatttaaatagaaagaagcatgtgttgcaatacccatgtgtcgataatgcaaataaccattcccatcaaacatatagatatctggttgcttagttagtttttttgctgcagctttaattaaaggcaactcacgaaaagcaagaaaacctgaaatatacggaattgttatttctccataactgtacactttttcaacaacttcatgtgtactaaaatcaatgactacaatacagcatgtaccatacgttttaccatttaattcccaatacgctaaatctactcctgcaacaaatcgtatttcttctaattcaaaggtatttctaagttgtacttttggtaagaatgcacgctgctcatttttaaattcctctattaaaggttttaatttagaattatccattgcaatcacagcgtaaatttttttcaataaatagtaaattctctttggctgattcaagattttgtttttttatatattcttgttgatcccactcagcgcaacataaacatatcgccgcatttaaatttctcttcatatttccctctccactttcataccaaatttagtgcatacctcctgtatgtcttctaaccatacttcatttaatgaattacaactcaacatttcaactgattttgtatagtatttactttattatacttttggctccctactgacctttttagcatataataaatctgattcacaaggatctgttttttgttctataatattc

SEQ ID NO: 914 - DNA, 2253 bp, Bacillus thuringiensis
agtcatcctagtatttgaaaaccatggtggtaaaaattatagcttactatatagttttattataattttaaacattgtccttaccttaggaccagtattatttccagtagttctgactattataggaaatgccatgaacgctagtgcagggcactaattttcacctatacagattattattaagatagaaagaagattataatatgaaaattaagcttaagaaaaagagaattataagtgtattgttggctattactttagtagcaatagggtattacgtgtttcaatctattacgaatcctaagctggtaaatgcggaagaggcaaatagtgttcagcaagtgagcagtctacctaaaaatgaattaaaaaaattgatacctaatcgttttgatggtaaagaaagaaaagttgcatatttaacttttgatgatggacctggaaaatatacagctaatctattagatgtactaaagaaaaatgatgtgaaagcaacattctttttaattggcgataatgtgaaaaggttcccagatttagtgaaacgagagcatgtagaaaacaattatgtgggcatgcatagtatgacacatgtttttaaaaagctatacaccaatcaggaatatgtgaaggaaatgaaagaagatcaatctttaattagaaacgttattggatacacaccgaaattaacacgtccaccatatggatcaatgcctggcttaaatgaatcacttcgaaatgaagtggtaggaaataatttgaaagtatgggattggacaattgattctttagattggaaatacaataaattacccgttgatgtagcagctgcaaagattgttcaaaatgtcttagcaggtgcgacgtcttcaaaggaaattgttttaatgcacgatattcatccacaatctgtcgcggcagttccagtaattataaaagggttaaaagaaaaagggtacgaatttgaagcttatgatgagaacaatcattttccaataaacttttggcatgataatcgtatataaagagatatattagttaaaagaaaatcagaatggaataagcaattcatatagggtttaaatatttgtaagagcgtgtttagatagatgaaaacacgctctttttactgaactattttattgtagatttaagtataggctttctaattttagaaaaatttatatgattttttcattcatttctacataagcgttggatatttcgtatgtttggccagaatgaaaagagtttattaaaccattcattattcacgttcttcttcatatatttgtaccacaattatttttttgttgttaaaactagtttttaagaagcatatgttttagcaactgcagaaattctgtatcacttttatcattttttatataatcctgttcgtagttaaaaatcattcgtactaacataaaagctgtaagcggtaatggtaccttatgcaaagctccttgctgataacctttttcgagcaaattacttatcatgttaattgcttcttcttcagattgtttaaaacaagttgtaatttcaggtgaatggtactctttatattcttgaaagagtgtagaaacaaacggatcttgatgatattctaggctgatataatgaagaattttttgtattctaagtaaaacatctttttcttctttatataaattaaataattgtgagcgtttgagctgaatatgacgcatatagcagtcacataatatttcagttttatctgtatagtaataataaatagtacctttaccaactttagctgtctttgcaatttcatcaaccgttgtgttacggacaccacgcgtagagaacagtattgtggcagattgaatgattttcatttttttattttctttttctaatttgatcattgtctacaccctatccttgaaatatttagcgaagttttctatctttacattctgtattagttcatttgtaattttgtaactcctaatagaaagtcctctatttgcttcttatagaataacatacaccattcttatttctagtatataactataatagaatgcaactgtatcacttaagataaaaatgaaagtttaaggtaataattttttaatcggacgatgatttctttcttgattgaattatttgattttttattcaattcattttattatataaacatgactaaaagatgtttttagtcggattttttacggaaaaccgactgatattcgattttagtcggtttctatactatttgag

SEQ ID NO: 915 - DNA, 2853 bp, Bacillus thuringiensis
tccctttcgttccgaaaaacggaacttaaattccgtttttcgaaacaaacatataattcaaaattataaaatattctttcaattcaatcaatagattttaagcaaataaaaaagcatggaagaatatctctcccatacttcactacactttataacgctcttacttgtttcaacggccagaaaacagcttgtccttttccaacaatttcatcttctgaaataaagccaaacatgcgaccatccttagaaacttcacgattatcccctaaaacaaatacttggccttctggcactttcgttttccctgtgatttgttctaacgtaaagtctggagttaatacacggcctactgctttttctttaaactgttttaaatatggttcttccatcgcttttccgtttacatataaaacatcatttttatactcaactgtatcgcctggcaaaccaattactcgttttactaaatcgtaaccttcttttccgtggaagacgataatatcaaagcgatctaatccacttatactataaccaatcttattcacgagaactcgttcgttattttctaaagtgggcatcatcgattcaccttgtactaaagaaggtgtaaataaaacaccgcgaataatagcaattaatacaagggtaaaccctatcgttttagcccatgagaataattctttcttcgtattttccttcatcgtttctcctctttcttaagcacttattttattatttcaactaattcttgtactaaattaggatctatttcagaaaaacatgattttccttctcttaccgctgtaccgacgtgcgcctgcgtaattccagtttcatctagcaatcgctttatattttctttcgtcacgccagctccagctacaagctgaatttgaccatcgcttaccttttgcatttctgtaagcaccggaatattctctactatatttccttgtccacctgaagttaaaacgtgagtcactttatgaaacttctttaaagttctcatcgcttctactggattttctatatcatctatcgcacggtggtacgttacatttattccatctacaacagatagtaagtccgctaatttctcttcatccacttcatttcgttcatttaatacgcctaatactacaccagctgctcctaacttctgtgcaactataatatcttctttcatcatttcaatttcttcttccgtatatgtaaaagacttcgcatgcggacgaatcataacatgaattggtatacttaccgcttctaccgctttttttataaaagcataactcggtgttaaaccaccttctgtataagatgaaattaattcaatccgcttcccgccagcgctttcaattcgttttacatcttctaaacatgttgcaataacctctagcatgagatgacctcttttcgtgcttttttcttattataacattagtaaaaataagaagcctagctttctcctttaaaacttaaaaaagaagaatgaaaagaaagatttttttattggcaacaattattggtaacatcctattattcatgtacactcctaccataatgaaaaaacccgtcattttgacggacttttctaatttcaagctttcctttcctcagttttcatatcaatgcctaattgatcttccaataactttacacctttctttgtaagatggacagcccgattcttatccgtttttgtaatccattcctgttcaaaaaatagttttgctattgcagatcctaaccaaccggcaatatggtagcgtcgttcactccaatcaaggcaaggttttgcaaataccctcctttttgtatctgcctcatcaacatttatttcaaaattcagaaaccattgcttaccttgttccgttacaatgtattctccatcctctaaaattataaattgcctatctagtaatttttcagttatctctacaccgagtttgcctgcaagatgatcataacaagttcgagcataacgaatttgttttagttgacctgattgttttaaagaacgaacttgaactgttggtgcgattgtccctaacttttcaagcacttctgcaacttcttgattagcaagtcgatagtaacgatgtctaccatgttgttcaactgtaagtaaattcccttctactaatttagaaagatgcgaactaattgttggatgtgacacttttgccatataagccaattcactagcaggtagtgcctgattattcattagacaatctaatatgattgctcttgtaggttcagcaattagtttagctatatatgagatattcggatatacattcatatttcgatgataccctaactattaaattgatacaattattttaagtttaatagtaaaggagaatgtattatgaatgcaattgatcttagtatattaaatttgaaagaaacgagaaggcgctcagaaaaattatggaattctcttcctaataattttcttaattggaagcctgatcctgaggctatgtcttttggtgagatgattcgtcatgtatggagttcaactttttactaccatatgattataaaaaacaacggttcaataaacgacatacgtatcccgtatgatgacgagccgattacttgtgtaaaaaaagaaattgaattggcgcaatcatactttactgacttcatagaatatgttcaatcaataagcatagccgatctagattcaagacttattgatagaagcgatgttggctatcaacgatatttaggcgatatgctattacgaattgcctatcatgatgcggtccatgcaggtcaatttttacaatatttacgaatggtaaacttagaaagaccattaaattgggattaaatacg

SEQ ID NO: 916 - DNA, 2724 bp, Bacillus thuringiensis
gaattagaacaaaatccgagaagtaataaaaagcgttctaaaagaaagtcaatgaaatggttcatattaattccatttttcctacttatttttggaggagtaggatatggttcgtttatatataataaagcaaaagctgttgtaaatgatgcgtatgcaaaaattgataagtcatcaaagcgtgataaagaagttgaacctttaaaggataatatttcaatattaatcatgggtgtagatggaagtgaaatgagaaaaagccaatatggcgaagcagttcgaacagatgcacttttattagcaacaattaataaagatgataagtctgttaagctagtaagtattccacgtgattcacgtgtttacattccaactagaaaaaaactagataaaattactcatgctcacgtatttggtggcgtagaaagcacacgtgatacggtggaaagatttttaaatgtccctgttgattattatgtgaagtttaactttgaatcattcgtacaaattgtcgattcaattggtggtattgatattgatgtaccagttactttcactgaacaagatagtaaagaccaagctggtatgatccatttagaaaaaggttaccaacatttaaatggagaacaagcacttgcacttgcaagaacgcgtaaaattgatagtgacgcaatgcgtggacagagacagcaacttgtaatagaagcaattgctaaaaaagcgatgtctgttcaatcaattagcaaaatgggctctttactggatgcggttgataaaaacatgaaaacgaacttaacatttgacgatatgcttgctattacaaaaaatatggcaggatctaatttggaaatggaaaaaatgcaaatagaaggtacagataaacgtatcggtggtatttattattacattccaaatgaaaaaaatgtaaaagacatttccaaaaaattaaatgatcatttaggtgtaacgccaaaatcagtccgaaacgaataataaaaaaagattggcttttgccaatctttttttatgggaatgtatttgtaacttttctgtaacgattttttagtttagaaaaattatactcatatgtatgagtataatggataggtaaaaaagtaaaaggacatattcaaaatttgtggtaaggaaagatatcatatgcagaaatggttaagcatgatgggaattatctttatattgactggatgtaaaatgtctgaggctccaacaagtctaatggaagctcctacaaatgaaaaatggattaatgaattaaaggaacaaattgataaagatttacctgttaattatcgcttacttactccaatgtctaacaaagataaacagatgatttggtcaatgaattttaaacaagataataagaaagaagccatcttattttataaattgccgaatgaagatcatagcgtatatttagccgtatatgaagaaatcggaaatggctggagaataaagtccacacataaatttgatggtggagatgtagatatcgttgaagtcggtgattttacagggaacgggaagagagagttgttaatcggaatctctgtaaatcgtgaatcgttagaacatgttatgtatgttttttcggaagaaaatgaagatatgaaggaaatatataatcgaagttatacgaagttattcatagaggatctaaatgaaaatggactgaaagatataagccttgttacatttgaaaaagatgagaagctgacagttgagttcatggaacaatttaagactttatctgaagtgtcatacgatccatttataaatagtattcaaagaatacaaatgggtcgtatatctaaatcactaaaggcggtggtaattgatgcaggagttggcgctcattcaggtataacttatgtagcaaaatttgatcaggatcattatgaagtattacctatagatgggaaagaagatttatttaatgaatatgttgtagaaagtaaagatgttaatgaagacggcattattgaatttgttcgtactgtacgtccaaaaggttgggaagataaatcacatggtgatagtccgctttttgaacgttacatacagtggagtgaatctggaattaaaccaattgaagaacgatatatagatatagaaaaagggtattatgtgaaaattcctaaagagttaatagggaaaattacaataccagatcagcaaaaagaatcaaattctcaaaagtttttggatacaagaacaaatgaaatatggcttgaagttcatatttttaagcggaaagaatggttcaatataaaaggctacagcgcagcaattaaaacagcttctcacgtatatgcagtaccgaagcaatcgaaatttgaaaaagtgaaagcatatataaaaccgctagcggattatcaacaagagtaggaggtgggaattatgtcaaaaattttagttttagaagatgaattaacaatccgtagctttattgttttaaatttaaaacgtgctggattttatgtaatagaagctactactggagaagaagcgttacagattttgagtgaacaaactgttgatatagcactgctggatgtaatgttaccggggattgatggtttagaagtttgtaaggctatcaggaaagaaaataaaaaaatgggtattattatgttaaccgcacgtgtacaagatgaagataaggtgcaaggactaggaataggtgcagatgattatattgcaaaa

SEQ ID NO: 917 - DNA, 3193 bp, Bacillus thuringiensis
ccgatataagctattttccatttccgaagtgtttcataagacggtttattgattattgccgctgtttctctgatagatgtcccgtgttcattcatataataaagtacatctagtttatactgggctgggtagaatgtatagcacttttcaaaggccttttcacctgaagactcatatcgtctaatccactcacgaagtacgctagggttaactcctatagatttagcaattgtttttccactttctgtaccatctaaatatcgtttcaccgcttggattttttcttttgaagaaaatttagccataaaaaatgcacctccaattgttagactgtgtctaacaattggggtgcacttcaaatgaatagaggactttttccaagcatattctattttaaagttcttacttatcttttactttaaaagatattgctgtaacttctttattaacagttccatcccgtttggacttacaataatcttcccattcgctaacgaaatattgctgtctgaaatatctcctgtaagtgcacaagctcttggagattgatattttcgtaaaataatctgatcctcttctataaacatttcaagagaatctttttctacaattcctaaactccgtcttatttccattggaataacaatacgccccatactatctgctttacgagtaattcctcttgatttcataaaatgccaccctttatatttatctaatattacggtattcattttagcaataaacaacaattaggaatagttcgtattacagtactttttttagaaataaataacaattaggaatagtttatgttaaaattctttcttgtttattcttgatttttaatatatttttccttgatcatttttatatattgttttctttcagttagttcaaatataaataatgctttttttatgtctgttaaaccaacttcattagagtgctgaactttcaataaaattgcacctttttcaaaaaacaattcacctaataagtataaagtattcatatttatggctaattttatacctatttcactatactttattgcttcttcatattgatttgcaaggtgtaaacattttgttaacgtatgaatgagtcttaatttgatttctttttctctaggaaattctatcttattaaaattaattaaactttgttttaatatatttatacttttctcatactcttcattttctgcatgtattatagcaattgaattcattatgcttatttctttttctgataaaaagttagtactacttaaggtttgttttagtgctctatttaaaatgtcaaaagcattacttgttgctccatttacataatatatagcaatcgcttcatgccataataaaaattgtttatcctctttcgattggaaattattatcatttttctctttttttactattttataaagctcattatattgtttttgttttacacaatctctcattacacattttacattttcaatatattttatttttttatttttggttagtgcgaatatataatttggatcaataccaagtctttcagataattgatacaacaatatgctagatggataaataatacctttttctatcttactaatttgactttgtgaacatattccatgacataattcagattgtgacatgttttttttctttctaagttctttaataataataccaagattgcagaattccatctttcctccctcaaatgtaacactttatgagtataagaatattttccaacttttaatgtaatgtaaaattgatatagttacaattactaattatatggatttatagtttcttttacaaacttgtatcacaatacgagaaattattaaaatatggttcactaataatcaatgtgcgttttattcacccccactgattattagtccaccccaggtaggcttttacagggagtccgacttctttgccacatctaaattttgaggtcggagtcttactacccgcaaatagccggattaaaataaatatgatttttcacctttatttcttttaatagtttcttttgatttttatataaataatttcgaaggagcgtattttatgaaaagaatgttgaccgaaagagagttagaagtggctatttatgtagcaaaaggatacacagatgcagaaatttcaaaaaaaatatatgttacccctcgaagaatttcaacgataattaatcatattaaagaaaaatggcatattaattctagagtggaattaggtattttagtttatcattatggttttatagatgcacccttattttcaaataaaaaaattcagctatgtaaaaaggttgtacaatagatagctgaatataacgagtttaaattgcaaataaaaatagaagagcagacaaacttttattatttggtttactccatcactttttaaatttcagacattaatataaaaaggttagagaattaacttctctaacctttttatatacactattaggtttcaaacagtaaagatgccctaatgctaccattgatcctgttccctattcaaccctgtataaacaaaaaaatcagatattaccactattcaaaaccagttacaattctctctttcattttctgtattacttcactgctcaatactttttgaccagcaggaagttttaatatggcagcggcacctttactaaggtatatttcttgatcattattttgatttactaccaatattccttgcccttcaaattcgaaataactaatatcttttgtttcatttgtattattttttattgctttatataatccatataaatctttacttctattttctccgcccgttcgaatcggttcagtatcattcgcaacaattagtccttctggctgctcacccttcataataaaccacagcttttcatttgttggtaatagtaaattcttaaattcagagctatttaaaatttgctgtgctggaattgtttcatagattggtaacgaaaatggagatgttgttattttttcaaaacttaaattttcagaagaacttcccttactatattgataatcttttaatgcgatcgattgtactgattcacttttattttttgatgcataactaattttactagcgaaaataataacggtcattaagcacatgcacagtatcacaagcttaagtagttttcccatttatgaaccccc

SEQ ID NO: 918 - DNA, 2542 bp, Bacillus thuringiensis
tgtaaagtagattacgtttttcgcaatgaaaaatataaaaaatgttgtatttttatttatcccgatattttcggccaataagacccccgtctcaaaattcagtaagtgcaaagcacttaggtaagaaattaaatactgtaaaattccaaattgatatgaacgtattaaagcttcactttatttacaaagaaaaatcccatactaacttttttaatatttgctgcaataaaactttttacaactatcttcgctttttaattcacaccattattttctacataaaaaatagggcacacatcataaaaatgatgtatgccctatctttatttatacatattttgtatttcttctttatttttaagtatttcctcaaacttatcactacaacccttcggaaataacactcccagtccatatgaatgcgcaaattgaaaatgagggtacttcgcttttacctcatcccaaaacttatatacgccgaaatcactacttctaacttcaatatcatgaaataatacaataccgtttttcgcgactttcggtagccatgtattataatcgtgagaaacagcttcatacgtatgatagccatcaatatgcaaaagatttatcgtttcatcttgaaaccggtctacagcatcatcaaaagtagatcgaattaaatttcctatattaaggtagttatcgctcactactttttctactatttgaaaaaccccttctccatatggacctgtatgcccatctccagcccaagtatctactgcaaagcatttagtcgataaccctccatcttttactccctgacaaaaactaaaaaaggaagctcctaaatgtgtacctaactcaactaaagtttctggtttttcaaatcgtactaagtcatatgcaaaatctaaatgtccactccacgcagattgtgaccgaataataggactaaatgtttcaaattcaaatgatggtttatgagtaacccagttcatcgcataactccttctgcacatatttttaacaaaccaaattactcttatctttatttttttatcgccttgattatgattctatttcatgaaaatatgaagaatttattcttttctattgaggtaaagcatcatatacatatgggtcagttggcttattaattttttcgattttgtttacttttacaagtggaaagactgttcctttatatgtcgtttcatctaataatcctgttatttttacccatgtttcttctggaattttttcaatatttttcccggtaacaatcatcccccagactgatgcatccgcaatacaacaagttatgccatatcgagccactactgctttattccccgtcacatctttatccttatatataaaccctaagaatgtaatttctttccctttaaaccaattaacattttgaccaattacattcattgtttgaacataatccttatcctttacttgtagtttacgctgtcctaacatactttttactacttgctcttccgttttataagtcgttgctaaatttgatgtttcttctgaatcaactgatacttctcgctcatcaaacttaacctgtttcccctctttttcgtttctttccagacttctcgcctgtacactttgattcatacccctttttcctcctaaacttccatcaattgttacacttccaaagagaaaagcactaactatcggaacaacaaataaaacatatacaaagaaactttttatccctgattttgatgttgtatgatgtttacaacaattgcaatcatgctgtttttctcttccatctccccaaacttgtacaataccaaaaattaaaattactacaaaagctatatacgtaaatttgatcatttttggagcgataaaattataaatattccctgttacaagtagtttaaataagagcattgctaaaccaattaaaataatgccacgaatatagcgatgatatgccttctgctcctctttctccattctttctccattctttctcacctcctataacattatgatttgcacgatggtatacacagatacaatgacaattcccatcaaaaagaatacaaatctcttttgaaaatacgcaaatagcattaacgtatttttcatatcaagcataggcccaaacacaagaaatgcgagaagtgcctttatcgagaaaacatgtccaaaagacgcagctataaaagcatcggctgcagagcaaattgataaaacataaccaaaccccatcataataatgggagcaattacttcgttatgtgctactgcatccagtacattccgatcaaaaaacgtttgaaatacacttgctaaaaaagcaccaatcaataaatacttaccagtatcaaaaaactcatctacagtgtgattcataacatctttccaactcttttttttgcttatttgaactgaaacctctacgtcttttaaaacatttctttcgcgatagcaataatacacaattagacctatgaatagagcaactagaattgttattcccaagcgtgcatatacccacgtatcattttttggg

SEQ ID NO: 919 - DNA, 2605 bp, Bacillus thuringiensis
atactaacgtaaatagattgtatatatgtacggtgggctacatcggaatttacgcctgtggagtgttacagcaaactgtagtagcgagtgattggcgagacaggacacgtagaagcaggaatactctaagaatgtacatttatctatatttttagtagcaggaccaacatgcagcatgcgaaacaaatcgcagaacatgcaacattacaaagctttttaaactgttatttaagagaaacagggagtggagaatggattacagaggatgaaagaatgaaaggtatcttcagtaatacgttgaatagagatacagtccccacatatttatgttgtcggctatcggcacagaacgttactttgtatggagaagttatatataaatcatcaacagatcgccatttgtttggagaacaattttattatcaaattggagatagtaattccgttattacagcagattacgttacagttattacgtttttaataaaagtagatgtcgatcaactacggagaaggaacgaatcctgcggaacttatgcttcgagttatccgtagttgtcaaaatattgaggaatttacaaaagagagaatagaagatacatccgcattatacggtttccatacaacttttatagaagcggagcagtctttattatttgggcatttaactcatcctacaccaaagagtagacaggggatattggattggaaaagtgcaatgtattctccagaattaaaaggggaatgtcagcttcattattttcgggcacataaaagtatagtaaatgaaaaatcattattatcagattctacaacaacgattataaaagaagaattaagtaatgatgagatggttagtaaggaatttatagcgaagtactgtaaggaagatcaatatgcattaattccaattcatccgcttcaggcagaatggctcttgcatcaagcttacgtacaagattggataattcaagaattgcttgagtatattggtcctgtaggtaagtattatatggcaacatcatcactaaggacgctatatcatcccaattcgaagtatatgcttaagttttcatttccggtgaaagtaacgaattcaatgcgtattaataaactgaaagaacttgagagtggtcttgaagggaaggaaatgttaaatacggctattggtgaagtacgagaaagatttccaggatttgattttatttgtgatccagcctttattacattaaattatggaacacaagaatctggatttgaagtgattattcgtgagaatcctttttatagtgaacatgcaaacgacgcaacattaattgctgggctagttcaagacgctatacctggggagcgtacgcggttatcgaatattattcatcgcctagcagatttagaaagtaaaagctgtgaagaagtaagcttagagtggtttagacgatatatgaatatttctttaaagccaatggtatggatgtatttacagtatggtgttgcattagaagctcatcagcaaaatagcgttgttcagctaaaagatggttatccggtcaaatattatttccgtgataatcaaggattttatttctgtaattcaatgaaagagatgcttaataatgaattagctggtattggagaacgtactggaaatttatatgacgactatattgtggatgagagatttcgttactacttaattttcaatcatatgtttggcctcattaatggttttggcacagcaggattaattaaggaggaaattcttctctcggaattaaggtctgtacttgaatcattccttccatataaccgggaaccttctacatttttaagagaattattggacgaagataagttagcgtgtaaagcaaatttactaacgagatttttcgatgtcgatgagttaagtaatccattggagcaagctatttatgtgcaagtacataatccactcgttagagaagtggctgttcgttcataaataacgttaaaatttcacgtaatacaaataatggtattttgtcataaggtggagggttttatgagagtggacatatatcatacgaaagtattgaaggcgctcgaatcagaagattacatttcagtacgaagaagagtgctacgtcaattagtagaatcgttaatttatgaggggattattacaccggttcgcatagaaaaagaagaacaacttctttttctaatacaaggacttgatgaagaaggcaaaagtgtcacgtacaaatgctatggcagggaacggatgacatttggacgtatttcgttagactcattaatagtaagagttcaagatgaacagcaagaaatacaatctgtctcgcaatttctagaagaagtttttcgggttactagtgtagaacaagctaaattagattcttttatacacgaattagaacaaacaatatttaaagacacgattgcacaatatgaaagaaataataagagagaatatactcaaaaatcttacgatgagttcgaaagccatttaatagacggccatccatatcatcctagttataaagcacgtgttggatttcaatatcgtgacaattttcaatatggttatgaatttatgcagccaataaaa

SEQ ID NO: 920 - DNA, 2062 bp, Bacillus thuringiensis
caaaagaacattggtttgcataaattatagagggaacgttctttttggtcaatagcttacaaactaacatttacagttgttgtatgaaattggtatgatttaggtataaatctatggagggaaactatatgaaaaaaccgttttataaaaaatggtgggtttggattattgctgcactaataataatttttgttgctgctggtgttagtggtaataaaaaggatggcactaaacctgcggttgcagaaaataaagaggctaaattaacagtagatgactacacaaaaagagtagaaaaagcattaaaagagatgggagaaaaaacaaagctaaaaattaactcaactgaaattttaaaagacgggagaacgtctattggtttatcagacaatattattattgttttagaaactgataataataaaaatataaaaaaagcttcattagcaatgactccaaatgcttattttactgagatggaagactttaaattcgctttcttattattaataggaacgatggatgattcactgagttttggagaacgtaatttagttaaacaagaacttggtcttagtgacgaaacagtatttagtaaagatcatacaaaggtttatcaaaaaaataaaataaggtatacatataaaggtagtataaaagaaaactttattctacaagcagaattgcgaaagtaggtgtttaaaataaaaagagattctaattttatgaaagttgttagctctatttttaaggggtttcgtttaataagtagaattataaatccgatcttaaaagcattatctaaaagtaaattttaattacgtagaaataaaaaagccgtcattatgacggctcttactttagtcttcaaacttcacatattcacctgaaacccattggtctccacccacattataccaaccatctctatatccccacgactgatactgttctccttggtacacattttttacaatgccataattagttcctggacctctacgaacacgcaatacatccgctgtaatagtaactattcctacaccattattgactgattgcgaacttgtcggtgtgctttctccagtataatgaatgtatgatgaatcattataaatccactgatcgccaccaaggtttagccatccattggattgtccccatacttcgtaggactcacctttacctaattgacgaataaccccgtatccagtacctggacctttacgaaggtttatgccattcccctcaatatacgcaatacctgtcccgttagttgacggtggaataagcgtaggagttactttaccatctccattgtatgcattttggactctctcgataaagctatcccaacgtccttctgccaacatacgatgaggacagtacttcccactccatgattggtgtgtacgaactttatgaattggaatatcgtactgtttcattagttgagctacaacgatggctgcattgtcttccgctttataatatctatctccaccacttaaagagtagcaaatttcaaccccaatagatttacgattaccattcccgttaccgtcgccagtatgccaggcgttacgctctaaagggattccttgtactgcttctttatcatctaccgcaatatgaaacgacacttggttgccattacgaatcatatacgatacttcattttctgctgtagcatcgttgtaagtattgtggactgtaatgaattccggattcattgtgtaaggacactttataccatatttacttgggtcaactagtttttttctaatttccattattgaacatctccctttttctcttcttgtttttgtttaccacctaaaatttcgactgcatttgttaaagctgaaggcaaaggtattcccatacgccctgcattttctaaaagtgaaagcaactcatttgcaataaagaaaaagatcgtcgcttcacgaatagcgctattgcttcctagtgccgcatctaattgagctgccgctcctaccaaaagaaaaagcaccacctttttggggatacctttgaaacccagtttactttttaaccc

SEQ ID NO: 921 - DNA, 2440 bp, Bacillus thuringiensis
  unsure (1)...(2440): unsure at all n locations
atatagacagcctaatcgttatttataccgactgttatctgtgcaaggtaatgtggaattaaaaaaatggttaagtcacccatcctatttttaaatacgaatgagagggaatatacaatggatattcagaaanagcgttctgtaacagaaagtgaaatacagcaaatgaaggatttggcttatatttgtgggcaacaagacaatcttgattactcttcagatttacatatcaactttttaaaaaatcgaaatgaagattatataaacgattttcttctttataacggtactcaattaattggcgctttaaatatgtatgatttcgaaagaccaacaaagcttgaactaataggctttgtacatcctcattttagaaaacaacgcttcggaactatccttttacaaactgcaatgaaagaaatacaaaatagggagacagatgaagctcttcttattattaatggggattctatttctgggaatgaatttgtaaaacatatgaagttaccatatttatatagtgaatatagtatggagtgcaaaacaaacgaaattcaaaaaacaacagataataatatacagcttactcttgcaccttcagaatcacttcttgatcttattaaaatttctagtaaagcttttggtgattcagtagaaaatacgactacatggttacaaaaaatgatgaattcatcttcccatcaagtttacagtgcccttattgctgaaaaagtgataggaacaattacagtttctaaacaagagcaatctactacactatcaggattcgccgttcatccttcttatcaaggtaaaggatacggaaaagatattctttgtaatatagtacatacccttattacagaaggagtttcaacaattgaattagacgtcgaaacgaaaaatatccacgctttaaaactatatacacaatgtggttttgaaattaacacgaggcatgactattataatttaattaatttttaggtgaatacatatgttaaaaaaacaatttattctaattatgatattttagcagacatctataataaacattggggacattttgttgaatactcccatccagcctcgttttacaagatgctcttccctactctcgtatattagatctttgttgcgggactggtcatctctgccggtgatagtttaatttagttgaactaaaaagtgtgtttcacaaagtttactccgtattacataacgagggtatattcgcatttgatatgaataaaaaaataaaaaaactgaatcgaaatgattcagttttttcttaatatatttacaactgcagttgtttcgtcattttctttatagacacgcggaattcttctatctagcatacatgtaacttcatagtttattgtacctaacatatccgctatttcttctactgcgatattttcttcaccttgtttaccgtagaatactacttcgtctcctacttgtactggcatcgcttttgaaacatccaacattaactgatccatacaaacacggccaataacaggtactcgaaccccattaattaacgcatagcctttattagataattgacgattataaccatcagcataaccaattggtacagtcgcaatccattcttcaccagttgttacatacgtattcccataacttacaccacgattcttcttcgcatgtttaatatgagctacttttgattttaacgacaacgcaggctgtaaagaaacgactgaatgatccacttcttttgatggatacataccgtacactcctattccaacgcgtaccatattttgaaatgtgttacttaattccattgatcccgcactatttgaactatgaatatatggtatttgaattcctaattctttcgctgtattaacagctttttcaaataaacttgtttgcatattcgtatatgatttatcgatttcatctgccgtagagtaatgcgtaaacatccctactacctctacatactccatacggtttaattcttctaaaaatggtttaacttcttcttcttgtaaaccgatacgactcattcctgtatcaattttcacttgaatttgtactttcttttgaagacggtttgcaatttcatttataccatgtaaatcttctactctataaacagtcatcataacgtcatattgaattacatcttctacagccgctactggtgtgtatcctaaaattaaaattggtacagtaattcctgcttctcttaattctattgcttcatctacaaatgcaactgcaagttgatgtattcccgcttcaattgcagctttggcaacttcaactgccccatggccatacccattcgcttttacagcagccatcatcttaatttcttcatcatttacatgttttttaaattcttttacattatgttttacagcatttaagtcaatttctacaattgtatctcttc

SEQ ID NO: 922 - DNA, 2229 bp, Bacillus thuringiensis
acgagaaattcccttctaattgggagttatcttcagcacgagcggcaaatatgattcaccatttaattgaagtgtataatgtggacgataaaaggctagctgcggtaggatatgcagacacaaagccaattgtaccaaatgattcaccgcagaactgggaaaaaaaccgtcgcgttgttatttatataaaagagtagtatattattattttaataataaaataataaaaacacgaaaattcttttaaaaaaatattaaattttatcattttattttgtataatgagtgagaatgataaggtgaaatattaagatatatttatacatagaaggagagaattaaaaagaatggcacataaaattttagtagtagacgatgcgatgtttatgcgaacgatgattaaaaacttattaaaaagtaatgctgaatttgaagttattggcgaagcagagaatggggtagaagcaattcaaaagtataaagaacttcaacctgatattgtaacattagatattactatgccagaaatggacgggcttgaagcattaaaagaaattattaaaattgattcaagtgcaaaggttgttatttgttctgcaatgggacaacaaggtatggtattagatgcaattaagggcggggcaaaagactttattgtaaagccattccaagcggatcgtgtaattgaagctttaacaaaagtagcaaatagttaatatagaaggggtgccacaaggaatcaaaacagtgatagcggatcgacgtgtggcccccttttttctcattgtaaaacactaaattgttatacataaatgaaatgtttgttagacaggtaggggataaaaatgcaaacagatctattaaatatatttttcgaagagtcagaagaacatttacagtcgctaaatgaaaatgtgctagtgttagaacaaaatcctgctgatatggatgttgtaggagaaatattccgatccgctcatacattcaaaggtatgtctgcgagcatggaatttacggaaatggctgatttaacgcataagatggaaaatgtgttagatgaaattcgtcatggaaatatagttgtaaatgcggatattattgatgtgatttttgagtgcattgataatttggagaagatggttgcagatgtgcaacaaggtggaatgggcaatattgatgtagcctcaactaaacagaaattagaagcattattgaacggcaatgtagaaactcctacggaacatatagagcaaaatcatatagacacggatgatgcagtttcgcatgaagtgcatataacagttgaacagcaagcaattttaaaagcggtacgtgctattatgtgtattgaagcattgcaaaatgtagggaatatacaaaaaacagctccgagtattgaagaaattgaagcagatgctttcggatttgaatttacagtatttatggatactgattgtagtatagaagaattgaaacaagtagtacttcatgtttctgaaattgagaaagtggaagtaaagcaaggagaacctatatcgaaggaagtagcttctaaaaaagtcgttacacaagaagttgtgcaagtagaaggaaagctacaaccagctgtggctacgcaggtagaatcaccaatagagccaacgaatcaaccttcaagtgctatgccagctaaaagtactacaaaaacgaaaaatgctaaagtggagaatcgttcaattcgtgttcaattagagaaaatcgaaagattaatgaatatgtttgaagaaagtgtaattgaacgtgggcgcattgatgaattggctcaaacgattcaaaacaaggagctaattgaacatttaaatcgattaggcgatatttcaaaagatattcaaaatgtactattaaatatgcgtatggtgccgattgaaactgtgttcaatcgtttcccgcgtatggtacgtatgttagcgaaagatttagggaaaaaaatcgatttacaaattacaggtgaagatactgaagtagataaaattgttattgatgaaatcggtgatccgctcgttcatttaattcgaaatgcaatcgatcacggtgttgaaactgttgaaaaacgacgtgatgcaggtaaaaatgagacaggtacgattaaattagaagcctttcatagtggaaatcatgtcgttattcaaattacggatgatggaaaccgcattaattaaggggaaagtattagaaaaagcgatttaaaat

SEQ ID NO: 923 - DNA, 3987 bp, Bacillus thuringiensis
ccttggaaggaaactgaaaggggacaacagcatgccaagaaagccgtaagttggctaaacatcaagtcaagactgagcggccagatataaagtatagataaggatgaaggctaaaccgcttgaatgatagcacaagggaggccaccgtaactagtctcgaaagatgtttataaacgagattcaacagatatcataaagatagtgagagtcatcttatatgaataggggcatctgttgcccagttctatatggaagaaaagtgtgaacgtcacatccgacactatacgtgcaaattccttgattactaaacggggattgtctaagttagaatgcctgcgaggctattgaggataacttcaagatgtaacagtcaagaagtatggctcatgaatatctaatatgacaacggagccttcgtagtagtcagagctagggaaagcctagtacagggcgaaggaaggcagtctgttagcttattaccaaattggggaggtgcgaaaggcactatgcaatgtccaaaaatagtactaagcaatctgcgaacgaagagtcttaataaggaatatcaatatacaagactttatcgtaatttatataacccagatttctttttattagcatacgataatctaagtaaaaatgatggcgcattaacgataggagtagaccaaaggtctattgatggtttttctatgaaggaagtggaggacttgataagtgttttaaaaagtaaaagctatcaaccatatccatctagaagaacctatattgaaaagaaaaatggcaagaaaaggccattaggaattcctagtttttatgataaattagtccaagaagttatacgtatgatactagaagcaatatacgattcaagcttttctagttcatcacatggataccgaaaaggaaagggatgccatagcacgttattagagataaagcgcacatttacaggtagtaaatggtttatcgaaggagatattaaaggatttttcgacaatattgaacatcatactctagttacaattcttaaaagaagaataaaggatgaggcgtttatagagttgatctggaaattcttacgagctggatatttagaagaatggaaatttcataatacctatagtggagcgcctcaaggtggaatcattagtccaatactttctaatatttatctaaatgaattagatgtttatatgaaaaagtatcaggatagatttgaatcagggaaaaagcgacaaattaataaagagtatagtaatttacagtataaagtacgaaagattcaagagaaaatcgatactgcctatctaaatggagaagtaacacgaattacggaactaaaagaacaacaaaaagttttgaaagggaagttgttacaaacaccttataataatccaatggatgaaaattatagaaggctcaaatatgtaagatatgcggatgactttcttattggagtaataggttctaaagaggatgcaattcttattaaaaatgagatagcttcatttttgaaagaagagctaaaattagaattatctatggaaaagactctgataacaaatgccttcaagaaacacgctaaatttctaggatttgaaattaaagtgtttaaaagtgaagcaacacgcattaacagtcttgggagagcttctagggttcttaacggtaaaattcaattaaaaatgccacatgaggcatggataaagaaacttcaaaagtatcaggccattaaaatgtgtgccgatggcacttggaaacctcagccaagaggatatttccaacacaatgaagatttagagattatcacgcaatataatagcgaaattcgagggttatacaattactatcgactagctgaaaatgtgagcaatcacatgcaccgctttgcatatttcatgtattattcaatgttgaaaacttttgcgtcaaaatacagaacacgtacgaaacaaattcgaaagaaatacgaaaagtacggacaatttactgtacagtatgagacaaagaaaggaatgaataaagttcatttcattgaaagaaagtttccaatgacaagaaatttatcactagaaggaacagacattttaccaaatactcggcatgtaatgagtacgactaaattgtcagatagaatcaaggcggaaacatgtgaactatgcggagctagcaatgttgtgatacatatgcatcacattaagaaattaaagaatctacgagcaaagtcaaataaatcatatcttgaaaaacaaatgatagcgagaaatcgaaagactatcgcactctgtaaagagtgtcatatgaaaagacacaagggcgagatataaaatgcagaagacagatggagagccggatacattgagagatgtaagtccggttcggggaggaacatttggaaacctatcacaggaatgtaataaggcgctggatgtttactctacacatatgccacaaaggtaaatgaaaaaacaaaacttattgaaaaacttcttcgaaatgtacatagttcttctaaataagttgcagaatgaaatataatgatacccagttattaataatagtatctaagaaaaaaactacttcctttcttaattcatatgatttttaaaaataaatcctatagatgttaatatttgttatataatatatttgtcaaagcattacccctaaaatttctacagtcaatctgtaagatagtttgtttggcccgtatattcaccttaaactaaaaagaacttgtagagattcctacaagttctttttagtttaaggattaaatgaggatttaaaatatagttgcaattttttgagggggaaaagtaaatgtttataaaaacagaaagattattaatacgaaaatttgagttcaaagattggcaagctgttcatgagtatacatcagatatcaatgttatgaaatacatacctgaaggtttttttactgaagaagatacaaaaaactttgtaaatgaaaatattggtgaaaacgctaagaactttcctgtagtattaattgataaagatattttgattggtcatatagtttttcataaatactttggtgagcatacttatgagattggttgggtgttcaaccctgaatatttcaataaaggatatgcttctgaagcagcacaagctacattggaatatgggtttaaggaattgaagttacatagaattatagctacatgtcagccacagaatataccatcatatcgagtgatggagaagattggaatgagaagagaaggctatttcaggaagtgtataccacatgggaatgaatggtgggacgaatattattacgctattttagaagaggagtaaagcctcataacgcattattaaaagaaaatgttcctcctgaagttgtaaaagcggtagctagaatatgaatggaaacaatttgatggaaacggtcagccaatcatagcgtaagacgatggaattggcattatgtaaattactattgttgttgatattgtcttaattgaaaaaataagttctgttattacttgacaagctcaaaaatggtagatatgctttaacacgaaacgaacaaagaatttgagatatctatgacctgttaggtgaggctcctatacaaacacaggctattgcccttaaatatcgaacgatgccaatgggtagaacaggaattgtcggattaaggctcttcttaagatagctaagtgatgaatgattcatcctttacggttgtatagtgccaaaactcaactagggggaatgagctttatttagctatgtcttttttagcaacctcctttagttgaattactaagggaggttttttatatgcaaaattttattcgtaataaatcttttataaaaggggggaagactaatgattgatgatattgatcccatatttatgaagaaattagttttcctagaagcgggaaaatgataccaagtaccactgttcttaaggaggaactcccatgaacgaatgctcacaac

SEQ ID NO: 924 - DNA, 1420 bp, Bacillus thuringiensis
gctgacgtggtaataatttactgcctggattaataaataaaacgccctcgattaattcagcacctaatacgtgagaatgtccaaagcatgcaacttgcgctcccacttcttcagcatggtacgctagcgtttgtaatgtcattttcacattatggcgatgtccatgcacaactaagaagcgaattccatctacatcagttacaatttcatcttgaaagttagcataatcacagtttccttttacaacacggaaaccttgcagttcttcatgagcaggcgttagctctgaatcaccgcaatgaatcatgatatctactttcccttcatatttctctttcaactgctgtaattccttcacagagctatgactatcacttacgattaaagctttcatcattctctctcccttattctcctaaaaaccattccgggattttttcttctaatttacgaagagcacggccacgatggctaatagcatttttctcatctgaacttagttccgccatcgcttttttatattcttccacataaaaaatcggatcatatccaaagccgttttccccgcggcgttgttctaaaataaatccttcacatgtcccgtttacaatgacaggctttttatcaccttcagggaaagcaactgctaatgcacaatagaaacgagctttacgcttttcaaacgctacttcatttaattcttgtaacactttatcaatattcgcttgatcatctttcggctctccagcaaaacgagctgaatacacgcctggtttcccgtttaacgcatctacaataagacctgaatcatccgcaattacaattgcattcaactgtctactcaaactatccgcttttaagatcgcattttcttcaaatgtttcaccagtttcttcgacttcttcaatatgaggaaaatcgtgtaatgatttcacttctaaatcaaatcgctcaaataactcagcaaattcacgtactttccccatattttttgtcgctacaacaacttgtttcattttttccacctctactctatatgagatacgatgtcacctaacgcttctttttgcatatcaatcagttggaaaatgccttgttctgctgcatcaagtagttcatttaactgcgctctactaaacgtcgcttcttctccagttccttgcacttcaacaaactggccttttccagtcataatcacgttcatatcaacgtctgctttagaatcttctgcataggttaaatctaaaacaacaccttgttcttcaacaatccctactgacgttgctgctaaataatcttttactggaattttagataccttttctacttgtaataacttcttaaacgctaataccatggctacatatgcacctgtaatagaagctggtctcgttcaccatccgcttgaatacatcacaat

SEQ ID NO: 925 - DNA, 2724 bp, Bacillus thuringiensis
ctgccgccatatgcttacaaagattctcatatggacatttgcagctactttctgaaaaatcttcgagatcgataactacttcataatttcctgcatttccagtaacgaaagcaaacacttttttatcatgtatttcaacatcttctacatgtccatcttcataatattcatatcccttatctacaatgtactttgggatccatttcgttatatcttttaataagtaagcgtacataattgtaccccttcctttaattcccttttgacttcaaaaatcctgtatgttattctaataactgtcaaatagcaagtctatatgacaaaacgactgacacctattcggcgaaggtgtctcttttcatttgcagccgatatgaattgcctctttcaggcacattcaatttttgacactacacactcaacaccattccctgtatcaggctgctttagcagtcttttactctacatactccgttattttaagaaaaaaagagagcttagctcccttttctcgccttatacaatacccctttttcagcatagagatattcatcagctaatgtaattttcccatccagttttagttcgtctaataatcttgataaataaaattgatgcaacatctttttcgtgaattttccttcatgatgcgaaacgatatgttcttgaatatctaacaatgatatcggcttatcttgctctatcatatattcataaactgtactacgcagttttacgtatttttcgagtgtcacagtaatgcgcaacccctttcttcttaatataaattttcgtaatcggtttttttgcaataaaaaaacctctccgataagaagaagttacgtatatatcttcgtcttatctcccagaacaaatatgttctgctggaattagcacctgcatcgcggttgctgggtttcatcgggccagtccctccacctctctggataagaaaatattcacttaattcttactatacgtaattccactttaattgtcaaataaatataacaaattatattttcttccttactgttcatactacccatatacgaacacgcaaggaggattatgaaatgcatcaaaatgctcgcggatatgtacaagattcttttcaatcattacaagaagctaaaaattgtttagaagaagcgctcgaaacagttgaaaaagattttaatcgcgctcgtattgaacaatcactttatgctgttgaacaagctattcaacgttgcgagtacaccgttcacattttagaaaaagattaaaaacttcccatcaattgatgggaagttttttcaaatggcatacttcataattattgccgttataattaaaaaatatacagaattagcaatttctaaaattcctacttttataatagaaatttttttgccatacaacacaattgctcgaatggcacttggtataaaaataagagaacaccagggattaatcacaaatatgattatcgttaatacgatatgatatccccaagatataagacgatacttcgggttatttttttcacgaatcatcgttttcacatagaacgtactacctaaaaagtataaaaatgaaataagtgcaatgaatatagctgtatgaccgatttgcttcattgaaaagtaataactaattaatccaccgatacaaaacacaataatcgcacaaatatcatttaatagtgctctttcatttttttgacgagcgtaatacatattcactataaataatggaatcattactattacgaataaaagaattcgccactcatataataaagaaatcatcccaaataggaacgcaatactgaaataaacaatggcagcttgtaaaaactctttttttcgtctttgctttatgtacgtaagaaatggatacgtggctaaatagataaaaaaccacgctaaaaacaatggaatatgataaatagtaggtttcccaagtatgacacttaataaaaaaggaataacaagcatagcccatgcaccatgttgcttcggaataactaacttcattaactatacacctcccttttgaaaaaagttctcacctaccattatacaaataattttatataataacggatgtatattaaatcgattttttgacaaaaaaatgctccttacagtatgtaagaagcatgaaagaggcaaacgaatatgtaagtcgcgaccctaccttatatgagtatgcttttctatgtcacgttatgctcatctaatataccgtatttctttttaaatcttgtaagaatcgtaatccatgaagtactaaatagtaataagaaaataacattcgaaatcgcatggctcaaatcaaagtaaaaacttgcgatataatacgaaatgacagtttcccatgttgcttctcgtataaaaccgagaagaccccagaaattcataatccagccaaataaaaagccaacaattactccgtaaagaagtcttccccatagctttttcataaaaaatgtattacgaagtaaacctgctataaaaccaatcatgccccatgaaaacatttgccacggtgtccatggaccttgtcctaaaaaaatattagatacgattgctgctgtagcaccaatcataaaaccagtttcactaccaaatacaattgcagaaacgataatgacaaaagaagttggttgtacacttggtaaaatagaaaatggcacccggcttactgctgcaattgccgctaatacagcaacgagaa

SEQ ID NO: 926 - DNA, 3544 bp, Bacillus thuringiensis
  unsure (1)...(3544): unsure at all n locations
tagtccccattagttttaaaaattttaatgaaggtcacgcccaacgccattaaggagcattttaaatggatttaacgcgtcaataagtataaaaaagcgggacaataatattaaattaggtgcccttcgaaaaattaaaaccttgtatttatggctattgggttaatccatcgatatgttattctgaaacgtcaatccacttttaacaggagctccctttatcaagagagctcctgttcttatttcttcttcttttctgtcggttggctttgtttagcaaaattagatgaatcatcaaaattcggttgctttttaccagcattattacttctaccttttcccatatgtaatgcacctcccctcccccttactattcccaataaaaaaattctcttgcatccaagagaattttaaattgggttcttattgatactacctaagtacttccaacactgccatttcataaaagatggatccaatgttaaattatttaatgctaaaacaaatattacattttcatatttaactggataatcaattaataatcctaatgtatttcctgaagctgcaacaattatgattcccttttctaacacgtcatctataacttcttttaattattcttacctagcatataatatttttctacacattgagattgcttgttgtataaggaagcttttcttttttccatgcaagaaatcctccctttaaattcactacttcctttataccagctctttgtaaaatactagctgctatagcggaacgtaatccggttcgacattgcaaaactattggaaaatctttcggtatataatctagttgttcaaatagattacctaaagtgatatgtattgcatcatgaaggtgtccttcctcccactcttttttactacgcacatcgataaccttaacgcttccaccttttatatgcggatataattcaatcgatgttttttctttgtaactttcaatctnatcaagtctttgtattacttttaagggtgcaaaagcaataatattatctaacccaatagattcaaattctctaataactgcctctactttaaccttttcctcatctagaattattaaagtttcttttttataatctaataaccatccacaccaagttgtgaaagaattgttataaggtatgttaattgacttctcgatatgacctgcagcaaaactctctacatcccttatatcaactatttgatgaacgctcttcaaaatttcttgaagttcttctactgtattaatagcagtactttttctcttcttacgaattggcggaccatacttatttaaattcttcattaatgaaaaatactttggaggctctggctgtcccgtcaataaagtcgatataaaatcactttcttcattacactgaaatgcccaattgaacatcttttcataacctaatgtagaagttggaattgctcctaatgcttttccacatgcgcttcccgcaccatgtgatggccatatttgcaaataatcaggaagtatttttattttttgtatagaattaaataattgtttcgctcctatttttgcagtatccttaataccgactgcagtttctaataaatccggccttcctatatctcctacaaatataaaatcacctgtgaatatccctatcggcttatcattcgtataattattttgacttgtatcagttattaaaaaagaaatactttcaggcgtatgccctggggtgtgaattacattaaattttatatgacctactttaaactccgtgccctctctaaccaatttgtatcgaccttcgttaagatattgatatttccaatcacaatccccttcatcagatacatataaatttgcatggtaaagagtagaaagttctctagacccagaaagaaaatcagcatgaatatgtgtctcagccgcagcaattacttccatcccctctttcttagcaaattctatatattggtctatatagcgactaggatcaataacgattgctacgccttctttctgacaaccgactaaataggaagcatgtgctaatttttcatcataaaaatattttaaaagcatatctattccctccaattaggtatttcaaattgattttcaatttttggaaccattttttatcttctcctatagaatccctttcaacattaaattccaatacatatatggcaacatatatcttttaagtaaaaacatactatacctttctttcgcttgattaaatggaaacgtttcttgtggctcatgttcatagttaaattcagcgagtataagacttttatatcctgtaacaatcggacatgatgtatatccatcatatttagcctgtaaatctcttccgctaagtacgtccataatattttgttttaagacgggtatttgttttcgaattgctgctccagttttagaggtaggtaaattggtacaatctccaagtccaaaaatatttttatattgcacatgctgcaaagtataagggcttatatctacccatccctgatgatcacttatctcactctctttaataaaattaggtggccccattggtggaacaacatgtatcatactatatggtacggtttctctttttagtgtttgcgtatcttcaaaaattgcctctctcttttcggcgataatttccactaaatttttattataattcggtataatttgctttctttctagtacttgccctaaagtattcgcatatcgtggaacctgaaatatgctattgtttgcagaataaaacattacttcacttctgtttcttacaccactattacaaaaatactcctctgctaagtacataattttttgtggagcaccaccgcatttaataggagtattagggtgggtaaaaagcgcatttcctcctttgaatttttcgatttctctccaagtagaatcaacatatgtataagaataattgctacataccccattagtgccaatagactcttttaaacctttaatactgtcccaatttatttgtataccagctgctacaataagaatttcatattcaagtaacagtccgtcatctaaaagtatcttattttcagatggaaataacttaacaacacttttagggatccacgttgccccttttggaataagcgattcctgattacgcatcgtactttcctttgaaacaattcctccccccactaaactccatagtggctgaaggtaatgtttttttgatggatcaataattgctatactttctttaaataggggtacatttcgtaataaatgtgcagtagaagatagtcctgctgtcccagcaccaattacaataattttataactatctctggtcttcattatcctcttcctatctaaaattgatttttaaattaactaattagtagccattttttcatcgtagtaacattattataagttaaaaacaccatagttttatctgatttaaatgaaaattttgttaattttaccatcaacattactatatgcgtaaatcccttatgttacttccatattttagttttaatattaaaac

SEQ ID NO: 927 - DNA, 2428 bp, Bacillus thuringiensis
tttgtatcactgatttactctatatattctaagaaattttgttcaaatccgttttggatatgtattacaatagcaattggtagttttttattaggaaaaatagtatatacatatcaagatagcttcttcgaaattccaatacatcgttttacggtttctgatgtattttacatgttttttctatttttctgtcttatcgctttctgctataaaatcttaaaggaatgcaataaatgggaaaaagcgttctttatttgtgatatatgcatagtgcttacttccatattcacattagaatggtatttatttaatcaaccaaatttaaatatattcgctctttcactaggagatgttttcctttcatttttatacccaattgcagatttattatttctactgctaggtgttagtctctttttccgtccaacaatttttaattccaaacggaaaatttatatctttatttttgtattaataagttctgcaacttttaactatatttatttttacttaaataaccacttatcaactgaaactataatattattacgtcttttatatagaatacctatattacttattgcaatagctggctctatttcagaagatcataatacccataaaaattatttccttgtaaaccctataataggaaaaaaagctttagttgtatttccctatcttgctgttgcaatactaatcgggtttacattaaaagaacaaacatcatcttcaactctcattacaggaaattgtattacttttattttcgtactcattcgtcattctatcgtacgtatgcaaaacaattccttaacaaaacgtttgcaggcatttaatgcccaactagaagaaaaagttactttacggacgtctgatttagttcataaatcagaggctctttctcaaaaacagcaaaagtttaaatcattatatgaatatcatcctgaccctatcttcaccattgatttaaatggaatattcttaaatgtaaataaggctgggagtgtactacttggagcaccaacggatgagttactaggtgaaacttgtttttcgatcattttagatgaagataagcataagctagcattggcattagaaaaagtgaaacaacaagaatcggcattcttacaacttagttctcaatataaagatggctttacttattttttatacgttacaatcattcctattataatagacggacaaatttcaggaagctatattatggtgaaagatattactgcactaaaaaaacagcaagaagaaataaaatatttagcattccatgacactgtaacgaaaattgggaaccgtgcctttttccataagaaattaaagagagttataaaaaatgctaaaatagcagaaagcgagtttgcattattatatttagatttagatcgctttaaagcaattaacgatacacttggacattcatcaggagattacatattagaagaagtagcaaagcgattccaatcatgtcttccatcacatactcatctttcaagaatcggtggcgatgaatttacaatcataattgaaaactatactgacgaagattacttattccaattatgtaaccaattatttgaatgcatgaaaaagtcatttatcatacatgagcataaattaactttatcactgagtatcggcatcgctatttatccacattccggaatcgataccgctacacttctgaaaaacgctaatgttgcaatgtatgatgcaaaagcaaaagagcttaactctgtctctatttatgacgatgtaatcgctaaaaaaattgaaagacgattacgattagaaaaagatttaccaaacgcactacaaaatgaagaattgttccttttgtatcaacctcaagttgatagtgaatctaataaaattatcggtgcagaagctttaattaggtggaatcatcctgaattaggtattatttctccatacgagtttattccgattgcagaagaaacactacaaattatttcaataggaaaatggacattagagcaggcttgcaagcaaatgaaacgttggcacgcactcggatattcacatttaaaaataggtgtaaatttatctgctaaagaatttgaacaagaggattttgtaaagtctatttcttctactttaacaaatacaggtttaccagcaagctctcttgatcttgaattaacagagcgaattgcaatgatggatgagcgagaaacattgataaaactgcgtacactaaaaagtttagggattcacatttctatcgacgattttggtacaggttattcttcgctagcctacttacctttgtatccaattgatacgttaaaaatcccgagagaatttattacaatgtctgaaacatgtgatgatggaatggaaattattaaaacgatcatcacattagcaaatacattaggaatgt

SEQ ID NO: 928 - DNA, 2487 bp, Bacillus thuringiensis
ggaagaaaatatagtcgttttttatttggaagaagaataaataaaatgatactacaaatgtaaaaaggcattccataaaggaaggccttttattgttcttgccctgattttttcttctcacgttttttacattctggacattttgatttacgaaacggtttggcaaagaatagcagaatgaaaaataaaccgaatataatactagctgagtttttcacgataatgacgctactatttttcatttgaatcgatggttgaatctctttttcttccatagtggccctccatatattggatttacattttaattatagcaaagttagttgttgtaatgatgtgaaatgaggaatggataataaatatttataggtagtataaatgctgtttttataactttaaaattaattaatttctatattgtgattttattgtttaacaaatgtttgataaatgataaaaaattgtaaaaaagcggaacttgtaagctatttccttttcatagatgctaaaattatatatgcagctgctaatataaatggaaaaaaggagataatggagtatggaaagtaaagtggaacgctatgtcgaaaattatgttgtaacgaaaaatacgatggccttacttcctgttattctaagtgaaaagaaaattgttacgcgagtcgttgaaatgaatgattcttttttcgtatttcaaaaacctctagatattatagaaagaagttgccgcaagcatggctctagtttcttaggcagaaaagaaggaacgaaagagttaactcatattacacataaagcaccgattgcgattagtccagcagatcaactttattttttccctacctattcttactctagaaaagagtgcgcttggttgtctcatttttatattgaaagtaataaagaattagaagatggaaatcttattattagatttataaatggctttgctgtgaaattagaaatatcaaaaactagttttgaaaatcaacaaaatcgtacagcgaaattacgtactgaatatgaagatcgtaggaaaaaacaagggaatccttgttttaaagaggtcgataaaaaagaggaatcaacattaagacccgcttatgagaaggtgtattttgtgaaggaaggcgaagtgtgaaaggatgggggaatccccattcttttttgtttgtcagtcagtctttgtagataaggcgatatattagaaaaaacgagttgtaattgatatatttagaaaatcaccagtataatttcatttaccgataaaaaccgaaaaacaatctaaataacaaaatgaacgacacgtcctgtcgaatattgatagattatcatagctaaataatgaaggaattcttatgaaagatatggaaactttaataaatacatctccgtatgtcgtatctaccatttcctctttcatataagcaatgatacagtagggatagtatttagagtaaaggggtaaagtgtagaatggattttcagacaatcaaagagtatttttcaccagaaaatatggatcatattgttgagagttataaagcgttcggaccacttcttggtattggtttaccgatgatagaggcgttgattccagcattaccgcttattgtatttgtactggcgaatgctgttgcatttggcttttggctcggttttctttattcatggcttggatcagtaatgggtgcattacttgtctttttcatcatccgccattttggtcgcagtcgtttcttttcgtttgtaaataagcatgagagagtacgaaaagcaatggggtgggttgaaaggaaaggattcgcaccgatttttgttatattttgttttccgtttacaccgtcagcgctcataaatgttgtcgctggtttatcccgaattagtgtaaaacagtttggtctagcgttagcattcggaaaacttgtgatgatttttattttaacgtatatcggtcatgatttaatgtcatttattcataatccagtgaaatcagttattgtagcgattggtatttttattttatggtatgtcggtaagaaaatcgaagtaaagttagaactacattaagaatagtcttctttgtaaaggaaagcttcagtattaaaggataaggggagaagcagatgaagaaaactttgaaaaaagaaggcatagagtggatacgaacaattttaattggtgtattattagctgtattttttcgaacgtttttcttttcaacgtatgttgtagaggggaagtcaatgatgccgacattgcaagatgggcatatatgcctaggttgtaaataaaggtgagtatcaaggttggggacttgaacagatttgacgttgtggttattgtcatccgcgataaataaagaaggaacttatggtattacgtgcggtctatctggttgaacctggaagatcatatgtggatattagcaggataagttatatatcagcggtcagtttattggtgagccgtatttcgcgtatgtat

SEQ ID NO: 929 - DNA, 3146 bp, Bacillus thuringiensis
ggaaccacggaggtgggtatattcagccctatattgagggatgaatatgcttttttgcattcaatttcataataagcgaagaaaaggacacgagttattttacccggttatacagagaaggaaggaaagctgagaacttcctaacgcagaaaaataacttaccaccttagagctgcactggggaaattaagtatctagtgccgtataaacgacgttaccgtaaaagaagccattgtttgtttacaatgggaatctgggtggaaccacgggtaaaagcacgctcgtccctattttagggatgagtgtgctttttattatgaaatggagagatgaaaaatgaaagaacaaatgattgaaattaaatttccagatggtagcgttaaagaatttgtaaatggagttactttagaagaaattgctggatccattagcagtagtttgaaaaagaaagcagttgcggggaaagtaaatgatggattatatgatttacgccgaaatattgaagaaaatgcggaagtggaaatcattactatagattcaaatgaaggggtagaaattgcaagacactccgcggcacatattttagcgcaagctgtaaaaagattgtatggtgatataaatcttggagtaggacctgttattgaaaatggattttattatgatatggatcttccaagtagtgtaaacatagaagatttacgaaaaatcgaaaaagaaatgaaaaagatcataaatgaaaatataaagatagaacgagttgaggtttctcgagaagaagcagctaaactgtttcaagaaatgaacgaccgcttgaaattagaacttttagaagcaattcctagtggggaaagtgtaacactatataaacaaggtgaatttgtagatttatgtagaggaccacatttaccatctacaggttatttgaaagcatttcaattaactcacgtttccggtgcatattggcgaggtgatagtaataaccaagtgcttcagcgcatatatggtgttgcattctcttctcaaaaagaattagaagagtatttacatttcgttgaagaagcagcaaaaagaaatcatcgtaagttaggcagtgagcttgagttatttatgttttctgaagaggctccgggaatgccgttttatttaccgaaaggacaaatgattcgtaacgaattggaagcatttttaagagaaattcaaaaagagtataagtatcaagaagtacgcactccgttcatgatgaaccaagaagtatgggagagatcagggcactggggacattataaagataatatgtatttctctgaagtagataataaaagttttgcattaaaaccgatgaactgcccagggcacatgcttatgtttaaaaataaattgcattcttatcgtgaattaccgattcgtatgtgtgaatttggtcaagtacatcgtcatgaatttagcggtgcgttaaacggattattaagagtacgtactttctgccaagatgatgcacatttatttgtaactccaaaacaaattgaagatgaaattaaatcagtaatggcgcatattgattacgtatataaaacttttggattcgaatatgaagtagagctttctactcgtccagaagattcaatgggtgatgataaattatgggagcaagcagaagcggcattagaaaatgtattacaatcgctaaattataaatatagactaaatgaaggtgacggtgcattttacgggccgaaaattgattttcatattagagatgctttaaatagaagccaccagtgcggaacaatccagcttgatttccaaatgccagagaaatttgatttaaattatatagatgaaaataatgaaaagaaaagaccagttgttattcacagggcagttttagggtcattagatcgcttcttagcaatattaattgagcactttggaggtgcgttcccagcatgggtggcaccagttcaagtgaaagtaattccagtttcaaatgcagtacatgaacaatatgccaatgagattgcacataaattagcacaagctggagttcgtgttgaacaagatgcacgagatgaaaaattaggatataaaataagagaagcacaaatgcaaaaagtaccgtatgttcttgttattggtgataaggaaatggaaaacggagctgtaaatgtacgtaaatatggggaagagaagtcagaagttattgcgctagatgtatttgtggcaactattgaagaggaaataaagaatagaaaatattgattgtaaagaaaacacactattagcaattagtgtgttttcttttttatcttacaaaaatgtaaggtaaatgtaagcgaaatcgagggaacgagttgtagaaaaatgagaatatgaagtaggaaaaaggttcatgttacaggtgtaactcttcttgaatgaataattaaaaaattcttaagaattcacatgacaaaataataagaaatatgtgagaaattaattttatacaaaagggatggagtgaaagagatgtcaacaaatgtagttactgtagaaagtgtagaaaaaacgtatgggaaaagaaatgagaatcagtcaaaagcattaaggggtgtatcgttaagtattaaagaaggagaatttgtcgggatcatgggaccttctgggtctggaaaaacgactttacttaatgtgataagtacacttgaccaagcgacaggtggtagtgtgacgatagctggtacaaatattacttctatgaagggcaatgcattatctgattttcgctctcaaaaattaggtttcatttttcaagattttaatcttctagaaaacttatcaatttatgaaaatatagctttaccactttctttgcaaggcgtaccgtcaagtgagattactggaaaggtaaatgacgttgcgaagaaattaggcatcaccgaaattttaacaaaatatccgacggctgtttctggaggacaaaagcaaagaacagcggcggcaagagctttagtacataatccagcaattgtattagcagatgaaccgacaggtgcgcttgatagtaaaaacgcaaaaagtttattagaagcgatgcaagatttacatgaaaatcacaatgtcagtattttgatggttacacacgatgcatttagtgcaagttattg

SEQ ID NO: 930 - DNA, 2867 bp, Bacillus thuringiensis
tttttaatgtatttcctccccagtgtctgcattttatcgttttttgccgataacaacataatattcgttataatacgaatattcaatatttttcaacaaataaaatgttgagaaatatttttttatgcagggtgaaatacataagatataaaaacaaacagactctcctataaataacagtgaacttttatatgttcttagttacaatcaaaacccagtaaatctgggattcatgcttttttaataaaaataagaattaaatattttctatactatttaatctatggattaccatattactcactattctcattattacaagctaatagtggttcgtacatcattatagcgtgattctctgttacatattgatcttctattaactgtttctgttgattatatactttacgttgaatcacattatgtcgtatataaccgccccagtatgcaggttgaattgagtgttctttctcatacacttcatattgataaagttgcggatagactgttctccattcaccaactaaatgttcatctgtcatataaaggtgaagttgatacggttggtccgtttcatttttaatttgtaaatccaaatagttataggaacaagtcgccccactcccaaacggttgagtgcgcctagagtcaggaaagacatcaaagctatgacgatatcgttctgttactgtcagtggtgtatgtaaagtcatccaatatattaaattcgaaagctgacaaagacctcctccaatacctgtttgaaaagatccgtaatgtaataccataccttctacatacccttttttcctcgttggcttacctattaaacgccagtaagaaaatgtttctcccggtctaatgacgataccatttagttttttaacagcaattttcaaattaacaaccttattctgttgataccacatatctacatctttgagcttacgaagtaatatcgttcggtgctgaattgctgtacaaggtagcttttcttgttgaaacctttttgcatatgtttttccgtctgctaaccactgaatgtacctctttgtagagtaataccacttccctagcataatgcgatacttagaccgctgtttaggacgtaagtgcactatattcattttattccctctctctttcttcaactaaattctaatatatttctaattcaataaattacagttttcttagctgcataataatttccgcaaaaaaataataaatttactctagtggagattttattttgatgattgctttataattatataaaactgagcttcaatacaataaattgaaataaacatattataaatataacggataaccttaaataaaaaataatgaacattaaagaaattctaaagtattaatatatttttcgtaaatattaattgataacacattagactttactatatgtataacttcttattctacaaaacgaaattttttaatgtaagaaaaaaatataatttccctttaacatttatacaagtctcatatggaaaactttacaaaacaattcgaacacttatatttagaataaacacaaaaaattgccaccagttagcttaactggttggcaattttttaacgagaatgctttacaaatagttgaattgcttcttctggtacatagcactttccattactctctacaataatacttcttaattcataccctttaccattgatacgaattatatttttgttaccaaataattgtgcttctactttattatgttttactacgagtaacgggtttgctccttcggttttgttggctgttacagttgcaccgattttcttaaaggcttgttcactctctaaaaatattttattcgttacttcttctaagttaaagcccatcgctttcgccatcgtcttcgcaatgtctgtattttggattaagccttctggtttttgaggtccataagaatgtaagaatacatcctcacctgtatgtcctcctgtcgtaaagccgatatttgcacgattagccaataatgtagtaagaattcgtcctacatccattttcttttttgccacttttaatttttctttttcatcatgagttagattatccaaaccgtatagtttagctacatcttctacatttgataaatcagatttcagtttatttatagttccttcaagtgtcattttcgcctttttcaatggatcaatgtatgcagaaaccggtgtagtattgtatccttttttcgtattcctattccctatagagatgccgctgttaccatgatcagttaaagcgatgagcatcgtatccccatctttcttcgcaaattgtaacgcctttgctaccgcttcatcaaatgccaatacatcactaatcatcccaattggatcattagcatgagctgcccaatcaggcttactaccttctacgaataaaaagaagccatctttatcttttgataatgtttgaattgctttttctgtcatttgagaaagtgttggttgttctggatttgttgctatacgatccatatcaaacgcaagagcatgatgtgagaaagagccccaaattttattagatttggagttcaataacgcatctttcgtttcaacaaagtcgtatcctttgttttgaatcacctttactaaatcttcaccatcttttcggatcccattactttttataggtagcagtgccgcttttcccccacctaatacaacatctatattttgatacacttgttgcttcgcaattacgtcaaaatgtttgcgattgacatggtgagcggagaatcccgccggagtagcatgctgaatttcagatgtagcaacaatgccagttgcacgaccagtacgttttgcgccttctaatacgtttg

SEQ ID NO: 931 - DNA, 3094 bp, Bacillus thuringiensis
  unsure (1)...(3094): unsure at all n locations
aaataagtgaaatatctattccagggactcacggtacgatggctttacatggagcgagttttcttgatgaaaatttgacaagaaatcaaactatgagtttatcccaacaattaaattccggaattcgatatgtagatatgcgtgttaaacgtgtaaaagattcttttgcaatgtatcatggcgttgtaaatcaaaaagctgtgtttgaagatgtgttaaaagagaccattcaatttttaaaagatcatccaacagaaacaatattaatgcgcttaaaagaagaaactactcctgaaagtggatctctatcatttgaggagatatttttaaaatataaaaacgttaatgcttcatatttttgggatcctaattccgtaccaacttcagatagaaataaccctactttaggagatacccgcgggaaaattgtaatcttacaaaactttacatccgctcaattgtacgggattgattacgaaggtttgaatatacaagataaatttgaaattggaagcggaccagacgaaatatatacaaaatggattgcgataaaaaaccatctacaaaatacaaatactaattttaataatgaaaaaatttatctcaaccattttagtggtacgggaggcgcagccgcatttttaaataatgtatatccttggtttgttgcaagcggaaaagagagcagaaatactgacagtagtcctaaattgattcaaacgaattccactaatgcgtggagtgattttcctcgcgatagaaacggacaagtatactatggggggatgaatacacttgggaccgaactcttacaacaaggcgcaattaaacattctggtatcatcgcagctgattttcccggtccaggtttaattgatagtatcattaaattaaatggtatacattcaaatgaaaaagaaatattaatttcacaaatatcatctgaatctagtcctttatcagggcaacaaaatcgatccagccaaaactttaaaattgatagtttacctgtaggtaccaaagaattaaaatgggttattgagccttcagaaaaagattatccttctactatttctttcaatgtaatgattgatgtttccctaggaatagattctactcgttggaaaaatattttacatgaatctaggactgaagcttacacaaatactaaatattatattgcaagtccaattggtgccactagcaaattcacagtgaaaatatatgctattacaaattagaaaataaagaatccaaatggaattcctttttgatggaataccattcggattcttttttgattttaattcgttaacattaggatgatgattaaatttattaatataccatttaaaccattagataattcatgcttggaacgacccttactttttaaagagcaatccaaaattgttaactacctttttcagcttatcacttattcaaaactggcttccaaagcgataaagcaaaaatccaatttgagtcgccattcccttgatgattttgaaccgcttcgtacactttcccctcatgtactactctatcacctttagtatatgcttttcttgcatcccatttttcatatgcgggatcctctaactttgttgttacattcaaaacatcacttctactagattcatttccagctaaatcaaccgccgtcactacatatttatacgatgtattagccttcaaatctttatccataaaagatgtattagccgccgtcccaattttattcataaccccagcgctttctctatatacaatataatggtcaacacctacattatcttctgacggactccacattaaattaacagttgtcgctgttgtacccatactatgtaatccttttggctgagttggagcctctatatctgggattgtatgtgttgtcttaaccttcagtttttcactttcttttgatatgtttccagcagagtctaatgcctttattgtataagtatattccgtatctgcttttaattttttatcaataaaagttgtacctgataccgtatcaattacttctccattacgtaacacttgatattcttttacacctatattatcagtggaggccttccatgttatttcaacactattggcagaaactttagaggcatttaattcagttggttgacttggagctactgtatcaggagtttcattatttactaaatttacatcaactacattataaaaagcgtttgacgtatctgctacatcccatacagctaaaataacatgataaccattacgatcagttggtacattaattgtatgtgttaaattatttgatgcggccgaaccgtcatgtttcacagttccgattggttctaattcagcacgtgttaatggtttgttaggatcccatccttttttggtaatgtaataatgccatttacttgtagaatgtggcgctgtatatttccatgtaaatgtatttactccacctttaattgtgtttttgaaccaacgatttgatgtttgttggtcaagaatacctccaaacaatcctcctgccgaagcaatttccccatcaatcggtccactatctggaaatcctttaggtgcttctagactttgaggttcatacattacatttccacaatttaaatttaatgccccataattctgactacataaagcagcacgactactcggcttttcaacaaacccatgtgcatacgcactttgaggagtcattgtgattgccgtcatgcctgcagccaaaacacaagcaccaatcccctttttacttgttcttaatctttccaatttagatgttaatttcaatttcatttttgtccccccaatatattgctttcgctaatataatagcaatatagggataaacgaacaaatcgtcaattaatatattaatatctctcataaattggtacatttattattatttttaatctcctataaaaataaagtaaatacaattaaggaattttgtaacattatgtattaaaagaagaataaaaaccccattggagttcacggaaaattccaatattaacacaaaaaaatcctcatgtaggaaaaatntaagtttttatattaaaaaaaaaaaaaaagt

SEQ ID NO: 932 - DNA, 3925 bp, Bacillus thuringiensis
aagtacgttggggctctatatttaatttatattggtattaaagcccttttagcagtaagaaataaagaaggcattgatacgaacgatatatctttgaataatgaagatgaacacacctcttgctttcgacaagggtttcttacgaatttattaaaccctaaagttgcagtattctttttaacgtttttaccgcaatttttaaatccaaatcataatacgtttatccaactactcgtaatgggccttacttacctcgttttaacagccatttggttcgctttttatatatttttaattgataaaattagtgcttttatgaaaaaaccgaagacgcaacgttatattcaagggctaacaggagtcttcttaattggttttggtattaaacttgcttttgaaaaaagtaattaacaagatgaaaaccaccactattaatagtggtggttttcatttaataactaatttggctgtttattttatattaaaaccagcgctcagttacaacttttttacgtgtatagaattgaacgccatctgtgccatttgtacctaaatcaccaaagaatgacgctttatttcctgcaaatgcgaagaatgccattggtgctggaacatttacgtttacaccgatcataccagcatcgatattatcacggaacgtttgtgcatgtttaccgtttgatgtataaataactgcaccatttgcaaatttagattgatttgttagtttaataccttcttctaaatctttaactcgtacaatgcttaatactggagcaaaaatctcatcttgccaaattttcatttcttgattcacgccatcaaagattgtcgcacctacaaagtaaccttctccaacttcttcattaattttacggccatctactaataaagttgccccatctgctacaccgctattaatgtagcctaaaacgcgctctttatgagattcacggattaatggtccaacatagttctcttcgttaaagccatcgcctacttttaattttttcgtttctgctactaatacatcaatgaattcatcagcaatttcatccactactgctactactgagcatgccatgcagcgctctccactacttgcaaatgcagatccaattacaccttgtactgttttctcaagattgcaatctggcattacaatcgcatggtttttcgcacctgctaacgcttgtacacgttttccgtgtttcgtacctgtttcatatacgtaacgagctaccggctcagagccaacgaacgaaacagcctgaatatctttattttctaaaatgctattaacaacatcttttccgccttgtactaaatttaatacgccttttgggaaacttgcttcatagaataattctacaagtcgctccgctaaaagtggcgttctttcagatgtttttaatacgaatgtattaccgcaagcaattgcaagtgggaacatccataacggaatcatcatcgggaagttaaatggcgtaataccagcaacaactccgattgggtagcgccaaatcgatccatcaattccgctagcgatattcggaagtgcttgacccatcattaaatttggcgtagatgttgcaagttctaccgcttcaataccacgttgcacttcacctgttgcatccgttagcgtcttaccattttctagcgtaatgatttttgcaagctcatctttattttcttgtaatagctgtaaatatttatataaatttcttgaacgatttggaactggtactttagaccatgtttcgaatgctgcttttgccgcttcaacagctttttcaacatcttcttttggagatagtggaacgtaagcgataatttttccagtcgctggatttggaactgcttctacttccgtacctgtcgattcaacccactcaccgttaatgtgattttttactcgtttaatttcagttgtaatcattgtattctctcctttgtataatttatttttgattagaaattaatgctcgctaactttcttatataaagcagccatatcgttttcaccatatccagcttgactcgcttcgtcatatacgtttaataacatttcgcttaccggtaaaggagttcgctttccttagctaagtcaactgcaaatcctaaatcttttttcaataagttcacagtaaatcctggcttgtagttttcaggcgctataaaacttttataattacgttcataaattctactttgaccgtaacttacatttaaaatatcaaacattttatctaaatccatattgttctttttcgctaatgttaaagcttcactcacaccagctgtataaaaaccaattaataagttattaattaacttaacagttgtaccactatcaatctgctcactaacgtggaaaatgttcgcgcctagtacgcccatgatagattccgttttctcatatacctcttttgatccaccaaccataaacgttaatgtacggttttcggctccgattacaccaccgctcacaggtgctgctaaaaagtctactttcttttcctttgcagcttcctctaactgtttgtttaactgcggcgataccgtacttgtatcaatgaaaactacattcgagtgaccattttcaaataatccttctgctccaaaatataccgcttcaacagcgcgaggtgaaggtaaacttgtaaaaactacatcacatgtttctgctagttttgagattgatagaccgataattccgccttctttttcaaaggacgcttccgcctctttatttaagtccacgccatatactgtgtaacctgatttaactagattttttgacattggaaggcccatgttacctaaaccgataaaaccaatctttttcatatcgctttcctcctatttacacaatatatttcccgcgatttataatagctttcgcaatttctctcttcttcgtaaatacgttcgtgtataaaggcactaataattgacggatttcagctaaaatcacatgtctatcttgttcttttgtgacagctgctgaaagtacagaaatcgccgcttcttctactttacggtatccttcttcacaaataacatccgttatgagttgcttcgtacgttctttttcctctccatttttacgtactgcttttctcgtacgtaaaaacgctgattccatgatgtacacgtccgtcaacatatttgatattacacgtgaatattcttgttcttggtcaatttttagacctggagttttagagagcgttttcaaagattgtttcaacaattttttcgctaataaaatgtaacgatggtttctttctacatttgctacattactttctacttcagtgtcttctaattgttcgatttgcttcattaacattttagcaactgttaatctattaatttcgttcgttccttcaaaaatacgactaattcttgcatcacgatataatcgttctacctcatactcttgcatataaccgtaaccaccatgaatttgtacagcttcatctacgatataagcaagtgtttcagaagcatttactttattcagtgcacattcaattgcaaattgggacattttcttcataagatcttcatcgctctcatgaattgcttcatcgattacacctgctgtacgataagctgcactttcggctccatatgtagcaataatcatatttgcaattttctcttgaatcatcgtaaagtctactaattccgtttggaactgttttcgctcttttccatattgaaccgacaaaccaattgcttgttttgctgttccaatattttcaaaagcaagtttaagtctagcaaagttaagaatattaagggctacgtgatgccctttcccaacttcccctaaaacattttcagcagggatgacaacatcttttaaaataagagtcgctgttgaagaacctttaatccccattttttttct

SEQ ID NO: 933 - DNA, 2300 bp, Bacillus thuringiensis
gacttcccagatccaattacatatcttgatatgtttgtaacagatgggtcacaaaataagatgaagtactctaatccaaaatacgatgaaatcattatgaaggcgaaaaaagatggaagcgatgtaaatgctcgttggaagaacttattagaagcagaaaaaatgttacttgatgatgctgcgatcgttccagtatatcaacgtggtagagcatatttacaaagagattcaattaaaaatatgtataaccataaatatggcggcgatttaagctttaaatgggcgtcagtagagaaataagaaaaaaaagcaggtgatcacctgctttttttaatacgttcgtttcttataaatgccttttccgccaacttggttccagccagattgtacatccaaacttttgttaacaaacttcattttttcttttccaccaaagagcttttcgccgatgctatttgtaatgacaccaatcaatgctgttattccgatgatgagggcagcaaccgtaataaaatcaataaaaaaagcaatcatttgaaaactccccctttgcctgtctgtatgtttattgtatgagataaaaaatgaaaaagaaagaaatgtcagaaaaatatttaatttactttagaaatcatgtagacaggagggaggatatttgttaaaataagaacaaatgttcctttttattctcatttgtatagtcttacatttcttaattgatttatcaagaaaaagtaagaaaacgttctctttttcatagggaagattatagataaataactatatattatatgaaaaatctatgggaagtgagtagtaaaagggttgaaagttattgttaaagtacagctgaaatgagcgtaatcatgttacatagcagtgaaatacacgggagagttttctcaactagcaggaaatttactgtatatttcttgcaaaatctattgtataatgattatagaagttacttattaaaagtaattgttgtttattataagttgttgcttacatgaaatgtgatttttgtacttttcaataagacaagttatcacgaaaaattgctgaagttagaaattaaaactgtatttagtacagaatttgtactctttaaggagagtgagctttgtatggtaacattatatagttctccaagctgtacgtcttgtagaaaggcgaaattatggctagaggaaaatcatattccctatacagaacgtaatattttctcagatccattaacgattgaggaaattaaagagattttacgtatgacagaaagcggaacggatgagattatttctactcgttcgaaagttttccaagaattgaatgtaaacttagagtctttaccacttcaagatttatataagatgattcgtgactatccagggattttacgtcgtccaattatgattgacgagaaacgccttcaagttggttacaacgaagacgaaattcgtcgtttcttaccacgtacagtaagaacgttccaattacgtgaagcacaacgtcttgtaaattaattataataatatgaaaaccttctacctattatatagtagaaggttttttttaatgtttcacattgcgtaatcgaacttgttgtacaataaagccgatgcataaaatagtgaaaatgaacaaataaggaatgcttgcagtgaaacttggattgttatgaaaaaaggttgcaagtctgtcttcatgtgtaaccatttttcctgcagtataggcaagaattgctgcaccgcaataaatgaggaatggaaatcgctccataagtattaaaataagtttgctgccccaaataataatcgggatagaaatgagtaagccgattatgacgagtaaaaatctcccgtgagctgcacctgcaatggcaataacattatcaaaccccataacgagatccgcgaaaacaattgtccgcacagcttgaaataaagttgtttttccttgaatagaagaaagatcgttgctattatcggttaataaattgactgcaattaatgtaagtaaaaccccgccaatcaattgtagaaatggaatgtcgagtaaatagacagctagtatagtaaggacaattcttagtacaatcgctaaaagagtaccgatcaaaatagccttatttcgtttcgattcaggtaaatttcggctagctagtgcgatgacgattgcattgtcaccacctaatacaacatcgataccgacaatcattagtacggatgttaaaaactctaagtccattcgtctgcctccatttatgatgttttaataagcgaactatatgtatgtgatga

SEQ ID NO: 934 - DNA, 3401 bp, Bacillus thuringiensis
gtatgcatccagatgcaacttttatacagaagggatacgacccctcacacttctgaaattgctgctataacaggggtctactctggatataaatgtgcgataccaccatatactttaaccgcaggagggatagcaatcatattcgcaagtacagacccatataatgacgatcacatcgcaactgccatacctgtaccaattggcgaagtatcctgtgagatttggagcataatgataagaccgattaacgtaccaatcattccccaagctggagcaaaatcaccaattttatctaataatgctgctccttttcttaactcatacacttccgtttcaatatctttcaataacacttcttttaattcatcttcatcgtaaccgcttaacattaatcgaattcctttttgaataaaaggattgtctacttgctctccatctacctctaaaggaaggcaggccgttctttctagaatttttcgaaaaatcgacaaacaaatccgttaactgctctaaatcttcttctcttctatgtaaaacagtaaaaatgcttttcgtatatttttttatttctccaaatcgatatgccacaacaattgtcgctgttgttccccctatgacaattaaaatagatgaaatatctaaaaagtttttgaaagcttttattccaccgccaccaagcataattgccgctatcactataatgaaacctactataatgcccactgggctagaaatatcaaacttcctttttcttctttgtggtctagctaatacttgatttttctctcccatatttctgccctttcctttccatttttatataacatttttttattttaataatacgttttcacatataacatgtattatacgcttatcatctgtttatcgcaatatactcataaaattgacacatttcatttctatattagaattatggtatgaataaatgaggaggatcacgatggaacacaacattttacaagtcattgcattagcagaaaaactaaaatatgaaatgcgacatagctggctttccaacggacgtcaagaaagtgttgccgaacatacatggcggatgtctctaatggccattttagttgaaccttatttggatcaaaaagtaagtattgagaaattacttaaaatggttattattcacgacctagtcgaagccgaagctggtgatattcctgcttttgatacaatgaatagtcacgaattacagctacaaaaacaaaaaaatgaactggaggctattttaaatattaaacaaacgttaacaggttctctcggcgaggaattatatgacttatggatggagtttgaagcgaaagaaacgtacgaagcaaaagttgctaatgcactcgataaacttgaggtaaaaattcagcataacgaagctgatattgatacgtggctaccaattgaacataaaatgacgttccaagtagcaaagcatacaaactttgattctttcttatctaaattacaaaaaattattgaacaagatggagaaaagaagttaattgctgccggcattgatgttgaggcatgcaagcaataatgaaataagacactcaacaagagtgtcttatttcattattgttgatatagcctgcttataaataagctgttgttttccatccactaagattaaaactgtaaatttatccactccaacaacttctcctattattctaacgccactctttaagaaaattgtaactgtacctttttcttcttttatttgtttatacaattcttcctgtaaatgttccaattactgtcctctcctttctgtgaaacatcttaatattaaaaactataaattttttatttatgcactttggcttttatattcataaacttattaataaggtatatctaaatcacgactaaataacaaaactttatcatgatccaatccgtgtctcgcaacaagttgaattaactctttctttttgttttctattttattttttaattgtcccatctccatctctatactaaaactcccttttcccataatattacttgtaaaattatagtacatattctctcataaaaaaataagaaaatggttttttttacaattttttattttttatgcctaaattatgaattacgtaaaggtttatttacaaatcactaacatgcaatcctaatgaatctacaggcatttgtctaattataaatgagactggctcgttttctatacaaaaaacatactgtatatagtagtccatgaaccatatagattaacttactaaaaaggaggaaaacatatgagttatggtggaagttgcgctggtttcggcggtggatttgctttgcttatcgtactattcatccttctaatcatcatcggatgtagctgttggggtggcggcggatacggatattaatatatcctatccttgaaaaatgaactaaaaactatagaaaaacagctcaaatatgagctgtttttttcatactttcgtatgaatttatatccctcttatttgcgatttcaactagcaacatattgtttactatggaataagaaacatttttactaagggggattacaatgattagaggtctttacgaagcacatttacctgtccgcaacttaaaagtatcaatacctttttatgaatcactagggctaaaattatataaaagaggagataatattgctttcttttggattaaagaaaatgagagttggctcggcctttgggaaggcacagaatacaaagtgaattatcacccctctttacgacatatcgcctttcaagtaagtttacatgatttagaaaatgcgattcattggctaaatcaaaaaggaatttcagcacgaaaagactttggaatggaaccaattgaaccgattgtttttccggaattagcacatgcagccgtatactttaacgaccctgatggaaatagtttagaattgattgcacaattacctgttggacttcccacagcggaaaaagtgtatttaagtgagtggaaagaacaaattcaaacatcgtcattacataaggattaatctatttatgtcagtttcttattccacacttcttaaaacaaataaaaacttcaataaactattttatgggcaaacattaagtgtacttggggattggttccatacggtagctttattaacatttgtctacagcataacggaatcgccgtttatgatcgcacttacttttataagtaaaagtttaccacagcttcttcttagtccattcataggcggaattgtagatcgtttctctaaaaagaatattatgatttttaccgatattacacggggaattctagtccttacatacttactcgcaggctataaaattgagattattttcattgctaatatatgtttataagaactttcttgt

SEQ ID NO: 935 - DNA, 2443 bp, Bacillus thuringiensis
tccattttcatgtgagacaaatttttcctaatttatcaaagttcataacaaccaataatcagtggatgaaccagccatccactgattacagcttgactctattttagtactcatcctcgcggaaacctaggtcacgaagctgagacattttattacgccaatctttttgcacttttacccatacttctaaaaatactttagaaccaagtagcgcttcaatatcaaaacgagctcgctcaccaacttcttttaacattttcccttgttttccgatgatgattcctttttgtgatgcacgttcaacaacaatcgttgcatttatataaactgccccgccctcacgcttttgaatcgcatcgataacaacagccacagaatgcggcacttcttcacgtgttaaatgtagtactttctcacgaataagctctgcaataataaatctctccggatgatccgttacttgattatctggatagtattgtggtccttctggtaaatactttttaattgttccaatagaagcgtccacattattaccgtctaacgcagaaattggtacaatctctgcaaactcatgtagtttacgatattgatcaattaactctagtaattgctctggatgaagttggtcaattttattaattactaaaaatactggttgtttcgtttcttttaacttctcgatgatgaattcttcaccacgaccaaagccttcgacagcattaaccataaacagaacgatatcaacttcttttaatgtcgtttgcgccatcttcaccatgaagtcgcctagtttatgtttaggtttatgtattcctggtgtatcaatgaaaataacttgtgcatcattttctgtatatacaccttgaattttattacgagtcgtttgtggcttatcactcataatagcaattttctggccgataatacgatttaaaaatgtagatttcccaacattcggtctgccaataatagagacaaaacctgatttataaccttttctattcatgtaaatcctccgctaaaaatgctcctggtaacaattctccgactgtcgtctcttgaacgtcaccatgtaaatttgttaagtatactttcgtatcctgtttacataattctaccataacttgtcgacatgctccacaaggaggtactgggcgctttgtatctgctacaaccgcaatggctacaaattctttatctccttcagaaaccgccttaaataaagctgttctttcagcacaattacataagccatatgatgcattctcaacattacatccacgatatacttttccatcgcgcgttaatagtgctgcacctacttgaaatttagaatatggtacgtacgcttgtttacgcgcttcgattgcttctagaattaattgtttactattcatattcccgcatccttcctgttcacagctatgaagaggtacactctctcattaaagccccttacggcacttccaaagcttaataaaagcttcggaatgcaactataccatatacggtaaaaagataatagcaccaattataacagctataattgcaaacaataaaaccgctcctgccgcaacatcctttgcaatttttgcaaatggatgaatatcggcagtcgctaaatctactgttttttccacagccgtatttaccatttctaaactcattacactccctattacaataagtaatatcatccactctgttctcgtaatatggaaataaaagccgcagcatataacaatgactgcggctaaataatggattttcatatttcgctcatgacgaaaacaaaagaatataccagctatagcatatccaaaactatctataagttttccttttttcatcgtcctaatccaaaagcttctaaaatttctttttgtcttccgaacatttctttttcatcttcttctgtcatgtgatcataaccaagtaaatgtaaaaagccatgtaatgccaaaaatccaagttcacgatcgaaagaatgtccgtactcttcagcttgctctttcgcccttggaatagagataataagatcacctaacatgcgtggcatctctgcaccaacaatctccatttctccttctcccatttcttccatcgcaaaggatattacatctgtaggttgatctttatctcggtaatcacgattaatttctctaatgcgctcattatctacaaatgtcaccgatacctccgcaccatcctcgatattttccatttgagctgctttttctaacacttcacgaattaaactcatatacgcttcttttacttcttctgtttcatcaataaaatcaattaacaaactcattctttctccttttcttccggaagttccggatatgtaatacgcgaatggaaaataccatttaacgtttcacacaacgtttttccaacgatttggagttccttaaacgtcaaatcacatccacta

SEQ ID NO: 936 - DNA, 2645 bp, Bacillus thuringiensis
tttggatgatgttgatcttggtcctcccacatccctaacgtttcacattcgaacggcgaaagtggtcttccaaattctttttcaaatactgtatataaatttacttgtagctgttttttttctttttgctcttcctctattgattcatccattaagaaatgtaatattttttcccataacggttgtaaagaataactttcgcacatcatcgcttctgatctttgtccaccttctagtgataaaaaacctttttgaatcaacgtctgaattacttccatacatttcatttccgttatcgtcatccgttcagaaatctctgaaggagtcggaaacgaattacctgattctaaaaatgtgtgtacatgaagtacaaccataaattccgtctcatttaaacctaattttttataatgcatcataagcaattttggaattgcaatgcttccctgctcaaaccactgtaacatcattttctttttcatcaccaaacacctcgctctctagtataacacacctttagctatttctttttgccacaatccgtcaaaaaaacctccccattaatagggaggttttttatattacatgaatgaaatataaaattaagcttgcactttacttttcataaatgtatggatgcgctctaatgctttctctacttgttcaagagatgtcgcatatgataaacgaacattatttggagcaccaaatcctgtacctggtacaagagccactttttcctcttctaatagagcttttgcccaatcatcaactgttgcatatcctgataaagctacagcttcttttacgttagggaataagtaaaatgccccttgcggtttaatacaagtaaagccagggatttgaattaatttatcataaatgatgtttaatctctcttcaaaggcttgacgcattgtttccacaggttcttgtgagcctgcatatgccgcaattgcgccgtattgagcgattgaagtagggtttgacgtactatgactcgctaaattcgtcattgctttaataagctgcttatttcctgcagcatattcaatacgccatcctgtcatagaatgagatttagatacaccattaataataagtgtttgttcttttaatgcattagaaagctgggcaaattgaagtatattctacgccaccataaattaatttttcataaatttcatcagatactattaaaatatcatgttctaaacatacttctccaagctgttgtaattcttctttgctataaatcattcctgttggattgctcggtgaattaataataactgctttcgttttctctgtaattgcctcacgcagctgctttgctgtaattttgtactcattgtcttctaaaccttctacataaaccgcttaccgccagcaagctttacttgctctggatagcttacccagtaaggagtgggatgataacttcatctccctcatcaagtaatacttggaataatgtataaatgcatgctttgcaccattacatacaataatttcagatggatcatacgcaatacctgatcgcgagtaaatttcttcacaatttcttgttttaacgattgtaatccacctgttggtgtatacttcgtatgcccttctaacatcgctttatgtgcagcatccataatatgctctggtgtattaaagtcaggttcccctgcccctaatccaattacatcatgaccctctgcttttaatgcttgtgcctttgctgtaatttctaaagttgaagacggtgttaaagcagctactcgctttgctaatttcatttgtagttccccctacatctatttttcaatgctatatcgtcttaaaaattttccatctttaaattcaagatagtaataactataacgattgtcatcatcaatatatgtaacttcccatagtggtacatcattttcaaagcctaatttcactttcataatctctttcggcttactttttgattccttactttcattgccgacttgctctattgttctttgtatagcctctttttcagaaataccttcgctctttttccttactacagtatccccttttttctcaggcacccaaacgataagttgttctcccttttcatctgtaccttgcacgactatatatgcagattttccgttgtaataatcaacagatttcacctttgtaagctttgctttttctttagcaatttctacaaatttcgactcttttggaattttctttcccatcgctttattataaacatacgccccatatattccgctagcaacgataacaataatgattgcaaaaatccactttttcattgtatcactacgttctgtaaatcgtaaatacagctgtttctttatctttttcgtctaatgctagtccgaacatgaggtcctgctcttttaacgtacgatttaaactatcaacaattttatacaaatccgacgaatatttaatacgcgtcgttgatagtacttcgattttcttatccatgaaaaaactcctccgttacacaaaaatttctaattatagaagaacgcaatgcggttacaataagagtacattctttacaacccctgcttcatcacccatctattatagcaggacatgtacagcaaaaaaaggtttcaagtcgaaaacccacacatttt

SEQ ID NO: 937 - DNA, 2948 bp, Bacillus thuringiensis
cggtaaacttacatttaaatcattaacttctaaaccgatactatgagctaatttttttgttgaacctgtaaattctttaaactgaggtgctgcctgtctcattttaataaaggtttctccattttcatttacacctatttgtatcggtaaaatcccagccttcgtttcaatcgtaaggttacttttctcttctaataaacctttttcgcgcaaggcaaatatcgtccctactgtcccatgaccacataaatccatttcaaaaccaggtgtaaaatagcgcattcttatatctcctacttctgtggaaagaacaaaagttatttcgttatatccaactttttcagcaataatttgcatttcctcttccgttaatccatctgcttctaatacaatacctgctggatttcccttatttggtttattcgtaaatgcgtcgtaatgaaatacatttatagtcttcattttcttttctcctaaccttctttaaagattttataatacagctctatctccgttttcaacgaacaattatttctccaaaatatcctctgcatctttccatttgaagtatgtgtgcttccaatgtaataagaagcccctatttcctttaaccttatccaacgattggaaaaggaatatggaaaccaattcctttcccccgataataaggcattaccccaaaataaaataaccgtccttcactttctgttccagtttctatatgcggtatggacataccaatcggctcatttttatcataaaaaacaatacatgacttttcccagcccgtacctaactctgtttgcactgaataaaaatgttcattgatagttaaaattgaagtttgattccctgaacccgacatacattgttcccaaatatatttaaattctttttccgataacgttccttctgctattgatcgatatgtatattgtctttcaagcttttctacattattcaattctctacatacttctatctttgcggcatacaaagaaaaaccggcatcaagtaacactttcacacttgagttataactactaaaccttttgtttaatacaatactcgctctttttaactcccaattaaaacaaacctcttccaatctacttatcttttctttatatgtttgtacgttatacaaaacatcttcttctatttcttcaatcgttactgcctttggtaagccatttaatatttttttagaagggccaaataagtttttgatgactgtaagatcgtacttcaccactgcacctccaatctacaatttctatccgtaataaccactctcatatactcatctccttatttttaaaataaataagaaaatccatccacttaccattctctaatgaaaacgcctttctcttgcattcaaatgaaaagcctgctctttccgcaagacgaaccgatggctcattatcaacacgtatatgtaattcgattctatgaaaatcaaggctactaaaaaataacggtaacgcagctttcacactttcaacaccatatccatttctccaatattgattatgtatggagtatcccatcatcgcccattgatagtccatacgtaaaatttttattagctctagctttccaatattagccccatcttctttacgaaaaatacctaatacatacatctcatctcgatgtgctgcttcatcaaatcctctaatccattccgtgaaccattcttttgttgatgatgccataacttgataaccatcgtcgtatttatactgagatggcagcctcttattaaatccatctaaccaactttcataatcatcattttggaacggacggatcatgagtctctctgtctctatctgtaatagcggcagcttcatttacatctcttcccttgattaatatttgaatattctttattatcttacacaaaatacaaaatctagtaaattattatgtttttgataaacatgcttctattaaaatacaaaaggaaaccctgttctaaaggatttccttttgtcatcacactaccaaacttatctgtaatttaaaacgttgtattctgtctttaatattccataaacatcaacatcttcatatgtatttaataaaagtctattttgtctcaatgtaccttctttacgtaaacccgacttctctaatactttaatcgacgatctatttctggaaatggcagatgcccaaattttgtttagacctaattcgataaagccaaattgaatcattctgtttacagcctcagttgcaaaaccctttccccaataattcttaccaatccaataaccaagttcacctctattgttacccttgtcaattcttagtgtaattgtacctacaatttctcttgattctttagagacaattcctaaaggatattcgattcctttcctaataagttctggttgcatatcaacccaatcttgcgcgaactccagtttatatggatgcggaagcccaagaatattagctaattccttgtcattagccaattctttaattctaaaaacatcatcattggtaaaaggttctatacataaatgctcagattctaattttatagccatcttttctcccccttgtactgaaattagttagatccctttattttcaatattacaccaaaaacacaaaatttttaaaatctttatgatatctactaacagaaccataaacaaaaaatccagttatgctgtgaacataactggattcctcattatctaatgttttttattttacaaagtacattttctcttaattccctcttcaacacttttcctaaagcatttttcggtaactcttctaagaataccacttctggaattttgtaacttgctaacttctctttacaatactgaagaatactttcttctgttaatgttgtttcgccatccttcacaatgtaagctcttggaacctctccccaaaagtcataaggaactccaact

SEQ ID NO: 938 - DNA, 3247 bp, Bacillus thuringiensis
ctcgtacagcattttcacttattcctggttttagaaacgtaagaatgtggtgaaatgcttcgtccgcgatattagctgcaattttcattgtttctatttcaggcgtgtctttaatgatacgaatattttcgataatttcgcacacttgaatcatttccgcctgtacgtatttttgcaagtttttatattgttgcaatgtcatgttgttttcttcaattccaagtttttgaatgtttaatttcgatacttgatgtgcaatttctttttctaaatttcctttatgcataataatttcagcatcttttatttgtgatttcgcttgatctacatagcggaaatcagtgataaaaacagcttgatcggcagagattaagacgacgccagcactacctgtaaagcctgttgcatattggcggttttcttttttggtaataagtaacccgtcaatttcatagttttgtaattgattttggattttattaatttttaaagtcatgttaattcctcctattcacagtattgaataaagcaaatagcgtgccaaaatgtatatttgaagaaaggatagtagggacaacatatattttaggggagataaaaaaatagcccgtaatttgtgggaggcggtttgttcataaaatctagattgcttcaatgaatagcagggggatggggaaaaataatgattggagttacacttgtactttatttacatgctgtaaaaaattttatacaaatgtgaaatgatactgtcaatttttttgacaatattgaatgaatatagcaacgaaattgaaaacatataaaaaatgcgctgcatacaagcaacgcattttttatttacgcttttaatttcattacaatatcagcatctggtgttacatatacggtttgctgattgtcgtacgtaacaaaaccaagttttgcaccactcggttttttgacatggcgtattttggtgaaatcaacaggtacagagctagactctttcgctttgctgtaataggcagcaattttggcagcttctagtaaagtttcttcagcaggctctaaagaacgaatgacaacgtgagagccaggtatgtctttcgtatgtaaccaaatttcatcacggcgggcaaacttcgttgttaaataatcattttgtttattgtttttaccaacgaaaatctctgtgccatcacttgctacatatttatctaatactggtttagtaggctttttctttgcgtttttcgttttgcgattgcgcacataaccttcttcagctaattcctcacgaatttcttcaatatcttttgaagaagcagcttccatttgttgaagtaagctatcaaaataaagaatttcttcatttgttttttcgatttgttcttctacaacaacaactgaattttttgctttttgatacttttggaaatagcgttgtgcattttcagatggtgtttttaaaggatctaatgtaatttttacagttccaccattctcatcgtaataattaacgacctcaatatctttatcgcccttttttaaagcgtacatattggctgtaagtagctctccaaatagttgatatttatctgcttttccagcatcttgcagtgttttttcgagtttaatgagttttttctcgtttttatttttttcgttttgcataaagcgttctaaatcatgagcttgttgttttacacgatcacgttctgctttgccaaagaagaaacgatctaacaattcgctcactgatgagaatgttttttcttctccttgcaagtgtgtaagagggaaaagataaaagaattcttttccatttgcagtaatcattgtaggtgtatatgcatgagatagtaatggtgtttgtatagagaaaaatgcttctgataatgctttctcgtttgccataccggctttctttactacttcttttgcaaataatggggatattcccatgaaagcaccgacgagttgtttatccatatttccagatagaaagtctagcggtctaataaaatcatctgcggtttcaatttgcagaggattgattttatgttgggctggtggcgcgacgtactcagcaccagcatatacagttcggtgacggtttacggctaatgaaacgtgttttaagctatctaaaatcacgtttgttttcgtatctaataagataatgttactatgtcgtcccattatttcaattactaatgtttttaatgattcgtctccgatttcattacgactgcgaactgtaatttgaataatgcgttctaagtcgatttgttcaattttttcaataaatccaccttctaaatgtttgcgaagaagcatacagaacatcggcggtattgctggcgaatcgtagttttgattcgttaagtgcatacgcgcatatgtaggatgagatgaaagaattagtttttggttctttccattcgctcgaatatgtaataaaatctcgtattttgaaggttgatatattttggaaattcttcctgtgtaaagagaattttcaatttcatgtgtaatcgctcttgtaaataatccatcgaatgccataaatgaacactcctttctaactaaatgttaattatagcatttttttggacgaggctgaataagctttcaatagagtatgtctggaatcaggaggtcgatagcaggatgaactggtatggaatgcgagcacatgaagtggaagaaagaacgaatacgaatgtaaaggttggacttacagagaaagaagcagaagggcgagtaaagaaatttggtactaatgaattagaagaagcaaaaaggccttctgcactaatggtatttttagcacagtttaaagatttcatggtactcgttttgtttggagcaacaattgtttctgcgtttttaggtgaatacattgattctattgctattgttgccattgttattatcaatggtattctcggcttttttcaagaaagaaaagctgaaaaatcattggaagctttaaaggaactagccgctccacaagttactgtaatgcggaatggaaagtgggtaaaagcaccatctaaagcacttgttttaggagatattattaagttttccagtggtgatcgtattggggctgatgtgcgtcttgttcaggcatcgagtttatatattcaagagtctgctttgacaggggagtctgtacctgtacaaaagaaggtaccaccattgcaagggcaagactccctccaattggggatcaaaaaaatatgactatgtggggact

SEQ ID NO: 939 - DNA, 2141 bp, Bacillus thuringiensis
gggaggttgaaaacgtgagttctgtagcaaaaaaacaggggatgggtgctgtcatatgggattatttaacgacagtagaccataaaaagattgccattctctatttaattgcaggtggattgttttttgtaataggcggaatagaagctctatttattcgccttcaattagcgattcctaacaacgcttttcttgttggggatgcttataatcaagtattaacgatgcacggtacaacaatgattttcctcgcagctatgccactcgtgtttgcatttatgaacgccgctgtaccacttcaaattggtgcacgtgatgtagcgttcccgtttttgaattcactcggattttggttatttttctttggtggagtatttttaaatttaagttggtttttaggtggagcacctgatgcaggatggacatcttatgcatctttagctttagcctctaaaggtcatggtgttgatttctatgtactcggcttgcaaatctcaggtattggtacattaattggaggaattaacttccttgtaaccattattaatatgcgcgctccaggaatgacgtatatgcgtatgccgatgtttacatggacaacatttgtaacatcttcgcttatattattcgcttttccgccgttaactgtaggattaggacttttaatgttagatcgtttatttggaacaagtttctttaatccggcattgggcgggaatacaattatatgggagcatttattctggattttcggtcatccagaagtatacattcttatactcccagctttcggaatattctcagaaatcttcgcaacattttcgaaaaaacgattgtttggttattcatcgatggtgtttgcgactgtattaattggatttttaggatttatggtatgggcgcaccatatgtttactgttggacttggtccagttgctaatgctattttctcagttgcaacaatggcgattgcggttccgactggtatcaaaatattcaactggctctttacaatgtggggcggaagtattcgttttacgacaccaatgatgtgggcagtagctttcattccatcattcgtaatgggtggagttacaggggttatgctagcatctgcaccagctgattatcaatttcatgataactatttcgtagtagcacattttcattatgtaatcgttggcggtgttgtatttggtttacttgcaggagctcattattattggccactgatgtttaataaagtattaaatgaaacattaggaaagataacgttttggctattctttatcggcttccatttaactttctttattcagcatttccttggcttgattggtatgccacgccgttactacacatatcttgaagggcaagggttggaaatggggaatatgattagttccatcggagcggtgtttatggctcttggaacgattgttcttctattcaatgtaattaaaacaacagtatcaaaagaaaaagctggtcgtgatccgtgggatgcacgtacattagaatggacaatgccagcaccgacaccagaatataactttaaacaattaccatttgttcgcggattagatccgttttggattgaaaaacgtgaaggtaataaagaaatgacagcagcggaaccagttggtgatattcatatgccaaatccttcgttttcaccatttgtcatttctttcggattgtttatagcggcatttggtgcgatgtatatgcagggcggaaaagataagttctggttattagtagcaattattggtttaatcattacatttggcacaatgttcctacgttcagtaattgatgatcatgggtatcatattcataaagaagatttagaggataaggggggcaaggcataatgcatgtagatgaaaaattaacgaatgaaacatttccagcagagcctgaaaaagcaacccttgaagggaaaaataagtttgtcggtttttggctatttcttggaggcgaaacagtgttgttcgcttccttattcggaacatatttagcgttaaagaattctacaaatggtggaccaacatctcaagagatgttccaaatgccactcgttttcattataaagaaacttttattaacgagtagcttaacgagtgtatatgcgatgt

SEQ ID NO: 940 - DNA, 2017 bp, Bacillus thuringiensis
ctccaattgtcttgtatgtgtctaacaattggggtgcactggaaaattgatagtctttagtcgtcgctacgctgcataccagtatacattaatacgagacgtaataattcaaataccgctacagctgcagctgctacatatgttaatgctgccgcatttaatactttacgagcttgcccatattcatctgttgatacaatacctaacgcttcaatttgttgcattgcgcgctttgacgcatcaaactcaactggcaatgtaacgagctggaacacaacacctgctgccattaaaatgatacctaataacaacaaaccagacatttgtgcaaatataccgattaggacgaaaatccaagacatattcgaaccaaagtttgcaactggcactaacgaatgacgaacgcgcataaatttataatcttttgcatcttgaattgcgtgtcctacttcgtgtgctgcaactgctgtaccagcaactgaatgtccataatagttatctgttgataatcgaaccgtcttagcggttggatcataatggtctgataaatgacctggtgtttcttctacagctacgttgtataatccattttcatctaaaatttttcgagccacttccgctcctgtcatacctgatgttgaataaacttgtgaatacttgctataggcactacgtactcttgactgtgcatacaacggtatgatcattatgatcgcgaagtaaattaaataaaacatcatgaacctccattgaagttttaattatagtacttctcattctattttcttctgccactattgtcaatgaataaaccttacaatccatatctttatttattgcattatctatttttagaatgtacattactttttcttttttctctttctcctttatactttctccatccaacataagttaatgtgaagaaaataagtcccccagtaattgtcataaaccaaatgagagagggtgcaatttcatctttttttactgtgtgaaatatcttttgcaaatcccctttaataatccctaattgcatttggccgcctttcgtttttaacataacgttacgaaattcatctaaataagataaatgaacatttacacgctgaacctcgttttctggcaaagcaatcattaagcttggataaataatattgaattcatttaaaaacgtatttaacgtttgttgaaactgcccagcatcttctttttccatcgctttttccatttgagaaaaggcatccattactttcctttctctttccatccaaagtggttgatatttcgatacttgtgcatcaacagcaagttgtaatgccagcacattatcaattttagcttgcttacctaaaccttcttcagagagcgattgttgcgccttatcgtaagctaaagaaataactctaacttgatctggtgttacttcctgcttcttttcattcccctttattaaaaattgctccgagaaatgttgtaatacttgtaccgctttttcatcttcattacgcttcactaactgtaacgagtcgtctaacaaccctgttagctcattccactcttcagcatatatacgtaacggaaacattataattagaaatgctatcaatccaattaatgttctcttcatcccggtcccccctataactactagtacaaaatatgttaatttggacaagaatagaacagaactagaccgaaaaatatattatcattttacaaagaaaaaaattctctttaagcagagaattttttctgtgacatccttttcttttttacgaaatatcgatataaactgtaacaaagtatactaccacctaaaatgaataataaaatagcacacgcagcatgcataaagaactcttctggtaacattaatataattggatctttttcaggatcaaaaacccaataatcattactaaataaaagtttatggaataatacaaaactcttttcaaaattaatagcaatcggtaacataagcgctatcggaaaaatgaatgttaaaatcgat

SEQ ID NO: 941 - DNA, 2489 bp, Bacillus thuringiensis
ttcacatttgagtcttttactcaaggcatagttgtatcttttttaggcatcgtaaaagtgacatcttctgttgaaagaacattacccgtcgcaattgtttgattatttttcgtaatatcaactgcaccaactacctcaccacgatgtattcctttatgatataaagattctttatctaatgaagccgcccggaaaatagttttcacatttttcccttcatctttcttaagcataagctccgcactttgttccaactcagaattaacatctttatttaaatatgttgttttttgatgccaattatgtttatcaagcaccatttgcttcgtaaattgaccgaaagaatattccgccatctgcttcaaatcttcataaatttcaggtctttgagaagccattactacgcttataatacgatttccatctttctcatttaataaaacaagtgtattacgtgcttcattcgtaaaccctgtcttaccgccaatgctatatggattttcaaaaaaattagatttattaaaaatagacaccgtctgcctagacgtcgtaactgtcgttcttttcgtattcatcgcttgtaaaatttcaggatacttttgcacacccttcgtaatcatagccatatcatacggcgtcgtataatggttcggatcatgcaatccattcggtgttacaaagtggctatctttcgctcctaattgcttcgctttctcattcatcatattagcgaaattctcaacactcccgccaatccgctccgcaatcgcatacgacacatcattcgcactcagcaccattaaaatcataagcgcagtatttctattaattgtctctccaggttgaaactcaatttgataattactcttctcttgatctaatgctaattgtgaaaatgtaaattggtcctctggctttgtatgctccatgagtaaaatcgctgttaacaccttcgtcgtactagcaggatatgctcggtgatatgcgtttttatcatacaaaacatctcctgttttcgcatcaattgtcgttgcaaactgactaaaaacattcggtccttccgcaggtgggggtgcaacttgttctggatttactccaatattcgtctcagcacgcaatgttatgggcgtcaaaaaaaacgaacaaataactgtaataaaaaccaaaattttcttaaaatttaccatatgactctcccttttccatttactccttaacaaaataataaatctaccaatcatatgtgatttgtattatattggaagaaatttcactattttttactatatcatacttttacgataaagaacataaatatacaataaaaataagaaggaattactctttcttatccttctcatcaatcaacgaatctattaacttttgactagcttcctcgggcgtaatctcatctgttattcccataaacgaccaacctttagaatcaacccactcaacaaactcttgtaaaaattcatcatgtgtaacatccacatcaagaatcgatccattaatcgaaatcgttctatttttagacacgcgcatcttgaacgtttttcttaccattacaacttttctccctctacttctgaatatttataaagtgaaactttcatcaaccctcacgaatcggacttttacgggcattccgacccgaacctaacttctttacttttgctgaatttcgaggtaagggatcttactgcccgcaaatagcgagataaaataatcatgtatctctgttatacatgattttcagtaaattgtaaaaaggatatattggccaatttaaatagcaaaaatgaaaatctcttacctatgtaaacgtaatacgacatacaattgctcatacattattaaataaattcataaaaacatacagtctaaaacataattgacgttgtttaaacaacgtcagttatgtgggtttagttgagtaagccattataaacttttggaagatattatctaaaatagtatactaaacggataaaggatatttgaataaagaaactgaggccttctatttagctggactcttaagtggtagacttaaagactaatgccggaattcatatttaatttctatttctgtacataatatcggaagaaagaaggtagtgctgtgaaaacaacagaaaattttactgacagggccgatatgtatgcaaaatatcgccctagttatcctaatgaatatattgattacttgcttccagctaaccaagtgaaagggaatcggattgtggctgatattggttcaggtacggggatatttagccgccagctgcttgaaagtggtttacatgttattggagttgagccaaatgatgatatgaggaagatggctgagcaatcgttaaaactatattctcgttttcaatccataaaagcaactgctgagaataccactttaaaagaaaatagtgtagatttagtaactgttgcccaagcatttcattggtttgataaagaagctttcaaaatcg

SEQ ID NO: 942 - DNA, 2660 bp, Bacillus thuringiensis
gacaagttggtggacgtcgtcaaggtgttttagtttcacttgaaacaggaaaagcatcagagtggggtattatgcaagttgaagaccgtggtgtaatcttcgttgaaccaggtacagaagtatatgctggtatgattgtaggagaacacactcgtgagaatgacttaacagttaacgttgtgaaaatgaaacaacaaactaacattcgttctgcgacgaaagatcaaacttcaacaatgaagaaaccacgcctaatgactttagaagaatcattagagtacttaaacgatgacgagttctgtgaagtaactccagaatcaattcgtctacgtaaaaagattcttgataagagtgagcgcgaaagagctgctaagaaaaagaaatctgtcgaagcgtaaaaataaaaaaacaacgccctttataaagggcgttgtttttttattttgtttattttttagaatatttactcatttttgtggacagtattttttttgcgagttactcttgtattaagtgtataaagaaaattgcattttactgctaggggggaagagtgtgttagaaaggatgtctttttttgcaaaattgtgtaaggtagatgaaaatccagagttaggaatgtggttactttatgggacgattattatattaagtgctctcgtttataatttagggtttgctagaaagttgtctgtactaaaaaatattgtgatatacatatcattagcaattggatgcacagtattaaccttttttgctgtgtttttacctgttggagaaggacttgttgtagcggcaattgtacttggaatttatagattgcgtttgcgtcaagcgaaacaacaaaaagcaggataaggaaggggagttttcatgcgttcagtacaagatgcactatataattggttaacaattaaaacagttgcggaagcacgcccagatgatagtgctgcaaaagaaacatatttgttatttcaaaatatgatatatgaagaacataaattaagaaatgttgaagtcgaaaagaacgaggaaatgtatttaattacatatgaaatgaatggagaacggaaatctgcaaggtttccgttagaagccattgattgttttttggatcagatgaatcgtgaaccagaaaaatataaataagtccttatctatatgagtaaggacttatttacattttaccaatcatcttcgatttttttatcacgatataatcggaaattaccacttgcatgacgttccattgtacgctctgcaattcgttccgaacattccatgcacatatatgtatgaatagggcgattacgcagtttttttgccataggattttcatcatctaacatatcttttttatcacaaatcatacatttgactctcatttcgtcacctcaatacgaattctatcagtataagtatatcatggaagtataatgtttttgaataatagtgggaaaaaataatattttcgcaattcaaaaaataagttatgataaggatataccaagtatgtttggaggtgaaaatatggcgaatgtagtagagcctaccttaacagaggatttagtacaaacgttgcgtaaagagtgtattgttatgatagcaacggcagatttcgaaaagcaagttcctaacgtaagtgctatttcttgggtgtatgcagtgagtaaaactagtattcgatttgcagtagatcaacgttcacgtattgtggaaaatatacggcataatacaggtgtggtattgactataatggcgaatgaatccgtattttctataagtggtgcaggtgaaattttgacagatagaatggaaggtatttctctaaaattaactgtaatagaagtaaatgtgcaagaagtgcgtgatgttatgttttatggagcgaaacttgcaattgaaccaacatatgaaaaaacatatgatcttcgggcagcgaaaaagctggataatgaagtgttagtagggataagagaattataaagatgctaaataggaaattcgtttattcacttttgtaatcggttattgtgatttaacgttaataattataataaaaagtaatatattgaatagaaatgaataaagaataaataaaaggtttaatgactatgattttcgattctacctcgtttacacggtacatataattataacaatggttcgtccatattgtatggatgaaacccttgttctacaaatttaaaagtggagtcagggggtaacaggttggataaaatttatgtgttagatacgaatgtacttttgcaggatcctttatctattttttcatttgaaaccaatgaagtagtgattccagcagttgtattagaagaggttgattcgaaaaaacgttatatggatgaagtaggacgaaacgctcgttatgtatctaagttaatagataaatttcgtgaaataggaaagctgcatgaaagtatcccgctagaaaacggcggaacatttcgtattgaattgaaccatcgttcattcgtgcaactacaagatatttttgtagaaaaaacaaatgataatcgaattttagctgtagcaaaaaatctatctttagaagaacaggaaaaagaggacgggaagtctgttattttggtaagtaaagatgtgctcgtaagggtaaaagctgatgcaattggtttgaa

SEQ ID NO: 943 - DNA, 2657 bp, Bacillus thuringiensis
gatactctttcattttttccatcgcgattacatctttcggttcttgtacgacacaaacaactgattgatctcgatgtgaatcattacaaatataacaaggatcacgatcagtaatatgtccgcatacagaacagtacgctaaatctcgcttcgcatttacaagtgctttcgcgaaacctaacacatcatcttctttcatatctaatacgaaaaatgccaatcgaaccgctgttttcggtccgatacctggcaacttcataaaactatcgattagttttgatattggttctggataatgcatgtatcaatatcctcctagaacattccacctggtaagtttaagccttttgtaaatttacccattgtagagtttgaaagctcatcagcctttttaagtgcatcatttgttgcagctaatactaagtcttgtagcatttcgatatcttctggatctacaacttcttctttaatcttcacttcaagaatttgcttgtgaccatttgcgataactgtaatcattccgccgccagctgtaccttcaactgttttttcaccaagctcttcttgtgctttcgccatgtccttttgcatcttttgcatttgtttcatcatgttattcatatttcccattccgccacgcatcataattaattcctcctaattattattactcttttatttcaatgagttcttgccctactaatttcactgcctcttctataagaggatcttcctttttctctgggctttcttcagactctccaccttcacgttgtaaaaagtcttcacggattttaccccattcactttttggaatggcaatcatatttaaccttttacttagcaattcaaataaagcttgttctactgtatccatagcttctcgattttcgctcgccatcttacagtgaatctcatattgaaatgctaaaacgtaagtgtcatctgaagctgccactggttcgctattttctagtaaaacagcaaacgctactttgttatatgatttgagtcttcctaacaactcaccccatacagcttttaattgttctaaatcttgacgcttcgcttgttttaatacttcatttacacgtccgacaggaatcttcatacttcctgttcttaccggctttggtgttgcacgtgtctctcttacttcctgttgtacaccagctggcacaccgttctttttaacttgctctaactctttctccagttgctgcatcctgttcataattgcttgcaaacgatctgtaccatttgcttgcatcataaactgttgacacaattgcaccataacaacttctaagaaaatacgcggatgatttgtccacttcatttcctgttgtcccttactaagggtatgaataatctcatagatcacttccggttgcatttcttcactcaacttacggaattgatcatctacaattactcgttccaacatatgttctagttgcggtgaagtttgatataaaagcatatcacgataatagtaaatgaaatcctccataaaacgaactggatccttccctttactcatcatttcatctatgatttgcaatgctcttgatacatcattttcacgtatgcattctactaaattgcctaagtattgctgagaaacagatcctgttacggccaatacatcttctgtcgtaacggtctcatcactataagatatagcctgatcaataagactaagtgcgtcacgcataccaccttcagcagcacgcgcaacaatttgtaatgcctcatcttccacttgcgtaccttcatttgtcacgaccgttgataatctctcaacaatatcattcactgatatttttcggaattcaaaacgctgacaacgtgaaataattgtaggcgggatcttatgaggttctgttgtcgccaaaataaagataacatgtcctggcggctcttctaaggtttttaaaagcgcattgaatgcacccatagaaagcatgtgaacttcatcaataatgtatactttatattctacagcacttggagcatattttactttatctctaatatctcgaatttcatctacaccgttatttgaagccgcatcaatttctaatacatctgaaatggatccttgtgtaattcctaaacaagaaggacattcattacaaggttcagctaccggagcatgttcacagttaattgcttttgcaaatacttttgcaattgtcgtttttcctgttcccctcgggccagaaaataaataagcatgtgaaactttctcttgaagaagggcattttgcaacgtttttgtcacgtgcttttgaccgactacatcttcgaacttttgcggtctccatgttcggtataacgcttggtatgacacgaaaatacggcctccctcaaaggttattatctcatttattataacccattctgggtatagattccaaaagttattttctatacaaaaaactcacctttgtattaaggtgagttttgtatacatatataactgccgtgcaccctccggggattacgaaccataagcgttactcaagcagttagctcggttcaggcactcctgcggcacacgagaagacccgattattgctgcttacttacggacctgacaaggctcacggggtcccgttgagcaggacccagacgtcaacaccacttactta

SEQ ID NO: 944 - DNA, 1379 bp, Bacillus thuringiensis
gtaacattttgactcatacaatgtcaactaagattaattgtttttatacaaaatttatgccggaaaattttactgttccacataaacctcatcgttttctacattcatgtcatcttgtgttgtttttacaagatccactttgcgataacgattcatacctgttccagcaggaacaagtttaccgataataacattttcttttaatcctagaagttcatcgcgtttacccttaattgctgcatcagttaagacacgagttgtttcttggaacgatgctgcagataagaatgaatctgtttcaagtgaagcttttgtaataccaagtagaacaggtctagctgttgctggttgcttaccttgcagtaagaccttagcattcgcatcagtgaactgatggatatctagtaatgttcctggtaatacatctgtttcacctgcatcacttacacgaactttacgtaacatttgacgtaccattacttctacgtgtttgtcaccaatttctaccccttgcatacggtatactttttgaacttcacgtaataagtattcttgaaccgccgtaatgtccgttacttttagtaattctttcggatcaatagaaccttctgttaactctttaccgtggctaattggctgtcctggagttactttcagacgagcaccgtaaggaatagcatacgtacgagcttcaacttcaccctgtacaactacttcttggcgatctttaacgtcgttgatcgctgcgataacaccgtcgatttcactgataactgcctgacctttcggattacgagcttcgaagatctcttggatacgaggtaaaccttgagtgatatcatctccggcaaccccacctgtatggaatgtacgcatcgttaactgtgtacctggctcaccgatagattgagctgcgataatacctaccgcttctcctacttctacgtctgttccagttgctaagttacgaccgtaacacttcttacatacaccgtggcgagtgttacacgtaaacgctgaacgaatgtttacagtttcaacacccgaattttcaacgatatgagcgatatcttcagtaattaattgattttcagcaactaatacttcacctgtttcaggatgttttacagtttttcttgcaaaacgttcaacaagacgatcatataatgactcgataacttcattaccctctttaattgcaccgattaataaaccgtgatctgtttcacaatcatcttcacgaacgattacatcttgggcaacggtaacaagacgaccgtgtttagtaaccagaatcggcagttttaagttgctgatttaacaagaccctttacgcgcaccgtgcgtatagatgaattacttaagtacttgttaaacct

SEQ ID NO: 945 - DNA, 3092 bp, Bacillus thuringiensis
tcatctattccaggtatagtagatgagaggcagtattcaaaaagcgagtgccttgaaccagacggcagcatctttatcaaatattttagcaccgattattggcggagttgtatttggtttcttttcaattaaatcgtttttcctattgaatagcattacattctttttagcggttgttgtgcaattgtttatcgtatttgatttatacaaaaaagaaaaggctgaaagtaaagagcatttcttgacgagtataaaagaagggttttcatatgtgaaaagacagcatgaaatatatggtttaatgaaaattgcagtaggggtaaacttttttgcgagtgcacttttcgtttcacttccatatattattgttcaaaatttgcatctatcttcgaaacaactcggtgttgtagagggaatgttagcagttgggatgttaattggtgcaattgcgttatcagtacgtaaagaagtgaatgatccgtttcgctctgtttatattgggttgtttttatttgcgagtttgagtttatgtacagtgtttccattagtagtcaccatcccgaaagtagcaagttttatttactatatcgcttttatgatgttaactggtatatcaatgatggttgtgaatatcccgatgcaagtacatttgcaaaagacgacagatccaagttatttaggacgcgttttcggcttacttgaaacaatttctactgcaatcgcaccgctcggtatgattgtgtatggattattattagatatgttgccaactagcattgttatgatgacattaggcgtaggtttattgttagttgtattagtaggagtaaagaagcatgtaatgaaaaagcaagtggatgtgtctgtctaaaaggaaatgtgacttaataaaataaaaatgactaaattagtattttagtttttgaaactctttttcatgtatgttaaagtaaagtgagcttgcaaagaaaaggagacaacagcatgaaaaaattaagttttgttatgctttttctattagccgtaatggctggatgtagcaattatgacacatatattgaaacaggtatgcaatcattgaaagatgaaaagtatagtgatgcaacaatgtggttcgaaaaagcagaaaaagagaaatcaggaaatgaagcgaaatcatataaagaagttgctgagaaaatggatcagggagcagcagcattaaaagacggtaagtatttagaagcgaaagtcattgcgaatgaagtgttacaaaagccaagagatgatggacttgaaccacctgtaatatcaaatgcagagaatatgcttccaaaagcaaaagatgtggaagagaaagtaaatgaaagagtggcaaagcgtagaaaggtagaagaagagggaatcgataaaattattaaagctgtcgatagtatagatgaagtgaaagaaaaagagaagaaagtatcagaagcattagataaggctgaagaggcgcaagcaaaaattgaggcaaagaaaaataaatagatttatagtttgaaaggctgtcgtgcataacgacagccttttaattttttgttgcaaatgtagtgatgctctgtagtaaaaaagaaatgattttagaattccatctgtcttcatgatgaatcgtataaatattacgctgaaattcaaattcagggattggtatatagcatagctcatttcgttgtatttcttgttcgatagccagtttagaaatcaaggcaattccattaccatattttaaaatttgtttcatcgtttctaatgagtctaattcaatttctgattggaatgtaatgttgtgcgctaacgtccattgtgtaagtaagtctctcgttgtagatggattacgatgcaatagtatgcgttccttttctatattttgtaacgatacattgtctttctttgaaaaatgatgttctttggaaaaagcaagaacaagtgtatcgggcattatattcgtttgttttaaaagtggttcatcaaatggagcagcggaaattatcccaagatcgatttcgtgattttgtagcatcattcgaatttcaggggcgattttaactagtagcgttatttttatattgggaaattcacattgaaattgatgaacgactgctggcaaaagataagtcgctggtacataactagcgccgattgttatagcgcctttatgaaaatctttaaactcttgcgtgacacgtctagcttctttcataagtgcatctattttacaagcataatggtgcaaagcctcaccagcctctgttaagaaataccttccagaacgtaattcgaataaagacacaccgagttcttcttctaagctttttatatgaaaagtaatagttggttgtttaacgccaagtttttctgcaacgattgtaagctttttgtatttcttaataagtactacaatttctaattttaagagattcattatgaattgccgccttttttattttaactatagaaaaaatctatagaaataaatagtttattagaagttttttaatttaatctttacagtacattaacattaagtataaatcttccatatagaatgaaagcaggttaagaatgaggggagagaggtgagacgatggatattaaaattaatggattagaaaaaacatttggaaaaacacaagcgttaaagccgttgcagattgtaatgaaacaaggggaattcactacacttttaggaccttcgggatgtgggaaaacgactttacttagaatgatagcaggacttgaagaaccggataagggagaaatatattttggagaccagtgcatgtattctgctacaaaaaagataaagacatctcctcatgaacggaatatcggtatggtatttcaagattttgctttatggccgcacatgactgtttttgaaaatgttgcatttggtttaagagctacaaagcaaacgaatcatttacgagaaaaagtagaagatgcaataaagcgagttcgcctgcaaggtatggagaaaaggtatccacacgaactttctggtggacagcaacaacgtgtcgcattcgctagagcaattgtaacaaaacaacaaattattttgtttgacg

SEQ ID NO: 946 - DNA, 3523 bp, Bacillus thuringiensis
gaaatgctttgttcgctggtatttcataatctgcaatccaatccaccctttgttctttcgttgatttccagtctggtaaaaattttgctatttccggttgatttgctattttataaatactctctgcatctttgaccgtaaactcttgcaagtatatatctccacaatctattttaaataacttagtgaatctctcttctcccatgttaatcccccttatttacgttatagctccttaatctgcttcgtaagttccataaaccgttcatccagtgctttatattctttgtctttagaagttaaaaagcttaattttcctaatacttcttgtctctctgtttctaacgttaaacgtagctcttcaatatcatctcttgttttagtaggttcttctagctgcttttgtatcgtattgtttgaaaacacgagttttgtgttagttgttttctccagaaaatatcgatcgtgagatacaattactaatgttccgttatactcagctaatgtattttcaagttgttcacgtgaaggtagatccaagtgattcgtcggttcgtctaaaatgagtacatctttttcatctaaaatataagccattagcttacactttactctttctcccatactcatatgctcaatcggctctttccattgagacgcttggaatcctaaatgtttcattaaattttggacttttcctctttcttcaaacgtctctttaaaaaataaattttctggtgttttatcaagcggtaaatcaaaaacttcttgtgttaaatagccgatgtttgctgaaggtgaaatccatatttctccttcagcagtttccgttcccataatcatcttcagtaatgttgttttcccactaccgtttggtccaacaatcgcaactttctcaccgtgctgaattgtaaaattaacgttttcaaataatactttcccatgaaagtctttttttaattgctttacttctaaaaagcgttttcctacttttttgttcgcttgaatagaaaactcaactgaatactcttctttcacacgttctactttcgttttctccagctctttttcaagtcgttttcgttttgacttcacttgtgcatccattcgcttcgcttttacacgatagaattctttcacaccttcttgttttgtagactgcgcgtgtgccttttgtgaccatgaactcaattcttttatatgtgtttctacttgttctatctttttttgttgtttttcatattcacgctgctgcgactttcttttttgctcacgtgctttcatgtagctcgtataattaccactatgctcaattaattttttgtcctcaattgaccatatttttgttgcgacaacatctaaaaaatatcgatcatgcgatacaacgataactgtacctttcatgttttttatttgtttaatgagaaatcccgtactgatctcatctaaatgatttgtcggttcgtctaatattaagacattaggattttcagcaaatccttttgctaatcgaattttcagcttttcaccaccacttaaagtatgaaaatcgttcgttggcacgccccatttcgcaagaagttctgcttcttttgcaattacatcattactaataaaagattctatttcttgctcaacatatgcggttgtcatattcatttgctgccattcaacaatcccttttgaaggctcaatctttccatttattaattgaagtaacgttgatttaccagcaccgtttttaccaattaatccgataacatccccttgttttactgtcacattcattttctctaacaacatattttcttttatttcaacataaacatcatttaatgttaatagttctttcataataccgatccctttcattaagggagaataaaaaaatcctcccaaataaatttggcaggattagtcgttaaaatatttacacccaaataagctattacataacataaatagcaataccgttctatggaaattgggcagactaatcctattttttagaaattgaaatttattgaatttcaacatttaaaaataagattagttaatcatcgtccacccatcattcctttctgtcattaataaccatattgtaccatgataatactgtatgcgtaaatattattatttgtacttcaaaagcaattatttttcttcaagtttatttttacaatttcatgtgctcatatctttaatttttactaatttgtatcatttattcatatgaaaactttttaaaaaatacaaaacaaggctaaaaaacttatctccaacgttctttagccttgatcactttttacacattaaaaaacattactcgtactaccgtacctttatcaacttctgaatggattgctacactatgtcctaattgcttcgtaatttcatatacgagatatagccccattcctgttgattctttaaaatctctaccgttttctcctgtaaagaaaggtttgaagactcttggtaaatcttgcttcggtatacctacgccattatcagcaatttcaagtataacggtattaccttccttacaagctttcactttaatcttttctctactacctgatgaatatttaatcgcattcgatagtatttgcccaattaaaaattgtaaccatttcgcatcactttctacagtaatgtccttatcaatttcaagctctggatatacaaaattccggataaagaaccgtttatgctcatgtaccgaatcattcactattttatgtagttgtactctttctacataaaaatcttgtgtaaatgcttctaaacgtgcgacatacagagccatttctaatcccttttttaatcgatcagtttcctcatttatactttcaaaacgtgaatctacttcatcctgtgtaattaattctattacagataaaggtgttttcatttgatgaatccactgattcataaaggttaaatggtcattattttttctctcttgcatttgcagctgattttgataatgtcgatattgcacctcaagtagttcttgaagagcagccgatacagctgcaaaatcagatttttgaacagattcatgttagtgataggtaaggatttgaagttatctctaccttttcccccactccacaccgtacgtgagactttcacctcatacggcgctccatctaatttgtttattgtttaattttttctaaattacaagctcttcgatattggtttattcgtttaacttgttccacagtcaacgagtgtttttgaaagtaggattcaatcgtttgtttatttgtcatgtgaattaatctatgaatttctttatgaatgattctaagattttcatactcatctgttccgcctaatcccttcggaatatagtggtggcaatgtagctcacttgctggtaaaaattctttaagtatctcacattttccattcaacatagaataccttgccattcgattatccaagtactctatactttcattagggatatttgcagttagtagtttcttaatttcgcaaaatctcaatttat

SEQ ID NO: 947 - DNA, 1690 bp, Bacillus thuringiensis
gtaacattttacactgctctgaaatcccggagagccagctacttataaagtggtaaggatttcgtatcctgcttctgtaagagcaatcgtgtgctcaaaatgggcacaccatttaccatctaccgttaccactgtccagtcatcagatagtgtttttacatatcgtcttccttgattcaccatcggctcaacacagatgaccattcccggctttaatctagggcctctatttggtggaccatagtgcgggatttgagggtcctcatgtaagtcttgcccgattccgtgaccaacatactccctaacgatcgagaatccattctcttcagcatgggtttgaaccgcatgtgagatatttgataatctctcgcctggttttacttgttctagaccaagatacaacgatttttctgtgacatcaagtagcttttgaacagattcagaaatgtttccaactggatacgtccatgcagaatctccatggtacccattgtatttcgcaccaatatcgatactgatgatatcgccctctttgagcttgcgcttccctggaattccgtgtacaagctcttcatttacagaagcacatatgctccccggaaatccgttgtatcctttaaaagatggcgtagcaccatatttttgaatcgtcttttccgctatttgatcgagctctttcgttgtaattcctggagtaatgtgctgtttcaactcttgatgagtcaaagcaacgatcctgccagcttctcgcatgatttctatctcgcgaggagttttgcagattatcattacgctaagcctccgatgagaacatcgatatcagcaaatactttattgatatcttgctcaccattaatgctttgtaagtaaccaagctcttcgtagaaatcaagcaaaggttttgtttgcttaatatttacatctaaacgatttgctacagtttcttcattgtcatcagagcgttgatataattcgccaccacatttatcgcacacatcagcttttgctggtggattgaattctaagtggtaagtcgcaccgcactctttacaaatgcgacggcctgtaaggcgttttaataacaaccctgaatccacattaatgtttaaaacatagtcgatttttttgccaagatctttcataatttcttcaagagctgatgcttgtgcaacagttcgtgggaaaccgtctagtaagaaacctcttacgcagtcgtcttgacttaaacgttcacgaacgattccgatcgtaacttcatctggaacaagtgcacctttatcaataaaagattttgcttgtagacccatttcagtttcagccttcatagctgcacggaacatgtctcctgttgaaatgtgagggatgttatacttggcaacaatctgttcggcttgtgtacctttaccagcaccaggaagccccattaaaattaagttcatccttgttccccctcagagtacatgagcatgtagggaagacaattcttcccacttactcactgcttgataaaccctttgtaatggcgttttaccagttggctttctagctgcttcattgtttctaaagcaacgccgacaacgattaacatactcgttccaccgatctgtgcagatggaggaagatttcccaatttcgtaaagataactggtaagattgcaatcgctgctaggaaaattgatcctacaaggtc

SEQ ID NO: 948 - DNA, 3200 bp, Bacillus thuringiensis
aggaatacatgaatggtatgaaaaccatggcgggaaagaatatgttttacaggagtacatagtagagatgaaaaatgaagagttagtatgtactgtaaagtagcagaggggtgagggataagagaaattaaaacaaaattatattttagtttagcatccactattttatttgcaatagccgtgattgttttctttataaatggtaatccacaaaagtggttttggttatgtattttctttgcgtccattatacaaaatatagtgctactaaaaaagaataaagaagtgcattaagatattcaaattattaacatatttgtgtcgtcttgctagttgtattgaaaacgcttttattcagttttataataaaagtatgttttataaatctccaaaacaattaaaagggagatgatacaatgttagcttcaccgttttacttacatacatggaaaaagtttgttaatgaaggtgttcttgattcaaatcgcataaatcaaagaatttcagaatcgtggcatcgatgtaaacaggctaatgttaatcctcacatgaataaaggtcagaaaattttgtcttctaacatttttcaagaacaaaagaaaaagagtgaaattttccttgatatcgcattacctcaaatacaaaatatgagaaaaaccattgatgaactacaaatgatggcattattaatcgatccagatggttatgttctatcgttaagtggaaataaacaaacgttaaagcgagcgaaacatattaattttattgaaggtgtaaaatggacggaatcagctgttggcacaaatgcaattggaacagcgctagaaattgaagaagctattatgataagtggtactgaacattacaccgtggcatctcatagctggagttgtgcggctgctcccattcataatgatgatgggaaattaattggtgttctagatttctcgtgtccgattgaattttcgcatccatatatgctcggtatggtaacttcaattgcacatgcgatagaacgtgaatgtagcataagagttcatcaaaatgaattacacttaatccatcgttttttagatgtcattgatagtgatgaacaagtagttatttgtaatcatcgtgatgttatcgtttctgcgagtaagagcgttcgtgaacgaataaataattggtcaagaatgaaacttgaagagttaatgcaccatggattggaaactaaattagagataccagtatatagtaatgaaagaatgattgggaaatgtatgtatttaaaggaaaataaacaaatgaatacatattctgctctcacatttataaaagggattactttttcaggagttaccgggacaagcagagcatttcaacacacactagaagaaattaagcttgtttcaccgactgatgctagtgtgtatgtatgtggtgagacaggagtaggaaaggaatatgtcgcgagagcgattcatgaaaatagtccaagaaaagacgggccctttatagctgttaactgcggggtctttgcctaaagaattaatggaaagtgaattgttcggttatgctgaaggtgcgtttacaggtgcgcgacgtcaaggatataaagggaaatttgaacaagcaaacggaggaacattatttttagatgaaattggtgaagtaccaccagagatgcaagtagcattattgcgtgttttacaagaacgcacaataactccaattgggagttcaaaattggtaccagtaaatattcgtattattactgccacacataaagatttactacggttagtagaagaagggaaattccgtcaagatttatattatcgtttgcacgtttatccgttatatgttccatcgttaatagaaagaaaagaggatatcccatattttatacaacacttttgcgaacggaagaattggaatgttgtatttccaaagagtatatacaatcaatttttacaacatacatggcccggaaatattcgggaactagtaaatgtattagaacgcatttacattttgtcgcaaggacgggaaatatgcgaaaaacaagtagattttttgttacaaacaatgaggggaaatcaacaacaacttgagttacaagttgaaaataaaacagaacatacattacattttcgcgaaaaaatacagcgtgatagcatgattgaagcattacaaaagacaaatggaaatgtttcgttagctgcaaaactattaaatgtaccccgtagtacattttataaacgaatgcaaaaatataagttataaagtagatttttgcaatctactttttctttgtgggctcatgttctgtcggaatgtgcgcttaccggggaaataatagaacagttagaaattaatttccgaaagggggacttatgtgaagtatattgaaattggcttcggaaataggtggttcgttcgaacagaaactgaaaataaagatggaactgaatttgaggaacgaggaattataaaacctatttattttgagtctttatatgtacgaatttggtttcggaaaacgtgttttatttttgatacgaaagaagggtttaaaaaaactaagaagaggaggattgaatataaatttatagttggaattgtaagtagactgaataaagaaaaagtgtgctgatatacgttattatattgaccaggaaattctttggacttatattaaattcataaaaagcaattttactaaatataaattgttaataaaaccactaaaaattattatcaagacctaaaagctaaaaatcctaaaaaaataaaggtgagcgcatattagtcatgtataatatgtactcacctttattttcttgttcaaagcacccgttagtcactcatggaacatggaataaagtgtggtattgatttaaaataaagtttgataatttataaaaaagattgataaaaccctgtattaatataagatttttctttcgccccttaaatttcagttgtattgttcaattaaagggccagattgttgaggaaacaggaataataagaatactcaaaagattgtttgtgaagtgctacacttaaactaacgggcagtttagcttaagtacattttttcacaaatttaaagggggatatttccccattttttataccagcttaacgttgattcgggaatgttgaacttcgctacctgctaattgaattctacttcatctggagacctttaa

SEQ ID NO: 949 - DNA, 3186 bp, Bacillus thuringiensis
tatattggcgagcgacatgtacttagtaaataagaacaactggggagttgttagcgccgcccgccagatgggtgtttgaccgacacccatcattaataataacgaattttcgacagaaaggaaagaatagcatgattaaaacaaatgaaattaagcaaaaagatgcattattagaagagattaccgattatgtattaaataaagaggttactagtgcagaagcattcagtacagctcgttacgtattacttgatacacttggatgtggaattttagcactgcaatatccagaatgtacgaaattactaggaccagttgtgccaggaacaatcgtgccaaatggtacacgtgtaccaggtacgtcttatgtactagatccagtaaaaggtgcatttaatatcggatgtatgatccgttggttagactataacgatacttggcttgcagcagagtggggacatccatctgataacctaggcggaattttagcagttgcagattatattagccgtgttcgtatttcagaaggaaaagaagctttaaaagtacgtgaagtattagaaatgatgattaaagcacatgaaattcaaggcgtgcttgctttagaaaacagcttaaacagagttggtcttgaccatgtattatatgtaaaagtagcaacaactgcagtagttgcgaaaatgcttggcggaacacgtgaagaaatctttaatgcattatcacatgcgtggattgataattctagtcttcgtacatatcgtcatgctccaaatacgggctcacgtaaatcatgggctgcaggtgacgcaacgagccgcggtgttcatcttgcaatgactgctctaaaaggtgaaatgggttatccaacagcattatctgcgccaggatggggattccaagatgtattattcaataaacaagaattaaaattagcaagaccactagagtcatatgtaatggaaaatgtattatttaaagtgtcatatccagcagaattccatgcacaaacggctgcagaatgtgcagtgaagttgcatccggaaattaaagagagattagatgaaattgaccgtattacaattacaactcatgaatcagcaattcgtattattgataaagaaggtccattaaataacccagctgatcgtgatcattgcttacaatacattacggcaattggtttattaaaaggagatatcgttgcagacgattatgaagatgcagtagcaaacgatccacgtgtagatgaattacgtaataagatggttgttgttgaaaacaaacagtacagtttagattaccttgacccgaacaagcgctcaatcgccaacgctgttcaagttcactttaaagatggcacagtaacagaaaatgtggaatgtgaatatccacttggtcaccgcttccgtagagacgaagcaattccaaaagttgttcaaaaattcactgcaaatatggcaggtcattattctagtaagcaacaagaacaaattcatgaagtttgtttaaatgaagaaaaactagaaaatatgaatgtaaacgaatttgtagatctattcttaatttaataatagggggaatttagaatggcttgggttgtgaaaaagcagtcaacacaagaggagcttgcgaatcgattccgagctttagtagaagcaaatgaaattttgcaaattccaggtgctcatgacgcaatggcggctttagttgcaaaaaatacaggtttttcagctctttatttatcaggagctgcttatactgcaagtaaaggcttaccagatttaggtatcgtgacgtctactgaagtggctgagagagcaagagatttagtaagagctacagacttacctgttcttgttgacattgatacaggatttggtggtgtactaaatgtggcgagaacagctgtagaaatggtggaagcgaaagtagcagctgtccaaattgaagatcagcaattaccaaaaaaatgtggacatttaaatggtaagaaacttgttactacagaagaattggttcaaaaaattaaagcgattaaagaagttgcaccgagcttatacattgtagcacgtactgatgctcgcggcgttgaaggattagatgaagcaattgaaagagcaaatgcatatgtaaaagcaggtgcagatgcaattttccctgaagcgcttcaatcagaggaagaattccgtctatttaatagtaaggtaaatgcacctttgcttgcgaatatgactgaatttggaaaaactccatattatagtgcagaggaatttgcgaatatgggcttccaaatggttatttatcctgtaacttcacttcgcgttgcagcgaaagcgtatgaaaatgtgtttactttaattaaagaaacaggctctcaaaaagatgcactttctaatatgcaaacgagaagtgaattatacgaaacaatttcatatcatgactttgaagagttagatactggtattgcaaaaacagtattatcagaagatcaatagataaagcagcgaaggcgatgaaaatacatctttggcaaaataaaatgcttgatgtgaaaaatcatcgccttctattttcaaaaaagatattccactcatcgtagacgagcataagcaaaaagctatgaaagccgaatgatagggggatacatatggagaaaacgaagttaccatgggatgaatttttttcacttaataaagatataaatcatacttactttacaccagaagatttttcaggtgatgaagatttaatcgcaaaaacgacagaacaattcgttaaacaagaaattgttccacaaatggagaatattgaacaacataactataaagtttctcgtcaattatttgagaaagctggggaacttggattattaggcattgaggtaccagaagattatggcgggttcgagttaggaaaggctgtctcaggtcttgtagcagagaaaatggggtacgctggtgcgtttagcgtttcttttaatatacacgctggtgtcggtacattgccttacatatattatggaacgaaagagcaaaaagaaaaatatttaccgaaaatcgcatcgggagaatggattggggcttatgctttaacggagccaaatgctggttcggatgcattaagtgcaaaaacaagcgccgaattgaatgaagagggaacagcttgaagttaaatggtgagaagcat

SEQ ID NO: 950 - DNA, 3380 bp, Bacillus thuringiensis
atcccgcaatttaacgtatttacagcattttttgcgattacattactaccatatgcattagtaggtgcaatgaaagatgtaacagcaagaaaaaatataaaggaataatagaggtataatatgctttttcaaaaagaaggtttattgattagatacgtaatggaagatgatgcatctatcatttctaaatggttaacggacccagaagtcctgcggtattacgaaggacgagataatccgcaatctgtagaaaaggtgcttgatcattttatacatagtccaaacagtaatgaaaaaagatgtttaatagaatttgataccattccgattggttacatacaaatgtatccagtggattcagagtggaaagcgttatatggctataaagaatcacaaaatgtatgggggatggaccaatttatcggtgaaccagcctattggggaaagggaattggaacaaaactcgttcaggcagcaattacatatattatgggtgaaatgggagcagaagcaattgcaatggatccgaaagtaaataatgaacgggcaataaagtgttatgaaaaaagtggatttaaaaaagtaaagattttaaaggaacatgagttgcatgaggggaaattagaagattgttggatgatggaatataaacaataataatggcttatacaaacaaagggggatgtgtgaaatgaaaaaagcattaatcgtaattgatgtgcaagcgggtatgtatacagctggaatgccagtacataatgggggaaagtttttacaaacactgcaagagcttattagggaatgtcgttcaaatgatattccagttatttatatccaacataacggtcctaaagaccatccgttagaaaaaggtacggatggatggcgaatccatgcggccatcgctccgcaagaaggagataatatagttgaaaagacgactccagattcattccataatacaaacttaagcgaagtgttacaagagaaaggaattgaacacgttattctttcgggaatgcaaacagagtattgtgtagatacgacaacgcgcagagcatgtagtgaaggatataaagtaacgttagtgagtgatgcacatagtacatttaatacagaagtgttacgtgctgaagatattgtgaaacatcataacgcagtattgggagcgtttgcggatgttgttgaagtaaaagacttaaaagtggctgcctctaaataagaggcagttttcattagaaaaaatagcgtcaaatattgttagtaggtcggtattttgaaataatcacttatataatttcacgtaccataatgaaaaaatacaaaaaaggagcaccacataattaaaaagggcgctcctgcattaaaacgttacttttttttatctttatccaatatatttttgttcttcagcaaactctgtaccatatgcaaagcggcgattaatacgaatgttatcattgttgtgccttgtatgagagttagagaagcgatgaacgattacttcagataaagtgaagacgatggcagaaaggatactgccccatgcaatttgcatatagttgtctaataaaatattaccgaaaatccatacgcttaaatatgttaataagaaatccgacataatggcaccagtattgccaattcgatttaaaatgattttatcaacgaacatgtaggatacgattgtaacaaagagactgaatgaaataatttgaacaaacgttgcagggaaaaataaagcaagcccaatgctaaatgcgataatgcacgatataaacttgataagcactactgtgaaatcattcaaaatttacacctccgatttatacatagtttttcaataaattctggagttcatacattgtaacggatttatttacataaaactttttcatgttcggaatttagtctaaatattataaaaacaatgaaaaaatgttatagtaaaatgagagtgtatgacatttttaggtaagggggaatccaggatgtggattacttcagaagtagaaattccagatgagttaattgatcaccttgagcaaggaaagttagtattatttgttggagcgggagtttctatgaaagggaaatcaaacttaccgaattttgatgatttagttgatgaaattgcaaaaacgttatatgtcgaaaaacgtgaaataacagaaccacatgattattatcttggtaaaattgcgaaaacaaaagatgtacatcaagtcgcaagagatcttgttcatatagagaaatcaaaaccgaatccattgcattatgcaattccaaggctatttcctttagatacagatatccgcattgtaacaacaaattttgatcaacattttacaacagcaattaaagaaataaatagagatatcaatgtttattacgctccagctttaccgactgggagagcttttaaaggtcttgcttatatacatggtaatgtagaacaggagaaagaggctttaattttaacagatggtgattttggaagggcttacttaacggaagggtgggcgagaagatttttagttgatctattctcaaattacaccgttttattcattggatatagtcataatgacccagtaatgaaatatttagcaactggtttaccaccaagtacaagacgatttgcttttgtcgcacaaggagaaaatacgtaccactgggaacatttagggataagaccaattgtgtatccgaataaggtgaataatcatcaatccctcgtaaaagcagtaaaacgctgggctgaattaatgggtgataattatattacgaaaagaatgcgtattcgggatattgtaacggttcccccgtcagtagaacaggaacggattatcatacataaagcaatcgattaaaaaaattgaaacagtacgttactttgtggaatttgctcatgattatgaatgggtcgaatggttagaagcagaaggtaaattacaaaatttgtttatgcttacgctaaactataatgaagtagatgaattacttgcagaatggttagtggaacaatttctttttagtcatcagaaagaattatttcaattaatttataaaaactattctaaaatatcaccgttattatggagaacaatttgtaactacttaaacgaaacgaagagtaagatggacccgctgttgtttgcaaggtggacactccttttattagaaacagctgaaaaagatagtagctctatagaaaagatttctaagctactgcaaaaatgttcttttcctgagcataaagaaattgccttattggtactaacttttattttaaacggaaaactgaagttgaaaacgtgtaagaaaatggggggaatgatacgcaagaatcaatagaactcgaggaatcgagtcgctta

SEQ ID NO: 951 - DNA, 2294 bp, Bacillus thuringiensis
ttaatgttaaataaaatatctcaattcacaattaagctttcgtcaattcttttatcactcttactattattaaatttaccttatttatttatcactcaacaaggatttacctttcaaccaatttatttttttaatcagaccgttactatgttaaaacaggtttttccccctgaatcattagtgattataggatcagacccgaagcttggccatttcaaaaaaacaccattatttccaactgttttagaaccttacctatattcatttactatattatttttagccttttttcttgctctctttttatcatctagcatggcatttttttattttttagcaaaagattatataaaaaaatggataaaccgaattgtgttcatattagaagctgtccctgatatgatgatgatgatttgtttgcaaatatttttcatatgggtacttcagaaatttggggaatctcctgtcactattatttcttttaatgaaaatcgagcttatttactccctattttatcattagctgtcttacctacattacaaatgtttcggatgatggtgttatacataaaagaagagcaaggaaaacattacgtagaggttgcatatggaaaaggcctttcatcaagttatatactatgcattcatttattcaaaaatatatctatccacttcttccaccatttaaaaacgatttttgttttcttactttctaatttattcattttagaatttggttttaatatggaaggcattattcaattatcatttaataaggcgttagcttcacctccagctgcatttatcacactctgcatgattgttttaccattttacgccattttccaaatagtctcattcatgatgaatagatggaaaaagcaattgaaaggagtatcattatgaaatctatttggaaatcaaaacgctttttaatcggctttacttatctattcatacttatttcagctagttttatttatagttggttctttaaagataacatcccaaaacctcctcagttactttacaatgacaataacgaattacttggaaaggccccctttccgccatcgttaattccaccttttggatctgatcgttttggagagtctgttttcttacaaattgtagaaggagcaaaattcactattttattggccatggcaattagcttctttcgaattttatgcggaacatgtataggaatcctcttaagtttatttgctccaaaactcaagagatttttccagtcatgctcagaagttttttattatattccaactctatttatcgcattcatactcatcacgcccgttaatattataatcacatcaaatgctgatggggtagatccaaatatttcatttacgttttatcaagtactcgtacttattttcgtcgctctgcctacactttctttatacatatcctcagaagttgatgaatttatgaaacaagattacatcttaagttcacaattactgggggctagtcgttttcatattataaaaaaacacttacgagtcttattacttgaccgcttatttgtattatttatggaacatatcgtccaaacactcatactcgttatccatttagcgttgcttaacattgtaattggcggcatacaaatgcgtgaactctatgacggagtgctcaaacctgtttctctatctaatgattgggcaggtcttattggattaaatcgtaatgaaatgaatctttcatggtggattattttttatactctcgcttcattctttattacgattctatttattaagcttatgaccatcgggattcaagatgcactgaaagcaagagattcgcaaattgtagcaattcaaaacgttccagatcataaaaaatttgttaaacataaagattccttttcgtttgcaaataaagtaaacctttaatcatttctcattaatcaagtattaattggcatcgatattagtagaaaataaagaagatgatccctattaaatacagggatcatcttcttatactgtctaacttttttacatgtcctttgctagactcatgctttttatatttaaagtgaattatttgcaatcacaattatgttttttaaaatcaattaccatacgcccttgaattctaccttgttccatttcttcgaatacattttgtactttatctagagaacaagtttgaacaaccggcactacttttccttctgccccgaacataaacgccttttccaaatctttacgagttccaactagagaaccaactactttaattccatccaggacaagtcgtgg

SEQ ID NO: 952 - DNA, 2132 bp, Bacillus thuringiensis
gaattatttacattttaaaaaactaaatttaaagcgagaaagtggggataatttgaaagaagattctttatggaaagtaagccttgagagtttgaaaatgagaagtaatatattttttatcattacatctttaagtatctttttagggtccacttattattacaataaaagatttccaaatcacaaatatcctgagtggttagaatttctaaagttgattggatgaataaaagacagaaaaacagaaaattaaaataaacaagttatggaggagctaaaaatgaatattagagaaagtgaacttccgggtattggttataagtttcaaatcgttacgaaaggtaatgaaaagatggtaattgtcattcatgatgatggtcgtagagaaatgtatcattttgattcagaccatgaagaaagcatctcaagtatttcactacgtgactcagaggcaagacaaatcgctgcaatattaggtggaatggtatataagcctagggcgttagaaaatgttgagatggtttttgaaggtttagcgattgagtggttcaaagtggagaatacagctccagcaatcggaaaaacaattggcgatcttgaaataagaaaaacatatagcgtaacaataatcgcggttatgaagaagaacatgaagaagctatttaatccaggaccagaaacagtaattgaagaaggagatatgcttgtagtttcaggtgagagagaagaaattaaaaaaatcattaatgaattactttcaaataggggggactgattagatggatacgttaatttttgaagttggtacagctttagttttagtggcaattgcagcagtaattgctgggaaatttaaattctcagtaattccttttctaatcgttcttggaatgttagtaggaccgcatgcaccgacaataggtgttatcgatctcaaatttattgaaagtgcaagtgtaatttccttccttggacgaattggggttctattccttctattctatctaggattagaattttcaatgaaaaaactaattaaatctggacgctctattgcgattggcggaacgatttatattttaattaacttttcacttggtttgttatacggatttataatgggattcccattactagaaatcttaattattgcgggtattattacgatttcttctagcgctatcgttgctaaagtgttagtggacttaagaagaactggtaataatgaaaccgaattaattttaggaattattatgtttgaagatatattccttgctgtatatttatcagttgtttctggtttagtacttggagatcacgcttccttcttaggtgcccttacttcaattggaattgctttaggatatatgcttctattctttatagtagctagaaaggctacgccgttattaaataaattgctcaatattagctcagatgaaatctttattattgtagtatttgcttcgttattcttcattgctggtttttcagaaacaattcacgttgcagaagcaattggagcacttcttctaggattagttttctctgagacagagcatagtgaccgaattgaacatcttgttgttccatttagagactttttcggagctattttcttcttcagcttcgggttaagtattgatccgttctcattaggcggagcgatatggttaacgttaggtgctgtccttcttacgataatcggtaactttgtagcaggaatgattgcaggaagacaagctggattatctcataaagcatcaacaaatatcggattaacaatcgtttccagaggagagttctccatcattatggctaatatcggtatcgccggtggtttaatgtcagtactgaaaccattctcagcactatacgtgcttatactatccattttaggcccacttctgacaaaagagtcgaagaatgtatataaattcttaaataaaatctttaagtgggatacgaagactaactaaattaaaaacataaaagtacaagatatctcctgcttgtactattattttggtgatgaaaacagtatatagaggtacatgatgttaggagagttgattcattcggttttacgtttttccagacagacttggcaactgcggatttatcttcacatt

SEQ ID NO: 953 - DNA, 2275 bp, Bacillus thuringiensis
aatgtagccaattctaccttttcatttacagtcattacttcacccctattctatattctccttacagtatggcataagaaacataatgttataaaagaaaaagcatcgaacatcgatgctttttctctacttcactttattttttccaacatccttctccatttcatcacttgtcacgtctaaaacatctagtaagaaaatgaagattggaataccgataatcagtccccatacacctaagaagtgctctgagaaaattaataccataaaagtatagaaaatcggtaaatttgttttttgcgacataaacttcggatttaatacgtaactttcaagcgcatgaatcactgttacgataatcaaaatataaacaacgtacataataccgccaatattataagcaatcatacaaagtgggaataaagaaatgataaccccggctactggaattaatccaagcaagaaaatcattaatgctaaacctaataattgcggaaatcctaatatccataatgcgataactgaaagaacacagttaacaacagcaattaaaaattgcgcttcgattacctttccaaatgaacgtgcaaatttctttccgaagtactcaatttcagtatagaaaattgcaagcctgctttctttaaactttgcagtaaaaccgacaatacgagatttttctaataagaaaaacaaactcaaaattaaagaaagtaaaacttgaaggccaaatttaccaacattcgtaattgatttatacaaaatgtctacgccttgtcctacatatttagaaagctccatatgattgacagcattaactgcatacttaattagttcactatctggtgggtttcttaaaaatacattgaattggtaaatcaattgtgaaatttgtatcgttaatactggtaaatatttaaatagcgtaatggcaattccaccaattaacattacatatagaaacgctataataatttttcgattaataggcatgaaatgatctaatttgcgggaaataaacttttggaatcgatccattaaatacgtgagaataaacgtaattaatattaaattcaacatactttgcagcccgtataacacgagagcaagtattactaatacgagtaacctctggaatcctttactttgaaacaggttttttatttgcataatcgacgaatactctctcctgtcctataaactaaaacgttaataagtagatttctctcttttttctacttttaattattattcatattaagatttttataaactcattatatgcctaccttaacaggtatatagtagcttacttcttattttacaatacaatgacctaattcaaaacgtattctacatagtattaatgaagatttaaggaaacttacatttttttaaataggtcttaccactactgtaacataaaaagcaagctatcagtagaaatctgtcctacaaatagcttgcttttcttattttttaagtaagttttactatccaatgaatggtatgaacattgggatgacaactactgttacaactccaactaccgttacagcaatacttgccatcgctgcctctacctcacccatttcaattcctaccgcaactcctaatgcatgacccgctgttccaagtgctaaaccttttgcaatcggatgtttcactctaaatgtttttaagaataatgctcctaatgcgtatacgataactgcgttgaaaataactgcaaacgatgtaattgctggaataccaccaatactttctgaaattggtaacgcaattgctgttgttgctgcttgtggtagcattgaattcattactgctgtatctaaaccgattgcttttgcaacaatgaacacgacaattactgagcaaatagatccaaccacgatagctgataaaatttgccaccaatattttttcaacttatcaacttgtttatagagtgggatagcaaatgcaattgttgctggctctaagaagaaactaatcatttttccgccagtattatattcttcaaaagtaaagttacctacctttagaaagacaatccctaataccatcgctacgaataatggtgtaaataggaagaacccttttgaatgcttgaataataatgtttcgatttcgtatgcgattaatgaaacgacgatttccaaatattggagtcattgagcttgccatgttcattaccttcttacaataattaaaggcaatgtgtacttaacctttacgtgcttgggtccttttattacttattttaaattcattt

SEQ ID NO: 954 - DNA, 3313 bp, Bacillus thuringiensis
caataatatttcttgttgctggtatcaaacttcccattctctcggatctgtctgtgtgaaaaatggatatccaccaattttatgtccttgatctttacataaatcatcatacagttcgcctaattctgtattattttcttcatcaacaatttcttcccaatcaatgttatcactaaaaatcatttcaaatcgataatctcttggtgttactggttgataagctaactcaaaattcagttttgctgcttcaggtatgataaagtcttctaattctaaagtgtttaaataactaaaatcaggaattaccttatttaaatcttctataattgtagaatgataaataattcgaaagtctttttggattgctggatgatcaaaatctgctccataaagctcatcatcagcacttacgaaaaactgtaacattcccttttgaggcatatattcaacatgcggaatttcttcaaagtctaactgcgcaagtagcatgataggttgtccatttgagtcttctggatgctcttgatctataggtaaatacggataaccaccaaacttactctcaaaaagtgttgtctctgctaatgttccagacactttaacatacggttttatactttcttctaaaatactacgatactgctctagttctgtcggaatttgaagttgatacgtattcttcatcacatttgcctccctttagtaatgaattgaaaatgccttacttaattatatagcaagaaatagcttcgtgaaaaattgttaaaagtccgttttcaccctcgttttttgcgcacttggtggacaaagtaaattatgttctaaaacctttttattaatagttcgaattaaatccgctgcttctgccgtatttgtattttcttttagtctttcttttaaatcgtcaatttcttttgaaagctcaatccacctaggcaaaacatgattatttgctaaagttctataaagttgcttttcaggattgtaagaaagatctttatcgagattaagaggtttacctttaccaggtaaattatcaaatgaccctttcttttctgcctctttaacgatagaactaatatgatcctcatacgtataggaccaaactttttcatcttttactaaaatctcttgcttttttagttttttatctagttcttcttgattcatagcttctctctcctttttattttttagtgtcgtttttgtaaattccaatgcccttaatccttcgaatagcttttctcgccaccacacgctaccatgatcgccttgaaactcttcataagtaatttggtattccttttcttttaaagctttatacagacgtctattagccgttaaaagaggtttgttttcaagttctcctactgctatgtaagaatagagatgagtcgcattagaatctattgattaaatttgattttcataatcatcttttttccaatgtacggatccagacattgacaacacatttccgaaaacatgtggattttgaagtgttgcataaaaagctgctaagccaccaagactgaaaccagcaattgttgtatgttttgtttcttgatgcacacgatacttcgcctgaattcacggaagtaattcctccttgaaaaatgcattcattttatcattataagttagctcttctaatcgatcgacaggatctatagcaacagcaatacaagatgggatttcatttttgtaaattaaataattaagctgtttttgcgattggaaggctatgaatgaatgaattcccatcaaatacaatgagaagttcttgaagatgtgaagtgtgagaataatcatgaggcgtataaatatgaattttacgtgtgttatttaaaatcgaactataaaaagaatatgtttcaatctttccggatggataatcatttgaaggaaaacgactgctatactgcacgtccatacctatttttaacacagacgctttattggtaccttctccatcacctctctttctcctttgtagtattctatatgtaattttttcattagaatccctatataaaagtagtcgtaagttatgtgtttagagaagttattgattagaaagatgatcaattgcttgaatagaaagttccaatgattttattcttctttctaacagtgttctttgaggactcccaagctttgacttaacataaatcttttcaattgatggcaacaaaccaattagaacatttcgagcgtctgctaaatcctcttgggtgtaatgatgggtttcttgattccaaatactttctaacatagctaagccgatactagctgctttgagtctttttttcactaatgtagtatttgcacctttttgagtcatctgagatagtgcattttcaagtttacggattgttgactgtaaagactgtatggattctactttatctacatttgatacgtttttcatattaaacctgtcccttcttcgtttctaaattagttttcttgatatttgataataccatttagaagcgaattttactcgaaatatttgagttggacatgaattggaaggaaaacagctaacaagcttctatctcctccctcttacatattttatatgtacttcttttttctcgttaaaatacctacatggacaaggtattaatattgtatattttatgaacaaaaaacgtacaaacagcatcacttgtacgttttaatttttattcagtaagataataaagtaatagcttacgggttttttcataattcatgaaatctctatataaaatgggataatttataatctctgtttctagaaaacgatattgcggaaaccactcaaaaaacgattttcttagccacttaatttgattaaacacaatctcctgttcattattattaaacacgtaacttaaagtacctgctgtatgcatccaataataatttaaatcagcgcttatacaatcatcttctgtaaacgtattattaaaatcttttcttatttttcgaatgtcacaattcggaaacggtttatacagtagactaggcatgttctgcaattcattaaaaataacctttttacctaccactcctttatttctctagccaatttaataagttttcataatgatattgagcatcgatatacccaagattatataaattaacgagcttttccttatttctttctattccgcttataggaagctgtacacttggttgaattacaaaaaaattatctttttgttcttcttgattcatataagatatcgtctcgttataaaaacgataatggtctactaaattctctgcgattttcggatattttctatatagaatttta

SEQ ID NO: 955 - DNA, 2724 bp, Bacillus thuringiensis
atcccccactgattattagccctcaccaatcgggcttttattggcagttaatccccacctaacttctttgcttccgctgaatttttgggtggggatcttactggataaagtttttatatacaggagttgagacagcatgagcatgaaattagtcattctcggcttgctactcgaaggagataaacatccatatgaagtgcagcatattatgaaagaacgacaaatggattgttatattaaatatgctaaaggatcactttattacgccttcgagcaattagaaaagcaaggcgcaattcatattacaaatgtaattagagacacaaatcgacctgacaaaacgatttttcatataacagaagaaggcaaaaaactattccacactttactattaaaacaattcgaagccaaaaaccaaatatataaacctatttattcggccttatctttcgctcactttagcaatgatcacgaattagttcctattttagaaaaaaagaaaaacgatactcttcaatatttacatactatgcaaacgatatatgattgtaataaaggaaaggttccacgtgcacaactatatattttgcaaagtgtaattgagcatattacagttgagttacaatggctaaacaccctccttaaagatgctatagcaggccgactttcagaagttgctatagatgaaaattgagctatgaaagaaggcatccctacttctttcatagctcaatttctctttttatactgtaatattattagttaatccaggatgaaaagtcataataataagaaataaaaacttttgaattttcttatttcaaaacagtagacaaaattccaaaaattgtgttagaatttgtttcaatatcatatcgcttgttaaattcctttcaaaaggaaaataggtacacgaaagtttcgtttcgtgtttaaaagggaagcttggtgaaactccaacacggtcccgccactgtaaatgctgagatttctttttggtgccactgtgaaaacgggaaggtgaaagaaattatatgaagcataagtcaggagacctgcctgttttaacaacactgatagattcacggatgatgatgaggtgttaaaacaaaaaggaaggcttattttctatgtctttgtactttttgttataggtatttcctagtaaacggaaatgcttactttcaattagggaggaatttaaaatggcaattcaaacaagtaacttaggttatccacgtatcggactacaacgagagtggaaaaaaacattggaagctttttggtccaataaaatcgatgaagaacaatttttaacaacaatgaaagaaattcgccttcaacacgtaaaagtacagcaagaaaaagggattgaactcattccaattggcgactttacatattatgatcacgttttggatactgcctatatgctaggatttattccatcacgtttttctgagtttacatcttaccttgatgtatatttcgcaatggcgcgtggctctaaagatcacgtagcttccgaaatgacaaaatggtttaacacaaactatcactatatcgttcctgaatatgaagagggattacaaatctctttaaaagataatcgcccacttcgcttatacgaagaggcaaaacaagaattaggagtagatggaaagcctgttattttaggaccatatactttcttaaaattagctaaaggctatacacaagaacaatttcctaacattttaaaacagttagttgcaccttatgtacaactgctttcagaactacatgcagctggggcacaagccattcaagttgatgaaccgattttcgcttctttaactaaaaaagaagttcaacaagcaaaagaaatttatgaagctattcgtaaagaagttccaaatgcgactcttcttttacaaacatattttgatagcgtagaagaaaactatgaagaaattattacattcccggtatccggtattggattagatttcattcatggtaaagaaggtaatctaaatgctatttcaaaatatggattcccagctgataaaactttagctgtcggttgtatagatggccgtaacatttggagagctgaccttgatgaagttcttgagttatttacaacgttacaaaaacaagtccaaacgaaagatatcatcgttcagccttcttgtagcttattgcatacaccaatcgataaaacagaagaaactcacttatcgactgagctgtttgatgcgttagcatttgcaaatcaaaaattagaagagttagttcttattcattccgctctcactcaaggtacagaaagcattagtaatgagctggaaacatatcgaaacgtacatcatacaattcgttcatctgctgcacgtaaccgagaagatgtcaaagcagcacgaacagcactaaaagaagaagatttttcacgttctcttccatttgaaaaacgatacgaattacaacaagttgctctagagttaccgctattaccaacaacgactattggtagcttcccgcaaacaactgaagttcgtcaaacgcgaaaagaatggcgtaacggtgttatttcaaatgaccaatatgaacaatttattgaaaaagagacagaaaaatggattcgttaccaagaagaaattgggcttgatgtacttgtacatggtgaatttgaaagaactgacatggtcgaatatttttggtgagcgccttgctggtttctca

SEQ ID NO: 956 - DNA, 3367 bp, Bacillus thuringiensis
acacccagatattttttaagtcattattgtttatataaagcatacgaatcttgcaaaaattttagtgaaacaacatttaattcctagttagttatttaaaaatatcataaagatatgtcctttcttttcattaaagacacactaattgtaaagaagcttgtattataaggctgtcctacgattaaaaattaaactgaaatttccgaatagaaaatcatatttccagaaacatatattatgataatttccgcacacttgaattaactttttagaagtactaacctatcggtgagcagaagaaaattctgtaaaaagaaaggagaatactttatgatgaccaaattacaaaaggagttttttaaacgcttagaaattcctgcaaaagaaataacacttgatgatttagatgaaattctcttaaaaatgggaatgatcctcccctatgaaaatcttgatattatggctggtactattaaaaatatctcaaaagataacttaatagaaaagttacttattcaaaaacgaggtggactttgttatgaattaaactccctattgtattattttttaattgattgtgggtttcaagtatacaaagtagccggtactgtttatgacctttacgataataaatggaaacccgatgatggtcatgtcattatcatattaagtcatgaggataaagattatgttgtggatgcaggttatgcatctcatctccctttacatccagtcccttttaacggagaagtcatctcctctcaaacaggagaatatcgaattcgtaagcgaaatactcgaaaaggtacgcatattttagaaatgagaaaaggagctaacggggaatctacaagtttcttacaatctgaaccttcaaacgaatggaaaataggctatgctttcactgtagatccaatagatgagaaaaaagtgaataagattcaaaaagtgattgtagagcataaagaatctccttttaataaaggagctatcacttgtaaattaactacttatggtcacatatcattaacaaataaaaattatacagaaacctttaaaggcaccaaaaataatcgaccaatagaatctaaagattatgctcgcattcttcgtgactcttttggaataacgcaagaaaatatgtaggaaaaacactagaaagaggctagttgactacaagtatttcataataaagcagattctatatttagaatctgctttattttatattttgttataaattaatttaattttgttgttaccctttaattttcaattatatactcatcatcatatttatcgtattgtagccctttccctatctttgactccgtaacttgatctcttaaaaacggtgcagcatccattttactagttgcaatttcaattccatattttttcgttaaatgagctaactctattaaaaaccactctcttcgcaatgtaactggaatatccaatgtttttcttttcatatataatagcacctcttttattttcatagcttaaaaatatcactggatgcacttattaaaactacctttcaccgctaacatccaatgaaacattatagtatatgcatgtccatttcaaacgtgctatcacaaatatgacatttaagtttacataattatattatgtaatagtaggaaaggaaggcatgtcccttcctcttctactatagatttaaattaagaacatcttggtacacctaaagctaaaaataaacctgctactcccgcagtaatcggtacttttaacgtaataacatcatctaccttcgttactaaaaagtaagcattaccttcttgtaatatacaagttaccaacaattgaaattccattcaaatctcctcctttcaattgatatactataatttatgaaatctctttcaaaaagtaataggaaatatatccatttttccttatatataaaataaatgtttatgagtctattaaaaatattaattttctaaatttatacaaaacgtgtaatatccaataaattcctatataatcaataagaagaatcttacaaatagaggtatgaaaatgtcgattttaagtaatattggtgcagctttattttttattgcttttattcttttaatcttatgtatcatttcattctttaagaaaaatggaaaagcaaaacaatatggacgtcctaccgttattctttttatgatttctattatattaataacggccggtacaacaaaatcggaacaccccgtcgtcgagtttttttctactttaagtttcattctatttatattcttccttgttctagcaatcttatctgttattaagaaaacaggtgtagcgaaaaaacaatttattattacagctgtattatttgtcatttttgttgtgttattaggtatttcagctccttcttctgaaaaaacgacagcaactagtacaaaagttgcctctaataatgaagagccaaaagatagcgaacagaaaaaagagctagaaaagaaagaggcggacgaaaaaactcaaaagcaagaagatgagaagcgtctagccgaagaacaagctcgtaagcaagaggatgaaaaacgtcaggctgatgaacaagctcgtaaacaacaagaagaacaaaaacgtcaggctgatgaacaagctcgtaaacaacaagaagaacaaaaacgtcaggctgatgaacaagctcgtaaacaacaagaagaacaaaaagcacagcaagctcaaacacaaccagctaatggtaatactgatagtgcatactacaaaaattgtgctgcagttagagcagctgggaaagctcctttacataaagggcaaccaggttatagctctcatcttgatcgtgatggcgatggaattgcatgtgaaaaatagtaataaaaaagaagcttttactaagcttcttttttattaacgtaaaatattaccacttattactttcccccttattttaataacattcttcttattattctcaaaaacgacacagaataagtgatttcaatcactacatagattttaatttatcgctattcttaattcagatattacattaaaattttatggaggcattcatatggaacatacatttactgaaacttcaattgttggtgagattgttacacaatttccgaaagctagtgatctttttaaatcatatagaatagatttttgttgtggcggtaataagccacttattgatgcaattcatgaaagaaatttatcagctactgaagtgcttacagagttaaatacgctttatcataatacgaaacgattaaatgaatcggaaattgattggaaaaatgcttgttatcgtgaattgattgattatgtcataaataagcatcaccggtatttaaatgaagaa

SEQ ID NO: 957 - DNA, 2345 bp, Bacillus thuringiensis
cggaatataataaaataagtaagcggcgacaaaacaagtttttggcgggtcggttttcgcctcagcacgactcataaaaatataaaaccctaatccgaataaaaacgaaaaaattgtataaaatttcgtttgaataaacatatcgtaaaataggcgaatatagctgtctatcccttcgtaaattcctgaaagatcacgtgagtcaaccccggcgataacaggccaattcacaagaaaaatacctagtacagctattcctctaataatatcgatggagtgtatcctctcgccatgtgtgagattttgcgtcatttttttcctccttgttaagtaattcccttttattatacaaaatgtaagatggaggggataggcgatatttccatttttttaaactgttaagttatgtaggataagatataataagagtgcacaataagttttaccctttttcaaaacaggcagtaaagctccttcttataaggagctttctttatgaaaagtgttgataatgattctctttaatgataaaatatatttaaaattgataatcattatcaaaaaaggttggtgcgtaagtatggtatatacattagtagcaggtacagtcgctgtatatgcagttattgcgaagtatgttttaaatggagtaggaacagcaaaatgagtgatatgacataaaatccctttcatttgtaaaaagaatgaaagggattttttatttttaatgagaatatgctgaaaatttagtatgatagtaaagtgaaactgtaatcaatgggtaggtgtaactctcactggttatgagctcgcaattagcgggaaaaagtatatacatcttggataaaggggaacaagggaatgacaaacatagtacagacaaacggtatgaaaaaacttgtttgtttttatgaagagtggcaaaaacacggcgatgcagagaatagtttaaagttgtttgaggtgattcaaaaatataaacaagaacagcttatgatagcgttctgtggtcacttctctgcggggaaatcaacgatgatgaatcatctatataaagcgcagctgttaccaacaagtccaattccgacaagcgctaacgttgtcaaaattgaaaaaggaatggatcgtgttgttgtaacggttaaatctggagaacagtacgagtatgacggtgcatattcagctgaagaattaaaacaaatttgtaaagatggtgatgaggtaattggtgttcacatttatcggaatgatgcgccaattcctgaaggtgttatgttagtagatacaccagggattgactcaacagatgatgcccatcaattagcgacagaatcaacgctacatctagcagacgtaattttttatatgatggattataatcacgtccaatcggaagtgaatttgcaatttgttaaagaattgaaacaacgtaataaaacggtttatctcgttgtcaatcaaatagataaacataaagaaaatgaattgtcgtttgagaattataaagatagtgtaaagcaatcgttctctaactgggatattgaagtagatgaagtatattatacgtcattacgaatgatgaaccatccacataatgaaattggaagcttagaaacgttaattacatctatcatgaaagaaaaagagcggtatgtaagagagggaatggagagagaaacagaatatttaatgggggaacatttctcgtttattctttctgaaaatgaaaaagctcttttgaaatatgagaaagagttagcatcaccgctttctatttcagagatagttgaaaagaaagcggagctaatggaaacgaaacgtcgcgaggctagtaaagagtctcatgtgagaaatgaatttataaaaggcctacaagctatattagataacgcgtatttaatgccatttgaaatgagagaattggcaaatgcgtacttagaaacgaaattaacaaagtttaaagtcggtttgctatttgcgaaaggaaagacggagcaagaaaaacaaaggcgtgtagaggcgttttattctgcccttcaaaagactgttgaaacgcagcttgattttcatgtgaaggaatttattgtagccttcttaaaagaagaaggattgttcacggaggaaattgggaaagacatatatgggttagaaattgctttcggaccagaaatgttggctgaggtaattaaacaaggcgcaggtttcacaggtgattacttacttctttatacagcggatgtagcgaatgaactaaagaagcgttattttataaaagcacagcaaatttttgataaaagtgcggtcgttttaaagcaaaaggtgagggaagcagttgctcgtattga

SEQ ID NO: 958 - DNA, 3699 bp, Bacillus thuringiensis
gcacaagctgatgcagctgctacttccagctcatcatgtgttgcattttctttaccataacgtaaattctcttctatactacctgagaacaacaaagccttctgaggtacaaaccctattgaagcacggagtttttgcaaatcatatgttttaacatctattccatctatacatatttcaccttgatccacatcatatagacgtggtaacagtttcgctaaggtagatttaccacttccagttgatccaataatccctactttttcacctttttgtatgctaaacgaaatatcttttaaaacgtattcattatttttcgtatagctataactaacatttttaaattcgatattcccctcgattttctcaggttcgattgcattagctgcgcttataatatcaacctcggtatttaacacttgctgtacacgatccgcagatggaaaagctcgcgcaatttgaataaataccatgctaatcgacataagtgacattaaaatgatattcaagtaattaataaatgccaaaatcgctcctacttgaagcgttccattgaatactttttctccaccaatccataatgttgcgacaatcccgccacttacaactagcataatgattggcatcattaaagaaataagttgcacagctcgaatatttatcttcgttaaatttgtatttacacttccgaattgagcgatttcatatttttgtcttacatacgcttttataacacgtacaccagataaattttcttgtaactttgtattcactttgtccaatgcctcttgcacctttttaaatgtaccacttgctttacttgcaattaaaataatcgcaagtaataaaatcggaacaactacaagtaatattggaaataaccctcgcgctgttacaaaaacaataattatacttcccataaataacagtggaccacgaacgagaacacgtaatgtcatcgtcattgccgattgaatggaagtgatatcattcgtcacgatcgttaataatttacctgttccaaatgaatcacgattattactagaaaatgtttctattttcgcaaacacatcttttcgtatgtctgtagcgaaattaacagctgcttttgtagaatacatcatacacccaagccctccaactaaaccgagtgctgctgctcctatcataagaagccccatttttattacataatttaaatcccgatttgcaatcccaacatcaatgatatgttgcataatagtcggttgaattaagtccatcgcaacctcaagtaccataaatagcggtccaataatagcgaagaacatgtatggttttaaatactgtaataacttacgaaatgatttcatacataatctccttttcccatgaaattaccactgaataattcatatccctccttatttaattgatattttttgtaatttcttcattacttttattatattatgcaaattaatatttaacattattaaatgataagtattaatgactttctggtcaataaatgtgctttatattatgtaaatacaaaaaccgcattcttaatgaaaagaatacggttttttcatctatatttcttcaattgtaaaatttaaaaactcagtctcaaatcccttatttttagaaggactacacgtgtaaaaacctattttaataggctcattccctatatcctccattaaatgagcgattcttatttgttcccattgatggctctttttcacatatattgtataatcaccgcgttttcgaataattcgaaaacgaagttgttgcttagctgcttcagttggataatcttgcgttgaccagtcagaatatccattattcgttacgacagctcctaaatgagaagggccatctggaatatactctaatgaagttttcaaccaacacttttccgaaatcataacaaaaagacctgcttgatcgtattttgaatttggattcatacacaattgtacttcagcttgaaagtctgtcatcatttcattataaaatacatgaccattcatgacttcaaaaccataatgtgttttaagccaaaaatctgtttctgctttcgaacggacaataaacgcctgcttgtcattaattttataatattcagggacattcattatagtgagctgctcaacatgtttaggtatatatgatatattcatagttcctccataataaaacctttatacaaatatttaaaactccgctaatactgggaatttataacctttaaaatctaactctttatcacttcgaaccattaaatacttgctagactgtaattctgtaaactgtacatcctcaacccctaattgatccggtgaaaaataaaattcgatttccgtaaacctttcattgatttctccacataattcatctaaaaccggaagtactggcgcaaatactccaaataatttcaacttttcattgtctacttcataaacgagtaaagcatctagtttctctgaataatacaatttctcattccattccgaatcatacatattcaaataaaatgaaggtgggaagtttaaagtcgaaaaactatttgaaagcctttggctactatcaatcgtttcatgtattaactgtctattctctatattatagaaatctaactttttaagtagtgaatggttattattaatatttttatcatatggtatagtcatcaaatattcctgcacaactttaaatccaaatgctgtatatagttcaggtttttccgtaaacaataatgcacattcacatttcttatcaatttcttctatcattttactcattaattgtgtcattagcccttgtctacggaaattagggtgtgtcattactgattgaatacccgccgcatttattttttcaccattaattaataatgggagtgaaaatgccgcaacatttgcaatcactttatcttcttgtaaaaatgataaagctttatatgtatcatcccaatatcctttatccgaaaaatcattcaatgtttgagttgtaattccaaacacttcttcaaataaaggaaataactgctctcttttcggttcttctattagaagacttgccaatttttcaacattccccatgttgtacctccaaatgttaaattccattaaattagatatacttatatgacctactcttaaaaatagaggtcttaccaatcaatatactatcataaaacataaaaaaaagtctaattaattttatgtttcgactatttgaaaataagtcgaataaaaaaatattaagattttcggatattaattagtttattttataaaaatagcgctttctaattagcttttactaatagaaatacactatttataataaaatatttttattcttttatcccttcaagtctttccttcgtattaatttcttctccacttatacgcttttcaaaagactttctccaactatttgaaagtgcatttacttctaatatcctttttaccccttcaatattttgtttttccttatgcataatacggttagcgaatgctactgaaacaccttttggatcagactgtagtctttttaaggtgtcgactgatgatacccatccttcttttaatacacgaaaataaaatcctgtatatcctgtttcttgaaaatatagtggtaactttggaatattatatttttttgctaatttaaaacaaggttgccttggttgtgtaacctgta

SEQ ID NO: 959 - DNA, 4618 bp, Bacillus thuringiensis
tgttagcgatacctacaaaaacgaatgataatatattttttataaattattcatttgataaaggtaatacatggcatactccaaatcgaaaaataaacactagtaaagttgctatttcttttttcagtgcacattatggttgggttataaatagtgagaacggagatgtgtatcaagtaaagaaaaaagcatcggaatggataaaattatcaagtaatccgttgttaaaaaatgtattttgtttacattttataaatgagcatagtggctgggcttgtagtaaagaagaaatatttactacaacagataggggtataacctggaagaaagtgttatataaaattaatcatattgataaattaacttaaaaaagagtcctaaaaaattaggactttttttatgatttttaaaaggcgagagttgtaatatacataattagaagggggaaggataaaagcgtaaagcatatattttcaaaaaaatggacgtttgttttttacacagtacaatccatttttgaatatattgataaagtagcaaatttagagggaatagtaatacttaatattttatgttcatattaatgatgccacatggtgtgtaaaaaagggggattgtaatgagatcattaacagttattatttcgtatagtgatagagcacaaatattagaagatttaattaaaaatgtatgggagctaaacccaattgaaattattgttatgctccctaatgatagaagtaaattatatgaaatagcaaagaaatatagatgccgaattgttttgacagagaaatatagtgggcattatcgcggatatgaagcttttataaaggaagcaagaggagatgctttattatttttagatggtaaattttcattatctacagatgaaatgaagggatttattgaaccaattgttacaaatcaggctgatgtaattttgaataaaatagataagtttatagaaatagataaatgtccgaatgtggatattgtatggagaaaaatgttaaatgaaattttaggtcggccagatttaaaatgcaattcaatgctttcattaccatatgtgcttacgaaggaagtattggttaatatcggttgtgattttatagaagatgccattctttctcatatcaagattgtgagtcaagggtggcggattagcgatcaatatgcaataaacactttatctaaagatgaaactttagaagaaaaaggatatttaataaaaaaggaactatcaaaaaatgaaaaagagaaagtgaaaaaatatctaattggaatatctaaagggatagaggaaaaagggagaagaggagggtttactgatgcaggaaaaagaagagatattattcaaaggttaggtgaattaaaacaatacccttgttatcatcaaggttttgggatgcattcttcaatttatggtggaaagcaactttctgtaattataccggtgcaggatgaagaagaaactatagaacaagtgatacttgagactagaaaaatagaaccgctagaaattattgttgttgtaaatgggtcaacagataataccgccaatattgctaaaagtcttggtgctactgttattaaatataacgagcgacttggccataatgttggacgtgcaattggggcacttgaagcgataggagatattctcttatttattgatggtgattttagtatttcaggaagtgatttgcattgctttacgcaagcagtctcagatggtgtagatatagcattaaataatctaaatccaagtttaaatccgcctttttatattgttgatattgtaaagtatatgcttaatttagcatataatcgtcctgaattaagtaatggttcgttagtagctattccacatgcaatgagtagatcatgtttagatgcaataggatgggaaactttattatgccctagccttgctcaagtgaaagctatattacaaggatacagagtagagtgtgtgcactatgtagatgttgtaaagccgaatagaattcgtttaaaagaacatgtagattacactgggcatcctccagcagtattaagaattctgggtgatcatattgaagcactctcctacttaatagaaaagttagattagggcaatgagttatataagagaattggtgaggtgtaaaaatgaagaaattactttccataatcatattagttgaatatgaaataggtttgttaaatgaaattattcagagtgctaaaagtttatttccatatgagattattatagtaataaatgagaagcgaaacataaacaaaaaaactctaactgaatctggagttaaatgtattagaagtgattcagaaaatatgccgtgttataggggcaaaaaaagccaaaggagatatattggttatttttagatgatagtaatagtatttctgcatgtgaacttaaacaatttatgcaacctgctattaaagataatgcagatgtggctttaaataacttgcactctttctttattgaaagacagaaaaaagaatttccaggtgctaatattatttggagacaaattataaatgaagtgttaggagcgaatgaattaaaaataaattctttgctctctttaccaaatataattacaaaaaaagctttacaagaaattaaatatgaaactcttaaaaaccctgttttggcgcaaataagacttattgaagaagaaaaaaagtttagttgccattactttatagaaacacaattggctaaagagttttgtttagaagaaagagcattaaatgaaagatcattagtagatatagaaaagaaaaatatgaacaaacacttagttgctatggcagaatggttaatgaaaactggaattaggggaatgtatcatgatgttacaagaaatcgaaaacttgtaaatattcttaaaaaacataataccatccctttttcacaaaaaggatggggaattcaatcacaaaaatataacggaaaacaattgtctgtaattatacccgctcagaatgaggaagcaacaattggacaagtaatttgtgaagtgagaaaaattgagcccctagaaattattgtcgttgtaaatggttccacagataatacagcaaatgttgctacgcaacttggtgctactgttattacgtataaaaatccgttagggcatgatgtgggaagagcaattggcactgtagcagcaaagggagatattcttttatttttagatggtgatcttgttgtttctgcaaaagatctatatccatttccacaagctattgcagatggatgtgatgttgccttaaatgatttaaatccctttttatgtaaacattttccccttcatattgtcaccttatttaaatacgcgttgaacttagcatgtgatagaaaagatttaggtgtaggttcacttacagcaattccacatgcaattagtaaacaatttataaatgatatcggatgggatatattactctgtccaagcgttgcgcaggtaaacgctattttaaatgattacaagatagaatgtgtacattatgtagacgtaattaaaaataatcggctccgcccgaatgaaaatgttgtagcgaaaggaatttctccaactatatcactcattctgggagatcatttggagggtttctcttatttgttgaatcatagcaaaatgtaagtatattttagatagatgggaagggtgattaaactgttagatcagtataaaaaaatcaatatttcatatgaacaattacagcaaatgaattttcaaactacggaaccttttatactcaaaattgattgggataaagtagcttatgaatttttaattcgtattaagcataatgcttccaatgttattgtttttggctctggagcaggtggttttcaagaacaaccaattggtccacctatttttcatagacattcttggatggaagaatttgaagatactgttatatattataatgatcctactttatatcatggagaaatatctttaggttggggacagggggagttagatagattttatttacaagatatcgcaaatattttaaaactattattgataaagttgcaagttgattcgaaaaatgtgttgttttatggaagttccgggggaggatttatgtctttaatattagctggtttcgtaaagggttccacagctttagttaataatcctcaaacaaatttaatgaaatggatacctgtaccggtaaatcaagttttcaatttatcttatccaggcttatcaagagaagaaattgaagagaaatttggcgaaagaattaacatcacggatttttttaagagtattgaatacgttccaaatatttattttttacaaaatgtcgcatgtgaatttgatgtgcaaaatcacttactaccatttatttctgggttagagcaaatggatgaaaatacggaagtgaatcaaattttagtagacttatatttcgacaagaaagcagggcatgcagctttagagaagaatgaaacgattgaatatataaaaaaggtaaaacctaatcagactgtaagagaggtgaaagacggagtggaattgtcagtcgttattgtcgtgggagaagcaaagtcgaaattaaatcgaatttagag

SEQ ID NO: 960 - DNA, 2858 bp, Bacillus thuringiensis
ttgtcatgaatacacgagaatgaataatgtattaattggctttttaaaagaggataaagaccgagtggctgtattaacagaaatagaaccaaataaaaaatacgagatcgactacataccaaaaccggacgtatatttttcattattaacacgcattcctttcttattgagagaaccgagggaaatagaagatacatttttctcaaagagaatgacagaggcagaacaacaaacatttgaggaaaaagatttatcaaataaagacgttatagcgatagaaacgtatacgaggcctcgaagtaatagaggaggaaaatgggaatgtttcttatattttactgaaggagaagatttcgttcaaatagatgtagatcgtaatcgatatgactgggtgagcctctatgcggttaataagaaattgtatgacgtgttaaaaatgccatataaaaagttaattgacccgagacaattctcgttaggaggtattcaataatgcaagtatcaatgggagatagtggttctggtggtggagaagaagtattagttaattttcaagaactacttgatatagtaatgaagttagaaaatatatataaaatccatgtagacgtcattggaacgaatattgagagtttattaagctgtaatttttatcaaaaaggtgaagcgatgagagtaattgaaaaatatcctgatatattacacaaaacactagaattggctgaacactattctaggtcagcgacagttgtaggaaatgtatgtgtagaaatgcttgaaaaggacgaacaattacgtgaaatattaagtaagttgtagaaatcaccatacggctggggggatgaaaacgagatggatgtgaaatatagacctgaaccatggcaaaacatgggggatggtatgaatcgaattacaaaagatgcactcataaaattacgggaagcaaatgaatcattaaaaagaattgatggaagaatacgagatttagactcggatggtagtatacattttaatcctaaagatcaatcgcaaaaaatcggggaattacttgatagctattcgacattacaaaaatattgcggagaagcagggcgattagtatctgaacatatagataaaccttttttagtagaaatggataaattcgctcaaaaaatgagagatacatctattctcagttttgaaacaaataaccgaattggctctacaacaacgacagtattaccaggtgcgcatgcaggctacggaagtgtaccacaaacaatacagaagaagaaagataaaataacagtagaagatatttttagagattcacctgcatttgataacgtacttagggcagaatacaaagaactaaaaaaacataatccagatgcaaaattaaattatgaagaatacaagaaagtaatgccatccacacgaggatttgaatacaaatcgatagaagatgaacagaaaaaactagaaatggtgcgagacataggaataggagtaggaatcatcatcacaacaatcctttgtccaccactcggggccgctgccgcagtagtatacggaggtgtacaaataaaaagcggtatcgacggagaagactggggaacacataggaaattgagccaagaagagcgggtaggaaacatcatttttggcggattagatgcaatcccagttgttggagcagtaggaaaaggagtaaaagcattcaaagggacgagtgaattagctgatttagccaaattattaaaattcaaagaaggaatgcctggttttaatccaaatttgggtggaaatgtggtacaatcgcttaaggaaaataagactttaaaaaatgcactagatgctatgaaaaatactcctattccagtagcagttaggatggtggatactggaataggaatgaggcttccttatatagaatcttcaactgttggagaagtagctggaaagttttcaaaggtaagtacggcagctaaggatgacgcttatcaacttgctaagggtagtggtggttcaggagttagtaaggaaggtagtgtagctaagggtacgggtaatagtcgaatagattatttacgtaataaatatggaaaatttacttcgaaagaattgaattataggattaacttacgcggcgaaacacttaaggaattgcaaaagttaaaggatacggggataagtaagaaaaaaattggtccagcctttgctggagtgtatgataaaacaactggtaaaatttattatgcgataaatgactacgatggaatattgcccgatttccatcctttaataaagtcaagatatgattctatgccacaagaagttattgattcatatacatttacaaaaggtgcaggttcacacgctgaagtaattgccttgaataaagcattaaaggctaatccaagtgctggtttggataattttgttatcaatgtaattcgtacgggtcaaaatagaacaaaaccagctggaatgatgtttctaaggtgtcctcattgtgcttatcttacagatgaatttgaaataatcacggaggtttcaaaaaatgttaaatgatatattaacgaaggaatatataatacagaacggcctagagtttgaggagtacttagaatacggagggccttatgatttaggaatagtagagtatactgatgatggaaaagaaaaattatttactggattagcttacgatatttatgaaaatgggaatatagaaagttatttctacgtagaaaatggtgctcaacaaggaaaatatgtggaattttatccgagtggtaatataaaaaggataggaaatatgaataaaaactcggcagaaggctacccaggtggaattctttgaaaacaggggc

SEQ ID NO: 961 - DNA, 4288 bp, Bacillus thuringiensis
gcttttttcacccaacgttcatcctgtctctttaaaattttccgatttactttttcttcttttaataggaaagggcccttgcggatgtttcccgaatacttttgttacgttttcaacacgcacctttgtattatccatgtcactactccttttctacccatctattcacatagtgttgcgattttacaaagaaatattacataaaaatgacattcataagatttctttaaaattctcgtttccgttcataataagaatgcttacttatacatttattttataaggcaaacgttacttaggaggttttcgatgcgaaagaaaatttggtttatatgccttgcattatttattactatgattttcacttcatgtaatgcaacaaatgcaaattcgaaaggaaaaattaaacttggtgtaacaagttggaaagaaaatattgcaaccgcaaacatgtggaaagttttattagaagaaaaaggctacaaagttgagctcatgtatttagaaaaagccgcaatttggactggtgtcgctcgtggtgatgttgatgcgaatttagaagtatggctaccagttacagataaaccgctaaacgatcgttataaagatgatattgtcttaaaatcaaaatggtacgaaggtactggactaggtttagtcgtcccttcttatatgaaaaacataaacagtatcgaagatttaaatgctcataaagatgaactagagaataaaattgtcggtatcgaacccggtagtagtcttatgaatttaacgaataaagcaatgaaagaatatgatataaaactaaaacttgtccaatcctctgaagctgcgatgatgagtgaactaaagaaagcatatacgaaaaagaaaccaatcgctgttacgctttggaatccgcattggggcttttcagaatttgacttaaaatatttaaaagaccctaagaaagtatatggtgaaaaagatgacatttattactctgttcgtaaaggtttcgaaaaagaccatccggatatcataaaatactttgacaaatggaagatgaacgatgaacagcttggtacattaatggtcgagttaaataaaacgaaagatcccgaagaagcggcgcgaaaatggattaagaagaatcaagcgctagttaatgaatggataaaagattaataaaaataggctagagggttaggatatcctctagcctgttttcaacttattttttcgtaacaacgtcatctacaatcccatatgccttcgcttcttctgcagtcataaaataatctctttctgtatcatgtgctactctttcaatcggttgccccgttttttctgcaatcattttattaatatcatgctttaactttaatattcttttcgcagttatttcaatttctgttgcttgcccttgtgcaccaccaagcggctgatgaatcataatttcactgttagggagagcaaaccgttttccttttgctcctgataataataacaatgcaccgaatgatgccgcaaagcccatgcatagcgtttgcacatctggtttaattaaattcatcgtatctaatattgcaaaacctgctgtcgttgaaccgccagggctattgatgtataagaatatatctttttctgcatcttctgcttctaaaaataataattgcgctacgacactactcgctacttgatcattaatttctgagccgataataataatgcgggcttttaataaccttgaatatatatcatatggaacggtctcctaatgttgtttggtctactacatatggagatgcattcattttaaatccctccaatacttgttatgctgcgtaaagcatataactgtagggcgaaggggttttcacattaaataataagactggctggttagatggtactttagtaagggcaagtgtcgaaagaagcttcgttaataattttggtctttcctcacgaatagatgttacagcaacttcaatatcctctgtgaattcgactatctcaatcccttcttcacttacagttttcagcctatttctactccgaaataaagaagctttcactgcaccttctgatacagaacacactttagcaatatcagcgatactatattgaaaaacatcttttaataataaaattgcggattgctgtacatttaatgaagacaatactttccctaccatttcatgcaaatctgcaatgttctcatgtggttcttcaaaagtgatttgtcctcttattttttcatgaacagacttagacttcatctgatctaaccaacgatttcttgctattttatagacgagtgtcatacaaatatctttatttctatattttcgaagcactttacacactgtttcttgggcgagatcttccccatcccatttgtttttcgttaaaaaagtacagtatctttttaactctccatattgttcaattaaaaagtttatatttgaatgattcatatcgatatgattctttaaaacatgagttacttttgtgcacaaaataaccactccttttcagcgcttacttaataaacgattcaacattaaaaaaagttacggggatataaaaaaataatgtttatgttcaataattcgcggtcataaatatgttatgtacaattttacgtgaggaggaacaaatttgccaaaattaacaattgaaggtgcgggaacttttgatgtgaaagaaggaacaaagttagtattagcaattgaagatagcggtgtcaacattcttcatcgttgcggcgggaatgcacgttgtacaacttgtggagtagaaatactagcaggtgatttctgtgaagcgagtgcgaatgagaaacatgcattgacggagaaaggaattgaagatcatttacgattatcttgtcaaatgcgtgtacataaagatatagtcgttcgtccggtacttacagttgaaaattcaggtcttgatgctgggccacgcccggcggagtaaagtgatgaatttaaaacagctcgctggcgaatatgctgctaactttgtaaatgatggcatgaaaattgggcttggtacaggttctactgtatattggacaatacaaaaattaggtgaacgtgtaaaagaaggattatcatttcaagctgtaccaacatcaaaggaaactgaagcattagcacagcaactaaatatccccctaatttcgttaaacgacgtacaaagccttgatcttacaattgatggagcggatgaaattgattcaaatttacaacttataaaaggcggtggtggtgcattacttcgtgaaaaaatcgttgcctcttcctctaaagaactaattatcattgctgatgaatcgaaatttgtaacacatttaggtaattttccattacctgttgaaatcatccctttttcatggaaacaaaccgaaaataaaattcagtctttagggtgtcaaacaacgttacgtttgaaaaatgatgaaacttatataaccgataacaataacctgattatcgattgtatattccctaatcatatttctaatcctgcccatttacacacccaattaaaaatgattactggtgtagttgaaacagggttgtttataagtatgacgagtacagcaattattggtactaaaaatgggataaagaaattgtaataaaagctaactttttaaagttggctttttagtatgttcttcttctcttaatagtgctttattatgatatactaggaaaacgcaaactgattacactagaaaggactgaacattttgcaatccaaacttataacagaacttgctgatttagaaactgcctttcatattcgaaaagaagtatttgtaaaagaacaaggtgtccctcttgcagatgaattcgatacattcgatgaaatcggagagcaatgtaaacatattttagtttattatcatgaacttcctgtaggcacaggtcgtatacgatttgttgatggtgtcggaaaattagaacgtatttgtattttaaaagattatcgtacatacggattaggtaaagtcatcattcaaacgttagaagaacttgctcgtaacgaacaagttacgaaagtgaaactacacggtcaaacacaagctgaaggattttataaaaaattagactatgaaacttcttctgatatatttatggaagatggcattccgcacatacttatgacgaaaatgttatcataataaaaagggtagtatatgaatcttatgtattcatacactacccttttttattaatagaaaagtgaattctcaagaaaaccttttgcatcaaagcccatcatctct

SEQ ID NO: 962 - DNA, 2294 bp, Bacillus thuringiensis
tattttcagatacatcgtaaaagttgattatagttttattcctttggaagttttccatctggactaattaatgctgcagagaattcatctgtaaacatgttacgaattaacccatctacattttcttttgttacagtgtttacactttcgataatctcatcaagtgaacgatgcttacgaagtagcaattcatttttaccattacggctcatacgactattcgtactttctaaacttaacattaagtttccttttaattgctctttactattaataagctctttttctgtaatacctgtatttttcaatgtttctaatgtttcttgcattgtttcatacagtgtatctaattgttgactacctgttccaccatacagtgttaacatacctgtatcttcataagaagaatggtaagaaaatactgagtaagctaacccacgttgctcacgtacttcttggaataaacggctactcatactaccgcctaaaacgttatttaatacaattaagttataaatatcttcgtgtcccatttgtaagcctttatatcctaaacataaatgagcttgttctgtttcctttttacgtgctactttgttaaaatggaaaattggactatgtacttgttcgcgatttgttgttccttcataactaccgaaatattgctctaccgtttgtaagaaggcttcatcaatatttcctgcaactgaaacaactacattttcaggtgtataatgatccttaatatattggcgtagcgtatcacctgtaaacgtatcaagtgtttcttctgttcctaaaataggatatccaagcggatgcgtttcatatgttgctttcgttaacatatcatgcacaatatcgtctggagcatcttcgtacattttaatttcttcacatacgacattcttctcttttttcaattcttcttcatcaaatgttgaattaaagaacatgtcagctaatacatctaaagcatatttagcatgttcatctagcacttttgcatagtaacaagtgtactcttttgaagtaaaagcattcacttgcccaccaatactatcaaatgattctgcaatttcgcgtgcactacgtgtttctgtccctttaaagaacatatgctctaaaaagtgagaaatcccgttatttttttcattttcatttcttgatcccgcatggatccaaataccaatcgcaaccgatcttacagttggtatattctccataactattcttacaccatttttacaagtatattttttaatcaaaaactttcctcctactgccagtttctctaaataagtgctattatttaatgataacaagtttaaggatgaatgtcatgcaaatgtatttaatccacacgtttttcatccagtaattctgttatattccctactttatatccttgttccttcaattttttaatcattgtatctaatgcttctgccgttgacgaagtaggatgcattaatacgatagcacctgggtgtatttttctcattactctctgcaatagtacatctggctcaggtcgcttccaatcgattgtatcgacagtccacataatcgttcccatttggaaatcatcagcgattttcacgacttcatcccgaaaacttccactcggcggggcaaaccatctcaccttttgattcgtagcagcttcaatcattcgatttgttttttgtaactgctctcgtatttcatcagacgatagcgttttcatattagggtgcgtataagaatgatttccgacttcttgatttgcatcgacaatcatttttgcaaatcgtaaattttctttcacccaacgtccttctaaaaagaaagtcgccttcacatcatgctttttcaatatttctaatatacgaggcaaatactcgtttccccatgccacatttattgttaatcccaccatctttttattcggatgccccctataaattggagcaggtgataaatcttctaagtggacactcggtgatacttccttaaattcaaggtgtttttgatcaaattcctttagcttcttcatattgttataggatgcttccatatcaacttgtcttccattatatcctggtgttgctttccatatcttatcaatcatcgcattttgaggtgcaatctcatattgttttgcatgcttttgaatttcttcatataagttatcctgtgcaaaaacagaataagagcctaaactgacatataaagaaaatatacatatgtatgccaatatacgaactttcatataaaccctcccaaattaactatataaaaaaacattatct

SEQ ID NO: 963 - DNA, 2335 bp, Bacillus thuringiensis
aaaggtttgctgctttttcaattccccatgctccttctccataataaatattacttacatataattttaaaatttcatccttcgtaaatgtgcgttcaatttttttcgtataaaaaatctctttccacttacgagaaaatgtacgttcatttgttaaaaaggcatttttagatagctgttgtgtaatcgtacttcctccttgcacgacaccaccagcctttatattctcaactgaggccctaataattgctatataatctaaaccgttatgatgataaaatcttttatcttctgtcgcaataaatgcatgtgttaatgattctggcacctctaacttagccggtacatgtaatttactaatatcacttttctcaatcattacatttccaacgaataataacgtacaacttaacaataataataatataatggctttataaaaaagtttagtcattggatttaatgcaactttttgatgatagttcaccctagataatactcgttctttcatcttgaacacctcttttccacacagcatataactcttactttaagaatacattgttgtaaaaaaatatcccatcgatttctcttacacgtaccttacatcattgtaaggtataaagtgaaactttaatgagccctcatcaatcaagcttactgcccagcaaatagtgggataaaaaagtattgtatcacagtatttttttatctactattcatctgaaatattgaatataggttatgttaaagcacgaataaccaataaaagagaaacccttaagactattatattttcactttacactttaattatatcatctacaaatatatatacttttgactatctagtaatctaaatgtatataacatatagatttattatacagaacaaatgttctgcaaatcaatactagtgctattattattttgacctttttcttaaacagtatacaaaaaagagtagtgattcgaatgtatctcaaatcggctactcttttctttacaatcttcctattaaattatacggctgtacttcccacgtttcatacggaataaaatgtgttgctctcattgcatcaagcgttctggatttcatatgaggacgcgttatatactcatctatgttctcttcatttaaatcaacaaatttacccacttgtatctcttcgggttgagtttttatttcaccacttatatatgctactttaaaaacaacagctagaatatgcatagaggtattataataaacccctgtaattccgataggcttcaccgttaaccctgtttcctcttttatttccctacagacagcttgatcgagcgcttcgccttcttctacctgtcctcctggcaactcccacgtatcagctcgccagtgcacttttgttaataacacttcatttttttcatttgttaaataacctgctacagcaactatatgctttggtgtcttatgttccatattaagcctcctagagataatgaatattttgtatatccctataatcatattcactacctacaacaaaatacctttaatacttcatcaccttaattaacttcataaaaaagaccctatccgctaagcgaaaagggtcatctatcgtattactctcctaagtctacgttgtgataaacttgttgaacatcttccaaatcttctaatgcatcaaccattttctcaaattgtgcttgagcatcttcaggaagtgttacatcactttgtgcaagcattgttaattctgcaactgtaaactcctcaacgccagcacctttaagtgcagattgtactgcatggaattgatctggttcagcatacacgataacagaatcttcttcttctagaatgtcacgtgcatctacatctgcttccattaaaatttcaagaacttcatctgatgttttaccttcaaggccgataacagctgtcgcatcaaacatgtaagctacagaaccgttcacacccatattaccactgtttttgctaaatgcagctcgtacatctgctgcagtacggtttacgttatttgtaagtgtatctacaataaccatagctccatttggtccgaatccttcataacgaagctcgtcataattttcttctgaaccgccttttgctttttcaactgcacgatcaataattgttcttggaacattgtatgttttcgcacgctctaatacaactcttagcgcttggtttgattctggatctggctcgccttgttttgctgccacataaatttcacgcccaaatttcgcgtatatacggcttgtatttgcatcttttgatgcttttttgtctttaatattggtccatttacggcccatactt

SEQ ID NO: 964 - DNA, 2610 bp, Bacillus thuringiensis
gtatgcgttaatgccagtagaatgcccagcttcgttcatgattttcgtttcaagctgcggccaaaaatataacatttcttcgcgcatcatcgttaatatatcacgctgccaatcttctaactcacggctatattcttcaataaagagaagtaaatccttctctggttgcggtgggattttcttctttttacgtatattagagcgctcttgttttttatttcggttatctaaattccataaatcatcgtattgcgatacctttttcttttctacttcttcctcttctaaatcatcaatactccatgcgagcttcggacgcataagcgacggatcaatatgctcttgaatggcaagtacggcatctaaaaatgtttctacctctgcttttccatacttatgctcataagctttcacacggtccgctgttgcggccatactctctaccatatctcgcttcgtatttgaaaaacgaatattatttttgaagaagtcacagtgtgctaaaacgtgcgctacaattaatttgttttgaattaaagagttcgtatctaataaaaaggcgtaacatggatcagagttaataacgagttcgtatattttactaagtcctaaatcgtattgtaatttcattctgaaaaattgttttccaaaactccaatgtgaaaaccttgtcggcatcccatatgcaccaaatgtataaataatttccgctggacatatttcataacgcatcggataaaaatcaagcccaaatccagtcgcaatttccgtaatttccgcaatcgcatattgcagtgctttatcgtcacttgctctcattattttccctccttacactttcccttaagaaagtgtatgatgaagaacaagctttcatgaggattgattgcataataaaaagacacccccgcaaaaacgagaatgtctcatctattaaccttcaataatctccatcttctccgtaatcggagtacgtgcttttccttctggcgctttatcgaaatagccgatatgaagaattccaacgatacgttggcctcttgttaaaccgattccttctataaataatggattgtagtttaatccgcctgatttccaaacgcaacctaatccgcgttcccaagcaagaagttggaagttttgcatgaatgcacatgttgcagcataatcttcatcacgttgaatttgacgcggatcttcatttatatatacaacgatttgtgcaggcgtgcttaaaaaacgatctgataaaattttaccgcgtttcgctctttcttcttccgtaaaagagtttaatactgcatctactaatttcttgcggccttctccgatgtatagtttacaattccatggttcacggtgcttatgatttggtgcccatgttgcatcgtttaatagttcaattaataaatctttttctactgctttgtctgtaaatgtacgaacagagcgtctttctttaatcacattagcgatggaagtatatgtagtcatatttatctctcccttatttttatctatatgtataagtttatcgtcatcattgatattgattttcaatttcgattataccttagttttttactattaatcaatgttttatgttggaaaacttctaaaaacgtcatttcatactgtgaataaaaaaacttgatttgttcacaagtatttcacattttatggaaatgatatatgtacagttttctacattatccatctaggaggagtttacatgtacaaaaaaatcgctgtttgtatgactatggcagcattattatgcgggatatccaccttccctacatccgctgccacaccaaaagaagtaacaatgcatcaccataaaccaattccagaagaagaaatgcaatcgctagaaaaactcggctataacaaacatgaaatttggaaagctgctcatattgcaagaattagtaataaagaaataaaagatgttttagcttactataagcaaaataaatcttgggagaaaacagccgagcatttcggtgtagatccaagtaagctgaaaaagcatcatatgaataaagaaacaaagcaagcactgctacaacagttagcaactatgcaaaaatccacacctgatcagctaaagcaaaaaatgaaagaatataacatcaaattgcgtcatcttactgtgttaacaatcatctctcaaaaaagcaatacccctcttgatgatgtattaaaaatgaaaaaagatggaatggacattaaacaaattgccgaaaaattaaatgtaaaaagagaagatatacgagcggaaatgatgaaattagtgaagtctattaaagaacaaaaaacaaattaaaatgctaaaaaggaagaggctttcactaaaatgtaccctatagaatagacacttgaaaaaagtctattctatagggtatttcttgtataataaaaggaaaattgggatcggagaatgttgaaaatgacaaaaaaactatctacagaaagagaaattcaaattctattaaataacctatacgtaaaatctgtaagtcagaaaggtatcacttatacagaggaatttaagcatatttttattgaggaaatgaaaaaggaagctaccttgaaaatttttgaaga

SEQ ID NO: 965 - DNA, 3183 bp, Bacillus thuringiensis
agttataaaaaggaatggtgtgtacgatattagcgataaaatctggtatcatttccacattatcaagtgcatgaatacagctaataatgaatgctgcgatcatcgctccgatgtagacagaaggtttacgtttcgtatatttatcgataaatgatacgaaaattaaaatgattgtaattgggtacaaaataattaatacaggtagtgtgattttaattaataagcttaatcctaagtttgaaataacgaaactaaagatacaaacgtatagcacaagctttttgtatgaaatatttgttagcactgttgtgaagtaatttgcaaatgcacttacaacaccaattgccgttgttaaacaagcgaagataatggcgatacttaataaaacattaccgcttgtcccaaagaattgatacataacagtagctaatagttgaccaccgttttcgaattgccctaagtttccgtttgaagctccgatataaccgagtaagaaataaacaattgttaagaatagagcagcgatacttccgcaaatgattgtatattttgcgatagatttcttctcttgtataccgttttgacgaattgcatttacaacaattgttgatagtacgagagcgccaattgcatctaacgttaaaaatccttcaagaaatcctttgaaaaacgggatgtctttatagtcaccgataggttctgcaaacgttcctggtgaaagaatcgcttttgttgccataattgcaataattacaagtaaaattggcgttaatattttacctatatgatctactagcttggatggatttaatgataagaagtaaacgactgtaaagaaaatcgcactaaaaactaacatagaataccattgatctgggaaaagtggtgcaatcccaatttcataagatacagatccagttcgtggaataacaaatagtgggccgattgaaagataaataatgatagcgaatactgctgcgaattttggatgaacacggctcgctaaagtgttaaaactaccaccagcaagggcaacagcaacgatagcaagtaaagataaaccgacgtctgtaataataaaccctgtaatggaaacccacatattttctccggaagaaagaccgagaaggggcgggaaaatcatattaccagcaccgaagaaaactgcgaatagtaataaactaatcgaaagtatttgcgctggttttaaagttgtatgcatataaagaaaatcctcctaatgagtgtttttgtcgaaaattcaaataatttgtcgagtaactgttattattttaaaggtctgatgactagaaagcaatagggaattttgaaaatattaaaaaataatgcattaaatcgaataaatatactatttatatgtttaataggaaggatttaacttttaacgtaaaaaaacacatatcgctaggatacgtgtattaaaaatatatttttctatcgcgttcttcttttaaaatttcaaccgcttctcggaaacgttgtgaatgaacgatttcacgttcacgtaagaagcgtagactatcatttatatctggatcatcggataagttaatgagccattgatatgttgctcgtgctttttcttcagctgcaatatcctcgtatagatcggcaattggatcacctttagcctgtatataggttgcagtaaatggaacaccagcagcgttatggtaatgaagagcactgtcatgatcagcgtaatgagggtcaagaccagcagctttcatttgttcaggggtcgcatctttcgtcagcttataaaccatcgtagcaatcatttcaaggtgagcaaattcttctgtaccaatatcagtaagtaggccaatgactttatcaggaattgtataacgttgatttaagtaacgtagtgcagcagctaattctccatctgcaccaccgtattgctcgattaataattttgcaagtgcgggattgcaagttcccactttaactgggtattgtaatttcttttcataaatccacatagtttctctcctttatatttgccatggccaaggacctttgctccattcccaaggggcattagaatagctgtttccaaactgttggagtggtccgtatttttcttccatcttttgttttaatactctccgtttataggaaaagtcattaaattgattaatcgcagcggtgtcatctggatgtgtatctaaataaagagtgagttcaactagtacaaagtccagttcttgaagctccagtaaaagtttatagtattcttctggtagcgattgattcacgacagtagtcaccgcccttttttataaggattttcataatagtcataaaaaacaggccataaagtccctttttgtagtgcttcttttggtgtgaattgtggtaagtttggcggttgaaagcctaaaaataaattaggaggagtagaataatatttttttccaataggaggacagggatcgagaggactatgatagggcacgaatgatctcatatatttattcacgaataaacctccttaagtgttcattactacgtattgtattcagacataataggcatttatgacacatataaaaaagtaataggtacggggggaatgaatgtggagaatgtgaaacaattcattgtattggaagtgaaaaacttaaaggaaactttgtatttttacgaagggattttaggaattaaacctagtttagaaagacctcaattagatgtaacaggggtttggtatgatgctgactcaacgagaattagttttattatgaagcgcagtttgggcgggcgtgagaagagtgttacggactcagttgatgttctaacgttttcaatttctaacatagagaatgtaaagaagaggttagtattttataaaatcgcatacacagaaaacaaaagtgagaagagtattgtggtacaagacccggatggatataaacttcaagtgatagagaaggatgaatagacggaggggatttagtggagagaaattatgaagaaagtgcgttgtttgagcatcaattttggttaaaagtacttactgatcatgcacaatttttactggatgcattagctccgaaggaaaaagaggatataaaaaaagctacttactttgttgaaacatttacgaatttgttaataaagttcggaatgtgaatctgatggcattttcaaaag

SEQ ID NO: 966 - DNA, 3670 bp, Bacillus thuringiensis
tagtagataagggaaaactttaatcaagtttaaaaaaccggggaatcgataatcgatttacggtatatatcccgctaaatgctgggcagtaagacccccactgattaaagcttcactaaatttaataattgttttctttatttcgcccaactttaatttaaattagtcgttattgaatttttataaatatctactttatgtgcagtgaagcgtaaggttttggattctgcatgaattgttaggttaataataatcgataacggcatttcgaccgttttcacaatatcttctatagcaatatactcattttctgcttcgttataataaacaacagaacgaattactgtctcgttattttcaatgtcaatttcacacatcatagggaatttttcaccattatgtaagaatagttcgcctagtacgattgaaccgtttagctcctctgtaaaattagtagttgctgctggttttacccatgtttcgtcatgttcttcgttttcctcttcatctattgtccattcccaaatggggttttgttttaggtcttcaatagttaattcatcaattggtttgcaattgctcatacataaatcctccttttgctttgataaataagtttcttaatctcaaaaattagatgattgcttacgagtaagttcaatatagtattttgctcatttgatattaaactattttattttgaagtaaagcttctatagcgatattaacaaaaaaataattatttagtaaataattattagtggaggttttaaagtggcatagagttaaggtagtaaaaaacatcaagaatgaatgggattcatttggtacgatatggatatgtttaataagagggggaatttgatgtatcaagtaaaggggtatttttcatcgctcaaaggaagtcattatgaaattggtaagcaacaaggtgaatttgtgaaacaacattcttatcttattccgcaatttatagagcaagaaaacttaatatcgcataaccattggacagaatctagaaatatattaaatcaatattgttctggaattaatgaagaaattgaaggtttttgtgaagtgttaaaaattccttcaaaaaatatgatgtattactatcaaacactattgaaagcaggttgtagtcattgtgcagtattacctaaaaagacagattcaactcacacttatgtattaagaaattatgatttgtcaccagtaatagatgatatgccgttttgcttcacgtatgttgaaggtgcgtatgcacatagtggcttttctactcaatattttggtcgaacagaaggggttaacgaacatggattatctgttacattttcagcatgtggtcaaccagtaggaaacattgcaggtttaagaaagccaatggtaaatggtttacagtgttttgcggtaattcgattgttgctggagaaatgtaaaaatgtgcaggaagctaaatcactaatagaagaaataccaattgctagtaatattaatttaatagtagctgatcctttaaacgcagcacatattgaaatatttgacggtcataaatccacaacaacgattgatggtgacaaccaagcttttattgtatcaacaaaccatgcagttagttcatcaattcagaaattaaataataggaaattagaacaatctacaaagagatatcatgttttacatgagcatttaaatggatatgaacaagtgagcatagagtctttaaaaaagttagtagaagaagaatatcctgatggactgactgtacataactatgaagaatggtttggaactttacattctgtattattcgatttacatgatcgtacaatgaagatttgtttcggatcaccacttttaaacgactggtactcattgaaagttggaggaagtatgccgttttctgaggtgaacgtgaactttaaaaataaaacttatactgacttttggagggaagataagaatgaattgatgcctaaaagataaatgagataagatgataatgaagagagtgcatttacactggagggattaccaatgctaaaagttatgttaccatttgttcttatcttttttcttgttattgcgatgtatattgcttatcaaaagagaaaaaaatctgggataaaaggattgaaaagtgcgttaacttctatttgcttcttttcactcgcaattttaaatatgtttgcatattggtttcactttggcggtgcttttacttggttattttcaattgtattattgctagttggtgcatattttactaaatatattccaatatctaaaaaggtacattaaaatctataagagtttaatataatgtttactttgttttgaaaagagattattctactagatcgttgtgaaacggtttcataggataatctcttttgtttagttttggaaagaacgtactgtactttttagttgctcaataaattctcgagttgcagcacacatatatttatcttttctataaattagccctatttcaattgttggagtagggttttctattttaatagcttgaatgtttttattttgtaaaaagtctatatatggtttgggtaacactgtaattcccattcctttggaaaccatttggattaaagattccatcgtgctaatttctaaaattggtcttggtttaaagttgaatttttgacaatgagatgtaattagttcggttaaaaagaaatttttaggtaaaagaattaaagggtagttctgtaattcagcaatagatacatgattacgttcagctaatcgatgaccagttggcacgactaatgtaagatcgcttttgtatagagggatagagataatctctttatcttgcaccgggagaaatgtaattccaatatctagttcgtttcgtaataatttttcacgaatatctcctgtgcgaagccctaatacagaaagctctatattgggatataaattattgaaatttaaaatagttagtggtagtaaataatttaggacggttaacaaagcccctattgttaaggaaccttgctgtaatccgtttaggtcttgaatagctgaacgagcttgttcgacttcatgaaaaatggttttactatgtgataataaaatcttccctgcttcagttaaagatatttttttaccaattcgatcgaaaagtggcattcctacttcatgctctaatgcacgtatttgttgacttagagaaggctgtgaaatatttaatttctcagctgcttttgtgaaatgtaattcttttgaaacagctaaaaagtattcaagttgtcgtaattcgattggaatcacctcaagtataataataggttatacctatcattattatataaataattgaattgaacaatgattttaaaggttttataatcatctttatatagcagagagggttgtaaaaattaattgagagaaaatacatgtaacacctttaaaggaggaaatagaatggctaatgaatatcaattattatctttaaatataggattaccaaaagaggttacatacggtggaaaggtagttcatacaggcataaataagaaacaagtaaaggaaccggtatatttatcctttgtaaaatttaatggggatggacaagctgacttaattcatcatggaggagtaaataaagcagtttgtgtttatactggtgatcact

SEQ ID NO: 967 - DNA, 3261 bp, Bacillus thuringiensis
agagaaggcaacgacctttttaagaataataacccaaagtgccagtgtcaaactattctgaaaatctaacgtgattacgacgatagagacactaacaagtatacggactcctaacataatccaatcggaccaaaaccaatacttaaccatatctaacaagttattcccccccctaagtagcctaccattttacttcctatattataaattaatccttcatacattgttatactttttaattttacactacaattttctcgcaaaagggaaacttctatcgatttagttgccgaatcatgctacgggtatagccaccaattttctttgtcaaacgttctactattctaatacttatggcggtaaatactatacccataaacattacaaagagtgacttggcaaaagtatctatctgtatgaatataatattcatttcaatgtagcgatacagtagtggtgccaacaggaacataagtggcattacataaaaaatgattgtactaatgagactgaaaatgccaatcactaatttctgcattaaccaaaagacagcagaccaagtgcgacgatcagtaagcactaatttcacctgagtccagttcgatgtatctattgttatacttctgtcataagagtctgttgaaatatctgtataaattttcgtctgtatgcgttcgaattgaataaaaggtgtagtagtctgtagtacacgtataattagtggaatcccaattaccgtaaatgaaagggtgaagctgaatagcagagctattagataaaaacaaaaataaaacaaccctgtaacgaaagttagcaataaaaaataaccattctgtatgaatcttgatttcataaagttcatcgctcctatctatataataaccgaatcatactgctttttttgtcattctcactagtgtaaaagtgtcatatgacatttctaaatgatgttaaaaaggggagaacaacctacttctggttaaaaaagatgcgtatattaatctccataaaacaatcccgtttttgcatctgcaagaacgggattgttttgtatttttatttaatatgagagtgacttgtttttcgaatatgaaaaataatatcaaattgctcaagcaatgatttatcaaagtatacagatttgttcggtaagagtcgtgcccctatactgagtaatggtctttttgctttaacccatttctttgctggtcctttaaggtgacgattatctaataaaaacatttcatatggtacttttccgagggtataattgaaactatttacatcttgtggaatcagatccgttataatcttatcttgggtgtcgttgtataaggtgacattcccctccgtagttgtactgccaattgtgacataattattgtctaaacgttccttcaaaaactgccccgaggcataagggtatgattcctcatcgataattcctttagccatatgaatattgtgtgtccacactatcgttttaccacccaatctctcttgtgcccacattgcatgatcggccatgtattgctcatgtagctttaacagacttggaaagtcgttaggaagtagcattgtggtaaatttctctattgcacttgccgttgctttcgcccagatgtactcgggtgaagctatttctgtgttggcttgcccattctcatcttttagtaattgggctactctctcagcgtttgccttgaacttttctcttatttcaggagcaagtttcatatattcctgtaaactgccagtaaaagacggcaattctttataattttcttctacttctgccagcaaatctggtcgatgcacccttacataatcaattactttattaaagcaaccttggtccaactcctttaagtcgagcccaataaattggatcttttttttattggatggatcagcattataatctttcatccactcaaccatggctataatttcatcagtaggatataacaagtttaaaaattctctagggtttccttttcctgtttggatatattcatttagttttaagccgtttccccaatcttcttccattgtgaagtttgtaaaacccatctcagtaaccaaatatttcacaaggcgaaacttcatagtgaaaatttcagagcttccatgagtattctctcctaatcctacatattgtgcgctcccaatcattttcttaagtggttttaaatcctcaaatgattttgacggctctatcgtttttaatggataagcctgtgattgtattgatttaactatatttttttgtattgattgatttgaattttcgactgctactgtttgagcctttcctacttctacacatcctgtgactaataaagctgtactaaccattgcaattattcttttcttattcattttttccacctcaattgaattatttgtaaaagcaagattgattcattgtacttgcacgaatcaattgccttaattcaattgttatctatcccatatcatattttctagttacatattgtcataaagttaattgacacagatcatatgctaatcattacacttttgtactatcggctatgacaacttataaataataattacattgatgagtcgtaagtaagactagattataaatgggggagggattttaaagatgaatgaatttgtatacaaaaatatttttattctaagttgtgtctgtggaaatgacaagaagtatattcgataaacaagtgaattataggggaagggcggattacaatgatattaaacgcaaaatcgttccacaataaagataaaatccaacgtgctaaaataggacttcaactttttctgagtatcttaatcattacttcaattatcctaaatgtagtagtaataattacgaaaagtatgccacttattgtggtatatatgtttaccccagcattatcttctattttgactcgcataatactgaaagaagggtttaaagatgtatcttttagtctcggtaacttaaagatatggaaggggatcggttttgctctgctaatccctatgattatttgtggaattacttattctatcgcctggttgagcggaattgcggggtttcagtatcccgaagttggtatgtttattttagaaccgatctacaatatgcttgggcttcagtatgtaacggcaccattcagcttcatttatctagtagtattgagcggcattttcggaagtttgcttggcttaatcccagctttgggagaagaaatgggttggcgaggttatatgatcacaagg

SEQ ID NO: 968 - DNA, 1495 bp, Bacillus thuringiensis
gaaactcttctccgcagcctaatacttatttttgcaagaacgcctttaaatctgcaaactgtctctttgcatcttcatagccttgctcgtataaattttgtagttttgctttatctttttccatacgatctacttgaagcggcacttctgggcgaataacaaataaattaccagcttgctcttctttttcaatatagtgaagtgtttcattatacacttcataacgattgagcatcgtgttaacaagattcggatattttttataagctttcgcagcaacccatccaaaccttgattttttcttcgcgtagccatgatttctcgttaaaataacgactgattttttaaatccatcctcttgcgctttacgaactggaattggatcagaaatcccgccatctaacagttgtttaccgcggtaatttactaccggtgcaatgaaaggcaatgaactagacgcttgtaataaatttagcgcatcatcattcgttccttctttttcaaaataaacagattgccctgtttcacaatccgtcgttcctacaaggaaacgttccgggctattaaagtatgtttcaaaatcaaacggcacatacttttctggaatttcatgaaaaatgaaatccatatcaaatagctgacgttttctccataagtttttatacgataaatatttcggatgtgatgcataatcaatattgaccgttttatttctatttctttgtctggaaagatacgacgctgcatgacaagcaccagctgatacaccgattacatatggaaaatataaatcttgttccataaagtattctaatatcccgcccgtgtacacaccacgcataccgccgccttctaatactaaccccgtattttcaagcatgttactctctcctctatatatattgactctttaattattcaccatgttaagtatctttttctattatatatgagttctttcagaaattatatttaaaagacttgagaaaaaggagttttttcttccaattatatttccaaatgatcggagacatcctttataaacctttgaataaagtcttgctcttctttcgtatatccatctaaaagtaacaaccacttttcttcagcttgcttatgcaatttttcatgagctttatatattttattcccactttccgttaagcggaagaagatttctttttgattatctaacatttgcatcttctcaacgaattgcttttgaaacaactttgtacaaattttagagattgctcccttcgtcatgcccatttctgtcgtaattgccgttacatttatcaaaccattttttccgatacattcgattacatgtaactcagataaagacatactacttacacctgtctcacgaagaaacttctcattttgtcgttttaaatgttcttcttttttatgcaaaagtgtacgaatgtccgaaagtatttccatttgcttcgttgcatgcttcaatccgttcgcctccaatatttccaaa

SEQ ID NO: 969 - DNA, 3187 bp, Bacillus thuringiensis
gttgaaactttcgatgatcaaattacggtgaacggtaatagaaagttaaaagtagttgatatcaaaacgcttgtatatccaggttttccaacggatttacaacagccgtttacgacgcttttaacaaaggcgcacgggacgggagttgtaacagatacaatttacggtgcccgtttcaaacacattgatgaattacgtcgtatgaatgctcaaattaaagtagagggtcgttcggcaattgtaactggtcctgtgttactgcaaggtgcaaaagtgaaggcgagtgatttacgagcgggagcggcacttgttattgcaggtttaatggcagatggaattacagaagtaacaggacttgagcatattgatcgaggttatgagaatatagtggacaagcttaaagggcttggagcaaacatttggcgagaacaaatgacaaagcaagaaattgaagaaatgaagaacgcataagtgatacttccgcaagggggaagcgaagcatcactacttgcggaagtacactttatagaaaaacacggttcacaaaatagggcagaaatataaagacttaaaggagagggattatcgtggaaagaagtttatctatggagttagtacgtgtaacagaggctgcagctttatcatcagcgcgttggatggggcgcgggaaaaaggacgaggcagacggtgcagcaacatcagctatgcgtgatgtatttgatacaattccgatgaaaggtacagttgtaattggtgaaggtgagatggatgaagcaccaatgctatatatcggagagaaattaggtacaggatatggaccacgtgtagacgttgcggttgatcctttagaagggacaaacatcgtagcagctggtggctggaatgctcttgctgttattgcaattgcagaccacggtaatttgttacatgcccctgacatgtacatggataaaatcgcggttggcccagaagcagtcggggcggtcgacattgatgcgcctattattgataacttacgtgcagttgcgaaagcaaaaaataaagatattgaagatgttgtagcgacagttttaaatcgtccacgtcatcaagaaattatcgaagaaattcgtaaagctggtgctcgcattaaattaattaatgatggagatgtagctggagcgattaatacagcgtttgatcgtacaggtgtagatattttatttggatctggtggagcacctgaaggtgtattagcagcagttgctttaaaatgtttaggtggagaaattcacggaaaactattgccacaaaacgaagctgaattagcacgttgtaaaaaaatgggcatagaagacattaatcgtatccttcgtatggaggacttagtaaaaggtgacgatgcaatctttgcagcaacaggcgtaacagatggagaactattacgcggtgttcaatttaaaggtagcgtaggaacaacgcaatcccttgttatgcgcgcaaaatcaggcacagttcgcttcgtggatggacgtcatagcttgaataaaaaaccaaacttggttattaaataaaaagcgtaagcagctcgttcagaaaggttaaaatggtcgacttttctaactatcggagctggaactaaattaaataagaagcgaagacaaattttcttgtcttcgcttcttggatttgtgttccaacgtattgatcaaaactagctaaacgggttacaatagtggatattaccgcacttgaacatactgcctttcatgattcagtatctgccttccgtatatttcccctttacccatgaaaaacgagagtaacgttaaagcgtggtgcctgaatgaatttgccaattgcagcattagaaagcatgaaattagaagagtctacgagcttgcgaaagaagtgaagatttcgtattatagcacagtaacgaacaaagagttaagttcttctataatgaaagctcgagcagaaaaagaaggtttctttttcatggaaggcgtattagaaattattcaatcagaaggatttggattcctacgtcctatcaactattctccaagctcagaagatatttatatctcagcttcgcaaattcgtcgtttcgatttacgtaatggagataaggtttctggtaaagtacgacctccgaaagaaaatgaacgctattttgggttattacaagttgaagctgtaaacggagatgatccagattcagcaaaagagcgtgtgcatttccctgcattaacaccattatacccagatcgccaaatgaaattggaaacggaacctaaaaagttaccgacacgcatcatggatttaatcgcaccagttggatttggacaacgtggtttaattgttgcgcctccaaaggctggtaaaacaagtctattaaaagaaatcgcgcatagtgttacaacaaatcatccggaagcagaattaattgtacttttaattgatgagcgtccagaggaagtaacagacattgaacgttctgttaaaggagatgttgtaagttctacttttgatgaagtgccagaaaatcatattaaagtagctgagcttgtgttagaacgtgcgatgcgtcttgtagagcacaagaaagatgttatcattttaatggatagtattacccgtttagctcgagcttacaacctcgttattccaccaagtggtagaacattatcaggtggtatcgatccagctgccttccatagaccgaagcgtttctttggagctgcgcgtaatattgaagaaggcggtagcttaacaattttagcgacagcccttgttgatacaggatcacgtatggacgatgttatttacgaggaatttaaaggaactggaaatatggaacttcacttagatcgttcattagctgaacgtcgtatcttcccggcgatcgatattcgtcgttctggtacacgtaaagaagatctattaattccaaaagaacatttagacaagttatggggcattcgtaaaacaatgcgtgatacaccagacttcgttgaaagtttcttacgtaagcttcgtcaaacgaagacaaatgaagagtttttacaaaacattgttgcagactcaaaaaggtatgtaacaactaagtaaagggaaaaaatcaggactcgcttattttataagaagcgagttttttatgctggttaggtgatattaaagagagaaataagtgagagaacct

SEQ ID NO: 970 - DNA, 4102 bp, Bacillus thuringiensis
cctcttttttatattcacctaacgggaaagtaacatatactggatgaaagccctacctctctctcatcattacggttccactgaccgctccttgattcactagtatacatatatagcttacaaatacaatttatagggtttgttcacaaaagttgttgataaaattacccgatctttcgcaaacttttcgtattgcattcataagagatatttactttacactagctgtaaccgagacacgaattaaaatcttaacaccaatacaataacttgtcaacttttttccgcaaattaaaaacagacattaacggtttgtctgttttaaaatggagctttttcttttattacatatacaacaaagccgcttactaacataaataagccaactactaagtttttgatattaatcataaattcctctcccttattccacacatcatatatatttacatttcaattattccgatcatcctaaagcgcactttttctaatatatcataattcctaaaaaatgcaagttcacttttgacgaccattcacaaatttatctacagtgcttggtacagtatttaaggccttttcaattaaatgtgtactgctgttgagatgtaatacttgcaccccattagaaccaactactaaaaaagctactggactaatggaaaccccagccccgcttcctcctccaaatggatgcccttgtttgttctctttatgctgattttgcccaccgttatgtttttcagtgatgaaatcccctttaaaatcacttccaccagctccaaaaccaaaagccacttgagatactgttaatactacatttccgtcagctgttgaaaccgggctcccaacaattgtatttacatctaccatctcttttaaatttgtcattgccgttttcattaaattttcaattggatgttccattatgtattgcaccctttcctcattattcctttttatattttccaaaatagaggaagtcatactaacttttcctattttaaaaaaacattttccttcttttaaaagatactactccctgtacatgctccggtatagtgaaactttaatcagtgggatgtgtacgtagctcgactcccacaaatagcgggataaaaaagaaaaagagatacatactactattgaaccttgttatgaaaggagtcatgactttgactgagaaatttgatgattataaaaaaagagatagaatagatagtgattatagtgactataaagaagagtacgccgctgaggtcgcaccacaacgcattgattatgattgccacgataaagacgataaagatgttgtaaaatcgtccgctgctggatcaactgctggttttatcgctcttgcgctatctatcttatcgcctattacatttccaacactatttggtcttgtttctgttttactcggtatttacgcttataatcgcggagctactggaactggcggtatcgctgcagttgtcggtggaattggtgcacttatcgcttttttattccgagtagcacttattggtctattgttctccctgttctaaaaaagaaaaaggtatctcgcttaacgcgggataccttatcctgtaaacacatcttccgatggatattttattttttgttttgctggtcgcgctaaagagaacacaagtgttaatggtccaattaatccgcagaacataacaaacataataatacattttccgaatgccgatagctgtgcagtaattcccatcgttaatccgactgtgccaaacgctgatattgtctcaaataataattgaataaagctgaagttttctgtaagcattaatatgaataccgctgctaaaataagtatttgactggcaacagcaattgctaatgccctcgttactgtcgacattttaattgtacgctgaaataaaacaatttcctccttttttctaaagaaagaaaggacagatgtaattaagataacaaacgtcgttaatttaattcctccacctgtcgatacacttcctgcaccaataaacattaaaatcatcgtaaataatatagatgattcttccatacctccatagtcaaccgtattaaatccagctgtccgcggagtaataccttgaaagaaggaagcccatagtttttcatttaaagataaattccctaacgtcttcacattattatattccaatacaaaaatcacaatcattgctataacatttagcactactgttccaataatcattatttttgagtgaagtgataattttcgaaaactgcgactataccatatatcaattaatacggtaaaaccgagtcctccgattacaattaaagagcaaatcccaatattaataatgggatcccctacatatcttgttaaattatctggccataaagcaaatcctgcattattataagatgcaattacatgaaaaatactatagtataaaccttttccaaaaccaaactctggaataaagcgaaacgataaaaagatgaccccaataagttcaatacaaatcgaaaatataaagacacgctttactaattttacaagaccacctatatttgtttgattaaatgcttctccaattaataaacgatggcgtaatccgatttttttacctagtacccaaacaattaaaatggcaattgtcataagacctagaccacctgtttgaattaaaaacataataacaatttcgccaaacatcgtaaatgtacttgctgtatccactactcccaaaccagttacggtcgctgctgacgttgctgtaaagaaagcatctacccaactaatatgtgctttcgttgcgaatggtaattttaataacaaaccgccaaccacaattaagcagaaaaagcctaatgctaatatttgtggtgggtttaatcgtataagacgattatacagcccttgtttttttgttacgtccatatcattaactcccttattaaagtgaagcttcccctcatacaataaaaagctttttaaaagcccttaaataattgggacaaaccttatattctcataatatagttgagcataatcttttttttcatagattacaacttttatttatattcagattccttttcgttttatgttggaaaactctatatcctaattctatattgctagcaataacaatttcatatgtactattgttcaaatccccatatctttcactctatgttcacatagaggtcacatccaccttttatagtatatgtatcgaagctgttcctccctaatttataagacattccccagtgtctttgaatagcttccatccctaattaaattgacataaattgtccccttcccttgaccatcttataaatgatggtcttattttttgtttgctttatcttttattccgctatttgtgggcaataaacgcccgattggttaaggctaataatcaacaggggatgaacaaaaaacactcattaaattttcattttatttaaaactccctctctctttcactctatattcacacagaggtcacatctatcttttatagtatatgtattgaagttgttcctccctaatttataagacattccccagtgtcttaaagcagcttccatccctaattaaattgacataaattgtccccttccttgaccatcttataaatgatggtcttattttttgtctttctatcttttatttaaaacttccactctctttcactctatgttcacacagaggtcacatctaccttttatagtatatgtatcgaagttgttcctccctaatttataagacattccccagtgtcttaaagcaacttccatccctaattaaattgacataaattgtccccttccctagaccatcctatgtgatggtctattttattttccaaacacaaaatcagtctatctacacctaaaaaccaaaaattcagaaaatattgttaaattagggattttttcggtataattgctttagaaagaaatttcgcaaaaacaaaagggggattttattgaaacaaacaaaagcaatcttaatcgcattatttctaggtctagttgttggactcactctaaatttagaagatccatctatctttgagccactaaatcaatatgtgttcaa

SEQ ID NO: 971 - DNA, 2711 bp, Bacillus thuringiensis
gttacctaaatttcagaacggatttgctccagcacgaacatttaaacgcccgccgttacataatatgtgctctttgtaaaatcggcacttacaaacgcttccttaccgttcaacttaatttttgtccatccattttctgtatttataacatctagtgtattcccacttaacactttacctacaagctttgactctacatttgggttttctctaacatttaatacgtctgttgttacaattgtttccgctttagcagaacccgcaaaaatcccaagaccaaaaactgctgctgttgctatacctaataattttttcatgaatagcctccatttgctttgttttcgtattttcattatagcaacagatttttagaatttttagaaatcacacaattacaaagcattcgtaatatacgattaacgagttgtaacataaatttccatattaataaaatgtatttctcatacaatctccagtggttttcatatatttttcatatacgagcacaagaacttttttccagaaaaaattacagtgttacttttttgttacaaaaaattcacaattcgttacatcttttaccaaaaaacatcaatatttaattgttaacctatttttttgtaataaaaagagagcagctactaaaagctgctctctttttatttgttattgaactttctttttccaaacacctagcataatggccgagacaatcgttccaattaatatagagaaaatatatagtaacggtttatttactaacgctattacaaataatccaccatgcggtgctggtaatgtaatttggaataacatagataacgcacctgcaatacttgaaccaacaacacaacttacgattactcgaaccggatctgcagctgcaaacggaatcgcaccttctgtaatgaacgatgctcccataatataatttgttaaaccagatttacgttccgcttctgtaaactttgatttaaagaatgtagttgcaaatgcaatcgcaagtggcggtaccataccaccagccataactgctgagtgcactccaaaattctgtgcttctattgcagcaataccaaacgtaaacgccgctttattaattggaccacccatatcaattgccatcataccacctaaaataagacctagtaatatagcattcgtaccgtttaaaccatttaaccaccctgtcaacatttcatttaatgctactacaggcggaatcactgctttttgcattacaactcctgtaatcaataatccaaagactggatataacaaaacaggtttaattccttctaattgtactggtagtcctgaaaataatcttttcaaccctaaaacaacatatccagctaagaaaccagcaattaatccacctaaaaagccagcattcgcattcgccgctaaaaatccacctacaacaccaggcataaaaccaggacgatcagcaatagaacttgcaataaatccagctaaaattggtacaaggaataaaaacgcacctgtttttcctccaccaattgacatgaacaattcagctaaaggaccttccgcctttataccaccaaacgaaaacgctagcgctattaaaatcccgccgccaacaacgaacggaagcatattacttacgccattcattaaatgcttataaattcctaatcctttttctttttccgtactttctgcctttccatcttcttttacacctttaaagattggtgcatcttgctttacagctcgattaagaagtgtttccgtttttctaatcccatcagcgactggtacttgaatgacatgtttaccagcaaaacgattcatttctacttgtttatccgccgcaacaataatagctgttgctcgttcaatgtcttcttttgttaaaccgttttttatacctgttgatccgttcgtttcaactttaattgcgattcctagctctgctgcttttgctttcaagctatctgcggccatatacgtgtgagcgattccagttgggcaagccgtaactgccaatacgtacggttcatttccttctggtttggcgacttcaatctcttcttctttttcattctctttttcatcaaatagttgaagaagctcactttcatcctttgcttctaatagttgcttgcgaaacccttcatccattaataatgtcgataaacgagacaacgtttctaaatgagtattattcgctccttcacttgcagcaatcataaagaataagtgtgctggctgtccgtcaagcgactcataattgataccgcttacacttctaccaaaacaaatcgatggttgtttaacagcctttgtcttcgcatgaggtattgcaataccttcccctattccagtcgtactttgggactcccgctttaaaatagcttctttaaattccattttactatttaaacgatttgccccatttaatttctcaactaattcatctatgacagcttctttatttgaagctgtcaaatccataatgactgtatctctttttaatagttctgtaattttcatatgttgcttccccctatcgcttagctacaattacttgcgacaataattcttctactttttccttcttacataaatcagctgaaaatgctgttgcactccctgttgcaacgccgtattgaaatgccttttcaatatcttttgtctgttcatatttgcctacaaaccctgcaacaagagaatctccggcc

SEQ ID NO: 972 - DNA, 3107 bp, Bacillus thuringiensis
cacgttgtcattctatgcagtttatttagcaatttgtgctaggttcgttgttatcctcatcggtttcttcgtcgtttcacctattttaaacggcatgcgcttagaagaacctgtggaacgtattgcagctcaatttttaagtattatcgcaataggaattatacctttattcacttacacggttttacgtggatttattgatgcattaggaaaaactcgaacaacgatgattattacattactatcattaccaattaacgtaatattaaattacttattaatctttggtaacttcggtttcccaaaacttggtggtgttggagcggcaattgcttccactgcaacatattggtgcattttaattattacagtcattattattcagacgaaagagccttttgcctctttcaacattttcaaacaattataccgcccttctctttcgagttggacagcattcttaaagcttggcgtccctataggatttgctatcttttttgaaatgagtattttcgctgcggtaacgcttatgatgagtaattttagtacgacaactattgcagctcaccaagcagctatgaactttgcttccttgttatatatgactccgctaagtttagcaatggcaatgactattgcgggcggattcgaagttggtgcaaaacgtttcgataatgcaaaacaatacggactgattggaattggattagcccttacctttgctttattatattcgattcttctctacttctttgatgatcaaattgcttctatttatacgacagatgcaaaagttcatcatttagcaaaagaatttcttatctttgcgattttatttcaaatttcagatgcaattgcaacccctgtacaaggagctctgcgtggttataaagatgtaaatgtcgctctaattatgactttaattgcttattggataataggtctaccactaggttatatattagcaacgtatacagaatgggccgcaaaaggctattggatcggtcttattatcggtctagcatttggcgctgccttcctacttatccgtctctttcaagtacaacgaaaatatacaacacaaaacagccgctaataataaagcggctgttttctttatgcatattttttcttgtaacgtataatataatgaaaaaggaaggtgggtacatatggacgacaaagaaaaaaagcaatcattcgatgaagaatttgcccctgaaatttcacctggatatcggcaagatgtacataagccacctaaatataaaaacacttcgtttttaatgggcattaccattttcgctgctgtattactcatacttatcattttcgtttatttttgatgaaaggtggcctattatatgaagaaacaagattccaatcgttcaaaaagaactgttaaaacacaaaaaggatatgcaggagattctgttcatacccttaaacaagtcgagcaaggaaatttatatattgctcaaaaagaacttggtcaacaaaatgaaaatctttaaaggccctttattccttgagggcctttttattccgcattaagtagtacacaccccaaaatgttctattgagcaatgaatttcctttattgtacgcgctgcttttgttctagcaccataaatatattattaacctttacaattttcacttcataattcaatttcatttcgcttctcttaccattttcagtacccgcaacgtacgctacagcttgataaagaaaactctcatcggtctcttcacgtatctcctcgtttgtaaatttatactctaaatctcgaaaacgatttggataataatttcccattaattgttcataccctctatttaaaaatagttcttcaccttttcgtttcacatcttctttattagtagacccaaacactgatagttgctcggtcacaaaatgctctcctacctttttcatttcattatgagttaaattttctatacttttgttctttaactccttatttaactcgtactgatcaatcggtttaaaggtagcaaaaacctcctctttatatgaccataacaatataaaagcgatacatagagaactgattaacagtctttttttcgtaatactcccgcccttcttaataatgatagctatattttaacatatagaaagaaaattctgatatcataaagtggaataacttaacttagaaacgaggaacaattatggactcttacaaacattatataaaagaagctttgcctaatctttctatacattcatataaacaaaatgaagaaggatgggataatgtagcagttatagtaaatgatgagctattgtttcgtttcccgcgaaaacaggaatatgcgatgcgaattccgttagaaaaagaactatgagcaattctcactcaatcactacaagaaatcgaagttccccaatatcacctaatttataaaaatgaatctgatgaggttcctctttgtagttactatactctcattcatggtgaaccattaaaaacagacacagttgccacgctggaggatccagagctgaaagcaattattacacaattagctactttccttgcggtactacatagcattcctttacaccaagttacaacgctatgtttccctattgaaaaaacatgtacctactggaaagagctacaaacaaaattaaaccaatatctcactactagccttacttcattacagaaactagccttaaatcgcttatttgaaaatttctttgcatgtttagctatatccacttttcaaaacacaatcattcacactgattttactcatcatcacattttatttaacaagcataacaaaagtatttcaggtgttatcgattttggtgatgcgcaaattggcgatcctgcttttgattttgcaggactatattatgatttcggacatgagtttactacatctgtatatgaacagtacagtacacttatttctcatcatgatccattactcattcatcgcattactatcttctatcaatacagtcctttactacataatattatttataactttgagtcagagaataaactcgaattcattacaggcacagaacagctaaaaacgatattacagggatgagatta

SEQ ID NO: 973 - DNA, 2486 bp, Bacillus thuringiensis
cgatcaccaggtttttagtctttgacaccgacagagattgtagagtcttttgctgaatttatatttgctgaaagcgctccttgttcgaaatgattttccaattgtcgatacgctatatctacatactggggatagactaaaaatgtatctggaactgaaaaagttgcttctttctctatcatgccgaataaatcgccggttttgacacgtacgcttgaaaaagtgtgctcgcctctagggattgtgtcaataacatattgaaacgaaatatttcgttccaatcctgggaagagtactaccttattcatctttatttgtttacaacttataaattgtggtggcagttcatcttctataactaaataaagtaagggaaaaggaaattttctttttattgtaatcgtgcttacaaattgttctcctactacatatccattctggtttgttattcgctttacttcagcgtcccgtaaagcgtagaaggggagtagtagcgaataaagagcaatgggaattatgctgtaaaataaaaaccaactgacaaaccctccttgaaacatagcgtacacaaatgttaagactaggcataaagggagtagcaataacttcataacgtgatatagtgctcgcagcattcgtttcatcaagggttcatcgccctttgagtaggcacggtagttcgtgcaacgatttttgcgataacttgttcgccagttattccttcaaattttgcttccatttttataatgagtctatgtgctaaaacgtaaggggctaaaagtttaacatcgtctggaataacataattcctgccatggataaatgcataagcttgtgaagctttcattaaagcaattgagccacgtggacttgcacctagctgtatagaactgtacgtacgagtctgattaacaagctttacaatgtaatgcttaattgctttgtccatacttactacccgtacgctttgttgtaaataaagtaattcttctattgtagtaatggtctgtaattgagagagtggatttgttttttccatccggtttaaaatttcaaattcttcctctggtgtaggatatcccatttttagtttcaataagaaacgatcgagttgagcttctggtagagaatatgttccttcatattcgaccggattttgtgtagccatgacaaagaacggctttggtaaaggccttgtaatgccatctattgtaatattgccttcttccatacattcaagtaaagcagattgtgtctttggagatgtacgattaatttcatcagcaagtacaaaattacccataattggtccaggcttgaactcaaattggagctctttcggattataaatagaaactcctgttacatctgacggcaataaatcaggtgtaaattgaattcgcttataatcagcatcaatggatttagaaagagcacgtactagcattgttttcccgacaccaggaacatcttctaataggacatgaccttcagctaagagagctgtcaaaactaagatggtttcttttcgttttccgaccattattttttcaatattattgattattttttctacagtgggatgtaatgaatcaagctggggcatcgtaatcctcctaatgttattatcgttttctaatctatttagtggacatatttctaattctatttgtagatagtaaaacttccacctttaattctgagaatattcagattatttattttgattatatctagtataattgtttccgtaactaagggcaatacagtaaataatgatttgtagttttatgtaaaatcagactcgatataaaataataacattgggaaaaatttttttacatacaatttatactcttttccttatagcagttttgaaataatatcaaaactctttttcttttgcaaaatagtcgatacctcaaaataccattctcctaataatcacgattaaccataaccttcacaacggaacaaaaggttttctcacaaacttattctctaataaatttttgacaatctcttgaactgtgcgaaatgtcacatctgtattttacaacctctcttatagtaagggtatgtaagagagacgtattaaagacctgcggtagtatgtcaactgaaaaacaaaagaatttttagttatcaaaggcctatttactaaaaaaagacatcacgaaactaaaccagtaacgtatgtaatttactggaaattaattgaaaggtagcgatgacaagttttatgtcacactttcacgcacctttctggcgtaaagagttggtgactacgtagtagcgcatccaccaatcgcacaagttttcttgcggttagaacgagtgcacgtttgtgttgatgttttggtacttcattatatttttttacgtaatattcttgataatcagatacgtgccttcttactgagttggcggcttcaactaagtaataccgcaagtaatgatttccattacgggatacgaagtgtttt

SEQ ID NO: 974 - DNA, 3248 bp, Bacillus thuringiensis
tgattttttgacagaatagcaacatcgaccgtattcaactgtcctccctatacttccactctcatcatgctaccccttgtggcttttgctccatatgatgcagcagtaataagcacattgttgtaagtccaacagaaacaacggccatcgccattcctatagatacttcaccctgttcaaattgagcaaaaataaacgttgctgacgtttctactgatggaggtaatacgagaagtgatgctactaattctcttattgaaattgtaaatgtcatcgcccatccggcaagaatgcctgggataataagaggcaatattatttttctaaaaatataaatataatttccagaaaaaatacttcctgcctgcacgagagaatcatcaatttgtccgagtgatgattttacatattgcaccgtgtaaggtaaaaacagaacaacatacgttacgataaccatgattggtgtattataaattgacataggcatatatggtgaattccaaaatagaataagacctacaaccataacgattcctggtaccatattcggtaacataccgcacatatcaagccatttttcagaggtttttttcccctttcgaatcataagtgccaaaaagactccaatcattaccgcaataatcgctgttacgagtgaaaaaagaaaactattccataaagcctctaatcccggagaccccattgtaaacaatgcctcataatgacttgttgtaaagttatttacatgtaaaccgccgcctcttaattttgaaaaagaagcaataagtatagaaaagtatggaattccaattgatacgattaataaaccaattacatacatccatgctacaacgcgcgtaaatatagacaaagtatatcttttagatttcacaccttttccactaaccattgcatatgaatactttcgattcaatacattttgcatataccaaatgagcatacaagcactaagtaataaagaagataatgctgttgcactactgaaatcaattggccaactcgaaataaatttatgaatttctgatgttaacacgtggaatcctattctacgtccgaatgtagccggtgttccaaattcagcaatcgtctttacgaaaatgagtaaagcacccattacataacttgatactaataacggcaatattatttttcttaagcgatagaaaaaacttccgccatgaactgctgcagcttcttctttactactcccaatctgaagtaacgtgtttttcagcatgaaataaaggaatgggaataaatgcagactcataattaataccatacctcctaaactaaaaaacgatgatgaaactgtctttagcatcgggaaaaattgttcaaaatagccgttaggttgcatgaacaaaatccagcccatcgatccaatatacggcggtgtcataaatggaatcataaaaacaatatctaacttactatactttcctacatctgttttgctcataataaatgccaatggaaatgcaaatattgtagcacctattacaacgagtgcacctagaagcatcgaatttagaaaaatcccagctaatccaccactctgcatcacttcaaaaggctttaaaaaattccaactgctattttcatatacactagaaaataaaataagaaaaagtggaatgacgattaacatcgccacaagtaataacgctaccgtcattccaacttgtcttactgatacgaatcgatttaccatggaatcaccatcttattgaaatactttcttaaattgttttcctatttcatcttgctctttctcaactgttttccaatcaatatttaatactggaatctcttctacatttggtctattttcagcttttatatctgttctaccaggcaataaatacgctttagaaacttgtttttgtacatcatcggataataaataatcaataaactcttttgcaccttcaacatttttactatccttcataatcccagctacacgtgggctaataactgttccgctttttggatatacaatatcaacaggttcaccctttgcttttgcgctatacgtcatataatcaacacccgcaatgaccatatctttcgcacctgttacaactgggtctaacgcttcctgatttgctcctgctactgtaacttcatttttcttaagctgctcaaataaattccatccatcttgtccattctttttcacgtatcctgttacaaagtctaaagctgaacctgaaagtgctggatctggaagattcactttccctttccattctcctttcgttatatcgctccaatcttcaggcgctgtcttcacattttttgtattgtacacaatccctaatgctgaagcactatacccgaaataatggcctttatcatctgaccattcagaacgcagcttatcagcttgtttcgcctctttataagctaacgtttgaccctctttctttaatccttccatcgctggtaaggaagcgagtacgacaacgtcaacgactggatttttcttttcagcttccattctcgctaaaattttaccagttgtcccttgaaacatttccacctttataccagttttcttttcaaagtctttttgaactttttctgctaacccttttggccctgcactatatacaacaattttcttttcattcgtatttgtactttttgcatctgcattaccctttgaactacaacctgttactacagccgaaaataataaagtacatacaaataaagacttaagcgaactgaatttcttcatacgattctccccctatatgatgaatacatttttttggcacatataacgatactggtttaccgatgcttaatttactattgtgataagctgtccatattccgagtgcccccatgtttacttttatttcataccgttctcctacatatgtaacgtgcttaatttcacctgtatacatttcgcacacttcatttttcgtccaactcacatgctctggacgaaccatttttttaccctctacaagccaattcgccttaccaacaaatttggcaacaaattcatgagacggtttcacataaatatcttcgggtgttcctttttgtaatactgctccttgtttcatgacaataatttggtctgacattgacattgcttctgtttgatcgtgagtaacatacagtgcagttaaaccaatggaatgaacgatatccataagctctacttctcatttcttctcgcaaaattgcatcgagcgcactta

SEQ ID NO: 975 - DNA, 2113 bp, Bacillus thuringiensis
acaaaaattgtgtagctttaaaattagacaaagctggagagcaacaatcaccaaaaaaacatccaccagggttatacttgttgttctttacagaggcatgggaaagatttagttattacggaatgcgtggcttattagttctttatttaacaacgagcttagtaagcggcggtttaggatttgataaagcagttgcagttcaaatttacggtattttcacaatgttagtatacttcacacctattattggtggttggttaactgaccatttcattacgaagcgacatgccattactattggtggtatcatcatggcaattggtaactttgtattattctcaatgaacacaaaaactggacttttcttaggattaggattattagttattggtaacggattcttcaaaccaaatatttcgactttattaggtcaattatatagcgaaaacgattctcgtcgtgatagtgccttcactatcttctacatggggattaacttaggagctcttatcgctccattcatttgcggttacttcgcagattatagatacggtttcttaacagcttgtatcggtatgattattgggcagcttgcctttaatttcttagcacctcgttacttagggtctatcggaacaactgttgtaggaaaaaaatctaaagaaaaaaatgcaaaagcaattgagaaaaaacctttaacaacacaagagaaaaaacgtactgctgcaattttaattttaacttgtttcgttgtattcttctgggcaggatttgagcaagctggtagttctttaacactttacacagataagttcgtagatcgtacaattggtggatttacaattccaacaccttggttccaatctgtaaacccactattcattatcttactagcattacctgtttctgcgttatggattaaactttcaaaaacaaaaaatggcgatttgaaaatcccaacaaaaatggcattaggtatgattttactagggattggatatttagttctaactttagctgttttaaaaactggtagcgatgaaagtaacattacaatgaaagcaaacttactattcattgtattcacttacatgttccacacaatcggtgagttattcttatcaccaatcggattatctatggtaagtgcaatcgctcctgttaaattagcatcattattaatgggtgtatggttagctggtactggcttcgcaaacttattagcaggacaattagccgctttcactcaatctttaggatatttagaagtattcgcaagcatcggtattatcgtaattgtactgggattagtacttcttatgttctctaagaaaattgcacatatgatggaataacaaaaagacgcttctaaaattagaagcgtcttttttattacttctcctctaaagctgtcacgtccacatgaacgctctcaccaggattagatacatcatacacttgagcactccccttctgctcatcacagctctcaatccatactggtacgccctcatatgtaacgtcaattctacttgaagaagataagatttgtttcacacgtttcacatccatactactatccctccttttgcttactacactcctttctattttttcttttccttttagaatatattccgtaaggcagcatgttgattgatagtcatttcttcctaacatgctaatatttactctctcgctacctttctgacaaataaaaaaagacgtatattctacacgtctttttccataatattcaaattttaagaaaataatgtttttactaccgcacttactttatcattatggatttgataatacacttctaatcctcgtctttcaaagcgtactactttattttgctttaacttcgttaaatgttgtgaaacagttgattgtggaatttctaatacttcctgtagctgtgttacattacatgttcctctttgcataagttccattactagacgtagacgaagtgggtgagctaacgctcttaacatttgtacatcttcttctgaaatacgacattcgaattgattttggctcataaagttcccctcattttcgtttttatttgcgctcctatgcacttttatttattatatatctg

SEQ ID NO: 976 - DNA, 2268 bp, Bacillus thuringiensis
gggattaattacatgggcgatggactgcaacaagcagctggagatcgtcttcgcgatattctagatcgttttacaacaaatccacttatgggtgtactagcaggtatgttagttactgtattaatccaatccagttcaggaacaactgctttaacagtcggacttgtaagtgccggatttatgacattaagacaagcaatcggtgttattatgggtgcaaacatcggtacgacagttactgcatttattatcggaattaaaatcggagaatatgctctcccagttatggcaattggagcaatcttactattcttctttaaaaataaaaaagtacattctgtaggtcaagttgtattcggttttggtatgttattcttcggtttagaattaatgagcgcaggtatgaaacctcttcgttctttagaatcattccaagaattaacagttagcatgagtgataatccaattttaggaattgttgttggtacagtctttactttaattgtacaaagttcaagtgcaactattggtattttacaagaactattcggtcaaggggcaatcgatttacaagcagctcttcctgtattattcggtgataacatcggtacaacaattacagctgtattagcagcaatcggtacttctattgccgcaagacgtgcagcattagttcacgttatctttaatattatcggtacaattatctttacaattttattagtaccatttacaagtttaattcaatatttccaaacatcattaaacttgaatccagaaatgactattgcatttgcacacggaacatttaacgtaacaaatacaatcattcaattcccgttcattgcagtgttagcatggatcgtaacaaaaattattcgtggtgaagatgcagcgattgacttcaaaccacaacatttaaatccaatctttattgaacaatctccagccatcgctttaactgaagctcaaaaagagattatccgtatggctgagttctcattacatggattaaaagaagcaaatcaatttttaaatacacaagacaaaaaacacgcaaacatggctactcaattagaaggagctattaacaatttagataaaaaaattaccgagtatttagttttactatcagaaaagccactttcacctacggattctgaaaaacattctgttttagcaggtgttgttggagatattgaacgtgtcggtgatcatgtagaaaaccttgtagaacttgtagatttccaaatttcaaaccgtgtttcactatcagatgaagcattagctgaattaaacgaaatgcttgagttaacaatttcaacactgcaagactcagttgaagctttaacaaacttcgatactgaactagctcaaactgttattgcaaaagaacgcaaaatcgaccaaatggaacgtgttcttcgtaaacgtcacgtattacgtctaaacgaacgcagctgttcaggtgatgcaagtatcatcttcgtcgatatggtaagtaacttagagcgcattggcgatcacgctgtaaatatcgctgacggtgttttaggtgaacaaggaaaaatcaatttaaaacaatcattataataagaaagagacgctaacgtaagcgtctcttttttcattatattttaacaactgttcttccttttaactttccttgcaatataagtgtaaacttcttctctaattcttctaatgtacattcttctatataagacagtaactctttatttccccattcattcgctaaaagcgtccaaacatctcttctcacatctactggacattgcacggaatctacccctaaaaggcttatgccccgtaaaataaacggatataccgttgtttgtagttcctgacctgccacattaccgcatgtcgttacacaaccaccatactttactgtttttaaagctgtttctaacatacgtccacctacagtatcaataactccggcgtatatcccttttaacatcggtcttcttgattcatcattcaattccgcgcgatgaatcacttttttcgctcctagacgtagtagcatatctttctcttccatttttcctgtcgctcctactacgttaaaccctaacttacttaatatactaacagctacactccctacgccggctgtagcacccgttactaaaacatcttccatattaggcttgattcctgcttcaataagcttatataccggacaaagccgcagtaaaacctgctgtcccatacattatacctttctttaatgacattcct

SEQ ID NO: 977 - DNA, 2437 bp, Bacillus thuringiensis
atcagttccatcgtttctttcgcatgatgtgccattgtcgtttcctcctctttttctctactattcagtatacaaaattcgccagaaaacctctacttatatagcttaattttctaaattgtagtaaaattctttttagtatataaaaggagttataaaatatgaatatatcaaaaaaatatatacacattgcactcatttggtttttagcatcattattttgtttacaaatctcttatgccattcacactactacttctattacaatcggctggatattaacagctatcttcttcattattagcttcattgcaacaaaaaagcatagcgttactcagtaacgctatgcttttcctataaaactattcttctgaaacgtctaataaataaatccctttttcaaatccaccgcgctctatctctttttgcttacgaaggcgttctacatcttcaatcgatgcaccttctgcacgtgctaatgagatgataacttctagtgcatctgcaagagaatctagcgcatgttcgcgttctttcatagaagcaaattcacgaatttcttccgttccaattttcgctaaagcctgtatgtatgcttgccctgttaatttttgtgctgtatatgtttttccagacattaaaatcttctctggaacacgatctcttactaacttgttatatgctgacatcattcatcctcctatatttaataacatccgagctctgctttatagaaaaaccattttttcttcacgcacgcacttaacatatcaattcctgatccatgtgctcttacatgtggaaagaaatagtgctctaagtcttcgtccttaccatatagagtttgatactcatctggaatcgcttcttttttcacatctttttctttcgtcaccccgtcagaaaatgcaacacttggatgtccctcaaaaaacaacgcagtccgaactgccaaagatggtgtactatgcaaagcagaatatgtaagcaaaataatagtaataacaccgatcattttcttcatgtattactccttaaaaaaagtgctaacacaattatactaaaatgtgttagcactttctcccctttatcccgaattaacgagctaataatcagtgaggaatggacaaaatcctcacttcactttattcccctttaaatactggtaaacgtttctctaaaaacgcagcaattccttctttatgatccgctgtttgtctcattgcatattgaccacgcttttctaattgcaatgtttgctctaaattagagcgatttacttcacataaaatttgcttcgtttgaatcattgctttaatcggtttttgtgaccattcattaattttttgtttcacagccgtttggaaatcttcgccgattacttcatcaattaagccgatatcaagcgcttctgtcgctgataacttcttaccttcccaaataatttgcttcgtcatattttcaccgacacgcttttgaaggaagaaatgaccgcctccatctggaattaaagcgattccaataaagttcattgcaataacagatgatatatccgccattacataatcagctgttaacgcaatacttaacccaagacctgcagtcggtccatgaattgcactaataacaagctttggcatcgtatataatgtcacgacaacttcagaaatggtattcataatgccatcaaacttactttcatcattacttgaaagcatcgatttaatatccccacccgcagaaaaaccacggccgttcccgcataacacaacgatatgcgcagaactttccgctacttctttcaacttttgtaataactcttttaatgtcggctcatctaacgcatttaacacctctgggcgattgaccataaccgttgcaacgttaccttcatatttcacaataacagattctgttttactcgttacttccattacatacccctcttttctccataaagattatacttatataattatagaaaaccactgaaaaatccttcttttttctcaattttctgtctaataatctcgcaatttgtacatttaccgtataaaacatacaattccgttgaaaaatatagaaattaaagtcggtttatccatgcttttcatctatttaccattacaatgaaatggtgtattcttaagtttgataaaaaaacaaatattgaaattcattcgccttactatgtaaaaaaggctttatacccctattttaggtgttgtaataaaggaatgaagaactggaggaacatatggttaataagttgaaacaaacggataactacttcccacatttcctattgctattcattgggtttcaaccaatttagatttattaacatctttgtcaatctatatactacacatgagcgcaacagatggagttgtagtccgttgcgcctatatgctacttgcattagggtccctacttc

SEQ ID NO: 978 - DNA, 2604 bp, Bacillus thuringiensis
cggctgataggagatgaagcaaagaagaggggcaaaccagccgtaggaacccgaatagttcaactaatcttttgcaaaaaaacgcaaaagaagtttcactttattatagtctatccaaaaatgggtcgcaaataggtgtttggcggggaataatatttgtcaaatcgcgatgaattggctaacatgaaagaggaaggattagaggtgaatagtatggaagcaaaaacgatgaaagatatgcagaaagaagtagatgcatatattggtcagtttaaagaaggttatttcagtccgcttgcaatgatggctcgtttaacggaagaaatgggagagcttgcaagagaggtaaatcattattatggtgagaaaccgaagaaaacaactgaaaaagaaagaagtattgaagaagagcttggagatgtattatttgttatgatttgtatggcaaatagtttaaatattgatttagagacagcacataacattgtaatgaataaatttaatacacgtgataaagatcgctggacacgtattgatgagggagagaaagaataatgaaagaaattaaagtaattatcgccggaccaagaggacgtatgggacatgaagcagttcttcttatggaaagaacggaacattttaatttagtagcagcagtggattataagcatggtggtgagaagatttctgatttacctggcatgccagcattacatgcaccgatttacgctgatttacatacttgtttagatgaagtagaagcagatgtgttgttagatttaacaacaccagaagtggggaaacaacacgttacacttgcagttgagcgtggacttcgttcggttattggtacaactggatttacagaagaagaattggcacgtttaacagagaatgcaaaagaaaaagcagtaggaacaattattgctccaaactttgcaattggtgcagttcttatgatgaaattctcacaaatggcagcgaaatatttccaagatgttgaggtaattgaattacatcatgatcaaaaattagacgcaccatctggtacagctgtaaaaacggtagagttaattcgtcaaaatcgtgaatcaaagcagcaaggtcatccaaaagaagtagagcaactagcaggtgcacgtggtgcaaatgtagacggtattcacattcatagtgtacgtttgccagggcttattgcacaccaagaagtaatgttcggtggagatggacaaatgttaacagttcgtcatgattcattcaatcgtgcatcatttatgtcaggtgtaaaactatcaattgagacagtaatgaaccttgatcatcttgtgtacggtttagaaaatattatcgactaaaggggagacaacggatgaaaattgccttaatcgcacatgacaaaaagaaaaatgatatggtttcgtttgcatacgcatataaaccaatttttgaacaacatgaattatttgcaacaggaacgacagggcttcgtattatggaagcgactggattagttgtaacaagatatcaatctggccctcttggtggagatcaagaaattggtgcaatgattgcaaagaacgatttagatatggtgattttcttccgcgatccattaacagcacagccgcatgaaccggatgtgaatgcattgcttcgtttatgtgatgtatatgcgattccacttgcaacgaatatggcaagtgctgaaatgttaatgcacgcattagagcgaggagatttagattatcgtaagttaagaaaatgaggggaacaattatgagtggattacatatattagcgtttggtgctcatgccgatgatgttgaaatcggcatggctggtaccatcgctaaatatacaaagcaagggtatgaagtaggtatttgtgatttaacagaagctgatctttcttcaaatggaacgatagagttgagaaaagaagaagcgaaggttgcagctcgtataatgggagtaaaaacgaggctgaatttagcgatgccagaccgtggtttgtatatgaaagaagagtatatacgtgaaattgtcaaggtgatccgtacatataaaccaaaactagtttttgcaccgtactatgaagatcgccatccagatcatgcaaattgtgcaaagcttgtggaagaggctattttttcagcaggaatccgtaaatatatgccggaactttcaccacatcgtgtggagtctttttataattatatgattaatggttttcataaaccgaatttttgtatagatataagtgagtacctctctataaaggtggaagcattagaagcgtatgaaagtcagttttcaacagggagcgatggtgttaagacaccgttaacagaggggtacgttgaaactgtaatcgctcgtgagaagatgtttggaaaagaagttggagtcttgtatgccgagggatctatgagtaagaaaccggttttattacatgcttatttattagggggatgtaaatgaaattaaaaataggtattacatgttatccttctgtaggtggttctggagttgctggaacagaatttggaatgatatagtggcaacgtgggtattgaaattcacttttttacaatcggtttacca

SEQ ID NO: 979 - DNA, 3244 bp, Bacillus thuringiensis
cgaaggaattagttatgtcgggcattattttattcggtgttgttctgatgcaagcagaacatgcttcttcattaggtattcgtgaaaccgttttatgtgtagttcctgtacttattgcagcatttgcgtatcctcttggaaatagaaaaatgatgcaagtttgtaaaggggaattagatgtatttcagcgagtactcggtatgacattagcaagtttaccattttggtttttattatctggttacgaagtatcaacaggcggattaccgtcaagtagccaagtttttcaatgttttattgtagcagttagctctgggttaatcgcgacagtattatttttctttgcaacagatcttgtgaaagatgatccgcaaaaattaacaacagtggaagcgacgcaatctggcgaagtcttatttgcgctagtaggagagctgatctggttatctgcaccaattccgtcatcattatcttggattggtatgagtctcgttattattggaatgatacttcatagttatgtggctgtcgttgtaaaaaaagaagaaaaaataacggcgtaatgagattagctctttttattaagagttagtctttttttcatagaaagggatgaaaatatgaatttacatcgcgttgaacaaattgaaaaagattcaatattaaatgtgctacaatatgccgtcggtccaaatgaaataagcttaaagaaagcagtattattttatcaaagtaataaagggactttgtacaaatatgaagaaaaagcttgtctaggtattgaagtaatcggagcaactaaagcacgagtatgtcatatagcagtggctccagattatcgtcaaaaaggaattgcactgcaaatgattaaagaagtggtaaggatatatcaattgacttatatagaagcagagacagacgatgaggcggtagaattttataaaagaattggttttcaagttaaaagtttaggagaaaaatatccagggatagaaagatttcattgttacatggaaaaatagcatgaaaatatacaattgtacatattgaatatagtttgaaaaaaataataatttcattatataatataggtatctggaaaaatatagataaaagaagatgggtgtataacaagtgagaatggataaaagtaagtttataaaaatagctacttcaataggggtgtcatcttttttattaacaggttgtggtgattatgaagaagaaactgctcagcaagaaagtacagctgttaaaacagatggtgcaaaacaaagaaatgaacaagaaacattaaattgtgatgataaagccccaaccaatgaaaatgtagagaaagatgagttatgcaaggaaaataatccgtcattttcatcttatcatgaaaactctcatttaccgatacttccatttgtagcaggatatttattagcgagtagaacttcaaatatgaattatacagcaaaaccaaatttaatgaagaaaccgtatgcaaataatgttattccatatcgtgaaaaagatgagcgtagaacaggtggcggtagtagcggtggttatactggtggttctaacggtaacaataatacttccaataaagtagatttaaataaacagcagccaaatccatccaataaagtaacaccagatacaaatacgccaaaatcatctactacgcaaacaccgaaagtaaactctggttcaagtggaattggaaacgcaaaagcgccagcaggatcctaaaacgaaagggtaatggagtaatgtatacagaacgagagcaagaagagtatatgaaagtatggttttcacttgcagaagaggctagtaggaatggtttcacttggcctagtctgttagagaatgaagaatggaatcaatatatggcaacagggatgtatcgcatgccagcaaaaacttatactgctatctcaaaagcgacagaagaaatcatgtatgtgttatatagaacgtatcaatatattgtaaatacgacagaagattttcaaaaacttggattcccagctgaagcgtgggaaatggcgagaatgaaacataatggtttattttcatattttacaaggtttgattttatcgtaaatggtgacgatataaaattaatagaagtaaattgtgatacgccaacaggctatttagaaccgtctgtcgcaaatgaagtgttatgccgttatcatgatgtaaatcacccaaaccatatagaagagcatattgtgcaggcatgggaacaaattaaacatgactatcatataggccctgaagagacgatatattttactagttatgattggcacgatgaagatagtcaaacggttcagtttttaagaacgtattgcttaaatcagtcaacggactatgtaggaatacaagacattgtcgttgcggaagatggtatatatacgccaagtggagaaaaaataaaatatttatatagactgtatccaatagagtatttagtaacggacgttgataagaacggaaaaaggattggtttacaatttttagatcatattgcgcaagaaagagtgaaaattattaatccgccagccgcgtttgttatgcaaaacaaaagtgtactcgcactaatttggaagctttatgaagaaagtgttttctttacagaagaagagcaagacattatttataaatactttctaccaacatatttttcaaataagcgatttctagaaagacatgaatcatacgtttcaaaacctgtatttggtcgtgaaggtggcggagtatctatatacgaaaatgatgaattattagctgaagataaaacagagtattactttgaacaaaggaagatataccagcaatacatagaaatgcctgactataccattgacacatgggatggtccatatactggtaaactattaattggctctcactgtataagcggaagagcagcaggcttatttttacgtgtaggtgagaaaataacgggaaacttatcaatgtttactggggttacaattgaaggataaagtaaacaaagagctcatcatttgtgatgagctctttcgtctatgtataaaacagctttttatggttggatgtaaaatcttcactttctttttgtgttttaaatctgaatattataattcaaatattttttgtgtaataatattactattttttatagatgtgaaaacatgataagttaaaaattaagaaaaatatgataatatatttattataaagtttaaaattacgtagc

SEQ ID NO: 980 - DNA, 2345 bp, Bacillus thuringiensis
gctgcctttttttttgcacttgattgccaacgggttccatcctttacttcctgtaccttgtccaacaccttttttcggttttgccttcgttttactcatatgatcactccgttatttaaaaatcttatttgataatagtcaatgatttagaaaatactctttataaatgactatgattgctttaagtaaaaataaactgcttgaatgctatagtatatcatgaaattgcaagtaaactgaaaggaattataaagaaaatgaaaataataagaaatactgcggattctatattccgaacgatcacattaattattgtgtatacgttagtttcggtcagtgaaacattttttggattgacgaggcagaaaaagtaaagatgttaaattaacaacaatcaataaagccgtaaaataaagaattgaaaaatattttaaaactttttgttgactttctttattttttgtatagaataatcattaataaaatgtttcagagatgtgacaacaaaacgactatgaaaggacgagtagtagtaggacgtagtttaagcgagtcaggggtggtgtgagcctgatacgaagcctattatgaagaacctcctggagttgctaaccgaaatcctttataggaaagtagacttagccgggaacttcgccgttacaagaagaacagtatcgagatatttcatctccgtattgtataagtgagcaacctctgttgctaatttgggtggtaccgcggaaccaaagcctttcgtcccagttttttgggaaagaagggctttttttgttggcttcttttcacaacatccaaacattttaggaggaaaccaccatgtatcaatcattaatgacagtaagagagactcaaattgcaattaaggaagttaaaacatttttcgaggaccaattagcaaaacgccttgaactattccgcgtatctgcaccattattcgtaacgaaaaaatcaggattaaacgatcacctaaacggtgtagaacgtccaattgaatttgatatgttacattcaggagaagaattagaaattgttcattcactagcgaaatggaaacgatttgcattacatgaatatggatatgaagctggtgaaggtttatatacaaacatgaacgcgattcgtcgtgatgaagaacttgatgcaacgcattccatttacgttgaccaatgggattgggaaaaaatcgttcaaaaagaatggcgtactgtcgattacttacaaaaaacagtacaaacaatttatggaatattcaaagatttagaagatcacttatttgaaaaatatccgttccttggaaagtatttaccggaagaaattgttttcgttacttctcaagaattagaagataaatatccagaattaacaccgaaagatcgtgaacatgcaattgcgaaagaacacggtgcagtcttcattatcggaattggtgatgcacttcgttcaggtgaaaagcacgacggacgcgcagctgattatgacgattggaaattaaacggtgacattttattctggcacccagtactacaatcttcatttgaattatcatcaatgggaattcgtgttgatagtaaatcacttgatgagcagttaacgaaaactggtgaagacttcaaacgtgagtatgatttccataaaggtatactagaagacgtactaccattaacaatcggcggtggtattggacaatcaagaatgtgcatgtacttcttacgtaaagctcatatcggtgaagttcaatcttctgtatggcctgacgatttacgtgcagcttgtaaaaaagaaaacattcatctgttttaatagaagtgagagagggtagtggtcatctccctgtcaagtagacagaaataaaaagagtattatgccacggccttttcccgatattctatcggggaaaggccgtgaagtttttcttggaatctttctgtattataaaattgaatatattcttgaattgctcggtaggccatttcatatgtttttgggcacactaaatacaacttctctgtttttaaatgtgagaagaatgattcgatacacgcattatcaaaacagtttccacgtctagaatgactaccgacaaatcctaatttctctaactgttttgcgtaggatttagatgtatattgaaacccttgatctgaatggaaaaggggcttagtagttaatgacttcccttctaattgacgtaatgtagttaaaaccaaatctaaatcatttttgaagatagcttccaggcacaattcaattgtgaaaaatctaacacagccgacaaaaggcaaattgtcttcgattcgacataagaatatctgtacgaattttgattt

SEQ ID NO: 981 - DNA, 2614 bp, Bacillus thuringiensis
gttagtgaagtgaatatgttatttggtttagggattgatgatgatggtgttgatacaatcggtggttggattttaactaagaatatagagattgctgaagaggattccattgaaattgaaaattataagttttgtgtgaaagaattagatggacattatataaaaagattagaagttacaaagatagtagaatcgattgttattttagaagatgaaaaacaaatttcgttacaagagcaaattagctcgtaaactctgctatatagcagagtttttttgagcataatgttttttgagggataagggctatgatacaatgacataagtcaaacctttcactaggtgaagtattgttgtatacatatatttggaaggagaagaagtatgaaaaagcatttatatataaatggagattggaaatctgtaaacacgtataaaccattatatgcaccatattctgaagaaacattagcggaaattgcacaaggcacggaagaagatgtaaaagaggctgttaccgctgcaaaaaatgcaatgacaaaaatgaatacattatctgcatatgatcgtgcgactattttagagaaagttgcacaaaaaatggatgaaagaagagaagaatttgcagagattattgcaaaagaagctgcaaaaccaatacgtgctgcaaggggagaagtagatcgtactgttcaaacatacaaatttgcagctgaagaagcgaagcgtatatatggtgagacattgccattagacgccgcacctggtgcagatgggcgtattgcatatacaatccgaaagccgattggggttataggggctattacaccatttaatttcccattaaatttagtagcgcataaagttggaccagcaatcgctgccggaaatacagttgtattaaagccagctgatcaaacgccattatcatcttatgcattagttgagttatttgaagaggcaggattgccaaatggagctttaaatatcatttctggtcctggctccacggttggtgaggcaatcgtcaaaaatgattacgttgcttctattacttttaccggaagtccaaaagttggaatcggaataaaacaaaaggctgggctaaaacgagttacgttagaactaggctcaaatgctgctgttatcattgatgaagatgtagagttaacagatgaaataattgaacgtgtaaaatggggagcatttgttaataatggacaagtttgtatttcagtacaacgtgtttttgtacatgaaacgaaaatgcatgaatttctttcgaagctaaagaaagcgatggaatcagttgttgttggtgatccactgcttgaggaaacggatgtatcagctttaatttcaaaaagagatgtagagcgaattgatatgtgggttcaagaagcaattaaggaaggagcaactgttttatgcggtggtaagaagcgggatgcacgaatttttgaaccgactgtattaaaaaatgttccaaatcatgtatctgtgcagtgccaagaagtattcggtccactcatgacagtaaatacatttaaagaatttgatgaagcgattgagcaagtaaataattcgcgttacggcttacaggcaggagtatttacaaataatttatttaaagcaatgcgtgcaattgatgagctagaggttggtggtgtcatgattaatgatattccaacgttcagagtagatcatatgccttatggtggcgtgaaagaaagtggcacggggcgtgaaggaattaaatatgcaatagaagaaatgacagaaatgaaattagtatgtattaaaaaataaagtagaaaaacttaaaacttgcactaaaaaacgagtaggaaatgtttacgattccatactcgttttttacgcttctagtaactatttaattaagtgtaacttttacttcatttcttgtttgaaaatagtatcttctacataaatttgttctttatctacagcagtagcatgagttaatactaaaccgattggtgtttttgtatctttattttgaacaattgtaaaaggaacatttttttcgtttgctaatttaatgtattttgataaatgtgggtaagcaatgccaccatttaggaggagttgtaatgattgagaagggcgcatgctacccgccacttcagagtatacattactttgcattacttgaccgatcgttaaagcgatttccacacgctcacgtaatgtagttaaatacatattacgttcttctggtttgttttgcttttggccgtaaatgccttcttggagataatcttccacatttttatttaccatatttttcacacctttcattttctattgtacgcaagaattaaaaatgatgcaaaaaaagtcgttttgactacggaaataatgaaaatatgtgaaggaaaaaggggatttgcatacaattagttaaataagaaagaaaaaataattttatcaacagaaattaacaaaatgtgacaaaaatctattaacgaatcgtattttttgtgttaatattcaaaatataaagggtattcgtcgtatggaaatggagggaatggaggtttttccaatcgataaggatattaaagaaatattttgttcacacttgaaaaac

SEQ ID NO: 982 - DNA, 2643 bp, Bacillus thuringiensis
cttgaaatcctaaatttttaataagctctgctattcttttttgaataatatgtgatgataatccgatattttctaaagaaaatgctaattcttgaattactgtatccataacgatctgattttctgggttttgaaataccatcccaatttcttgggcagataacaaatcagctacttcctctattaaaacaccctcataaaatatctctccagaacgcgtaccaattggaagtaactcctttttaaaatgttttaataaagtcgtcttcccagatcccgatcctccagcaagtgcaataaactcacctttttgaacagaaagagaaatatgctgtaacgctttttcattttcatcagcatatacaaatgataaattgtttatttctgcatgcgccaccatatccattctctcccttccattatgattggtaaactaataaacatcgtaaatacgacaaacatcatcccatcgtattgctgaaatagaatcgattcgactttcggataaataatcaatttccccccgccataattactacatataatagcagctataaataaaatgattaaataactgagcgtataccaatcgcgcctttccattctatagcgaatatacgtcgtacgcttcgttacaccaaatccacgagcttgcatagaatctgccgtttgcagtgcatcttctaatgaacaaattaataatacttgcagcaattgcataccatttttgacgcgttcaattatcgaacctgaatctacctgcacacctttcgtcttttgaacgagtgtgattttctttaatcgccttataaacaaaggaacaaatctcactgtaatcatcgttaacaatgcaactttcggtgaaattcttgaaaacaaatataaaaatttatgactggaaataatatcattgtatgacgcaaacgtaaacataactgcaactagtaataaccccattactatgccaaacataatcgcctcaagcttaatacggctatcacctaaccaaaataacgtagttcgacctctatgcgttaataacgaattaaataaaattaccataaagaagaaaacaattgtgctcggtagcatctttcttatcttttcgctatttccttgcatcacatttaacataataattaatactattgctccaattaaaaaaagaggatgaagacacatcatacatagtatcatcaccccgatataatagaaaaaattcacaaaaggatgtaaagaagaaaaacttattttcatagccctttaccgaatgcctttcttattgtaatacgtatacccactcaattgtatctcctggttttaccgtagctacaccagcactatggtttggaaaagcaccgttcacacgatatttccatccactagtatccgcaatatctttttcatataaatcattaataccttttacataaatactatctctagatccgcttgcatcaacatctaatcctgtacgttgcaatactttatacacagtatcgccatcttgtacatccatctttttcgcacccattatatatccgttatttccttttactgagattgttacttgttttgcttgcggtttcggtactggtactggatctggttttggtggttcaggttttggtactgccggagtcggtatcgttttctccgctttattcggatcttctttttgctcctgcttcggtgtttctttcggctgattcacaacctttgcttcttcttttacttctggtgctttcggttgttgtttctcttcttgtacttgttgctgctctggttgcttatttacagcaggttgctctttcggttgttcctgttgtttctcttctttctttacctctggttgtgcctgcggcttttcctctttcggcttctcttctactttttgttcttgtttctctttctgttcttcttgctgcttttgctctgattcagcttgcttttcttttgttttttcttccggcttcgcttcatctttttgttctttttgtttcgctacctcttcttgcttcggttctaccttcttctcaggctttacagctgcctcttcacatccggcaagtagcccgagcgaaagcagtaaagaaataaaccatttcaccttactcatcctatctctcacctttcatacgaaaattaggagcaaataattgctcctaattttttgttaagctgctttacgtctccataatacatatgcagaagcaatacataatacacccatacctacttctgttgctggactatgagaagatgctcctgtttttggtagactgttaccgtttccgatttttttattcttaaccggttcgttatctacaactacttttagattttcatcttttgtttcttgttgtacttgtttttgttctttcggttcttcagtaacttctttttctactacattattttctggttcaacgaccttttctggctcttcaatcggttttggcttaattacatcaccagcgtctacattagaccaatcataaatagattttcccatttccttaaattgaagtaatgctaaaagagcctgttctgtagccattccgttaccattttgatcacttggtaaccatttaaattcaccatttgaaagttgatatgataataggttttgcattgccttat

SEQ ID NO: 983 - DNA, 2455 bp, Bacillus thuringiensis
acgttaattatgaataatctgtgacatgcgtatgaaatatttaaaactaacgtttatatagggactttgattacctgtaaaaacttgaacatatcataccacaagtgataaccattttcattgaaaaaaatgtaaaaaaatgtgagttaaatgtgaaacaagtttattcgaatatagaataaacttgtttcacactaattatagaatcgaaatgtatgtgtctcctcatcaattaaactcgcttcttgaaacgcttcttctaacgttttcccatggttaataaccccataaaataagcgtatagtaaacataagtgctgcatttccatctacataatcaatcgatccaatatatgatttcgcaccactatgtaaaaaagattttgctagattttgctcccctaacgtgcacccgctatttacaatatgtgtattatgcaattttgcatatttataaatttcttctgtaccaaaatcccctctcggttcatcttgttcatatacttcttcgcctaactcttccatgacaaacttcccttcttcaccatgaaagcaaaaaataatataattaatattgttaaataagttctttccagaaagaacttccacaaaatctttcggtctaccaatccaatatgtcacaacccttgcaccaaaatattcaagagatgctcgaattgattgcgcttctaaatccgaattaaaaccaactactaatgcaatattcaacatacaacccccatcctataatcagcccttatcaatcagaattttatgggataaatccatttcatatatgcccctttctttcaaaaaatctgatctagttaaaacgactttctgtaaatattgcctatatgctgtaattgttccatcgtgagatacaatgcaaattctttcagcacccagttcataacaccaaagaagaaattcatctactatttgctgaaaactattctctgaaatagtgtttataccttccttccataactgattatttgagcttttctctatcgaaaaatgcggaaataactttgttatcattccctgatctactatataatcgcacggtaatgttttcgctccttctcgataaggaaaaatacgtggggatacatatggatggactagtttttgacaagcaactttcgcactccatattgtcgccgtttgcaaagttctaagtgtaggactaacaattaatatatccgtctcttgcaatggcacattgcattgaagtaatttagcttgagcctttcctactctcgtcaatggtgggtcaaacacttgtaaactttctggtaaatccgttgtatgttcaccttcaccatgccgaacaaaaacgattttcatcctcttcctcctctctttatgaaatcctcttacatatttcttccctatcttatactttattcctgctatatgaaaaactgatatgtaaaacactttttacaagggagaagtgaatcaaaaaatatgaaatggataaccatcttaattggaatgattatatggggatacataaatggattttttagtagtgataaagtgaaactttaatccgtgggggttttgttcatcccccacggattattagttgaaccaatcgggcttttacggacagttgatccccacctaacttctttgcctccgctgaattttgaggtgggggtcttactgcccgttaatgcgggataaaactgctaatccttggattacagatgatgaacgtgaaacaaaaattaaacaaaaagcaattacggcaagctggtccggtgtttttatgttttgtaccattagcctcttaaataaatggttaggtttaaacacaaacgataaatcaccgtacttaccagaccctatcgcagctattttaaaggaaaatgtagagttacaagttttactcatgctatttgttatgtatggaatattttacttacattatcgaagaaaattaagtgcctaacttctaactcatgattatcctcctaaatggttatagtaattaggacgaaatgaaaggagtgatagaaaaatgagtaactctgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcaagtacccaatttcatcaataataagtaatttgtattttgtatagtggcttaaacgagattctaggcgattctcaatcttggcactgtttaaattttgaagtaaatcatgacatttattaaataa

SEQ ID NO: 984 - DNA, 4160 bp, Bacillus thuringiensis
agacccgttaattatgttcaaggatgcagcatataagcaaaaaacaaatatatatatgcaaaataattctacattgattttatgcgattcagttacgcctggttggtcgccaaatatggagaagttcacataccaatattttgattcgttaacaaaaatatatatggaaaataaacttgtagtatacgatcatttattgctaaaccctttcaaagagtcgttagatcaaatgggaatattaaatcaatattcccattatggtactttcatagttattaatgagaacattacaaatgatttaattgcaacattgaaaacatcactttctaacactaacaatatgaaaattggaatatcttctacaccatgtaaaggctttgtcattcgcatacttagtcataatactgaggatatggagtctatattttttcagtgtcatcgttttgttagagagaattgtctacatgaagaattaacatcctatcgaaaatattaagtaggagaaggggatactatgactaatgtgggattattgtttgtcggtgcagttctatttatgaattcactagcagcttttaaacttattgatagcaaaagtgtaggatactttaatttatttgtaggggcattacaaactttgacaccattatatttattatttacaggaagtcaatccgatgagtggactatcctatctaatggaactatttttttatttgggtttacttatttatatgttggtcttacgaatatattaaaacttgattcttcaggtgtaggttactattctctttgggttgctatcattgcatcggttatgggaattgtgaatcaattacatgagagtggtagtttgcaaagtacaataatttggttcttttgggcattcctttggtttttatttttcctacaagatggattgaaaaagaagattcatatttatgtaggtattgtttgcttcattgaatcttggattgctgcaacagtaccagctctgttaacacttacaaatcataccgacgtgttaaataattttgtaattattttagcgactattataacgattttagtttttattatggcacttttctttttcaagagtattcaatttaaagtagaaagggttagtaactatgtggaaaagtgaactgaaaaaggcaaccaacttttttgttattattatatttcttcatgtgcttggaattttattattattaccggcgctatataaaggtaatagcataatcggaatggctattattgcatattctttagggttgcgtcatgcgtttgatagtgatcatattgtcgcaattgataatactgttcggaaattaattgaaaaaggtaaaaactcacagggggtgggagttcacttctcattagggcactctacggtagtatttgcgatgattgtattaattgctttgattggaaaatcggcaaaacatggaatgcagagcttttctactataggcggtattatcggtacaatcgtttctagtacattccttatcattattggtcttaccaatctgttgtaccttattaaagtgttgagaagccacgaggacaaacagccagaaaatttagggtttatatatcgtttcacacagcgcttatttacgtttattgatagtcagaagcaattgtatataatcggttttttatttggacttggttttgatacagcgagtgaaattggattaattgctctttctacagtaactgcaacaagtcaatctattccacttgtaagtatatttgctttccccgttttgtttgctgccggaatgtcattgatggatacattagatagtacattcatgaatacgaattataagtgggcaatggaaaatagtcgaataagaaattcatataatgtattaattacctcaatatctgttattacggcttttttaatagggggatatcaactattatctttgcttattgaaagctataatttacagggcccgttttggaatctcatacaagtagttaattttgattatctgggtatatgtcttgttgcattctttattatttctcttattgtttttgttgtatggaatagaaatgcctttaaagaaccgcttacaaagagcatagagaaataaaaatatatcatatgtcatttggttcattatgtatataaagtaaaataaaaaacacgttagatgaaaattcatccaacgtgttttttattatttatgttccttatattcatgtactttttctttcacattaccaactgtatctttagcagtgcctttcaccttatcccattttccttcagcttgtaatttcttattgtcagttactttcccaacagcttcttttacttcgccttttaccttatcaatggcaccttctactttttcttttaaaccgtgttcatgcttagtcatacatttctcctccttgtagtttgattagaattctcttttcatagtgcaagttgaatgatgtacctagtaatagcgtaacaaatctagttggaatattcaaatgattaataggatagaaaaggaattgtcataaaatgtttaaaaatgtaacggaaggagaaataaagtaaattataatatgtctcttgcggtccatattgattttgtataagcaattttcatgtgggcacgttccatgttattttgactgccgctaccgaaccttgcttgtccaactattaaagtacaattggattcaatagctgtcttaattcgtttttgaattaatgcagtatgacagcctttacgctgaaattctggcaaagtagcagaagcagctaatgatgcgacacccttatttatatacaggacaccaataccagcagggatattttgaacttcagctatgaaaaaatgccatcctggttcattgtaaagaatttcattattttggcgcacgctatcttttgtaaaggatggcatattaaatccacatacataaatgtctgcaaaaatatcaaactcattttcttttagttttcgtattgtaatattagaaggaagaagtgatgaaccctctctcggtatactatacaaagcggtatggaagctagattgataaaaccctttttgagataagtattgaaataattcagttgtaccttgtgctggggtaatttcaaaacgacaagggatttgtagtgattcatactaagaaatgattgcatcaatcgcatctgcatttgtaataccttttaccgtattaaaagcatgaccagcaattatttttgatgaaaaggcagtggcgctaccgaatttttttatttgcacttgcatggggtttccgcttattgtttgtagtctctctaatctagaagagagcatatcaatttctgcattttcaatttctgttgctatatcgagtgtcataacagtagtcataaaattcctccgttaataaatatatttcatagtatatatacgatttttgttttgagattcctgttgtaatgtaggagaataagaagttttttggaagggaaatggaattgaactgtcgaagggagtagaaacagattaaaggtggtgctctcatgaaacagaaagacgtgcagacatgctctaattgtggttctcaaaatataggagaaggtgagtttgttggatatgcacaaatacggaaaaaggaaacgatgttcacatcttcaccggtggatgcttatatttgtacagattgtgggaatatccttttattaaaggtaaggaattatgaaaggtttaaacagaaacctttatgattattgagaagtggtcatatccaactttgtatacgaaacgacttatgttaaggaaaatgaatatgagtgatagtttacatatatatgagtatgctacagataaagagatgacaacttttactgtatgggatgctcattgatcggtatgtgacacatataactatatagaagaaattgtggggcaatataatggagggcaagtagcacctcttggaattgtattaaaagaggagaagaaacttataggcacgtgtggatttataaaatatgattcggtcacacatacagcagaaattgcatacgccttatctcgaaaatattggggatgaggattatctgcgggggctgcattagctttctgctactatggttttcatgagtagcctgttaatagtattgaagcgggatgtga

SEQ ID NO: 985 - DNA, 3068 bp, Bacillus thuringiensis
cttagctactatttctgaagatgatgcaaaaaataataaagattactttactttaatggaagaaaacgtaaacacattgaaagaagcaacaaactaatccattacactttctaggcagctgaatttgttattcagttgcctttttatgtatttatccttgacttgaccaaaataacaagtaaaattatccatattagctttaaagctatattaatttagaaggtgagttggaattatgaatcttcacatttgtgaagtaacagcaaaaaattggcgttcagtagttgctttagacgtcgcaaaagatcagcaacaatttattgaaagtaacgcgttttctttagcagaatcattatatgaaggaaacggaacgtcagtaggtttatatgatggagaaacacttgtaggatacgcaatgtatggatggtattcagtaaaacataaaagtgtatggctcgatcgctttatgattgaccaacaatatcaaggaaaaggatacgcaaaacgtttccttcgcttactcattcaattcttacaagaaaaatttgaatgcaaaataatttacttaagtttacatccagacaacaaacttgcaatgggactgtatgaatcatttggtttccgcttaaatggggatattgatgatgaaggtccagttgtaggtgttgtaatggagttactaatagacgaaaatataagcctgtgaaaacaggctttttattatacatttatcaatttttagtttctctcccttatttaattctgttttgcaatctaatagaatgctcataaaaaataagcctgcaatttacgcagacttatttcacacactcctcgaaatgttcttggaaccactctttattaatatctcttccgataaaaactacttcacttactcgctcttcgccctcttgccactctctatcgtacgaagcagcaaataacgtatgtacaccttggaaaacgatacgtttatctactccatctatcgataaaattcctttgtaacgatataaatattcccctagctcttgaacgacagctgacatccactcattaagcttttgtaaatccagcggacgttcttcacgtaatacaaatgatttcacaccttctaagtggttatgttctttatgagggtaaatttgcaacgtatctttcattttaaacgtttggatttgtaataaagatggtatatctacctcacagttagtcgcctcaattaactttgcagtcgggttaattccttgaatttcatgcaagagattttctttctcattctcttcaattaaatctaatttatttactaaaacgacatcagcaaacgcaatttgctcttttgcttctaatcctttttcaaaatgtttatgtatatgataactatctactaccgttacaacaccgttaatttggtaagcagattgaatgactggatctaaaaagaatgtttgaataatcgggcctggatttgcaaggccagtcgtttcaattactaaaccatcaaaatccattttcccttccgcttttacgtccagtaactgttttaaagcaacgagtaaatcttcacgtacagtacagcataaacagccatttgtcatttccataatttcttcttccacattcataatcaactgattatcaatgccaatttgccctatttcatttacaatcaccgctaatttcttaccgtgattttctgataaaatacgatttaataatgtcgttttcccagatccaagaaaaccagttaatattgttactggaatcatttcgtacatctccttatagctatatgtttctacattatagcatatgaacactcccccacttaacaaagcttgaagtgggggtttctaacgtttcgacctaacggacgattaacgtcaggggagttaacacattagcgagctgtttcacgcctaacccctctatcccatttgtccatgcatttgggattacttttcgtaaaatgttagccgcagcatttacatctgcattaattaaagttttatttgctgaacgatatataccgcgctttattcgttttcctgaaaaagttgtattttggtcattttctccatacgttggaatgaagtcgttatccagaaaacttgctttcgatgtatatgattcttcagttacaacaacttgaatgcctacagcatttgctttgtatgtaatcatttgaatcagtaaattatgcgggatatgacaaaacgattggttatttctttttcccatattcgtttcttgtttccaacttttgttttgaccaataacgattttacaaacttcttcttcttgagctagttttacgatgtggtgactaactttatggaagacgtcttttattttcaagtaacgtttttgatgaagtttttctatccttttagaagtaaaaggtccttcattcgtttgttttccatttctaagaatgcttgtaaaatgactcttcattttgttgtaatattgatttatgcttttgacatgtttgcccttaacaaggacaggtttcatacctgtgtttgttacgatggttgcaaggttatcaatccctaaatcaatactcatataacgagcattctcttcaatcatttgttgttcagaaggaacatcaattaccaattccactacatattcattgtattttggaatcacacgaacttgtttcagtttaccttcagtgaaacctagtttcccaatatttaattgcaatttcgtctttggaaactttaaaaatctaccgtttttaatgatgcaatcttggtttgtatacagaatctctttttcagaagaacgaatatactttggaatcctaggcattccatcatatttgtttggattctttttatagtcttttaaactagcaaaaaaagatttccaattttggaacaaacctttcatgatggactggctacattgcgtaggcaaagctcgataatcattttgaatcatagccttaaatagtgcatctagaaagttgtaatctacataaggtttttcaaaattaggttctgaaaacaaattacatgtaatctctttctgttcttctttaggctttactttct

SEQ ID NO: 986 - DNA, 2757 bp, Bacillus thuringiensis
caataacaaaatgtaaatattataattcattcttccgtacttacagtataaggccaactcatagcaaaagatcccgtatacaattattagtattggatttgttactaatgacagaagtatcctttttgtattttctctaaatatagaaaccactcctaattatatgaattactgatattaagtatactttattgtaaagtaacaaaaaagctatttaatcttgccgcaaaaaatacaatagacatatgaatattatattcatgttaaaaaggccaacaatccaagattgttagcctctacttcccctattcgtaccttttatcactttacttcctaacaactggaatccacatttcaccaaacactaagccgtttcttttccccatctcaaccgtcgtatttggtccaccaacataagcaaactcatttgcatctggtaaagcttgaccgaaggcgatgccagtcaacttattacttaactcttcagctgttttgtcttccccttttactactaagtattctcccctcggaaactgaattactctagattcttcttctatttgtgcttctgtcatgacacccgcataatacatcattttgttattcaccgcttcgctcacagaaaaaatgtattcatttgtcgctaaagcttttaaagtgtccagccttccatcttctttaacagccgaccaaaaggcttccttttctttatttattccagcaaagtctgtatattcactcttaatttcagttccaatacctaacacaataaagctatctttttcttctatagtataatttttcatatgcaaaacctgcctctttttttattaatcaaacgatttatcttttcatctgatacgtttataatatctttaaaccatgtcaaaaaatgatactgtttaggagaccaacatgaaaaaagttgaacggatcaatacaattatgcgatatatcaacaaccgctcccactttacaatttctgaaatcatacgagaatttaacatatcaagatcgacagctattagagacattagagaaattgaagctatgggaatgccacttgtcgctgaagttgggagaacgggtggatattttgttatgcataattctatcctgcccgttgttcgctttactgataatgaagtgaaagctctttttattgcctttatggctacgaggaatcaacaacttccctacctaaagagtcgtcaatctttagccgaaaaactactaggactcatctcagaaacccagcaggatgaccttgttcttttaaatcaactcttgctgttccaaggaactaatcctcataatcccgatctacttgagctttctgatctcccccatcctatgttagaaaaactcattcaaatccttcttttggataaccatttattgattaccattaaaaaagatgaagaaattaagtcttatccaatttatctattacacctttatcaagaaaaaagccattggattattgaaggatttgacttaaaagaagaaaagaagttaatgtttcctgtcgatgatctcatcaatatcgaaccatacacgacgaataaaaggctcaataagaaaaagattttagaaaaactaagtaagaaggctgaagcaattaaccttgtacttgaacttggtccgacagcaattgcccagttcaaaaaataccatcctttaaaaatttcaatatcttatactaatccttaccaatccacagccattttaaaaacttttatcaatgttaacaatcccgatgaagtgacggaaataataaattggctgctttttctagggaaggatattaaaatcaaagaaatacccgatgaagtattagcagatttacaaaaacgagtgtgcttatacattccataagcagtgagcctcaaatattaagctttatcactggacaattattctatttttaaataccatttcatttactacaatgagagcatgataaataataaaagcacggaaaatctcccgtgcttttctaaatatatattattcctgaaggtttcgtttatctcgtttcttaccctagctgacgtttaaatgctttactagcaaagaagtaagcaataaccataattccgacgcaccaagcgagcgcaatccaaatatcgtttccaacagttccttcatataaaagagcacgaatcgcattcacgattgaagttacaggctgattctctgcaaacacacgaacaatttttggcatcgtttcggtaggtacgaaggctgaactaataaatggaagaaaaactagtgggtacgagtaggctgtcgccccttccatagactttgccgtcagccctggaatgatagccaaccatgttagcgctaacgtaaacattcctagtatcccagctactgcaagccaatctagaatattcgcactggaacggaaacccattaagagcgcaacaagaataactacaacgatagtaagtacattagcaacaagagaggttaaaacatgagcccacaatatcgatgaacgcttaataggcatcgtaatgaaacgtgccatcagcccactctttacatccgtaaagagtcgcacggaagtgtaagctacaccggatgcgatagccattagcaaaattcccggcaataaataatgacggtagttatctgttcctgtctgtatagccccaccaaatacgtatacgtacggtagcatcatcataatcggcgtaatcgctaccgtaataaatgtatatggaatacgcataatattgcgcacta

SEQ ID NO: 987 - DNA, 2110 bp, Bacillus thuringiensis
ttgcatgtacgtttttacgcatcgttttaattgtagaattctctacaactttatttccgatagtcgcctggggtggcacttcaaactgttgtctcggtattaattcttttaatttctctacgattactttaccacggtcatacgctgaatcacggtgtacgataaatgataaagcatccacttgttcattatttaaaagaatatccattttcacaagtttagatggtttatagccaattaactcgtaatcaaatgatgcataccctttcgtatttgatttcaattgatcgaagaagtcatatacgatttctgataacgggatttcatatgttaatgtaacacgcgtttcatctaaatattgcatatcaataaacgttccacgtttaccttggcaaatctccattacagctccaacatagtcattcggaaccataattgaagccttcacaaacggctcttctacacgatcgatagactgtggatctggcatattagatgggttatcaacaataacatcttcaccgttagttaaataaactttataaataacgcttggcgctgttgtaattaagtcaatcttaaattcacgttcaatacgttcttgaatgatttccatgtgaagaagccctaagaaaccacaacggaaaccaaatcctagcgcttgagatgtttctggttcaaactcaagagcagaatcgtttaactctaatttttctaatgcatcacgtaaatcgttataacgagcagagtcaattggatacagaccacagaataccatcggatttaacttacggtaacctgctaacggctctgcagctggacgtttcgcatgtgtaatcgtatcaccaacacgtgtgtcaccaacatttttaatcgatgctgctaagaaacctacatcacctactgttaactcgtcacgttgcgtagttttcggtgtaaatacacctacttctgttacttcaaattctttacccgttgccatcatacgtactttatcgccaacttttactgttccatttacaacacggatataagcaattacaccgcggtacggatcatataaagagtcgaaaatcatacattgtaatggctcttctgaatcacccgacggagctggtactttttcaacaatttgttctaaaatttcttcaataccaattccagctttcgcagaagcaagtaccgcttctgatgcatctaaaccaattacatcttctacctcttgacgtacacgttctggatccgcacttggtaagtcgattttattaataactggtaaaatttctaaattgttatcaagcgctaagtatacgtttgctaacgtttgcgcttcaataccttgcgctgcatctactacaagaatcgcgccttcacaagccgctaaactacgagatacttcgtacgtaaagtcgacatgtcctggtgtatcaattaaatgaagaatatactcttcaccatcttttgctttatagtttaattgtactgcgtttaatttgattgtaataccacgctcacgctctaaatccatagagtcaagcaactgagctttcatttcgcgttgtgttaacgcgtttgttttctctaaaatacggtctgctaacgttgattttccgtggtcaatatgagcaataatagagaaattacgaattttggactgtctttttgctctttcttctttattcatctatgttctcaactcctaatagtctcgccaatatacactagcactgattatatcaatagagcaacaaagattcaatgaaaactcgtgctgcttacgatacaaatcattctatctatatcttatgcgaataaaccataagagacaaacccttttcaaattttaaaacggctgtcctacaaatcagtaaaacaaccgcctcccatgttactcttagctaaaaattccttttattttcccaacaactatatccgtcccgaacttcgtcatttcataagctacacttgctaccgccatcccaattccttctacaacattaaaacttcttaaacgttctaattgctgttgtttttctgaggccgaaaacgagctacccaaaatttctgattcagcacctgtactttctgtccctgtcatatgagctatttg

SEQ ID NO: 988 - DNA, 4356 bp, Bacillus thuringiensis
gctgcatgttgcgcagcatgcaccatcttttctactacatctttcggaattgattcttctttatatttacgaactgacacatgttgctccatcttatgtatgatctcattcatgaaaatcactccttttttctcttcataatgaaaaattaacatatctttttcaattttcacaacttataagcacaaaaagagcaattctttttgaattgcccttttttaaaacgtttatcgatacggtaaatgaaattataattatcttattacgccgttttcaaaactttaataccttttacgatattccaaatgaagtagtaaattcctacaagaatgaacactgcatatgtgatagccattccaattccagcaccgtcagattgattgaaacataaaccgtacatgcctgatactgctagtcctccaaataagattgcgtatgggaaaacatgtgaccaaaatgcttttttcgcgtgatacttcacttcatcttctgcaacaaagtacacgataattggtagtaaaaatggtgcaaaaaagatactaaagtaacataacgaagataaaatattatttcctttcatccgattcacctctaaatagtttttgttaccttcattatgtcaggaaatcattctagaaactatcgctttacctttcacgaacgtgacatatttgtaagattttcctcaaactaaatcccgcctgagtttcagacgggatcactttcactatattcgattcataaaccaatactgtgtaattgctaaatattctcgtacattcgatggaatgatgattggtttcggtgtttttgccggaagaccttctaattgtaaaccttgtttggccgctatttttttcgctctaaacatgtgaaaatcgtttgttacgatcataccttttttcatatcggctggaattaacggttttgagaatgtaatattctcatctgtactcgtagatttgtcctccattataatgcggtcttctgcgatattttgttttattagtccttgtttcattgctaatgcttctgaaatgtcttcgccttttccttgtcctccagatacgatagcgattgttttctcatgtgattttaaatattcagctgctttatcaatacgatattgcaatgaataagatggtttcgtcccatttactttcgatcctagtacaattatgtaatcagcatcgtatgttgcattcatatgcccatgcttataaatgtgatattgtaaaaaccccgcatacacggcgcaaatcattataacaactaaaatgcccttcattattttcttctttctcatattcatatactcctattttcttttacttccttcatgataatatccatttatttgtttgtatacagacaaattccaataaaccctaatttatcctctgaaaggtaatatttatattactttcgggaatagtaagtacaactttacacgaaggagtgtctctattgcttctctttttatgtaacgtgtcgttctttttcatcttatttttgctatcgcttaagttactcggtaaatccgcgttagcgcaactaactcctcatgattttggggctataatttttttatcttatttagctttccaggccatacccgtctctggtgctttacaagcatttctcggtatggttgttatcacatgtttacatttactccttacaaaattaagcctattcaacaaactaaatcgttttattctcggacaccctatcattttaattaaacatggtgatattatttttgagaacttacaaaaaagtagataccccattgcagaactgctttctaatcttcgcgttgcaggatatccaagtgttcatgaaattgaatacgctattttagaagcgaacggcgctattagtattttaccaaaaagagaacttgtaccattaactccaaaagatttaaacatagatgttaagtatgctggattaccaattgcacttatcgtcgattcacaaattcaatatgataacttaaagttaatacataaagatgaaaaatggttatataaagaattaaaagaaaaaggaattacaaatattaaaaacgttgcctttgcttctgttcaagaaacggatggatcttttgctattagtttaaaggaataagaaaatccccttaattgcttaaggggattttttatcatatcgcttctttctctcctgccatatttaatggaacaggatgtttcatacgattcatcgtaaatacgataatcgctgtcattacttctgcaactggcataacgagccaaattccatttataccaaatagtttcggcataatccataacaatggaataataaatagtaatcctcggctcattataataagtactgatttcttcgtttgtcgcactgattggaagtactctccatacacaatgttataacctaaaaatacgtattggataaagaataaactaatacctgttaaggttaactccaataattctggagattgaacatcaaataaaccaatgatatatttcccgaagaataatccgacaattatcgcaacgcctccaaggacaactgcaattttcacagcaaacttcaatccttcacgaagtctctctgataaatttgccccgtaatggaaactagcaattggctgtaatgctgctccaacaccaaagaataatagtaatgtcattgcatgaatactattcaccatcgcataggaagctactcctacttctcctgcatattggacaaatgcgatattaaaaccaatcgttacgattgcaaccgtactttctgctgtaaaacttgggaaaccaatcaccataatttgtttgacagtatcccattcaaaatgaaatttcgtccactttaaaatactactttttctaaagaaatgggttaataatacaaggaaaccaatcgctgccgaaagaatagtcgctgaggcagcacctgttacgccccatccaaagataaaaataaagatatagtcaaacactatatttaatacagccgttacaacaagaccagccattgctaaattaggatttccatcatttcgtataaatgtacttaaaatattttctaaaacgtatatcattccaaatgttaataatacgtgtaaatagtctaacgcatatggtagaatcacttcgtttgcaccaaataagtatgctaaatcttctattctccataagcaaatcgctgctaaaatccctacgataacaactgctaccgtcattgattgagtaaaaatagaccttgctctttctcgtttattttcacctaatgcaatggagtataacgttgccccgcccattccgatccataatgaaatagagaagaaaatcgaaaaggctggaatagccacgttcactcctgctaaaccgttcgccccaactcctctactaatcataaccgcgtcaattacaatattcactgacattaataccattccaagaactgctggtattaaataagaaataaataagcttttaattggtttttctcttaatttttctgttgcttccatactctaatatgctcctttttttcaactctcttttcttagtttaaaccttcaagtaactttaaggtcaatagagaattaaaaaataggtgacttaattatcgcgtttgatgctcatttgtaattatacgagccctataacttattgctttgttttttcattataggaatttgaatttctgttacttgctcctcaggatcttctgttacagaccaatcaattaatgcaatctcaattgcatctccacttatttcgtatccttcttgatcaatatatttcattagcttcttatatgtttcatcagtttcttcatatggcccatgatgatatacacaggcaaacataccttctttaatttcatctgaactctgtacttcaaaaggcatataatccaaaagaataaatacactgctatatgcttgaaactcattttgcattaacccttttttcgcaacagttacaccaatatctccagaaaataagctatcatccatttgcctcatatttttttgcaacgaatgaatgtagtactcaaacatatcatccgtcgtattcggggcaaccgcaatagctgttatttttcgctgcgggatctcttttattaccatttgttcagcttttgcttttgttgcttccttaattaaatgaattctatgctccattttcgctaaagcatactcaatttctctttgtttcttcagcatcatctcttgttgtttttccagtaaattgagtgcgtatgctggatttctttcatcaatatattttttaatttcctttaatggaatgtttaattgaacgtaaaaacttaatcgtatctaatagtgaaaattga

SEQ ID NO: 989 - DNA, 2931 bp, Bacillus thuringiensis
attcgtgattttccggtagactttatggttattagcttatatcgtttattatgttttgtcaattctttctaaataaatattttgagaatttttccaaaattttcactctacatttatactttaagaaaactcagctataattcgtattaaaacttaaaaatctacttctattccttcagcatgaaacatagaatactaataaccaattaccaaaaagggggcgaaaatatggacaacctattccaatacgtcctgcactacgtattattaacaattatgatagtcggagcgctattactattcccgttcttcccaaagttcgtcctctttttagctttttttattatgctcgggatcgctattataatttcaacgagagaagatgccacgcaaaaagagagcagagttcagcgcgtaaagctgtaactttgctctcttttcgtttccattcactagtctctgttacacatatttatcccgctatttgccgtgcagtaagacccccacctcaaaattcagcgaaagcaaaagaagttaggtctgggtcggggtgcccgtaaaatccctcactttatctctcgggaaataattagcctttgtttttgtaattacgcctatccaaaaaccactaatgacatttattttttaccttattattttcatatgtttcacaagctatgcaaattgaggaacacggatttatttaagttactgtttcacgtgaaacacatcgcttcatttaacctttaaagcaaaatatcattatgaagaaagccacttcctccagcaaaactgaaaggaagtggctttctactcattactccacaatattctctaattcattatataaatctgctcgtaacaactctttcttcgttttttcctcatataatttttcaagtttttcaacatcagctacatgttccattccacattctattgcatatatatcttcttctacatgcattaactcattttcaatctcttcaagattcctagcttctttctcttttacaggaaccgtttcaacactttttctcccttggcgtttctgctttattacttgcttctcaatcttttcctcccacttttgacgagcccatgcataatttcctgcaaactcaaataatttgcatctatcaatccagtacgtcttttcaaataacttatttaaaaaatatcgatcgtgtgaaacagctaaaatcgtcccattatattgctcaagggcttcctctaaaacttcccttgattcaatatcaaggtggtttgtcggctcatctaaaattagaaaattgatgtcttgatacataagttgcgcaagtcttaacctcattttttctccaccgctcagttgtgttactttcttaaacaccgctggaccataaaataaaaacttagctaatatatgtcttgcttctccttctgttacagccacatactctctaaacgcttccaatacattactcttcatattttcatatgcatgttgtgataaataaccaattttgacactactaccaattcgaatttcaccaacgtctggatttatttcttctaatagtagttttaataatgtagtctttcctgtaccattacgaccaacgatagcagcacgctcttgaaaacgaacatgtaaattcgcttgttcaaataaagatcggccagcaaaacctttactcacttctttcattacaacaacatcttttccgcttctctcttgcccttcaaactgaagacccatctgttttctttctaaaatcggtctctttaatttctctatacgctctaacgcacgttccatattcctcgctcttttatgcaatccttcattcggaggattcgcttgatttgcccattcacgtaggcgcttaattgcttctttcattttctttattttcttttgctgctcttgataagcttgaaactcttgaagtaatctttcttccttctcctcaacgaactgggaataattcgtatggtacacgtgaatctctccatcttccaaatcaaaaattttcgttacaacttcatcaaggaaatagcgatcgtgtgaaataaccataactgttccattatattcttttaaaaatttctctaaccattcaactgcaaacaaatctaaatgatttgttggttcatctaatagaagtaaatctggtttctgcaatagcatatatgcaaggcttactttcgtctgttctcctccacttaattccgtaaatactcttggaaataagtctgttacttgtaagccatttgctaccttcattatatttgcctctatttcataaccaccgagaaatgcaaatttttcttgaattattccgtacctctccattagcttttgcaaagaagattgttcctgctcctccgccatatttttttctagagcatgcatttctttttctaattccttttctactttaaaagcggaactcaatacatcatatacagtcatgacctcatcaaacttcggaatttgtgcgacatgaccaatacgtgtacctttcttcatatggatggctcctgcatccaaactctccattcccgttagaagcccaaagattgttgtcttcccactaccgttacgaccaactaacccaacacgttcaccattctttatttcaagcgatatattttcaaatatgatgtttccaccaacagatttcgttacattatttacactacaaatagtcattttccgtactcctttcaatataaaaaaccatgagaaagaaacattccccatggttttcggcatagaaaaaggaagccaaatagctcccttttcacacgtttattaaaaatgggtgaagagatttctatcgttcaatagtcactatgcaattgttaaaaaagggcatacgtatcccgttaacaactacatcatgaaaaatcgcacgacaaaaatagataaaatctaaaaatttg

SEQ ID NO: 990 - DNA, 4313 bp, Bacillus thuringiensis
  unsure (1)...(4313): unsure at all n locations
agcctgcaccgagtaaaaaagaaatgtttcgctcataatgtatattcatgtagtaaaactctttcacaatatgcggcacgtgctaaaaggtgttggtgataactgaacttgtgtaatccattttaatatttcttttggattgtcttgaaaccgctctgcaatgtctgtattgaaaaagtgaatcccttgaaccatgttcgtttcaatattgttacgttcttttggcgatatgaattctttagcgatataatcatcaaagaccttcggattatcaaattcactatgatatgccctgctgaaagctgatactaacgacgttacacttgcttcaccttgtttcacgtacatacactctccttcatttttacaacaaaaatagggttcccctggccaggagaaccctattatacactttatttttatattggtaaattatagcataaataagtttttttgtcaagttttcagcctactaacgctcaacaatttgtgtaatctctagcaggaagatttcgatctacaccgaatattccagttcataacaatacaaatggagggcgtcataaaaagattagtcatcattacaggtggaaaaacacacagtggaaaaactacatttgcaagagcattagaaaagagttaccccactctttcgtatggatcaagatcaacaagctgaatttattaacacgcatgatgaaaaattacagccggctgaaggtgctaatacatttaagcacggtctttctaaattcattgttgattatgcgaaagaacatacaaatttacaccttattattagtaactccaatcgcagtaaaaatggaaggttatatttactaaacgaattatttccacagaatgaatatgtacgcatactcgttcattttgacattccagatgatgtactttacgaaagagtggctcgaagcacgcgaagtaccaatatttttagaggtggatattctagtttcaaagaagtatttgatcaacaacaaactgaatcacttcacgatgatgtggtagatcctatagaaaatgaggctgattatttgtttgttattcgcaataataaagatataagctttactattgaaganattgttcatctagctaaagatttatcccctactccaaaataagagattataaaaattacataatcatagattattatgcaaatacttcctctaggcagcgcagatggtatataatgatggaagaatctacttctatatgctcaattttacacaaaacagctcatgcatatgaaagaaaagaggtacaaaaatatgaaaacaaaacaaacaatcgctgcgtctacactagctttagcaatgattgctggcgcgaactctgctcatgcggaagtaaatgatactactccccagcaaagtacaggagatcgattagctgaaattaagcaacataaacaagagttagatgcgaaattacagcaacaaaaagaaaacgtggatcaaacattaaacgaacttaacaaagttaaggaaaatgttgatacgaaggtgaatgaactacatgaacgtaaacaagttgctgatgaaaaaattaacgaagttaaacagcataaacaagaactagatgcaaaactgcagcaggacatacaaattgccgaagataaaatcgctgaaattaaagagcataaaaaacaagtagaagataaagttgctgaagtaaaagaacataagcaaaatatcgataacaaagtgaatgagattaaagaacataaacaaactgtcgatgaaaaagtgaatgaaatgaagcaacataaagagaacattgatcaaaaggttaatgaacttaaggaagttaaaaaacaagtagatgaaaaattagctgagttaaaaaaagcgaaacaaactgctgaggacaaactcgctgaactaaaagaaaacaagccgaataccggtaacacgttagaggaacttaagaaaattaaaggcaatttagacagtctttccgctaacttagaattagctaaacaagatgtaaaaaacaaactagctgttttacaagaagctagacaagatttaattaataaaattaacgaaattaaacaatcgaaacaaactgtttcagatgatttatcaaagaaaaaacaagacttagatattaaaatcaacgactttaagcatactgagaaaaaaattgacgacaaattagctgagttacatacaacgaagcaaaatgttgacaacaagattaatgaagtatcacagtctaaacaaacgcaagcagataatggtactaaaaacaataacgctaaagaacttcctaacgctggtagcgagcaatcaaacaatatggctctaggaatgctatctgtattaggcggtgttttattacttactcgtaataaaattaaaacgttattctctaaataagtccataaaaaaaggaaaaccgcacatacatgtacggttttcctttttttatattaactgtccatctcgaagcgtcaatatacgatcacatacatcaagcattctttcatcatgtgtaatcataattgctgctttttggctctctttcacttcgcgtttcatcatttcaacaacttcacgtgcgcgttttgagtctaagcttgccgttggctcatccgctaatattaaatctgggttgttcatgaacgcacgagcgattgctaccctttgtttttccccgccagatagttgatttggataatgattctttctttctcctaatccaaatgccgctaataaatgatctgcacgctttccggattcttgtttactttctttttttagctttgcaatgtaaagtaactgttctttcacatttaaatatggaacaaggtttgcaaactggaaaatgaagccgatttttttcaaacgaatgtctgtcatttccttttctgatagcttcgtaatattttgctcgcgaatgtaaatatccccttttgacggtgataataaagcaccagcaattgataataacgtacttttccctgatccagaaggaccaacgattccgataaactctccagctttcacatcaagcgacatcggatgaagggctgttacttccgtatttccttctccgtacactttacttactttgtctaattttaataatgaagtcattacatcccgcctccaattgcttctaatgcatcaacttttaatacttgatataacgaaataagtgttcctaaaatactaataacgataaagattgccgcatattgtgcaatcatcggtgttgttaataagaatggcataccagctggtaaaatttgttctaacccttgtacaagaacaatacttattaccatcgcaacgactgataagaataacgcctgtacgactaagctatttgctaaataagagttcttcgtaccaattgcttttaatacgcctaattgctgtgttttttgcagtgtaataacgtagaagaatacaccgattaataacgcagcgataacaagtaagaatgcaatgatcatcgtcaatgttccttgctcttctttaaatcctggaatactttgcagtacttcttttttgtcgataacatgtgcatttttgatttctttatctgtattcagcgcaattgcactataatctttttgatttggttgtgaaatagacccccttactgctttcatttacatacacatctggtgtatggctaaacatttgatctttcgtaaatccaacgattgtaaattctttctttgaaacaggatcaataattgtatctccaatatcaattcctttttctttaattgattcgtcagcaaccatttcgatatttgctgtacctaatttctcaccttttacaatttttggttctaaaaatgaatcacgttcacttgagaaaatagcgatatcaacctttttcgaactatctttcttttcatatgttgaaactttcacacgaaacggaacggcttctttctcgcctacttgatttactacgttatctacatcgtctttcttaatttgtgaacgaagtaatttattttccgcatcatctgctaaaacgaacttatttgcctccatattttgaatcgatgaagcattatcatatgatagtccatttgctaatcctgaaataacaagaactaaaaatgataataacaccataatcagtccgattaatccgtatcttaattttgattgtttcaattcacgcagagctaaaaacatttcgctcgctccttcctctttctttctatgcacttatcataaaaaagaaatatgaacggaatttgtacagatgattacagaggggaaattaaattacaattgatactttttgagcgcgggaag

SEQ ID NO: 991 - DNA, 2273 bp, Bacillus thuringiensis
cgataaacccttgtttcataaggttttttagcaattgttgttacttcttcatgttcggcaacttcatagttatttaaaagcaaacgtttgcgttttagtgcaaatgaaccctcattatacacagcttcctcttttgagatattactaattacaatgactttttcatcctgtaacgtacgtgtatatgcataaatttgtggatcttcttctaaaagtaaatcgtacgtaccatagttcagtacatcgtgctcttttttcagagcaatcattttcttatagaaattgaaaatagacttttcttcatttttttgcttctcaacattaatttctttgtaatttggattcatgctaaaccaaggtgtactcgttgtgaaaccagcattcatctcatcattccactgcataggtgtacgggaattatcgcggcaagaagcccatataatctccatcatatcttgatgtggtacgccctctgcaattttctcgcgatataaatttttaattgctacatcatcgtaatcttcaatatttggcaactgaacatttgtcataccaatttcttgtccttgataaataaacggtgtaccgtgcataaagaaatacatcgctcctagagctgttgcactttcacgccaatattgtttgtcatctccccatgttgaaacgatacgtggtttatcatgattctcaatatataaagcgttccatcctttattttccaatcctttttgccatttcgttaatacttttttcaatcctacaacatcaaggtctttcttcttctctgcatcccataaacttaaatgttcaaactggaataccatattgaacttaccttgctcttctccaacccaaagctcagcatcttcaatcttaacaccatttgcttcaccaacagtcataatatcgtacttagagaatgtattttcttttagctcttctaataaaggttgaatacctttcacattcatatgtttatcaaaacgatggcacatattttaactcttttggatttggcatatccttgaggccttcttcttttttaatatgactgatcgcatcaacgcggaaaccatcaatacctttatcaagccaccaattaaccgtatcatatagtacttcgcgaacttctttattctcccagtttaaatctggttgtttacgtgagaatagatgtaaataatattgttctgtttcttcatcatattcccatgccgaaccattaaaaatactttcccagttgtttggctccgcaccatctttaccatcatgccaaatataccaatcacgcttcggattatctttagatgaacgtgattcaataaaccatggatgttcatcactcgtatgattaataactaaatcaataataagcttcatatcacgcttatgaacttcatctagtaaagcatcaaagtctgccattgtaccaaactcatccataatatcttgataatcactaatatcataaccattatcatcattaggcgacttatacattggacaaatccaaattacatctatacctaaatcttttaaataatccagttttgcaataataccttgtaaatctccaataccatcaccatttgaatccataaagcttcgtggataaatttgataagcaaccgcttctttccaccatgtcttattcatagtcattctctccttttgcatcccatcggaatttttatgcaaacgttttcgtaacactatcataacaaaatatgaacagtttgcaactgttttcattgaactctatgtagattctttattcttatgctttatttatttctcacaaaggtaaatctcattcttcacctcttcttgaaactggtagcccctctctctttatagaagaagttccttatataaaggctgttgaattttttaatggcggtaacatccctgaaaatttcaagcgctctggttcctatgtctataaacctattccccttaaaggcattcaaatcatgcaatactttctttctcatgcaccgaataaagatgctagtatttggcatcaatcgctcataggtgctgttgaaaatatttcgccgaataaaacggcttattttcatcgtaaagcaattattgctcaagaatacattacctcttggtgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattg

SEQ ID NO: 992 - DNA, 3271 bp, Bacillus thuringiensis
gaatgtaaagcgtatattggattgttaaaacattctccagtaacaggctatgaagtgagtaaacaaacaggagtacctcgttctatgatttacgaggtactcggtaagttaatggataaaggagcggtgcatattgtaccttctgaaccagttaaatatgtaccagtaccagctaccgaattaatgaatcgaatgcgaaaagactttgaaaagtcctttgaatttttagatgagaaattaaattgtttagaacaagagcgacaaatagatgtaatttcgcatattcgctcaaatgatcgtgttttaaaagaaatatgcaatataattaatagggcaaaggaagaattatggatttctgtatgggaagaacaagtgcatgaaattgagccatacattcatcaaaaggaagaggaaggcgtacatatattttcaatcttatttggagctccagaaacaaaaataggagcgacgtttcatcataattatatgacgccccacgttgttgaaaagagaatgggtggtcatttaactgttattgctcgtgatggagaggaagtattaattgcgaacttctcaaatgatagcacttcatgggccgttacaacgtatgacccagcgctagttctcgttgctacagagtatgtgcggcacgatattatggttgaagaaatcacaaaggaatttggagctgataagttagatacgttatggcgtgaaaatatagatttagttcatgtcgtaacaggaaaacgaactttagaaggaatggaggatgatagagatgagtaaagctcaggcacatgtagctttgcagagtgacgatacatttcagcaaggagtaaaagattgtttaccaactgtatttggttacttgagcatcggtatagcagctggtgtaattgcaaaaacagctggtttctccatcattgaaattgcatttatgtccactttaatttatgcaggttctgcccaatttatattagctggtatgtatgcagccggtgctcctgcttccgcaattatttttactgtattttttgttaacttgcgccaccttcttatgagtgctgcacttgcaccgtactttacgaaaattcctctatttaaaaacctaatcatcggttcgcaaattacagatgaaactttcggcgttgcagtgcagcatgctgcgcaaaaaggatatttaggtgaaagatggatgatagggcttaatgtaacagcgtatttaaattggattcttgccactatcattggcgggctatttggtgagtggataccagatccacatacatacggcatggattatgcattaccagcgatgtttatcggattatttgttcttcagctcataagtagtaaaccgaaactagcaattcatttaagtgttgcaattgtagcgattattatcgcatacgtttcacacctatttatgccagatagtatagcggttattatcgcaaccttactagctgcgacgattggagtgttgattgaaaaatggaaatgagattagatgtattattacttttactagcagcaggagctgttacaatcgtgccacgtattttacctctactcgtatttagcaaactacaaattgctgactggggtttaaaatggttaaattacataccaattgcgatattagcagcgcttttagcacaagttttatttatgcatgaaacgatgcagtgggattatcttattgcagcaattccaacatttcttgtagcgatatatactcgtagtttattaggtacagtattaacgggagtgattgtgattattttgttacgtttccttttctaaaaaggattacactcatatcatagcgaaaagtgtaataacatgaaaaatataggggtggtgttatgatacttttaacgataggagcaattttgttaacgttatttattttctttattatcggctttattacgtttatgatgtttgttgataaggcgacacctcaaatatattatacaccttgtgaatcagtgacagtgaaaactaaaggtaaacatagaaggaagaaaagttgaaagttggcttttcttccttcttctattacatcccggaaagaactaacaacaataatccaaataaaaaactagtcaaggaaagaaaaccgatacatatggagaatacacgattatttccccattcacgccagaaagttataaaacctaaaatacaaaggaaaaaccaaatgggtaggaataggaactcactaattttctcgggaagtaacgaataaaaagttgttacatataagatccaattagtaaaaaataaaaggcaaacgattatagattgtgagtaggggcggttgaaaaatagccctttttttacggttttaaaaatgatagttagcgctgagataaaggcaatgagtatgaaaacaagtaagagtaatgtcagcgtcattttgagtctcctgtataagattgtttttatcacgcatgggcagtaagacccacaccttaaaactcaacgtaagaaaagagattaggtgggggatgcccccccccccactgattgaagtttcactttacaagaaatgaatctattaaattgtatgcttgttttgtagagtgcccgttatatttttcagtgtacggatttagaaatccatgttcaccgtgtagttgttttatttctaataaaggattcttttgttgctgcaatgtgtgaattaaagaggatactgaaaaactagcttctttttcagggaatataagtaatgtagagcatgtaggctttatgtgaacatagtcgcgtatacgagaaccgtaacatccgataataaaatctattttcggattgttactacatagccatgagatggtagctccaacactaaagccgataagtccaatatgtgtataactactagaaagatgagaaatgaattcttcaatttgcttttttccatcatcaaatccaatatgatttacaaaatgttcatatgccttttcttcatcacgataatgaaatgcatgttgtaagtgtagaagattaggacagaatacgtctatatgagatgaagtaaagtgctgggtaacgtgatgcatatggtcgttcacaccatatatttcatgaacaataacgagagctaatttttccttcatagttataaagtacctctatgaaacttaaattctttctcaacaagacaaatacgcaggtggaagttttcataccattgctcacgacctctttttttcgcttctttatgtaaggtgttcttcttccaaatttcaatcgcatc

SEQ ID NO: 993 - DNA, 4532 bp, Bacillus thuringiensis
taattccaagaacgctgtgttctcatcaaagaactgtaaagatttaaagcctgataaagagcaacgtaaaaagcactagctgatacatccagtacaattaaatcaaaattttttatcggaacaatgttaggatacaaattcgctgtgaaatccgccatttccggcactaaaaatatgcataaagcaagcactgaaattccagcaagaaaaataattacttttaagaacaatgttaaacttcgtttaagattcatttacaatacctcacttatttaatggcaacataattttatcacaacatttattgtttaacaataaataaatatcgtttaattttcgtcatgttttttaatttaggcaaaaataaaaaagaatttctcattacaaagaaattctttttcttgaaaatgtctctttcaacttaattttttaaaacgttaattcgtaatggaaataacgattatctctcaaataaccattttcagcgtataatcgttgtgctgataaattatcaatctccgtttgcagctttacaccttttgctccattttctaatgcgtattctttagcagcttctaataattttttacctgttccggctccacgcttcgccgcttgtacaaataaatcatttaaaatccataattctttcattgaaatagaagaaaatgatggatatagttgcgtgaacccaatatattcgccgtcttcaactgctacgaaaataacagactcttttttctcaattctatttcgtaaaaatacttttgccccttctaaatcagaatcttgcctataaaacatgcgatagttattaaaaactgatgctagtccatctaaatctgcaattgttgcctcatatattctcattttactccattccccttccaatactgtctcattatatccgttgcccatttaggctggtgtatttcttctgtcggcataaactctttcattattggttttatatccaatataggagtgccatcaatagcatctaatccctcaacaataattgatttaccttctcttttgatcatctttacaattgttacacctatgcgatttgggcgatttttcccgcgctgtgcaaaaatacctacttcaggataatccttattatttctaggatgtctagcaaaatactgaatttgctcgtcagttactttatgaaaataaaaaacaacttcaatatgagaaaaatcttcaaccccttgtatactctcttctgcatacatttcagttaaagttatacgagatcttacttctccccactcatcatcttttatttcctttctttcattatgtacaaatgcgattggttgaactgaaaacatacgcattcccccttaaatgtaaccacttacattataaaatattttctgaatgttttccagatatacgaataaagtttacataatataattatactctatctagagctaccttgactgcttcaattgcatgtatatgagttgtatcaaatatcgggacagatacgttttcttgctttattaataaccctatttctgtacaacctaatatgattccctgtgctcctttttgcactaactcttcgatgcctcttttataatattctctagattgagatactatttttcctaaacataattctgtatatattactttatttatttcttttctatttttttctgatggtactattacttttatattattttcttctatacgtgacttatagaaatcttgctccattgtatatttagttccaagcagaccaaccttttgaatgtcttttcttttaatttcttttgcagttgcatcagcaatatgtaagactggaatatcaattttggcctttatttttccaactaccttatgcattgtatttgtacaaatgattataaagtctgctcctcccttttgtaatgaatatgccgcattccctagaatttctccagcaccatcccaatctccgctagactgacatcgttcaatctcttcaaaatccacactattaatcaaacattttgctgaatgtagccctcctaatctctcttttatttcttcattaataattcgataatattcagaagttgattcccaactcataccacctataagacctatcgttttcatataaacacctacctaaacttttttataaaactaataacaacgttttattatgtatattatacacaataaaacaagactttaagtttgggatataaagtcttgttttaacgtaataatatagaataattgtactttcatttccaaggaaatttttatagaatattctgaaattaataatctgatatttttataaattctttatacttataattaaaacactctcgatacaactctttgatttcatcatatgatggaacacgtgggttattagctgggctaccactttcaattgcatctgatgccattttagagatagcattttcaaattcaatttcatcgataccgtattcttttaaatttggaatacgaagatcatagcaaagcttttttatttccccaatcgtgtagtctgctacttcctcatcagaattcgaatacaaatccttatttaagttacgtccaatttttgctaaccttttcactgcacttgtttttgtaaactctaacactgtaggtaatagtatggcatttgatattccatgcggtacatgaaataatgctcccactggccttgacattccatgaactaatgtaactgatgcattcgaaaatgcaattccagcttgtaaggaagcaatcatcatcgcttctcttgcctccatattatgtccatcttcatatgctatacgtaaatatttcataatactttcaatagctgaaagagcaagtacatctgtaagtggttgtgaaaatttagaaatataagcttcaatcgcatgacataacgcatctattcctgttgctgccgtaatttgtggtggtaacgaacttgtcaaaactggatctataattgctactttcggtataaaactaggatgcttcatcatcatttttacatctgtttttttattcgtaattactgctacacttgtaacttccgaaccagtaccagaagttgttggaattgcaataagtggtagtggattgttttctatttcaatatccttttggacataatcctcaacttctccaccatttgtatataaaaccgctaccgctttcgcagcatcaatacaacttccaccaccaataccgataataaaatcgcacttttcctctttacaaagagataacgcttctaatacgtgtatatttgtaggctcagcatccactttattatatgtactaacaataatacctttcttatttagttgttgcatacacttttcaacatatcctaatttctccataattgtatcagtaactataaaagctcttttccctaacttttttgattgttctcccagtttttcaagcgaattccttccatataataccgactttggcatacgaaactcagaaacctcttgcaagtcccccaccccttcttatcctaattaatattttataatataaattatcgatttgatgaatctttacgattcaaattttttaatagagtcctgttaaagtatagaatgcgataactaaaaatacagcaaccgttttcaaaatagtaatagcaaatatatctttatatgactgtttatgtgttaatcccgttactgtaagaatagtaataatagccccgttatgtggtagtgtatccattcctcctgatgccattgatacgatacggtgcataacttctaatggaatatcaaattgattggccgctgcaataaatttatctcccattgcgcttaatactattcccattcctcctgatgccgagcctgtaattccagctaaaatattcgtcgttactgcaccattcactaacggatttgtgaaagtagcagagatgccatctctcataattgcgaagcctggaagtgctgcaatgacaccaccgaatccaaactcagctcctgtattcatcgttgcaagtagcgctccaccaatacttgtattcaatccagcttggaaacctgttactactcgcttccaatataataataacgttgttaagatccctataataagtgccaattctacagaccaaattcctactactgcacttaattctacttttccaaatgctttcataccaattgcagaaaaatcaaaaccgcttggataccacttcggtatcataatagtaaacactttattcattacacctactaaaataagtggtataaatgcaataagttgttgcgctcttgtgatttcaatgttattaattaatggcatattttttttgttctacttgcaaagatgctgccatttcagtatttccatcattaaaaccaaaatatccttcacctgctgcttttgccttcttacgtctactctctaaatatagtaaacctaatgtaagaacaaaaattgctcctacaatcccaagtatcggtgcagcataaatatccgttttaaaaaatgttgtaggtattacattttgaatt

SEQ ID NO: 994 - DNA, 2659 bp, Bacillus thuringiensis
attaagtaatattcacataattcggtagtaatgagagagtctcatgcttcttcaaggaacacatcgaattggtcgtatggccatgctgtaggcgctttcgtatgagtctgaaagtcctgtattgtccattccagaaggttggaagtattgtacggggaaagtgggttcgatgaattcgcaaaaggttgtcgcagcaatggaaacagcggctaaaagcaaccaagttattgaaacagacgtttacagagaaacacatgcactttatcatgcaattatggaagctttgtacggagtgacgagaggtcaaattcagttagcagacgttcttcgtacagtaggacttcgttttgcgattgtgcgcggtacaccatacgacggaaaaaaagaaggcgaatgggttgctgttgcattatatggaacgattggtgcacctgtaaaaggatctgagcatgaggcgattggtttaggaattaatcacatatgatttgcccatagtctattagttagaagggggccttacttttttaggacagaagtctgtcttaaaaagataaggtccccttttgcctttttaaggaggaaaaatgatgattacgttaacaggacatacattgacagttgaagaaatgaagaggttattactggaaggagaaggtgtaacagcttgtccaactagtatgcaaaaggtagcggagtgccgcgaagtagttgagaaaattgtagaggacggaaaagtcgtttacggaattacaactggatttggaaagtttagtgatgtgcttatccaaaaagatgatgtaaaggcacttcaacataatttaattcagtcacatgcatgtgggattggtgatccattcccggaagaagtatcgcgtggaatgttaattttacgagcgaacacgatgcttaaaggagtatctggtgttaggccgcttgttgtaaatatgcttcttgagtttgtaaaccgtaaaattcatccagtcgttccgcaacaaggttcacttggtgcaagtggcgatttagcacctttatctcatcttgcgctcgtattattaggcgaaggtgaagtgttctataaggggaaacgcgttcatgcaatggttgctcttacagaagaagggcttgagccaattgaacttgaagcaaaagaaggtcttgcgttaattaatggtacgcaggcgatgacagcacaaggagttctttcttatatagaagcagaagcaacggcgtatcaagctgaactaattgcttcgatgacaattgaagggttacaaggcattattgatgcatttgatgaaaatgttcataaagcacgtggttataaagagcaagtggaagtagcgagcagaattcgtgacattcttcatgatagtaaattaacaacaaaacaaggagaactacgtgtacaggatgcctattcacttcgctgtatcccgcaagtacacggtgcttcttggcaagttttaaattatgtgaaagaaaaattagaaattgaaatgaatgcagcaacagataatccgcttatctttgatggtggggaaaaagtaatttcgggcgggaatttccatggtcaaccgattgcgtttgcgatggacttcttaaaagtaggaatggcagaacttgcaaatatttcggagcgccgtattgagcgtttagtgaatccgcaattaaatgatttaccaccatttttaagtccagaaccaggacttcagtctggtgcaatgattatgcaatatgctgcagcgtcactagtttctgaaaataaaacgttggcacatccggcgagtgtagattcaattccgtcttctgctaaccaagaagatcatgtaagtatgggaacaattgcttcacgccatgcacatcagattattcaaaatgcaagacgtgttctttctattgagatgatttgtgcgatgcaagcagcagaatatcgcggaattgaaaacatgagtacagtgacgaagagcttctaccatcaaggtcgtcagcaggtgccatctattaaaaatgaccgtatattctcaacagatattgaaaatattgcgcattggttaaaaacgaattattcgataaaagaaagattagatgtaaacgcagcactataaaatgagaaaagggagagattgaaatggaaaaagtacaacaaacaattcgcgcgccaagaggtacagagttacaaacgaaagggtgggtgcaagaagctgcacttcgtatgttaatgaacaatttagatcctgaagttgctgaaaaaccagaagaattagttgtatatggcggaattggccgtgcagctcgtaactgggaaagttatcaggcgattgtagattcattaaaaacgttagaaagcgatgaaacgttacttgttcaatcaggaaaaccagttgccatttttaaatcacatgcagatgcacctcgcgttctgttagcgaactcaaacttagtaccgaaatgggcaaactgggatcacttccgagaactagagaaaaaaggtcttatgatgtacggacaaatgacagctggtagctggatttacattggaacgcaagggattctacaaggaacatatgaaacatttggtgaagcagctcgtcaacatttcgatggttcattaaaagggacattaacacttactgctggtttaggtggatgggttgggtgc

SEQ ID NO: 995 - DNA, 3494 bp, Bacillus thuringiensis
ccgctggaaactgctcttcaaataactttttattttcaaatgggtaatgatattgtgcaaatggcatagaaccactatcaaaccaaacatcaatcacttctggtgtacgattcattgtgcctccgcatttcccgcagcacacttgtacttcatctacatacggcttatgcaattccaaatcttctggtgtttctttcgtactatactttcttaattcggcaatgctcttcggtgcgaactgatgattgcaactttcacattcccacacgtttaatggtgttccccaatatctatttcggctaatattccaatccaccatattttctaaaaacttaccaaaacgtccatgtttcatatgatccggataccaagtaacagaatcattattttgtaaaaatgtatctttaattgcagttgttcggattaaccaactttctcctgcataataaagtagtggtgaatcacaacgccagcaatgcggatagctatgttcatatttttctttatgatacagtaaaccttccttcgctaaataacgaacgatatccacgtcacaatcttttacaaatttccctttcaaaaatggtactgcttctgtatactcacctttttcatctacaacgtgcaaaaatgacaatccttcactttgaacaactctataatcgtcctctccatatgctggagcaatatgaacaagtcctgtaccactatctcccgttacaaaatctgctgcaataacgcggtaaccatttgtaacttctttcatcggaaatggcgctgtataagatgtgtttaataattcttcgcctttatgaacagataatacttcatagttctcttttaatacttcttgtacacgttctttcgcaacaatgtatacatgactttcttgttttgctttaacgtattccatatttggatggacagcaagcgcaacgtttgctggaagtgtccaaggtgttgtggtcctacctacaaaatactcattttcactatctttcactttaaacttcacagttgcacttaaatcttttactgttttatacccttgtgcaacctcatgtgagctcaatgaggtttggcagcttgggcagtatggtgaaactctatgtcctttatataacaatcccttttcatggattgtccccaaaatattccatacactttcgatatatggattccttaaagttacatatggatcatccatatctacccaataaccgatgctttcagtgaattcacgccactgcttttcatatgtgaaaacactctctttacacttttgaataaatggttcaatgccatattcttcgatctcatgtttaccagaaataccaagttgcttctcaacacctagttctacaggtaaaccgtgtgtatcccatcctgcttttcttactactttataaccagccatcgttttatatcttgctactaaatctttaattgcccgaccaagtgcatggccgacgtgtggtaaaccgttcgccgttggtggtccttcataaaacacaaacgattgcgcgccttctcgattctgaattgattgttcaaaaatgctttgttcgttccactgcttacgaatacgtgtttctctccctacagctgactcttttacatctactttcttcatctacaatcactcctttgaatgttttaaaagcacacaaaaaacccgcccctatgaagtagggacgggtttacccgcgttactaccctaattctattagctttttcactaatagcgcttagcaacgtactatcatacgtgttctttgtaacggtagacatccgtccgggcttactcactttcagcctcgtctcctcggagatgattttcaaataacttctgcccaccggctttcagcaatataccggctctctggagaacagttcactattttactctttctcgtcttcagatttgtatactttgttaaaagttattttatgccatttagcaactaattgtcaactaattcaaaatatattcttatccttatctcctattcttatacaattacttttcaaattctcgcaatgctgctaaattttcatcatcctcaataagttcaacaaagaatcccgagtcatcctcacgaaggacaatttcaagctcttccttcgcctcttcatttctatttaactgtgctaaataacaagcacgatcatatcttgctaacaaatcacttgcatccattgttaatacttcatttgttattttttctgcctttagtgtttggccggcaccatgatatgaagacgctaaagaaagaagaattactgtttcatttggatgatgtatagaagcattttctaatacttgaattgcctcttcaaacctttcttgactttgatatatttctcctaaagcaagaaatgctgggcttacaaacggtgtttgctctgttaattgtaagataatcttttctgcttttctttcttcccctgctttaaagaatacttgtgcttgcagaagaagagtatcataatcatctggtagttctcgaaccatttgcttcgttaattccaaagcatctcttaacatatcttcttcctcgcactcaacgaaaagatttacaagttgcttcgctacttcataatcccatttattttctagtgacgtgtgcagaatctctattgcttctttattcatctctacattctcataaaatagcgcaaatcgctgtgctgccatactatttttcggatttaactttaaagagatttcatataaatcaattatcatagtaaccattgaaatttctttcgcacgatttttcatacgataaaaagctctcgtaatgatagatcgtttcggctgttcatgcagctggcgttcaatccatatttccgtaaccgcagctgcagcatacatgaatgctgtacttctttctgcttttttcacctttaacgtatgaagaaaatctcgtatgttagacaattttttatgttgctctactgcttttacataaacatcaaatatacgttcattatcaaaatctttttgtattactttcattgcaacttcaattgcttttacatttctttttttcactaatacttttgcataatgatatagaacttctatatgctcaccatctaattgtagcgcgtattcaatctgtgcttgttctttatctatttcattcatcgctccgtacacatatgcaatcgcatctaaacgccatatttcaggtacttcgtctgctaattgctctagttcagtcagcaattcttcctgaagattcatatctactgaaagctgtgctaaatattccatattaatatgcaacggctcttctttcatcgcctgaaccatatgactttgttctttagaacggttttcttctttttcgtatatttccgcaagctgtaaatgtacacctacgaaattcccatcaagctctaaacatgtttcatacgcttgttttgcttccgtcaattgccctaatgccataagtgtttcaccaattcggtaatacggtaatacc

SEQ ID NO: 996 - DNA, 3053 bp, Bacillus thuringiensis
cgtttaaaaagtaaaaagatggcttaagttttaactttaagtaagccatggaataaataatacaatactctcacttcatacatgcacaggtttatttcatccttgcatgtattttttattgtaaaaaattccacctcttatcttttatttactgtttgtctcctaaaataatccaccagtttttcctttattttgctatactattaatggtatattagataaggttcgtttaaaaataactataatataattaagtatataagggatggtgcgataatgtctattgaggtaccaatttcaataccaaaaacgttaattattattcctgcgtataacgaggaagaagcaattgcagatacattaacaagattattaaaactaaaacagcattttacagaattaagcatttgcgttattaatgatggatcacatgataaaacagctcaaatcgtaaatgattttcctgttcaccttgtgaacttaccatataacctaggtattggctcagctgtacaaactggttataaatacgcttatgagaatggatatgatattgcgattcagttcgatgctgatgggcaacataatcctgatgatttgtacaaaattataaaacctattgctgaagaccaatgcgatatggtgctaggttcacgttttacagagaaaacagcctataaaggtagtatttctagaagaattggtattttttattttactgctctactgaaagtactaacaaaacaaacctttatggatccaacttctgggtatcgtgctatcaatagagaagtaattaagatttttgcacataattatccaaaagattatccagaaccagaagtccttattcatttaaaaaagaaaaaattacgcattaatgaaatatccgtaaatatgcaagagcgtcaagggggacaatcttctatcacacctcttaaatctgcatattacatgattaaagtaagccttgctatattgatgcaaaaaattgtgaaaggttgataataaatgcctataattaccttttcatttatcttcattctattattatttttattaattattaattccattcgtcgtggagctttagaaactaaatatgctattttatggatttttgtttgtgttgcaatggctattttaagttctactgaaaaaattataaattggattggccaactattacacgtagaatatcctccatctgttttattcttatttggactattattctgtttcatattaatttttgacttaacaagaaaaatttctaaattacatcatcaacttgtaacgttaacgcaagattatgcgttattaaaacaaaaattaaaagtaacgcaacctgaaaccgataaagaatagttttctatttaaatatgaacatatacaaaaaaacatcttaattttttaaaaaaattaagatgttttttattgcaaactatttttttctaattaataatttactaattttcataacagttgccacggtcccaactccaattataataaataagaatggtattaacggtaatgcatatcgttcatatgcaacataaaaacatgttaaagctgtttgcaataaaaggattgaccataaaaatgtagtctctctccacctttttaaaaggaaaataaatgaaagtactgtacatattaaaaacgtcgtcttaataaaattatatatttcattcatatcctttgcagaaacattgaatacttcaatattatgctctatagaataatacggttttttccaaagaatttctggcttcaaaactaaataactctctatcatagattccttatcagttttccaccattccttcattttatcaatcgctattttttcttctaattccataaattcatgtgcttcaagattagggtattttgcatgtaactctatttcaagttcccccatatccttaccttctgggtaacctttcccttgatacgttccaagtaataacggattccctgccccagcagttagtgggataaatttatcaaattgaatgtaattgcgagcccaccatggtccaagtacgataagtcctattcctatgcttataatcgcttgcttcatcataatacggaatgggtagcgtttcattaaaagatacccaaatagtaagattggatataaggcaatttgtacacggaggtacagtgctaaaaagtagaaaattaatacaatcagaagatgtttcgttttatgagtatcagctaattttaaactccaatatactaatcctaatgaaaggaatagaaacggtccttctgttaaagttaaattttccataacaatctctggaggatacacagctaataagaaagcacctattaatcctgcagcagaattcaataaataagtaccaatcttataagttagcaaaatactaagtacccctaataggataataattaattttgctacaaaaagaccttcactgccatttccaaaaaaataaaatacaacagctaataaagctggaaaacccggcataatatgaatcgttggtttatctggttcatgatatgttaacatccctgtttccaataaaatatttgccgttttttgataacctatatcatcgctagctatagatagatctgcaccatgtgtttgtaaagttgcaaaacgaagtgcaaaaccgactatcataataatccctaaaaggattatattagatttgcgagtaaatcgccctaacatctcatcttctcccttcagatacataattttcaaaatatatttctatatttttacaacacaatacgttctataataaatactttttatacaaagtacaacaatagaaagttgatttacaaagtttatatgcgttaaacttatacagatgttcttgtaatcttcttccttccaaaaggcttgtatatatgatgcaagacataaaaaacttgaggagataaaaattctatgatggaacaaaagcaacttgtttctgttgtcatacccctgtataacacggaaaaatatattgaagaaacgatgcagtcaatactagatcaaacatatcaaaaca

SEQ ID NO: 997 - DNA, 3398 bp, Bacillus thuringiensis
  unsure (1)...(3398): unsure at all n locations
tgcatttgaattatgtttccataagtatggtatagagcatcgtgaggcaagcgccactgttgtcagtatgcgtgatgactatacccggacactgtgaggtcagtgtgtagtgtacctgatggccagttcatatcagttggctatgtatcatgagatatcagtagtaaatgtaatgggccttcttccagggcatagtaatgaggctctttatataattctccaatcgatatgagcttctatagttgctgaatgaatacatgtttttcaggtatccaactattctgtccgatatctaccgcgttttccactctaccccacactcgaaaagatgtcgatccatctatgtttcctttataattcatacattcaggctcttcataataatttactccgtaaccgacaggatattttgaagttgcataaaaccatttcacattaaaatgttttaaatatacccactgcttatcgttccctaaacaaatcatatcttgctcaccgcctccccaataacctgctaagattaaatatggaattttttgagtgagtgtacctgtaaattgaggattcatgaggttttcatataaatttattccatatccatcaggatatttcgaaactgcaataccaatgccatttggttgctgtgtatacactatgttagattgatttgctttgttcgaatttataaaccaagaaagtgacttatttcctactaatcgattcagatcacatttcccaatcccaggaacattccctgaatccgtatattgccacatatcgcatggatatgctggcttattccctccataacgagggatccatacgaaatcagcttcaatattacgtgctccaaatgatagatacgtgtgatgccctacatataatcctactttttccgcacctaaacggcgtaattcatcaataaatgcctgtgtcccgccttgcatatctaccatcgtttgaacttctacgtccgctacccaaaacttagcagattgatcaccacgattccaaaaatcttgtgcctctttctttgcatcagcaatagatataaaacggcaaaaagcataattaccgaatgggatactatgctttttcatttcactaacataattttgatacataaaatccaccgtattagagccatcttgaactctagcaatcactaaatctagctgagatgctgcaatatcccaattgatagttccattccattttgaaatgtctacaatataccccatacattccagctccttttgaatgtcctattcatagctagttttattgtaagcctcagctctctaaaactagctatctataatataagtaaaaagaatctttactgtttttcaaaatatattctctttcagaaatatttctataaactttaacatgtatgccacataaaacattcgaaatataccctactattcatttattatgtaatctcgtcctattaatcatttttacagatattagaaaaaaatccctgttttattaaattataactttcagtatcgatttcctttcaactaaaaaatttcatccctcattttctatatattcttaagtcaaaattactacctctacatgaaatttgagatttagaaaaatttaaattaattgaagtttactccttttaaatcacaattttccaacctgaacactattggtgcataaaaaaagacattttctattaatgaaaatgtctttttacagtttaataaaacaactttggtgctaaatctgtattttgtaattctttattttcactgctcataacacaacttgtggaaaatagaattgggataccacaaatctcatctttcattacatcacgaaatacattggcagcaacacctgtaaacgtttgacataagttagaaatatcgtcattgaaaaactgaatgacttccgcagcgaaaaccggaaagacaacattcggtccgccagggaactgaggctgtaccacaacttgttcaaaataaggattattttctagtgctacttgaaataaatgagctatttcaaatgcatctagtggacaaggaaatggatttacaatttcattctcattattcgttacaataactgtcacacttacattcccaaattgtacaaaagattttaaaagagttactaatgctctcgctttttcgttgcttaacgcatgcactaaaataatataattaccaccaacaggaataagtggcccaactgtaacagttggatcagcacctattgaatttttcaattcattaaaatatgtgatccaaggtggcgaaagctgaacttgtacattcccttccaatattttacactacctccttatacaattcttactagcataatatgtaaaaaactaaaaaatgcatcagttatattaattaaacatcttatttcacattctcaattttccctttacatctttaagcacttttactactatgaaattctttattataagcaaatccactgaaatttcatattatactaatacgactctatatcctttaaattataatactcaatattaggagctgatttcatggaaaaaaaacctatcgtgttcaaaatcccaccaaattcaaaactaaaagttacatttttcggtccttgtaacgaagtaattacaaatgtgtctataattaatcaactatgcgcccctaaatgtcaaactatcacgcaatatccagactttaagaaatatgtaactgaagtacgatcgttatcccgttgttagtccgcataatgcacgattttcacaactttgttacctaaaataactgagaaagaaaataactgcattcctagactaaaattactcattttatgatattccattgataattcattgattttttacacgtttttattaaaagaacatatattatcgtatggagattatccactcataaaacctatctttctttggagcgtacttattatgtatgctctttttttatataaccgtcccccttctaaattgaccaacaatatattaaaattctttatatactcaaggaggtcaaatatgttcaagctgcatccgatactactcatcttaggattgattttgtttttatatagtgtaatcgcctttatgttattcttttcagtgtattagcattacctatacaaagctgtgttcaatatgtaatttctatatagtaaagaaaaaacgtaatgatacgatcttttatgtattccgtctttctgttcaataagaaaactagtaaacttactaacaatgagttttcacaagcatgttacttattattctgtttattatctgaagaagattgaaacctctacaaattaaactacactttacctatttacttatatattttagaaaaacaaaantattcccccaccatttggtaaggggattaact

SEQ ID NO: 998 - DNA, 4968 bp, Bacillus thuringiensis
cggtcgtgattggcgcagcctgactggcgtatgatacaagatggtgtatgtatggtaaatcaagtcatcgataaagatttacctgattttaaaattgaaaatggcgaactaaaagccgatattgatcaacctattgaaaaagaagaaggaaatgcacttttcgtatttgatccaaattcaacagacctagaaaaatatcaaaataaaacaggtttatttgttttaaaagataaagtagtctctatgggaaatggtcaaatacaaacgtattcttataacgatttgttaggtgcatctcttgagaaaaaagatctacaagaatttatttctttattcgataatatttatccaattttattatttgttattggattcttagtgtacctattccaattattcatcacttttgtaggtgtgactttacttgcgttcatcggttctgctatgagcggtcaacgtaaactatcctataaacaagtttggacactaactgcatacagctacacaatcccaacaatcttctttatgattatggatgcatgtaagattgtcgtacctggatcaacattcatctatatcgcagttgttttaattgttctgtacttaacgattaaagaagttccaaaaccgaaagaaaaataagaacgaaaaaaaatgcctaaataggcattttttttttggacaagcatatattcctagcaaaggagtgaagaatatgaagagattaggtatattcctattcgtgcttgttctcggttatatattttattacgatataaaaatcggtactttaccgatgttaagttcatataaaaaaacaactgctgctcaaacgattaaaaaagaaaacacagacagtcagcagaataaagagatcaagacagaaaaagaaacggatgtatcttataaaacaattgaagtaaaaactggtgagacagttctttctattacagaacaaattaacaagaaaaaaattccttccatagaaaaagtcattgacgactttaaacaattaaacaaaagtacatctgctacaaaaatacaaattggaaagtcttataaattccccttatatcaataagctatcacttaatccttgtcaattacataaaggcgctgatacaatagtaaaagtgaaaccgagtacttcggtttctatagccctatatcacgtatactatcattgatatgagggactaaataagaaacttcttttataaggagagcgatctattcgtgaatgaaatgactcatcgtacaaaaacacgtccagttaaagtcggtaatttaacaatcggcggtaataatgaattaattatacaaagtatgacaacaacaaaaacacatgatgttgaagcaacagttgctgaaattaagcgtttagaagaagccggctgtcaagtcgtccgcgttgccgttccagatgaacgcgcagcagatgctattgctgatataaaaaaacaaatcaacattccacttgttgctgatattcattttgattatcgccttgctttaaaagcaattgaaggcggcattgataaagtacgtatcaatccaggtaacattggtcgtcgccataaagtagaagctgttgtaaatgcagcaaaagagcgcggtactccaatccgtattggtgtaaacgctggttcattagagcgtcatattttagaaaagtacgggtacccaactgcagatggtatggttgagagcgcgctacatcatattaaaattttagaggacctagatttccacgatattatcgtatctatgaaagcctctgatgttaacttagcaattgaagcatacgagaaagctgctcgtgcttttgattatccattacatttaggtattacagaatctggaacattgtttgccggaactgtaaaaagtgctgctggtcttggagcaatcttaaataaaggcatcggaaatacactacgtatttcattaagtgctgatccagttgaagaagtaaaagttgctcgtgaactattaaaatcattcggtcttgcgtctaacgcagcaacacttatctcttgtccaacttgtggtcgtattgaaattgatttaattagcatcgctaacgaagtggaagaatacatctctacacttcaagtaccaattaaagttgcagtacttggttgcgctgtaaatggccctggtgaagctcgtgaagctgatatcggtattgccggtgcacgtggagagggattattattccgtaaagggcaagtcgttcgtaaagtaccagaagaaacaatggtagaagaactgaaaaaagaaatcgacgtaattgctgctgaaatggctgctgaacgagaaaaagaaaaagagacacaagaacaataaaaagaaggttgccacaacatttgtgagcaaccttcttttctacgtaaaaaagctcgtcagttatataaccgacgagcttttactttgcacattttggacaacgaccatatatttcaaacttatgccccgttacttcataaccggtaaaatctttattcataaaatccattggacaggaagtaatctctttcgttcccccacaatccaaacaaataaaatgatgatgatgttccataatagaacaagtaaaacgaaaatgtttttcaccatttaattccgtttgttctaaaacaccaatctcagcaaaaactgttaagttacgataaatcgtatcaaaactaagccctggataatcgtccttcatatgctctaaaacgtctttcgcagttaaataacgattatgtgctgcaaataatctgagcatctcttctctttttccagtatgtttgtatcctttttctttcattaggcgtaaagcttctgttagattcatacctatccctactttatgcagtttttttcttcttccataaaatcgcaccgattaaaataagaactgctatcataacaattgtaccacctggcgctagatcaagttgatacgaagcaaacattccaccaattactgcaatttcaccaaataaaatggaaaagaaaattgtttgtttaaatcctttagcaatacgaatacttgctgcaactggtaacgtcattaatgatgatacaagaagaacccccactacacgcattgatactgcaatgacaagagcaactaatataatgaaaataaagtgaatccatttcgctcttaaaccagttgatactgcgtattcctcatcaaatgataatagaaacagctctttatataattaaataattgtcgcaacaacaacaattgctacaatcccaataataattaaatctgtacttgttacagcactgacactaccaaataaataactaaataagtctgtgttaaatccatttgcaagtgaaatgaaaataactccaacccccatccctgccgaaaggataattggaattgctaattcttgatagtgcttatatacagttcgtaacttttcgattagtagcgctccaccaatcgagaaaatcatccccatatataaggggtttaaaaacccacctgtaaaaatggttttttcaagtaataaacttgctgcaatacccgataacgtcacgtgacttaatgcatccgcaataagagataaacgacgaataacaacaaacacaccaattaacggtgcaacaagtccaattaaaatacctgcgtataaagaattacgtaaaaagtcatattgtaaaaaatcttgtatcattatatcctcccgtgatgctcatgttcgtgttctaaacgatgaacatgatgtccatataagacggacatttctgcatcttctaactctcggaacttctctacattcccatggaaatgtagatgttggtttaggcatgcaacatgtgttactttttcagtaacagctcccatatcatgagtaacaagaattaatgtgatcccgagccttttgtttaaatcctctaatatttcgtaaaaactttccacatttttcacatcgattccaacagtaggctcgtccaaaataagcaattcaggatcactaacgagcgcacgagcaataaatacacgctgttgctgtccaccagaaagctctccaatgttacgaccttgaaactcactcatccctacatcagcaattgctttttctacctttttcttatcctcttttgtgaaaaagcgaaaaagcccttttttcgaaacaagtcccattgacacaacttcagaaacagttgctggaaaaccagaattgaaactatttgccttttgggatacataaccaactttgttccattccttaaacttcttactatcaacgccaaacacgcgaatgcttccttcttttggctttaaaacacctaataaacacttaagtaaagttgatttacctgaaccattcggtcccactaaacctaaaaaagctcccttcggaacttgcaaattaatattttctaacacattccgatcttcgtatcggaatgttaaaccttcaatttctaatatattattcatagcatctcacctattttaattcagaatgattccgatttatatctatttgaattatagtacagcttattatagttgtaaaccaatctgcctaaaatatatctattttttcaagaaaccttactattataacaaaaagcagagaaaaattctctgctttcgaaaaatattcctataaactttttagtgaatagccgatttaaacttaccaccatttgtctcttgcgtgctcataatcgtaacaaacgcattttcatcaatttcatgcacaattgattttaacttcgtcacttctagacgcgttacaactgcataaataacttctttttctttatccgtgtaaccacctttcgctacaagctttgtagttccacggccaagacgatgcaaaatcgcgtttgatacttcctcatattgatcagatacaattaaaaccgccttcgtttcatctagcccttgaattactgtatcgatcgttttaaatgcgatatagtacgtcataacagaataca

SEQ ID NO: 999 - DNA, 2333 bp, Bacillus thuringiensis
ctctgggcgcgcttttagatttttaaataatcacatgttttttcttaaaaccttgatatacttggacttatataattttgtaggaactatctatttcaaataaacttatacgttttagaattttttttgcacgatttttgcacgttttatataactgattggaacaaattcaacatagtttgatcaacgattctagattccttttgttccatttcatctaagacatgtgaatatgtttgtagtgtaattacaatatctttgtggccaagtcttcttgaaatgtattttatattaacgccattgtataagagtatagatgcatgtgtatggcgtaatgaatgacatgttattggtttaacattgcaccttgcgcaaatctttttaagaactttgtttacagcgttatttgttataacttccatttgattattaataaagcacaaatttttagtattccttaaacctgttttcagagcatgttctttttggtgtttttgtaaatcttttaacatactcactgtttcctgatcaattgttattgtacgtacagattgataatttttagtgttaccaaagtcattcttatcacgataatcccaagtcttattgattgtaattgttctttcttctaagtctatacagtcccatgtcatccccattatttcaccaaatcttgccccagtggctatggcaaaaagaattatatatcttgaaatgtattgtggtgtcaaatttgcgcgtaattcatccactatgtttttcatctcttcttgattgataaactttaattcttctgattttgtttcattctctccatgtatgatagctttgtaagtagggtctctatgcaaaattccatcttcaattgcatattttatacatgctttaacacagttatgttttttcttgacggtcattttagcacgttttttagataattcatttaaaaagttttgatataaaactctatttaagtctttcatacggacaccaataaaatgttcttcgactaattttacagattgtaaaaggtttttctcatgcgatagactatgttttccttttttatatacttcaaaccattctctcatatactcggagaatagtttatcttctgcatttaaattatgtccacgacttatttttttttctaattcacttgctgcaattgctgcttcctttttggtcgagaatccaccttgggtttttgttttgtatttatctccatctttataagaaacgcgatacctccaaccagttgctcttttttcaaagcttgccaagtttttctcctccattcaaaataaaattcgctaaaacttttgaatgtttatatgtgtatcagttaagaaatgaactaagtaatttttatgataaaaagatactccttttgtcatccggatatattcaaatgcatctataacacaagccgttgtaacttcaagttcttctgctatatcccaaggtgtttggatgcctttttcatagcatagtattaaagcatcaattgtaacaattcggaggcagcctatttttcgggcttggaattcttgctgacgttcggtaatagtttcctgtttaattatattacctatgcctttctcaaagtgagctatttcctcactaactgttacgtacttttctgcaatggtttgattaagattattattgatatatatttcactaccaacacaaagtccacttaacccattaggcatctcattattaaagttgaaagttatttctggatattgtgctataagtgtttccaacttgttcatataaatgctcctattttcttttacttttaacaaaattaatgaagtccattacctcttgtagttcttctttgcttagattatcttccatgtgagctgcgattaccatatgaggatcatcttctgtttcctgatccttgtttatagtgataatccctgatacatcatcatcagtaattctttctcctttttccagcttttctgctatcgtaaagaaactttggggacttacctgtaatgcctttgcataattttgtatatctaactcatcaagtgtgctatttctattttcatgaccagatatggtgctttgtttataaccagtaactttttctaaatctttttgagtcattcttctgtatttacgtaaatatttgatcgctggacccagaatattttttttcaatttcaagtgacctccatccattgatacgataaggatagtatactctaaaataacgcgtggcacaataaaaatatgggacatcgtaatattatttttgggatagcttgattatatcgagatatgcgatatatttggtcatcggataattc

SEQ ID NO: 1000 - DNA, 4309 bp, Bacillus thuringiensis
tatgcagatctaggcgatataaacgtggtgatcgagtaaaaatcaatattcataaatcggtatcacctgaaatgcttgcgtggctgaataaacaatcaaatccaactaatttcttcttctttgctgcacagcaactatttaaacaagtaggagatattgacgtttctaaagctttaccaagcagccatgttttctcattatatgtggagccttcatccttattaaaagtcgaagtaaacccttttaaaaacatgacactagacacaaatacatccactgaaaatgcaaaaaaaaaattatgggaatctgttgatcaattagattgtccatttttttaaacatagaaaaatataagaagtccccatcactatacatacgaatacagtgatggggttttgtttgtaaatggaaggggcacaatacaatttgtgacccttccattagttatttatctaaattttagatgtatgtttagaaacagcattaattatgctttcccagtcatctggatggttttcatggcctgcccctttaagggttaatagtactgagtttggaatttcatcaattagtgcgaggccatgttcaaatggtagtgctgtatcgtctgttccgtgaataactaatgtaggtgcttgtatggattgaagtacaccttcatatgcatcatcaccttgaagtaaagcgtgattaaacatacttaataaattgtttgcgcgttctatttcttgttttacttgtttataaactctattttcatcaaatattcgttctgatccacataatagacgagatcctgaaactaaatactctgccacatcatttttatttgcccaatctatacttgtgccatttacatgatgtgttaaaatcctttcatccattggaggtaaatcgcgagtattgtcatcagatcctattacactagtcgctagtaaagttagcgtcaaaattctttcgggatgttttacagcggcaatttgagcaatcataccacctaatgacatgccaaataggtgagctttatcaatatgataagcatctagtactccaattgcatcttcagccatatctgttactgtgtaattggaagttctaggttcataggcaacagagcgcccaacatcacggttatcaaagcgaataacaaacttccccgtactagccaacagctcacaaaactcttcatcccaataaaccatggaacatgtagcgcccataattaataaaatagcagggttcttagggttcccaaagctttctgtacatatatcaattccgtttattttaaatatcttttcactcatatagttagcctcatttcttttgaatttaattaataaaacaattttggatgattctaagatgtgtgtaagattcgtggtggaattcatcccgctatttgctggacagtaagagtcccatcttaaaattcagggaaagtaaagaagttgggaggggaccaacttcccgaaaaagcccgattggcgagggttgattaaagtttcactttataatgcttcttgcataattacccccaaaaataattatatgttaattcaaggcaaaaaattttgagaaataattgtatgttattaaaataaacagcaaggaggagaggaaatgaaagcacttgttattgatcaatatggtattgttgaagaattaaaagaatgacaagttataaaaccggttgttcataataacgaaaaagctaaacaatcaataacttcccttactatacattttcattttcgagtattatttattgttagctattgttagctattgtgatattacttctaacaaatactgtttcgtattgtatcgtgtaatttttctaatccaatttccatatctttctcgtttaacattgaatagctaattcttaattggttatcatttgtttcgtaatttaatagacaagctgttcctggtaaaaaagagacatctacttcatttgctttttgtaataaggtaaagggatctatcgaatcaggcagtgtcacccataaattaaaacctccatttggtatttcaaagtgtagttcttttaatggcgacaatatatcaattgttaaatcacgtctcatttgtaaagctgtacgtaatttttctaaatggtttttcatacgttctgcacgtaaaaatggtagaagtgccttctgtgttaataaaggactaccgatatccatcgaaccttttactgcatatagccattcaaaaatagggccatcggcaataagtgctgcgatacgcagtcctggtgctaacgttttactaaatccttttatatatattacgtggccatctttatcaaaacttttgattgggggcgggactatagcatcctcaaaatatatttctccgaaagaatcatcttcaataataaaaaattgatatagctccgatagttctataagttccattcttcgttctttactcattactgtacctgtcggattctggaaggtgggattcgtatacaataaaacgggatttttactttgacaaatatcatcaattaagtcggagcgaactccatgattatcaagagaaacgggaatgatttgaacacctttattgatgaaaatatcaagcgcagcactgtaacatggactttctactaatacaatatctccaggttttaataatgtttgagcaattaaatcaattccttgttgtgcgccgcttgtaattaataattgagatgggtctgtcactaatttctggtgttcatttaagtaatttgctatttcaactcgcaattcataatcgccttgaactggcccataagttgctaacaacatcggatttttatccagcaatttatgcatttcatctgccaaaaatggatttggtaacagacgaggatacagaattgcttgtgaaaaattataatatttacggtgcttattcattgcatattgagaacgcataacattaatcgttttcatttgttgccatttatacggaattggtttgaaatctttctttacccgtttatatatgtaagcaccttttccttgttcgatgcgtatataccctttcgtttctaactgtttatacgctttacgaactgttaatacattgatttgtaaatctgtggccatacaacgtaaagaaggaagagattcaccatgtgaaagcataccactttgtattctgtcaacaatttgcatatatatttgcttgtaatacggtatgtttgtttctttacgcaatacaattttcataggttcacctatttttctttttaacttaattaaagcgaaaaatatatagggaatcaactacaacttgaagtaactgttatatgtaccgatacactgttatacaccatagcctctatactcattctaagagtaaaaaggaggaagcaaaatggtcatttttaattacattttagtatgtattattttcgggacaacatttttaacgataaaaattggaattgaagcaggggcgccaccgttgttttcagcaggaattcgcttctttttagcgggcataatccttatgattatttttaaattaaagcgaaaagaaattatgccacatatattttcaaaacgcattatgtatgctggattttgtttaacatttatgacattcgcaagtttatattggtcagaacaatatatttcttcgggattagctgctgttctttctgctacgggaccaatgatgattttattaatacaagcaaagagggatagggagaaattacaaatggaacaactcgttgctttagttattgcactagcaggtgttatatttgtttctttaccaggaatgcatcaacaagtaagtttcatatggagtattgcttgtattgtgttagttataggggagttattttacggaataggctctattcgttcgaaagaaatactgtcagatttatcaaatgtatcaccatttcttattaacggtattcaaatgttttatggagggattttactactaatcgcatctattattgtagaacaaccaaatgtaaccgtattaacttcatggagtgtgcaatggcctattttatatctcatatttatcggatcgattggtggacacggattatattactggctcttatcaaaaacaaatccagtatttccatcgacgtggttatatgtatcaccattaattgcaataattgtgggatatatcattttaggagaacctttaaatcctacaatgggaatgggggcttgtcttatattgattggtgtatttttggccaatcgttcaacactacggacttatttaaaaaaagggcggttattagagaaggagatgtaatttaata

SEQ ID NO: 1001 - DNA, 3572 bp, Bacillus thuringiensis
tcccgtttccttttcaattaatacaaattttcttaggccgtttttatagctaggaattacccactcctccaaactttttttacattgcatatatgtttttaacttcccgtttccaatatagcgcattactttttcgtttccccatagtgaagcgtagaactgtaaatcatccattgtatatttacgaatttgtaaacggtctgtatgaaacattccttcactcctttccactaatttattcttaatttcacgatcatattttgtatgcacaataaatgttaccatttattataaatgaatcaactacataacacagaatattcaatcttatagaaacaaaaaaagcagtagacaaatattgtccactgcatccatatcataactagcataaagaaaactacaattgaggggggtgtaggattttcaaatatactagatacttatcccgttctaacgggcggtaaactttccaattgtttcaagtgaaaagtttaccgcacataagaacttcttccgttcattaagatagtattgctaaataatcatatacacgcttagatttctctccacccattcgtgcatgttgaagaagagaaataccatgaggaccagatgcacgcaatgcttctggttgagctactaaaatagcttgtacaacttctaattcaccaagcatagctgctgcaaaaatatccatccgagcacccttttctagtaaataaagagcaatatctttacgacctacatgtgccgatgcgcctaacgcactttcccaatctgatccaccccaattataagaggcgtgaagtaagcttggtgattcaaccaatagctcttgtactttctctaaatccccgtgagctgccataacaaattctcttactaattcaatggtaatacgctcttctgcttgcatcgctcttctccccttttagaaattcgtttcggtgtaaaaaaaggcttgtcacttccctgaaaaatatctacatctatgccaaacacatgttgaaacatttcatggcatagtacttcttctggtataccatcatactgaatttttcctcgctttaatacaagtaaacgatcgctatattgagcagcttggttaatgtcatgcaaaaccattataattgtcattccaaactcctcatttaatcgtttaacaagttccattacttccaactggtgaacgatatctaaaaaggttgttggttcatccaataataagacatttgtacgttgcgctagcgtcatcgcaatccaagcacgttgccgttcccctcctgataaagaatgtaaaagacgatattcatacccttcaagatttgtaacagacaatgcccaatcaacaatttcttcatcttctttatttaagtggctactccatgatttatgtggacctcttccgaactcaattagttctttcactgttaaatctaattgatgatcatgcatttgtggtaacattgctaattgcttcgctacatcagcactcttcatcatatgaatatttttcccatctaaaatgatgtccccttcgctttgtttcagtagccttgctattaaacgaagcaaagtagattttcccgatccattcggaccaattaaactaacgatttctccaaccttaatatgtacattcatattttgcatttgaaatctttcagagtgtgcgtaaaacactttgttaacggaaatcactttgttttcctcctctatgaattaaatataagaagaacggaccacctaagaaggacagtaaaataccaacaggcaattcgattgggtcaaaccaacttcgagctattgcatccgcaaaaacaagtaataccccgccgccaaggcatgataaaggtagcaaatatctataatcatttccaactaataaacgtagcatatgtggtacgacaagaccgacaaatccaataagaccagacacacttactgcaattccagctaataatgtacttactacgattaaataaaaccgacttttttccacgttatgtcctaataactttgccatttcatctccaagcattaacactcgaatatgcttaataccaaagaaagctaatataatggcgaatattgcataataaataatcatgtttaaatgtgcccaacttacaccaccaataccgcccgctagccacggtaacaccgattgtactttgtcactatgtaataacattaatgctgacgttgctgcaccaattaatgcattgatcgacacccctactaagacgattcttgaaggtgatgcccctttttgccatgataaagcataaataaccattgctgttatgaaagctcctaaaaacgcccctagtggtaaaaaagctagatgctgtgggaataaaatcatgatgacaattgctacaaggcctgccccagatgaaactccgataataccaggatctgcaagagggtttctcataaccccttgtagcagtgtaccagatgcagctaaacatgttcctactataaacccaatgagcactctcggtatgcgaagatcccatacaattcgatgaactgtcgaaccttcctcttgtatacctgttaaaatatctcgtacagaaaaggataaacttcctgcgaagagaccgtaaaagagacctaggattgttaatacaactaaagtaactgctattatccatctttttttcgcaaaggatgttccttttctcttactacttcactactttccatacgtatcatttccttacatcttgtatacttttatacataaagtccattgcttctgtaacttttgtaccaggattagatccaaataaatcaggtggcaaaataactacgcggttttgttttactgcctctaaatttttccacgcttcatttttcatcatttcgccttcaaatgcttttttcacactttttggatctccgtgtgtaattaaataaatgacatctggattcgcctcaataatacgttctacacttagctgtgcatattgcggatattctttcgtttctggaaaatcagaagcaatattttttccgcctgttttttctaaaatatcacctgataaagatgttggtaatgccgctaaataagttcctggtgcgccatacactagcaatgctttcacatcactttttttctcatatttcttcatttgatcattcattttttgattaatttcttttgctttatcttctttcttcattaccgttccatataattcaatattcttttgaatatcttgtacagaattcgcagaagaaatgataacttgcgttccttgtccttcaaccgttggcacattcttttggaatccattgttagcaacaagtacatcgggcttcaaactagcaatttgctcaaaattcggttgatgtgcattcccaattacttgtgctttctttaactcctctggaagagttaatttcgtatccgggcgacctactatttttccacctaaagcatgaataatatccatgtcccccatacttaatgttgcaaaactttctggcactttatcgaatgttacctttcttcctgataggtcggtaatttcgattttctcttttcctttttctgtttt

SEQ ID NO: 1002 - DNA, 1768 bp, Bacillus thuringiensis
tacaatatttttaccgattgccataagagcaacgaacatggcagctaatgctaaatctaaaacatgaaatcttctcataatgttaacctcctgttgtttttaggttaacattatcgtagcgaaaatatttacttgttgtcaatcaaaatattttgataagaaggctttaaatagtctcttagcaacgtatatggaatacgaaattgcggaattccacttgaatagggagcaatctcatataaagggaaataaatgacgagattgtctggctctaaaaagaagtggaattttttcatactcattactttttcagttgcatcaggaaaataaatgctttcattttgtttaatttgtcgtacaatctccgcacggattacatctttatatttatccttttgttgaaataaatcgtctaagtgcagtacctttttttcgtttaaatcgaatgtatttgccttccacgtataaagaccgtgtgctccaccagtatattgatagtaattcacatataggctaagaaaaggtggtttgtttaaagagactttataatcaacatttgctacgtacggatgaaatggtgtactagatccttctgtctctttataatatttttttgcttctttttctaatttggttttaaatttgtcagtggattttttgtagtataaattgagtttattttgaaatttagagtcagaaaattcgtgaaaataaggcctgtttatttgatattctatataaggtttcttacctttttgcgttacagtcttaacatcgattgtcaggttagatgctttggctgttattgcacaatttggtacaatagtcagcaaggagaacataagcagtaatatacaaaatttctgtttcatttaggtgaagcctccttatataagtgttataagtagtttgaaaataaataggtaaaattatacatttaattaaagtaagagaagggggaagcgatatggcaaaaactttaatggattcacttggaattgagttgttagagatgacagaagataaggtggttgctacgatgcctgttgatgagcgtacgcatcagccatttggatttttacatggtggtgcatcggttgcattagcagaaacagtggcaagtgttggttcatataatttaattgatcaagaaaaatgtatttgtttcggattagaaattaatgcgaaccacattcgctcaaagaaagatggaattgtaacagcgattggaacaccaatacatagaggacaatcgacaatggtttgggatgttcgcattattgatgaaaatgatgatttactatgtatatcaagatgtacagtagcaattaaagaaaaacgtgaaaaataaaaaagaggcgctcttattaatctgtaccctttgtaaaggacattttgaaaaaagttaggcaacatcaagaagatggtttctgtatccaacaggagtcatcttttttaaattccattgatatctataatgattataatacgtcatatatttcttaatctcttgtttcaattcattaaaggacacgcaaggttttatatgagcttcatctttcagatgaccaaaaaatgattcttgtggggcgttatcccaacagtttcctcttcttgacatggattgtcctaggtttagctttttaactagcttttgataggtagggcttgtgtagtgggatccttgatctgaatgaatataagcaccttcagtcaatcgaatccgcggattcctttttagtttatggagagttgtcgttacgagctc

SEQ ID NO: 1003 - DNA, 2488 bp, Bacillus thuringiensis
taaatctcttgattcaatgttcccaccgaaattaatgggcgcatctttaagcattgcaaatacttgctttgaaagctcgtttccttttccatcctctgttccaacgtttaatagtccaacgcgaggattttcaattcctcttaccttctcagcataaacagatcccattactgcatattgatataaatgaattggttttgcatcaacatttgctccaacatctaacataacaaaaccttttccatctacagttggcattgtaggcgataaagctggtcgctcaattccttccatacgaccgacaacaaataatccagctgccattaaagctcctgtactacctgcggatatacaagcgtctgcttctccatcctttacttgttgtgccgcaagcaccattgaagcttgtttttttcgacgaaccgctcttactggttcctccgttgattctattttttcgtctgtatgaagaatagtaattcgttcatcactcgttaagtattgacgaatttcctcttctttccctactaacgtaatatgtaaatcagaatattccttaatagctttcattgcccctaatactacagcctttggagcgtgatctccgcccattgcatctattgcgattttcataagttgttaccttcctcactataattactagatcgatacatttcaaaagtgcctgtaaaaacaagttcttctccaacgaagctacgcactttgacaaccgtccgtcccttatcattctctacatcttcaacgcgcgcttttgcaacaacacgctctcctaattttacagggcgaatgtatcgaatggtagactttgcagttaaagctaattcttcatcaataactgcaacagctagtgagtttgcttgcgcaaacagatgatgcccacgggcaatttgatttcttttaaatacatgttctacctttacttcaaagatagagattgcatgtctatctaattcaatatcaataatttctccaacaacctcttctaacggtaaagatttcacatcttcttcatgttgctttgtagctacatgtttaattctctctcttaattcaggaatagacaattccatacgatcaagtcgtactgtttgtatactcacttgaaatttttccgctaaatcttcatccgtaataaaaggatttgattcgattgtttgttgtaataactcttgtctttcttttttacttcttctttttttcataccgcaccatccatttttatgactaggtactaacagtagtatataatcattaaaagtagaatgcaacaaaaaattttgttgactccctttaatcgagcttctctccttggaacacccctgtcccatcaagatacgtacgcaaggcagcgtactgatcattgtgccaaaacgcttctgaatctactagtatcgccgcatcttgccctgctgtttctaacgctcgataatcatgtaccatgtcagcaaccttaaattctggtaagccactttgcttactcccaaagaaatctccaggacctcgtaattctaaatctttttctgacaatacaaatccatcatttgtttcagtcattatgcgcattctttctttccctgtttctgatttagggtctgctattaataaacaatatgattgctcactaccacggccgacacgccctctaagctgatgaagctgcgataaaccgaaacgttctgcatcataaataaccattacagtcgcattcggtacgttcacacctacttcaacaactgttgtcgatacaagaatttgcactttattttcactaaactgtcccattatctcttctttttcctgagacgataatctcccatgcatcaatccaacttggcatttcccttggtaatgatgcgtcagcatactatgtaagtcgatagcattttgcacatcaagtttctcagattcttcaattagaggacaaataacgtatgcctgtcttcctttttttatctccttttcaacaaaaccgagaacgcgatctaacatatcatgttttgcccaatatgtttcaatcacctttctacctgctggcatctcatcgattatcgaaacatccatctctccaaatgcagtaattgcaagcgtacgcggaattggtgtcgctgtcataaataatacatctggactttcacctttctcccgtaaaactcggcgctgcgctacaccaaatcgatgctgttcatctgtaataacgagacccaacctatgaaatataacttcatcttgaattaaggcatgcgttccaacaagaatatctatttctccttgttctaacttcgctaaaatttctcgacgtctcgcacctttaacagaacttgttaacagttccaccttcataccaaaatgcgaaaacgtttcagcaagcgactgataatgttgctcagctaaaatttctgtaggaaccattaaagcaccctgataatgagctaatttcgatgcataaaggccaatcgcagcaacaact

SEQ ID NO: 1004 - DNA, 3798 bp, Bacillus thuringiensis
tgaaataaaaaatgaaatagtaataaaatggattcgccaacaaatgaaagaagtaaagctgatgacttcagtttgtacaggagcgctattactggcgaaagcaggtttactggaaggtttaaaagcaacaacacattgggctagtattgaaaagtttaaaaatgagtttcaaaatgttgaagttatagaaaatgtaaagtttgtagatgaaggacatattataacatctgccggaatttcagctggaattaatatggcatttcatattgtgaaaaacttgttaggtgtgcatgttgcggaggacacagcgaagcgaatggagtatgatattagtttgccaaattaaaaagcccggattgggctttttatattgaatgaatatagttaagctcttcatcactcaaaatagggcgaacagatgcatttgcattttcttgtgcttgtgttcctgtttttgcaccaggaattacaacacttactgccggatgagagagtacatagcgaagtgcaagttgccctaggatctgatttttatttgagagcagccgaagtttctctacggtttgtaagtcttcttgaaaccaaatttcatttggccaatctttgcgtaaatctccatctggaaaaattgttttatttgtgaattttccagttaaaatgcccatttttaatggaccacgaataacagctcctagatttttctcttgtaagaatggtaatatatctttttctggttttcgatttaatatattgtaatcaagttgtacgatatcaatttcgttgttgttattgaaatgatgaatgtattgtaaatcatgagtcgaaacaccgactgctcttactttgccatcacgttttaatatgtcaaatgcacgtagaaatgcttctgtttctctacgattatgccaccaaatatgacaaaaataaagatcaatataatctgtttgaagacgttgtaaacttgtttcgaatacggcgatgattttttcgggagtatcatatacaggaactccattagggtcgtagtgatgtccgattaaaccacctttcgttgataggataatatcattacgatgtcctttaatcgcggtagctaccaacttttcactatgtcctaaaccatacacatccgcagtatcaataaaattcacaccacactcaattgctttttttatagcggttatagattgtttatcgttaacaggtccccattcatcaccaccgattgcccatgcgccaaaacctatttcagaaacagttattccagttttacctaatgtgcggtaatgcatattccccctccttgtaagcatgttataacatggatatgtggggaaggaattttgtgtgtgaaaaaactcttctacaatagtagaaaaagaattacagaaactactattttatagcagcatgtataaaaaaaatcggtgtaaatatggaaatgtcgtcgaatgctatctttaattggttaatttatgggatatttttgtgaaggagtttattttataagaatagaatttagtttagtaagaaaacgtgccgatggtagtgaaaaatatggggttagggggggttttgaatgaggaaactcgagcgagtaaatgttcctaatataccagagcgattatcacaccctagtgacaagcgtaggataaataaaaagaagttaaggcgacttattttaatggtcctttttattgcggcaactactctatatgttcaatatattttaacgaaacaacaagaagtaattgataaaaagaaagatacgattacggatcaaaagaagcaattagtatctttaaagaaagataaagattctttaaagactaacatagaaaatttaacagacgatgaggaagaaattttgaagttagcgagaaaagagtatcaattttctaagtcaaatgaaactatatttgtgatgccaaagtaataaaaacagttagccattgaactgcacccccaattgttagacaccgtctaacaattgggggtgcagttttttatgtatgaatgtcatggtacaaggaacaatcacatattgtagaaatgaagagtttaagctattttcataaatatggaatatgcactaaaataaatgttgttaaaattctgtcaattatattataatacaaggtaagcggatacattttttaatcaacgttgagttcctcgctcatacgactattaagaaacccgttatcctcgtataagaaaggaagatagctgtgtacgcctcaaatacaatttatatcgtaggggatgcgaaagcacctcaaaataatcccattactgaaaagtttaaaagctatttcgtagcatttatacttgttaaggatacaggggaaattgtagatgcagactgctcagcgacaattgcattaacatctcaatttgttaaatatttatttctacataaaaatataaatgacccggcgttagtaatggaagtaaagaaccgatatttcggttcttctcaaaaagcgttacttgtagcgctaaaagatgcacagaaaaaatataatcagattgctgctttgtctactcaatcatagacaaaatccagccgtaagaatcattcttatggctggatttttttatttcacattatcgtcctacatcaaaagtgaacgaaaacaaagtagagagatagaagagtaaatgcccaataggtttacctaataatccgtgggtataaatctccggtggattaaaatttcacttcattggagaatgaaaggatgaacaaaatgaaaattacagatgtaaaagtaaatcgtagacgtgtaaaactgcatacaccgtttaaaaccgcgcttcgtactgtaacagaaattgaaagtatagatgtttatattcatacagacgaaggagtgattggtaagggggctgcagccgcaacgccagttattacgggggatttcaccagcggaatggaagaagcgattttaggaccgatgcgttcatgtttaattggtcaaaatatcattcagtttcagcagttactacagggcattcaaatgagttgtattggaaattcaagtgccaaagcagcggtagatatcgctttatatgatgtatattgcgaatatcaaaatgtgccgttatatgcattgttaggcgggaagaaagaaattcataccgatattacagtgagtgtggatgagcctgtattaatggcaaaagaagcgaagaaacatatagaaaaaggatttcaaacattaaagattaaagtgggtaaagaggcgcatttagatttggaacgtattgaggcaattcgaaatgtggtaccaagaaatacgatattacgtttagatgcgaatcaaggttggagtccaaaagaagcggtctctattattcaagagatggaaaatcgtaatttaaatatagaatttattgaacaaccagtacacgcgaaagattgggatgggttaaagtatgtcaaagatcgtgtgcaaacgccaattatggccgatgaaagtatattttcagcaagtgacgcattaaagctcgttcaaggaagatatgcagacttcattaatattaaattaatgaaatgtggtggtatacgtgaagcatggcgtattgcagatatcgcagaaacagctggtgtgaagtgtatggtgggcagcatgatggaatcttcactttccgttagtgctgttgcgcatttagcggcagcgcatcctaatattcattattttgatcttgatgcaccgctttggttaatggaagagccagaaggaatgacttattctggatcaaaggtaaaccttcaatcgacagtgaatagta

SEQ ID NO: 1005 - DNA, 3085 bp, Bacillus thuringiensis
taataatctgtcaataatgctagtaacataatattttctccactcccccttggagagatcccttgaatggagcagttagcttttgctagctgctcttttttatttatccgcacactatgatgaaatactcatagatcaaatccatttttcatcacataacaacatctatttattttccaatgagcttttgtatgtacgaattttattctcaagcatcttctctgtaacctctaagttttctctttgaatctgaatagatttcctatgatcttctaggagctgtaaacgagcttctgttgtatgctccccttctgtatataatctagcgtattctcttatttttgctattggcatttgcgtttgttttaatttcattacaaactgcaaccactttatatgtgactcttcgtaaagtcgatttccatttgtatcacgatttgcaatcaatatattttccttttcataataacgtagtgtatgtgtgctcaatcctaataattttgctacctcactaattgtatacatactaaactccctccacatgcttatccttatatattttatgaacgtatcaaatttataaaaaacatttgacttagagtatactctaacaaatacaatctaaccataaataaatttgaatttagggggattttatatgaaatacactgttattactggtgcaagttccggaattggttatgaagcagctttagcatttgcatctcgcgggaaaaatttagtacttgtagctcgaagacaagaagaattagatggattaaaattgaaaattaacgaaatgcatccagagttagatgttgtcattcgacgaactgatttatctgttactgaagatgtttataaactttatgaaagcctacaagcttttcaaattgaaacgtggattaataacgcaggttttggtaatttcgcctcaattgccgaacaaaatttaaataaaatcgagacgatgttgcatgtcaatatagaagcactaacaatactctcttctcttttcgttcgagattattcaatggttgacggaacacagcttattaacgtttcatcgggcggcggatacacgattgttgctgatgctgttacgtattgcgctacaaaattttatgtaagtgcctttacagaagggctgtctcacgaactgaaagaacaaggcgcaaaactgcaagcaaaggttttagcacctggggcaactgaaacagaatttgcaaaacgttcatttggtattgatgagttcgaatacgataatgttgtaccgaaattccacactgcaaaacaaatggcaaaatttatgctcgacctttatgataatgataaagttgtaggaattgtcgacggtttaacgtataactatgaacttaaagatccactttataattttgccgtaagacaaacgaattcaaattcttaataacctgtccatttcttatggaaatacatgttcccactatatctgtaaataatagtgggaactttttctctataaatttttttatccaacataccgaaccatcgccacttcatcacaataatccatctttggacaatgtctacaatcaatccatactttctctggcaacgcttctttatttataaaatcaaatccacacttttgaaaaaatactgtttcatatgttaaggaaattactcttcttacatttattttcgtagcttcctccattacatgatttacgagcatacgtcctatccctttccctgcatatgtatgcgaaactactaacgatcgtatttctgcaagatcttctcctaacacatgcaatccagcaactccaacaattctctcgtcttctttcataacatataaacattgcaaatattgataaagagacaaaagagaacgtggtaaaacaactccctcttttgcataaacctcaataagactataaatttctttcacatcactggtcaccgcattacagattttcatattacatccccttgcccctcaatattaatatttataactttaaatgaattttaattcataattttatataataatacagctctcttttctcctcgtcaatcactttatacaaacaaaaaaccaagcaatctaatcgatgctcggttcctcatctcgtatcggtaatactgttgaatatttaatttcacgaagtgccaaactcgtctgtatacgtgtaataccaagcttattcagctttctaataaactgctctagttctttacgatcacgatttgcaacctttaataaataatcgtactctcctgttaaacagtgacattctaacacttccggcatcgattctaattctttctccaacacttctaacttgtcaaattgatgaatattcgtactcataaaaataaagcataataaatcaaacccaagcttttcttgatttaaaatcgcaacttgcttatcgatgaaaccttccccatctaacctttttattcttgcatgcatcgcagccggtgataaattaacgcgacgtgccagctctgcattacttacttgtgaatccttctgcaatatatctaaaattcgtacatccaaatcatccaacactttaataacagacgactccattacaattcctccttttttcttaccgatgattattcgagaaaacaacttataatttatataaaactgaatatttttctgtaaatatcattttaaactaaatattttatcgagttttcaccattatacaaaagaatatattacacaataaagaaaaatgctaaaattatttacaataagtattgattacaaaaaaggggattttatcatgccttatttttacgtctttttactattactaacgagcttattatggggaggaaatttcgtcgttggaaaatcactcgtcgatcatgcatcaccgatgacactgacaagtttaaggtggctgattgcgattgtttgtttattaccaatggtatggtttaaagaaaagaaaatccttccaccacgtaccgcgatacttccgttaatattaatgggaatttcaggagtcgctctttttaacatctttcaatttttagcattagaaaaaacatccgctacgaatgtaggtct

SEQ ID NO: 1006 - DNA, 4904 bp, Bacillus thuringiensis
agctagcgagctatcagcgtcaatagcgcacggaatccacaatcctctaaccacggtacatggattcactcaattattaaatgaaaaacatgcctctaagctatctcaggatcaatacttagaaatcatgttaattgaaatgcagcaaatacaatctactattaataactatttatctttaaccaaaccacagaataccctaaaagaaaaaatagatattaatcacattttaaatcaggtgaaagatactatttcaccactcgctctatcatacaaagttgaaatcaaacaaaatagtacagattccttttatataaatggggaccccgaaaaattcaaactctgtctaaacaacatcatccaaaacggaattgaggctatgaaaaatggtggattattacaaataaatatacaaaaagtaaaaggaaatatcataattgatattattgattcaggaattgggatgtcatctcaacaaataaaacgaattgctttgccattctattcaacaacagaaaaaggaactgggcttggtactatgattgcttatagtattattagagaattaaacggtgatatagaaatagagagtgaattaggtaaagggacacgcttttctattagtatcccttgctaatgtgataacaattttctgtttagttaattacataaatgaattttaagaatcccgctagctagcttacttattaattatcttaaagtcatatgcgttaattaaatataataaggatcagagcctatctattgttacagatacactctgatcctttagtttaattcaattaaaaacacttaatatttataacttttcttacatcgtgatgaaatactagttcatctattttatcttatttactgattagatggggttaatataaatataacatctcgcgacacttaatttgttattatcattagagacattgcctgcagttgttttttcattaaagtacagacctttttccattcattgaacaagataactccccttttactacttcacttccaccgtataattccctgtccccccgccatactgatacacatgtaaataatacttccctggatacgtatagtaactacctactagtttattcccttgttgctgagcatacgtaacataattatttaaatctgcttcagaataaagtacccagttcattccaatattattttcattcgttacgttaatttgaaggtttttagcagtctccacattaatttcaaagaaatcacttgtatcgccatttcctaaactagcacgtaaaacttgatttaactgcaatttgtttgctgtttggaatgagttattcggttctttttctacactggtatcttctttcttttgaacagttacagtcgctgtagcagtattagttgctcctttatcgtctgttaccgttaatttcgtggtatactttccttcttttgtatatacgtgagttggattttgctcattacttactgctccatcaccaaactcccatttatacgaagtaattttcccgtcttcatcttttgatccgtcgcttgtaaatgaaattgcttcatttacatttccgctatacggaccgtttataactgcaactggtgctttattctctgcaccttcttctgtattaataccgtggaacacaacatcatattcaaattgtcctgatgtattcacgcgataatttacaaagtatgctgttactgttttatagcctgtccattcctttgcacttaaacgttttaacgtatcattaacgttttgtgtaattgttttccaatcttcatattctccttttgctgcagttcctgtatatgttccttgtagtgtgaatgtattaaagaactgtgatttatttttcttcactgatacatttttcaattttgcttccgctgttatttctgctgcaatatctgaaactggcttcgatgcatgattcgctaaataatcgtctgatactaatggcacattatatttctcacgattatcaactagcatttgcatatagtcctgatattctttatttaaattcgcatctttacttaatgtagagcgatatgcatcatatgctgttacatcatttttcctaataagatcatgtattttatcgaacatatcatatctcttattgtacatatacgattgtaaagcaaaggaataattatagaaatcccacgttccatactttgcatttaacgttcgctctgccgtataacgctctgctggatttgaagataatcctcctataatactctttctcggtacaacattatccgttctcgttgcccctgcaaaaaattcagcatttccttcttcaaaccaagataatctttcattttcatatattttcccttgtccccataaccctggtacttcatatctaccttgtaaataatgcgtgaactcgtgtctgaataattcttctaaactataaatactttcttctggcgtacgctcataagtaaagaacgtacctgttccttctatataaagaccaccgttattcgtttcataaccgtacaattgacgattaaattgatattctgctgggctattataaataaccatcgttaatacatcatcaggatttcctttttctaaaggttgatcactttcaaccgtacgatggaattgtgcctttacttcttttgccgcccaatataaacgttttactttttcttctgtcactttatctccagcttttaaaacaattgctccatcatcaaacgtatacgtttttggcaaatattttttctttccatcttctcttatttgatctaaattcaccactttaccatttgcatcttttccgccataattcgttgcaatttgctcagcagctacgaaatattgctcccctaaatacggatacattttcatcgcatctgttacaacttgtaaccctttagttcctgtactatggaacataccgagtctacctgtataataaatgccattattaataagccaaccgttttttgctgtaatcgttcccattaatgcaaaacgacttaattcattaatataactatctattttctgataccatactgtatctttcggcgctttcctcgtatcgtccaaatacgattgaatgtcgtaattaacaccttgcataatatcgtaaatagcatttccagctgaaagattatctactaatgtagaaaaattatcattatattgtttaaaaatctttgcagccgatgttatcgtttccacatcgctcgaagcgtttcctattaactttccgtatgatgataccactctattttgctctaatgtacccagcttaaaatttgaattgttagccatcgcttttaatgcaggtaagcatttatcatgataactccgttcatttaatttactaagttccgaattataaaatcctaaataaaatcctgaacgtaatacctctactaatgtctcaatcccttttgaatcatccttcgtataggcttgtccttgctgcttcaatttatcaataatcgtctgcatcctactatcattttgatagaatgctagactgtctgtattaaactgaaatagccccgtaatttgctcccaatcaattgttacaagtaaatctactaactgctgattgcttaattgatttaattcggcaattgtataagttttcgctacagctaattgcttactttcttttttcacctcaggtggtctttgtgataaatcggcaaattgtaaccttttctcaaaagacttgctttcgagcactttcgatgaatgagctaattcttgtactggtagttgtacaccgactggctccattttgagcacatttcgataagaaacttgctctcccttagtatcttctgccaaacttaccccttgaaaactccctaacattaaactagcaaaacttacccctactaacattttctttgaatagcctttcatgctctcccctaccttacatttttagtgtcccgctccattattttactatttttactttttgtcctgtattgagaaaaaataaggtaacgttcacacatgtatccattccatataaaattaacgcttgactttccgtgcattttatatcaaaaaaagatagataatagcaaaattcctgctacatctatcctcgttttcaacactatgattttaactttataaatgtaacttccggtaatgtttgcatatgctgaataaactcattcttttcttctgacgatatatttttcagttgcatccctaccttataaacagtttctgtaccttgctgtgaagcttccacctcatatgagagtattgggatgcctttcacttgtagtgtttctaatatttgttgtaccgcttcatgtttatttacaaacatttgcactgttatattttgtggaaataaaaattgcaccttaaaaatacgacttacaatttctaaaccaattaaaacgagaatcgtcgctccaatgcctactacatacattcccgctccaattgctaatcctatgccggcagtagcccataaaccagccgcagtcgttaatcctttcaccgcctgcttttgaataataattgtgcctgcacctaaaaaaccaactccactaacgacttgtgctgcaatacgacttgggtctagagatatatgctcttcaaacacaatatctgaaaaggcatatttcgaaacaaccattattaacgcacttcctaccgctacgaggaaatgagtctttaatccagcttctttcgatcgaatttctctttcaataccaatcattgctcctaacaagccagcaacaccgattcgtataataaaatcaaaatctacactcacgggcacttccccccttcattcattatagatagataaaccaaaaattatcacaaacatccttttatttacatggagggttacccgtaaatatac

SEQ ID NO: 1007 - DNA, 2764 bp, Bacillus thuringiensis
atcctccgttttctaattaccaccataccttctctattttggtatattacagaaaaaagtatacaaaaaaagaaagtgaattactccacttccttctctttcttatcacgaaaaactaatgcactacggttatactccacatctttcacttgtaatcgggcatttattactcgagctatcgcaaacaaataatcagataatctatttacatactttaagacaacttcatttattttcacttctttttgcaatgatactatagagcgttctgctctccttacaacagtacgtgcaatatgaataatagccgccgcctcgctaccacctggcaaaataaagcgttctaatggcggggcttcttctatatataaatcaatctttctttctaaactttcaaccatctcaattgtcactttataaggaattttttgttccactattgccaagtctcctccgcaatcaaatagttcatgttgaatattttcgagctcattgtaaatatctctaaaagccccgccttgaaccttagtcattgcatatccaatatgagaatttgcctcgtctattgttccatacgcttccacacggatatcatctttatcaaccctgccacctattacacttgtcgttcctttatctcctgtttttgtatataatttcatttcttcacagcaccctctcttgttattcttgattcgaccaagatagaaaaaagttctaccattctttatttaattgagtttacaaaaaaataaaaaacagcagaactttattcattatcaactttaaaaaagcatatctaaattatacgattcggtaaatatacagagaatgtagttccttctccaacaacacttgatacagaaattttaccgtcatggccttgaacaatatttttcgcaattgcaagcccgagtcctgtgccaccctttttcccacgtgttcttgctttatcagctttatagaaacgatcaaataaaaatggaatatcctcttctggaatgcctacacccgaatcttgtacttcaaaaatgaggccattatttttcgtatcaattacaagcgttacatgtccacccgcattcgtatgacgaattgcgttatcaatcaagttcgtcaacacttgttccatccgatctgcatcaaacgcatattcttcaatctgattccggaaatcaactgttagttcaacttctttatcctttgcaatcccttggaatttacgaccaattttttccacaaacggatgtatgtccacttcaccaatatgtaactctacgtgaccgctttccatacgagctaaatctaacaattcatttacaagtttacctaaacgaacggattcatcataaatgatttgaacaaactcatctatttcctctttcgtttgcacaatatcatctaaaatcgcttcactatacccttgcagcatgaccatcggtgtacgaagttcatgtgatacattcgcaataaagtcttgacgcattttctcaagacgacgttcttccgtcatatctcgcagtaccgctacagccccacgaattttcgtttgattgtaaagtggtgtcataagaactacatagttccctttttgtaaattaatttcaacaacttgttgttgctcgctttctacaacgagatggaatagttccacaagttcagaaggtaattttttacttaactctatctctttttcttcttgccaaacttgtaagaaatgttcagccggtggattaataactacgacttcaccttcttgatttaacgtaataactccatctgccatactactcaaaatactagctaactgttctttttcttgctgcaaagcattcatattaaacttcaactgtttacccatttgatttaaggccgttgccagctcaccaatttcgtcctgagataccataggagccttcgcatcaaatttcccacgtgacacttcaaaagcaacctcacgcattttacgaagcggtgctgtaatccgagtagataagaagaacgcaaagaaagttgttaatataatcgcaatcccagcggctaagaaaatgaaatcagtcgttctctccatatcttttattggcacttgtaaagattcatatacgaacactgcgctttgattttttgattgcactggtttcccaacgatcacaatatcattttcagtgcttttattctttctactatcagaagcttttctaatgttggtcttaatttcttttttgtccgtaaaaacagcggctaattctttatcttcttttaaattatccattgtaagggtgactaacccttcttgtttcggtgaagaagagatttccttgccatcttctacaataataatccttgaaagtggatcagagaatttgtacgcgatgttctcaatcgtttttacatcggcaccttcttcaattaattccgtaacacttgttgcgactttttgaagtctattttcactcatatcaacataatacgttctaaaaaattgtgaaagtaaaatcgcaacatatccaagaacaatctaatctagaagtaatatggttattcattacttccctactacatttcttcaaagcattaattgttcacaacctcatatttgttacctatccccctgactagctcgataaacaaagctgtttttcagaatctttatggtaatgaccatctgtaaactgaatacattattattatcttaccaaagagttatgttcatgtaatgtttttcgaattcttttttcagcttccgggtttttagataagaatt

SEQ ID NO: 1008 - DNA, 1415 bp, Bacillus thuringiensis
cgtaaaatttattacactttttttacgtttttttatgataaccctcaaaaacctttatttaatgcgtttttcactaagttcacgtttgtaacattcgtgtaacattacagtcataaagtgaaatgtagtcatattcctctctatttttgttacaaattgtttatttagtgccactaaacctatctaatctttacttacttttaatatgagataaaataccgtctttccaagataagtttatatgtttcctctatataactatgtataataaaaacaaagaggtggtcattttgaaattaatcgcattagatatggatggtacactactatcatctaatcttgaaatctccaaagaaaacctacaagcaatccaaactgcacaagaagccggtcatattgtaatgatctgttctggtcgtgcgaaagaggatgctttaaagctattggaagaatataaattatctcttccagtcggagcaagcaatggggctattgtttatgtggatggaaaagtaattaactcgcgttgtatacaaaacgacaaagtgtacaaacttgcaaaattactagaatctgaaggtttcccatataagctatatacaaataaaggagtttattctccatatacatggcaagatcaagtgatgcaagcattcgaagaaaataagcatgcgcttgatgttacattagaggaacttgaacgaattacagaaaagcaaaagaaatcgaacctaattactgatttcaaaaaaatagaagatgttgtaaataaccaagaactagaaatatctaaattcttcattttaacgtttaatgcagcgcatcgcgcacagctattaagtatattacaagaggatgctgatattatggttacagcatcggctcctactaacttagaaattatggataagaatggacataaaggaaacgggatacagcagatggcagctcattttaatatccctattgaagatacagttgctattggtgataattttaatgatgtaccgatgttagaagtagcgggtttatctgttgcaatgggcaacgctgaagaagatgtaaaaaagctatgtgatgttgtaacactaacaaacaatgaacatggtgttgctcatgcaatcgagcaatttgtattgaaacaaacttcatctagtaaataaaaaaaggactctttcaatttaaaatgtaccctatagaatagacacttgaaaaaagtctattctatagggtatttcttgtataataaaaggaaaattgggatcggagaatgttgaaaatgacaaaaaaactatttacagaaagagaaattcaaattctatcaaataacctatacgtaaaatctgtaagtcagaaaggtatcacttatacagaggaatttaagcatatttttattgaggaaaatgaaaaaagaa

SEQ ID NO: 1009 - DNA, 3889 bp, Bacillus thuringiensis
aaacttttttagtcttgttaatggaataggtcatcaaggtgttaaattagatatggaagatatatgagcccttaaaagggttttggtgttattcgcaattttaattccataattacttaagccgatataataaaatgttctatgtctaaatcgatataaaataataatcattaagtgatatttcttttttatagaataagtaaaaactgatattgtagtaattactgttttgaggtcaatttactgtgcaccttaattattgaagtttttttgttgattaacaactattgtatttggaaattaataataagtttatcccgctatttgccgggcagtaagacctccacctcaaaattcagccgaagccaaagaagttaggtgggggggcgggctgcccgtaaaagcccgattggtgagagctaataatcagtgggggatgaacaaaacccccactgattaaagtttcactttatgtgatgcggtaataaaactatctagtttgctattcttagtatttgtaaagtctatatatttttcctcttttgtggaaagtaaaactattgttacgaccagtaatatagtgtcatgtttttgaatattccattcgttttttatttttagttgatgaaaagacctttctctcaattaaatatttaattgagtacttgaatttcctccaccttgtacttttcaaagcatagtgcttcaaaaatagccgtatcgctttcatctgtttccaatttcacaacttctttattatctttttctaaaatttggagcaaaatagtttttcagtttcacatttaaattagcagtatttattttttgaattcaatttgtataaatgattgaattggaactttgactgttgtttcttgcggtggtacagtatctcctgttactttcgctttattttaaatctttttccagcttggtcctcgcattgactaccactgtattttgaagtacttcactgttttctcaagttcaataattatattttgtagaattaagaaaagaacttagtgtatttcctttacgtatctactctgatatttagatgctaactacaattaaataatatatgatttttataaaaaagatatagtaatattttgttgtgaattgtactaatttgatattttatagtattatttgtcgtgaattatatataacaaaatatattttatggatctataaaggagaatgtaatgaatacttctatcgatatacaacacttgtgtgatcttgcacataaagcatttaatgcccctgtacatattttatctgcagacagaaaaattttatatcattctacatctgataatgtttgtagtcctttttattcttcaaaagaagaacatcttagtgatatttatcaagaaaacgatcccctgtaacttgccactttttcgaagcaacaactatcttgaaaattttgttctaattcatatagaaaatcatgatgatattaaagggactattataatcggtcctactatacattcaaaagattcagatgatatgatcataaaatttcagaaagaatttaaatcaaatgataacattcaagaaagacttgcctattatcagtgtttatcggagattaaaaaaactacattaattgatatgggaattttattacattacatgattttcaatgaaaagttagatgtagatattgtcttggaaaaaaataaagtactagaggaaactcctaataaaaatgtgaaacctgatttatatattttaaaacgtcgacaaaacaaacctaaaacgcacaatatggcattagtaaatgatttcttttcgactatcaaagaaggaaataaaaaaaagttaatacagtatatgtatgcggtttcgcaagaagatgttgaacttatgctagtagaggatccgctcaggaatcaaaaaaaccttggaattattgcgattaccttagccactcgatatgcaatagaaggaaatctgccaccagatattgcttttgcccatagtattttatatatacaaaccctagaacaattagataatgtagaatctgtaaagcgattatcaggggacgctttacgtacctttgcagatcgtgtgaaagaatacaatgcaaaaaagtattcttacgcggttactacatgtataaaacatattaataaaaatgtttacgatggaatatctctgaatgaacttgctaatcatttagaaattacgcctacttatctgtctaaactatttaaaaaagaaatgggaattactttaagtgaatatattcaaagggaacgagtggaagaagcaaagaaattattaacactcactacttattcgttatcagatatctgtgcttggcttaactttaatgaccaaagttattttataagagttttcaaaaaaatcactagcatgactcctaggcagtaccgtgaaaaatatacaataatataagtttgttatctactgtctccaatgtaaagacttaaacatgggtgtaagtatcccaaaagatgaaaatactgaacttattacgctagaaagagtttgtgatttgtctagaaaaagaacttgtattcaaatagacgtatgagattaaccagatattatcttgttagcggaacagtttcaatttttaggagttagaaaaataatggagaaacaaagtatatctatttttttaataacaatcatgtgctgaatttatcccgctatttgccgggcagtaagacctccatctaaaaattcagcgaaagcaaagaagttaggtggggggggtggggctgcccgtaaaagcccgattggtgtgggctaataatcagtggggatgaacaaaacccccactgattaaagttgcactttatcggtatagttctaaatcagataaactagtctgacgtcagctcaaacaaatagctcttgaagactttataaacacatatgtgagcaaaagctcaatggaaatctttgtaccatattgttaatttgaaaaaatacattaaccgttattttgctaaaggaaataaaaagacagaaggctgcaaagtgttccatggaagctttgcagcttttttgtaatttaaaacctatgtttataacgatgacaagtttatagactaatatcttcatactagatatttgttaataatgatattagaatgttatgtaaaaaaatcaataatataacatatattactaaatatatctacatgttatgcaattatgcataactaaataaaggtaaaaaagtataaaaagacctattatattattctataagtattttttctaaaataaaatttcttggttgagctaaaatagttatttttaaccgtatacacattaatttgtaatcattccaattacagaaatgaaatttacgaataactatatttatataatttttttcgggacatatttttatttaacagtgaattatcgagcttaatcgacaaaatttttctatttacgcattaaaaatttaatgttttaatgaacaacataactggtatgaccagacagaaaggagaaggttacgctaataggaattatagtgaagttataagtaacattatgtctttaataattttctaaatagtcaatttatttataagaggtcaagaatcaaattggtaataaacgtgttctaagtttctgcataacaaaagtgaagttattccgcaataaaagtataagcaatgtacagtataatttcatcttttgttgtctagtaaggagtttgctgacaaaactaagagggatattatcaaattgaaattaaacaatgttatgacaggattaactgtaagcattggtttattgatcctcacgattctgtaagttaaaccgcaactttaggaaagaatataataaattactactcataaggtgcctgattcaa

SEQ ID NO: 1010 - DNA, 2606 bp, Bacillus thuringiensis
  unsure (1)...(2606): unsure at all n locations
aagtttctagaaaaaccacgaaaatgggatactgcaaacttacgaaacttcattatttgtatcggcccaattagttccatatttgatattatcacatacgtagtcatgtggaatgtatttggtgcaaatacaccgagcgagcaatcattattccagtccggttggtttgtcgttggattgttaacacaaactttaattgttcacatgataagaacacaaaagattccatttattcaaagcactgcatcaacaccagtcgttttattaaccgctcttattatggcaatcgggatttatattccattctcaccacttggtgcagccgttggtttacaagcattgccacttaactacttcccttggttagtaggaatactattaggctacgcttttttaacacaattcctgaaaaagctttatattaaaaagtttcatagctggttgtaaaaataagaatgagtgggtattccccgctcattctaaaagacataacacatattatatatggaggtgaccatgatggtatggtacgacattgtattcagattagttatcgcaattattgtaggagcttgcattggaatggaaagacaatggagacaccgaatggctgggttacggacaaatgctctcgtatcacttggtgcctgtatatttgttttattatccgtcatgcttgatcatgatgctagcccatcccgcattgctgctcaagtcgttagtggcattggctttttagggggtggcgttattatccgcgatggttttagtattagagggctaaatacggcagctactttatggtgtgcagctgctgtcggtactcttacaggcgccggtttcctcgttgcagctatattaggtgcagctggcgtgttactagcaaatatacttcttcgcccaattgctctttttatgaataaaaaatcaaaagaagaatcaccagaacaaacgaactacttactttcccttacttgttcagaagaaaatgaagcacatattcgttttttacttatgcatatggtaagtacagaagggctcggtttaaaagaattgtatagtgaagatgtagattctaatcaaaaagtttgtatacaggctacattacattgcaagacaaatgcggctatcttaattgaaaaaatagtaagtagaatgctattagagtctggcgttactggagctggatggaagacttctttaaatttagaagcgagttaaacaggaaaggtgtcatgattttactacttcatgacaccttctacataaacttattttctaacttttgttgaaacgacttctcttgcttacgtagtagttgactacctcgttgtaaaatcggtgttccatacttatcgttaatttgatcaatgacagcaagtagtggttcttttttcgcatcctcttcaaatgaaaacaaatctaattgtttcaccgattctgtcttccactctatttcagtagctgtaacacctagtaaacgaatggaatcaccatcccaatgttgcttccataaacgggatgctgcttgaaaaatatcgcgttcttcccaaattgcatttttcaattgcttactccgtgttactgttcgcctatcatggtatttaatcataatttgaatattatagctgacaagggttcgcttttgtaatcttttactcactgattttgataaccgttctaacatatcaagcaattctttctcttcatccatatcctttgaaaaagtcatcgagttaccgacacttttatgttggcccatttgactcggatccacttccctatcatccataccttttgcacgcttttgtaaatcaataccatgcttcccaattttagcgcgaatgatatgctcgtctcccttcgctaactgttcaattgtatgtatatgaatttcatttaatttttcagctgttttttctccaatcccatgcattgcttcaactggaagtggccaaatcatttctggaatatcacgttttcgaagtacggtaataccgagaggttttttcatatcagaagctgtttttgctaggaaaagatttggagcgattccgatactacacggaagctgcaactctgttaatagtgcttgttgaatcatctttgctatttcaagaggcgaaccgagtgcgtagcaatctgtaatatctaaatatccttcatctattgagactggttgtatcttttctgtaaaacgggaaaggacttgaaacatttgaaatgaagcttcgcgatataatgtgaaattaggacgccttacaactaattgcgggcataaccttttcgcttcccaaaggggcatcgtcgtacgtattccgtattctctcgcctcataactacatgttataataattccttttctctctttttcatttccagcaaccgctaatggctttccttgtaatgatggatcatgagcaatttcaacagatgcgaaaaagcaattcatatctacatgtaaaataacacgaccatttttcggatacatttctcgcatagtactcactccctaatcagaacgttcgttctttcattatatcaaattttgcacaatagttataataattacttgttctttntatattcgatataaagaggatata

SEQ ID NO: 1011 - DNA, 3421 bp, Bacillus thuringiensis
tccttgtagaaagtattgtaagtaattaacatatcaaactataacatacattacattatggttcacttccattacgcttttaaaatgtaaaataagaatacaccccataagccacaaataagattaatagaatagaaatgccgagtaccgtatatataatccattttaaatttgaattcatatcatcctcccgcctcccagcaattccattatataacaaaaaagcattggatacccaatgctttttacacttaagcaaataaagaagtattcgcatataaagctggtgaaccacctgaatgtacgaataaaatattgtcttccttattaaatttaccttttctaattaaatcgattaatcccgctaccgccttacctgtatacactggatcaagtaaaataccttctgttttcgcaagtaactgaactgcctctaccatttccggcgttggtaacgcatatcctggccctacatattcatcaaagcacgtaacagcgtcgcgcgggataaagtttggaataccaacgtgtgctgaagtttcatctacaagttttgctactttctcttcttgctcagcttttcctctacttacgttaattccgattacaggaatctggctttgcgttccagaaaaaccagtaattaaaccggcatgcataccgccgcttccacttacacaaacaactgaactgaaatcaattccttgctcaaatgattgcgccataatttcttgggcacaagcaacgtatcccatagcacccgtagggtttgatccaccaactggaattacatatggtgtattccctttttcacttacttcttttgctactttatgcatttcttccataagatctgctccgttcggtacaacaattacattttcagcacctaataagtgatataagaaatagttcccgttaaagtctctcttctcttctggctcaagcccttcctctaatacaaggatacatttcattttttcttttaccgcagcagcaagtgtcaggcggcaatgatttgactgaataccaccagctgtaattaacgtatctgcaccattttcctgtgcatctgcaactaaaaattctaattttctcgtcttattgccaccagctgttaaaccaagtaaatcatctcgtttaaaataaatagtcgggccaccaagtgcttcagaaaagttgtttaacttttcaattggtgtatatgattctgtatatttttttctcgggaatttagctaaattcattgtaacgttccttttgtacttctttcacaatatatgtaacgttactattattacacgtaaaaatggtgaagtcacctttctcggttaaaaatgtattagaatttcgttttgataagtaaaaccgtattaatgattttaacttaattacggtacatgaaatttacatcaacgatttttcaaatatatcgttcattccttacaatatatcaacaatttttcaaatgtatctatcgtaacttgcaatatatcaacgattttcttaatatatcgatctatcgacaaaaaacgacagacaggcacctcctttctcatcaacaaaaaaagagcctacacattcaaatgcagactccctccaatcacttatttaccgaaaaacgaagtaactgtgttaatcccggctctaaattcatttcacctttatggcgtacgtatacgactttatccccatcaaatttcggagggtttgctttactatacgtatgccactcattcgttccttctatagaatactccatatattcagttgcaccgacaattatattttcactatcatctgccgttacatttggtgccatctgcgcaatttttgaatcactaattaataacttctttatatccttatcacgtttgtaatcgtaagctgtcacaattacatcgttaccatatgctttcacttgtaacccttgtttaaatgaatagccatctggagcagttttctctcctccatttggccctgctgacatccagcctgtttcaatcccgcccgtatttacaacagtgaaacctttttcatctccgcctttaattttctttttaccagcccagtcaggtaagtttaaatcccaatgcgtatgactcgtgaagaaaacaacctgcggatagtcttttaatatatcgtacaatttatccacgtttaaataatcttgtaaatatggtgattgtcttgatccagatactgtatcaggtaaaacgtgatgagagaaaataaagattggtttatttttatctttttgactatactcttctaaattttgttttaaccaacctaattgctcatcactcatatatacttcatcccacatttttgaatcgtggtatttcatatatttttcagttcctaaaaataaaagtggatagccatctaattcttttttatgatataccttttcttgtccactaaatttcagatagcggttaaataaagtttcctcagttacaccatttggccatgtactttgagagagtttcccatctgctgtccatttaccagcataaaactcatgattcccaacagtagaccatacattttctggatgcttatttttatttaacacacgctttacatcatcatattgtgactgttgtccagtcggcgttatatccccattcataataagcgctctagaaagtggcgttactttattcatatcttttaatacgtgatcaaaatctcctaaatcaccttgaatgtcactaataacattaaaagttgtagctgattttcgaacttgctctttcccttccgcatgtgctgaaaatgtcggtaataatgccgccataactgctaacgaagcaactgtctttttcatacaaattctccccctaataatagaatgtaccaactgacatattctgcttctcttaggtgcttgtccaattcacattatagggggagattgtaaagattaatggaataaaaaattaagtgttttttaagagattttgtcttttctacacactccacaattagcaattcgcgccaatctagctttttagtctttaacattacataaatgtaaatgaatatgatgaatctcttagtttaatatgttgtctttttaatctctgttatataaccgccacaaaatatgctatcttttcaagttttctttctttaataaacgttactcctcttttaattagccttaaaattgtaaagtggcttaataatatgtttaatatcaattgtttcttttgtattctcaataatttcatccattggcttatataccattggtgcttcatctaaagtactttctgcaacagatgtagtccaaacctctgtcattgtattttgaaaatcctctaagttaagtacttctttcgccttcttgcgactcataatacgccctgctccatgagggccagaaaagttccaatctggatttccttta

SEQ ID NO: 1012 - DNA, 4800 bp, Bacillus thuringiensis
ttatttataatggatgaatattttaactgtacatgactcaaataaacctactagtgtatcattccgctttttcgtctttattactggtaagaggagcaaaacatgctctgtgttacaagaacttttaacaactagttttcttcgtattttcccctactcgttttaccagtacatctttacaatgtagcctttaattctgcttaggggcttgctctaacgtgtgttctcttatgaaacgaaggtcattccagtttatacaatgaactgaaacttggatggctaatgaatccgagttatccatttaatcatttattggctgctttaaaatcatggtatttaaaaaacttgtcaagagtcaatttaaggcttaacgtcagccttatattttttatataaatatataatatttctccatgctataatccattcataaaatgtacatgttgcatgagttataacgacaaaagacataaaattaggaatagttgactttgtaaaatcagttatgtaactactattaaaaagcgaggtaaataatatggaacaaaaacataatggcattatttttactgcaataacagacgaatcaaatgaatattatcaaccattttatgaagacttgatttactttaatgaatgtttaaatgaaaagaaatcaattgcggatcaacttatatctttatctgttgaagaacaagactttcatacgagctgttttgagtatgatgatatttggctaagagatgttgcaccggttgtcacaaatcatctagttaaatttaaatatcgaccaaattatttgccaaatgatcaagggcgatatttagatcaacaatttaataaatggttgaaaaagaatgactttgaatatgtaaaatccccattaatattagatggtggtaatcttatttggaataaaaaagatactgtaatattaacagaacgcatatttgatgataacgatgattggacagaagaggaaattattgagcagttagaatgggatttagatgtgagccgagttattattattcctgctgaggaaggggatgtactagcacacgcagacggaatggttaaatttattgatgaacatacaatgtttattagtgattttttaggggatcatgaatttagatatagtgttcaagagattattaaagaacaaatgccaaaagctgaatttatagttgttccttcatcatatacagagaaaggacaatatgatcaagagatagcatcggcaaaagggttgtatataaatatgttagaatcatgtgatgctctttatgttcctaagtttggactagctaaagatgaggaagttttacgatatattcaacagtatacggagaaacaagttattcaaattcatgtaggagaaatatcaacaatgggaggcgcgatgaattgtttaacgtggtattgtccaagtcatttgttaccttcgaaaatgagaagattgaaaaatcagaatgaaaatttttcaatgaagaagatttttgattggttttaataaataagtaatgaaaagaaaatatattcaaggagtattgatatgtataccatcgctgagttttctcggatttgtaaaatgagtacgcggatgttaagacattatgacaaagaggagatattaaaaccggcatatgtgaatccggttaatgggtataggtattatgaacaagagcagctggaagtagcattgaaaataaaaaagctaagggagtataaatttcctcttccaaaaattaaaattgttttgcagtcatcggatcaagattcgtttgttcaacatatacaatcacaaattatcgagttgtctcaggaagtgaagcaaaatttacaggttatttcagaaatgaatgaaatggtaatggtgaatagtagtctaaatattgcacgccatagaagttacgatatattaatgggaatgagtaacgaagtaacgttaattactcaaagagtaaaaatagatatagatgatatggatgattatttttatgacttatatgaagaggtacaaaaaaataactttcaaatagtcggttctccatctgcagtcttttatgatgaagaatatattccgagtaacagtgatattgagttaagaattccggttatgcaggggaatgatgatgacgtagcgcaagagtatgaaatgaaacaactaagtccacatcatatcgttactactatgcattatggaagttacgactatataggttacgcttatatagcgttagaagaatggattgaaagaaatgggtatgtgataattaattcgccatatgaggtttatataaagggacctgaatgtgattgtttagcagaagagtatgtgacacaaatttgttttttagttatgaaaatagaatgagaataaggattgatattaacattatgtcaatccttattctatgtatgaaagcaatttatcataataaaaaggagaaataaagaatcaccttataaagttgctacaagtaaatgaagatattcctgttgaccttaacacgatgtcaaagtatagactgtacgtacattcatataaggggtgaacacgtatgagaaatatagaaaatagtttgttttatatgcctgcggaatgggagaaacatgaaggtacatggctccaatggccacatgataaagcacatagaggtgaaggttacagagctaagttagatgatatttggatatcgatggcaaaggagcttcactatggagaaaatgtccatattgttgtatgtgatgaagaagagaaaatacatgtccaatcgaagttaattgtagctaacgtgaatatggataaaattgatttcttaattcaagaaactgatgatatttggatacgagataacggaccaatttttgtaacggataaggaagggaatcgctgcctaacgcactggatatttaatggttggggaaataaatatccgtacgaaaaagacgctaatattccgaataaaataagtgaaatgtatcgtattccaaaagttgaatctagtgtctgtctagagggtgggggaattgagataaacggaaacgggaccttaatggcggcgaaaacgtctattataaatgaaaatagaaatcccacactaagtcagaaagaaattgaaatggagttaacgaaatatttaggagtaacaaattttatatggataactggtatacgcggagaagataattatgatgaagatacggattatcatattgatggcgcggcacggtttgtaaatgaaaatacgatactgtatgaatatgatcctttcgatgaaggagagccataccttttggaggcgtacgaaaagcattatcaagaattgcggcaagcgaaaaatatagatggaaagccatttcagctcattccagtaccagtaacaagaaaagtggtaaaagaagcagattgtaaaggatcgtacttaaatttttacattggtaatgaagttgtattggtacctatatacggtgatgaacatgataaattagggcttcaaatcattgaaggtcaatttccagggagaagaattgtcggtatatatgttaacgaattgtatgcatacggtggtatgattcattgtgtgacgcagcagcatatagaatagagtaattcaaataaaaagcatgcagagcatatactctgcatgctttttataatgttgaaaactcctcaacaagttgagtgaattgttttaatgcactttcaatcggttctggcgttgttaaatcgacgccagcttttttcaataagtttaatgggtagtctgaacttccgcctttaaggaattcaatataatttttctgagcatccggatcacggcttaatagtttatcagcgatttgaatggcagatgcgaatccagttgcatatttgtatacgtaaaacgggcgatagaaatgagggattctagcccatccgtattttacttcttcatcaaatacaagtgaatcaccgttatattctttaaatagcttttcataaatttcactgaagacttgtgcatgtaatggtttaccttgttcagccatttcatgtgtgattttttcaaattctgcaaacataatttgtgtaaagaaagtacctttaaatttctcaataaaatggttaactaaatggttacgcacgttcgtatcttttgcttcttttaataaatagtgaattaataacacttcatttactgtagaagcgacttctgcgacaaagatagaataatgtgcagaaattcttggttggtatccatgtgaatagtgcgtatgcataccgtgaccgcattcatgagtaagagtgaacaggctgtttaaatcatcgtgatgatttaaaagaatgaaaggatgaacgccgtatacaccaaagttataagcaccagaacgtttccctggtgtttctcttacgtctatatatcttttatctttaaaactttttaatgtctcaatatattcttctcctaaaggagctagtgatgcaatcataatgtcaaatgcttcactatatgggatgtcttgttttgcaccttctactaaatcgacgcctaagtcgtattgtcttagttcatctacgtttaatttttcttttcgaatttcattgtatgtatgtaatgtttgaatgttttttttcgttgtatcaattaggttttcatatacttctttcggaaccatatcgccaaataatgatttctctagcgctgatggatagtttcttaatttcgaaacagtaacattatttttaatagcagcggataaagtagatgcgatggaattctttaactgaacatatggtttgtaatatgcttt

SEQ ID NO: 1013 - DNA, 3711 bp, Bacillus thuringiensis
gtttcattccatgtaaaaatgacggagtacttgtataatatggtgagtgcatggatttccaagttgtatcatttaactgtagttgtcctacataagttgaaaagtaccttgataatatttcatatccgttatgagacatcgtgtaatgaggtgcttcaaaggcaacaggatatagtttagcatctacaagttcttgaattcctttttcaatatgatctttcgtatatttcccctcgaattcttcccctttttttacatattggttatatgcctctatatttggaaagtcatcttttgtcttcggtttttcatgcttcggttggagaattggttgatctgttttgacatcccaaaattcaaagccctcacctgtttcactgtcataaaattggtgagtataaccatgcataataattgctgcaccatcatcttgcatagagcgtaaaagatcaactagttctggtttatcttttaaatgtattatctttcctgtatctggatctttatataccggaataacagtaatcatgtaaggcatctttttctcttttagtaattcagcaatttctttcaattgatttatatctgctgctgggtgaacatcctcaagacgtaaataagcttcaactttatttttcgttggtttttggctgaaataagaaaataacatttcaccgacgtaatgagacatccagtcaaagaggttaggtgttgcaacataataagatatttcatgctgaacgattagtgggttagtgttatttgagcttaaagcgttagcaagcacagttccattcgtatcaaatgattgaattaatcgttcctcttctaaggtattttttagcttcttttctggatattcaattttattaactcgtatatcgtcactcttcaatgtaatgaaagaaaaacgcttagataattgttcaacattttgtcctaatactaatacaggaccggagaagttttctagaaattgtttcgtttcatcagaaaacgcttcttttgtttcaccgatataaacaatatgtgtataggaggatacgttattaattgaagttgcttcttttaagttttttagggttatatcatttgtaaaatgtcctaattgagtattaaggatttggacattatttgaaactttatcgtcttgtgtactatacaaaacaagtacttttggttttgatgatgtttgtgcagaggtgtaggtagggatgagtagtaaaatgctgaacaagagtgttaggcattttttcattttgtacgctcctattctatatatagagttcagtttacaattatatacaaaaaatgcgttatagtctatgaaagttacattttttcacatatttaccagctgttttttcacaaaatcggtctaaagcatgatgataatacgtatagttatttgctatgataaaagagtaatagaatgtaggtaattgtaaagggaaggctgaaaggggacaaatttcagcggagaaagaggtagaggtagtgaagaaattctttgtaggatttttagttgttcttggagtatatttatatttccaaggaaagtctgaaggaatccataagctagtgaatggaacaagctatgttgattcagaagaagcaaaacagatgaaacaaatcattatagaggaagcgaagaaagtaaatcttccagaatggatacctcttgcaattgccgagcatgaaagtcgattaaatccaagaagtgttggagataatggaacttcattcggattgtttcaactacaccgcggcggcgggcttgcaccagaacatttaactgatgatgagctgaaagatccacgtacaaatgcgcaaattgcaatgccgcatttaatgaaaggatataagcgtggggtgcaaaaaggtttgactgattttgcattactgaaatatatagcgaatacatctggatggccagggaatttagggccagagtggacggataataacatgaagtataacatcggactagaagatgtgtactatcgaaataaaggtgtaataaagtgaaactttaatcagtgggggagtctgttcatcccccgctgattattagtcttcaccaatcgggcttttacgagcagttaatcttccgcctaaattctagcgttttccggattttgaggtggaagttttactgctcgttaatgcggggtcaaagagtaggttttctatacctactctgtttttttatgaataatttcatccttttctttcgtgaaatactgcgtgagttgtattttcacctcttctagttttgtagaaactttgcgtattttatatcctacatacaatggtgaaacgacaaatctaggtacaactttacaaatgatttttccatttaagtaataaaagaataagttataactactgcatcctttatggaaatctatcagtatgtaacgtacagtttgctgaatgtaatttgccatttcatctatatatgaaatattatcaatgattatattgaattcagtgaagccaataatgggacgctctgaaatattaagctcaatgcgttcatttttttgaacaattaccccttgaaaattttcttcttcaatattttcaagataatctacatatttcattccgataatttgcatgtgtgcatgatgcaaacttccacctgaaaatggaccgtgatttttgtataaaattacagatgcaaattctgcgttcttttgtaagtgtaaccaatgttgaatagaaaattgcattaattttcgcatatgttcttctgtatatgttgcgatatgatcttcgcaattatccgtttcaatcagcaccgtttgaaatgtatcttgtaatgtaggaaatttattttttaaccaaataatagaaccatcagttgctaaaatatccgttaaatgttctttatcgcaaaatggacatgcagcgcttctattccgaatactttctggtttttgtttaccgatatcgtttaaaaaatatagttgttgtgtatccatttgtatatatgcccctttaaaatatgtgtaaaaatcccgcttaatacattcgggaaaaggagaaggaaatcctctaaagacaatatggaaaaaataaaagacaagatatcctcattacgatagggtaccttgtcttttattttttctctaatagtgtgtatggataatatagaacattttcattatttttcttttttctattttttattgtgtataaagtaattgctgtgcttgcaattataataatggctttcttcatattcatatacccctttttattgttggtttaattcttggctaactgcttttgcatcgactaaagcgtgtaaaatcattttcaccatgttcatcatatttcttcactcctttttatagttcatttagttcttttacaactgcttgtccgttcactaatacctcaaagattgcttttacgatttctttcatcatgtttgtttcctccttgtgtttgtctctcttgttttacatctttattgtatagggaggcatcttttcgtactatcgctttccattacgtgaacataacagttttgtaagatttgatgtcacttattgaaatgtttagtctatcttcattattttcagaaaaatgactattcaaacatgaaattggaaagtattattaagaaggtagtattaaatttcctacgaaaggggtgaatgagaagaaacgttctttaactgcgcgtgccaaattttt

SEQ ID NO: 1014 - DNA, 3135 bp, Bacillus thuringiensis
tgattgcaccagggtgatttacaatttcacgtttactcattgtatcatttggtaatactacatcatcaacacgaactgttataactctaccatcaaagatcggctcagtttttactgttctctctgcaagattactcatactacttcatctccctgttctatttcctattctttcctcatacattttaccacattgaaaggagcgtgatagaaatgaaagtttatattttaccaaatcgcgtcactttagtcggaaaagcatggcaaattcgccataagctaaagcaatatagcaaagagtatgcaactgtacaagagtggattacagcaaataaagtgaaacattaatcatgcttttacgggcagttaatgcgaaacgaaaagtaaacgtttgtcaacctcttttccctctcgtacaataaaggtaaggagggtgacctatgacaaaacgtcaattaggaaactcagatttgtttgttacagaaatgggccttggctgtatgtctctcggtacatctgaaacagaagctatgcatattatcgatgattcaatcgatttaggaattaatttttttgatacagcagatttatatgattacggattaaatgaagaatttgttggaaaagccttgaagggaagaagagaccaaattgttcttacaacgaaagttggaaatcgttggacagaagaaaaaaatggctggtcttgggatccttctaaagcttacataaaaactgaagtaaaggaaagtttacgtagacttcaaactgattatattgatctttaccaacttcatgggggaacgattgaagatccaatagatgaaacaattgaagcttttgaagaattgaaaaaggaaggtattattcgccattatggtatttcttctatacgcccaaatgtcgttcgtgagtatgcaaaacgctcaaacatcgttagtgtactaatggaatatagccttttaaatcgtcgtccagaagaatggtttccccttctgaatgaacaccaaattagcgtcattgcccgcgggccacttgcaaaaggaattttaactgacaacaatgcaataaaaatagaaagagtaaaggaaaaggattatctctcttattcttacgatgaattacatacaactctagcgagtgtaaaagaaacgattggagaacgctctttaacaggaacagctattcaatattgcttacataataagactgttgcagctgttatacctggtgcaagctcgcttcaacaattacaggaaaatatacgagctagccaacagttacctttaacgaaagaagaatatatacaacttcaaaagattgttaaatatgacacatatgctttgcatcgttaaaaatatcgaattaccgataaacagaagactgtctccagtattaggagacagtcttttttataacgtatcatatttatcaggattcgttcctacatgtaaatcacgattcaacgtgttaatttgacgtatctcttcttcagttagtgcaaaatcaaaaatagtaaagttttcttcaatacgagatggtgtaacagatttaggaattgtaacaattccgatttgaatatcccaccttaatataacttgtgcaggtgttttttcatatttgttagcaatagcctgaatgattggatgctggaatacttctccgcccctcattaacggactccatgcttccatttgaatttgctcatcttgacaataattgcgcaactcaaattgcgtcaacatcggatgaagttccacttggtttaccatcggcttcactttgcaatttggtaataatagttctaaatgatgtttatgaaaattagaaacaccaatcgcgcgcactttaccttcttcatacaatttctccaaagctcggtacgtatcaacatacttccctcttaccggccaatgtattaaatataaatctacatagtccatttgtaattttttcaaactcttttcaaacgcctcgagtgtctcctcatatccttgatcgtcgttccatacttttgttgttataaatatatcttctcttggaattcctgattcacgtatcgcctctccgacaccgctttcattttcatatacagttgctgtatcaatcgaacggtatccaacttctaacgctgtttttactgcttgctttacttcgtctccttctttcgctttatatacgcctagaccaatcatcggcattttcacgccattatgaagtgtagttgttggaatatgcacagtcgtctccctttcattgttacattttttataagccacaactttatttcaacaagattcatcccaaaagtcaaaacatacgtacagtttacataacacttttatatagctaaaaaataacgtgaactcattcatttaagttattttctctccattctttcgctttttcatccacattgcgcacaaactcatttttcccttcggtatataacgtgccatcatatgtatacttttcggctaattctctctttaaggttgcatatgcctctgcttcttcacaatgagccatcatataatcacgaaacgctaaatgccttacaatctctggatttcctttttcaaacacgtgtaaatgatacgaacgtttttcttcagttccatgaataaaatatcggcgtcttgaaataccattttccccttttacgatgtaaccaagctctataaatcgttcattccacccatctactctttcgatattttctacttccatgatcatatcaataataggtttagctgccagtccgggcactgacgtacttccaatatgatgaattttcaccgtttctggcatcgctgtttttaatctttcagcctccatttgaaatttttcactccaatggttttcatgtggaacaacgataatttttctcattctaactccccttttcttacaagctcgtcaaaaaatgatcagtgaaataccactgatcattttttattatttaaagtctttccaagtaaggttactttcacttagcagttcttcaaatgatttattcttttcacgttctttttgttcttggcgctttctttccagttcagctgcctctttttcctcttccctcacttgcaactctttcttcttactctttaattgttgcatgagtgaatcatt

SEQ ID NO: 1015 - DNA, 3551 bp, Bacillus thuringiensis
ggtaatattatagtagcagctccaactatataagaaaatgctcctgaaagcttcgctaatttatttttatctccaacaaacgtttcttcttgatatcctgctaacaaaaacaacctctttttcacatgtatttgataccctaaaaaaatgataagtaaccctacaaataaacaaactaaaaatccagctaacatatactccccctcctctacaatattttactatacataaaaaacaaattagaaatttcagtttattaatgagtcattctgtgatatattgcatattgtattcaatttgtatttttagaaaggagaattttagatcatatggattcaaatcgattaaaaggaattataatggtcataatcggtgcttgtttatggggcttgtctggtacagctgcacaacaactttttcaatatgacaatgtttcaaccgaatggttagttacgatccgtttacttatatctggaattattttgctcattatttcctcattcggaacgagaaaaaaagagatatttagcatttggaaacaaaaatctgatgctattaaaatgattttgtttggtctattcggtatgcttgctgtacagtatacgtatttcgcttcaattaaagaaggaaatgctgccgtcgcaacattattacaatatttagctcctatattcatcactgtatacttacttttcaaatggaacgttcgtctatcaaaaattgatttcatttcaattaccctttcattagtaggcacttttctcttactaacaaacgggtctgttcataacttggctgtttctacaccagctattatttgggggattttatctggattatctctcgctttttatagtttatattcaaaggaattgttagaaaaatggtcttcttccgttatcgttggatggggcatgattattgggggtattggtgtaacgattgtacactttatttctacaaacgaattcattttattatcaactatgaaatatgtaaaactaagtaccctaccgctcatcacatttgtcgtcattttcgggacacttattgccttttatttatacttagacagcatacgatacctgactccgaaagaaacaacattatttggttgcacagagccactcgcagctattatttcttctgtacttatattacacgtgccatttcaatcttttcagttattaggcgctttttgtgtcattgtaatggtgctcatcttaagccaaaagccggatgaagggaaacaaaaattaaagcttgttcatgcaaaaaaggaaaatatacaatgaaaggattgaattcactatgcctgtccctcaaaattataaaaaaccaggaagagtttcagcaaaatcactcgttttaaatcaactacaaaattggattattgaaggtgtactgaagcccaatgaaaaaattaataatggggaattggctgaggcactaggagtaagcagaacacctgtaagagaagcacttcaaatattagagctttctggattagtggaaatggtaccagggcaaaaaacgaaaattgctcctattaagttagacgacgtatctatcatttatgaaacgatggctggtcttcactctattataggaaagcaagctcttcaaaacattacaaacgctgatattcaactactttctgaaataaatgagcattttcagcaatctatagagaaaaaaaacgcaaaacaagctttagaattagatatacaattccacaatacaatttcttctattgctaaaaaccaatatattgaaccctttctagaaaatatgcaacttcacgttttacgtcttgaatatttgtttttccaaaactttgttccagcaagtcaatctattgaagaacatcactctatcattcaagcattacagaagcaggacgaaaaacaaatggaacaaataatgacccaaaactggctccgtcccatgaaagaaatacaaaaaataatttctacgaaataaaaagagagctggttacacaaaatcgtaaccagctctctttttactaatctatatagctacgcctgaatattcgcataatcttccatatcttcgtactctttttccaattcctctaaagacagctcgtataattgtcggtcgcgaatcttaaacacacctgctccaattaactcatcaattaaatgcctcttacgattttcaacagcaaaacggagttgactactcatcttttaaaaaacttctttctacgatcattgaaaatgataatctctatcaattaccacttttgattataaaagatgactctttataagtaaagtaatttcatgaaatatttaccttgcaaagtacttgtggccacattatatatatgtatgccgtgcgaaaaatgttatgacactttttcttatcctttttctttcatactttgcaagttgtctcatcatgattaaattcaccatctatttctacttgaatggtgacatgttctacatgaaatttctcctttaatacatacgtagcctcttttaatacactttgcgtttcattccctttaataataagatgacatgttaatacttgaaaatctgatgtgacagaccatatgtgcaaatcatgaacttctttgacaatcggaatatttaataacgtactttttacctcttcaacatttatgtgctgtggtgcaccttccattaatatatgaaccgtatcacgtgttacacgccatccactaataatgactaaaatagacacaagaatactagcaatcgcatctgcacgcagtccatccgaaaaatttaataagtaacgcagcaataatcgctccgacggaacccaatagatcgcctagtacgtgcaggaaagcacttcttaaattcaaattacctttcacatctccgcctctcattaatatccaagctgataaaatattaataagcagaccaaggactgcaataatgagcatcccattactagcaatctcaactggttctttaaaacgacggattgcttcaataaaaatgtataccgaaatgacaataagaacgacaccgttacataatgctgctaacatttcgactcgcttatacccgtatgttttcgcagttgttgctgttttttctccgagtttaaacgcaagtaaacttaaagctaaagatactgcatcacttagcatatgccccgcgtcagatagtagtgctaagctatttgttacaaatccaccaacaacttctgcaatcataaaacttgttgttagtaggaaggcaattagtaacgcctttttattttttgaatgaccatgatcatgcgaatgtcccatacttatactcctttaagtacaatatctgtatgttagtatgaaacaaactccccatctttatcccgaattgactgattgtaaacgcccgcttcctctgtatacacacttcgctattttttaaacaatccctttttctcaaataaaacaagactacttcttttttattttcatattgtttactaatgaaagaatttttaaggagcgctacttaaatgaaacgtttatttctctgaaaaaaacgtgaact

SEQ ID NO: 1016 - DNA, 1840 bp, Bacillus thuringiensis
ccctccttacattcatgactatttaaaaaacacgcttaccagagatgagctccaaatcgttatttcataatggaagaacatatttttacatgtgtaccaaatgaaggagaacgcgaaatcgctaaacttgctagtcaaatgtacggagaattttattacgctttattattaaacctattccataaaattgttttattaaaaatggcaaacgcctatgctgagctaaacattgaacaagatactaatgaaatagagaaattaatttattcgatcaattcgttcactgctaattatttttctttagaattagtatcccaatcacaaagtgaagatattttctttcgtttaagaaaactttttaatattgaggttctatactcgaacgcgaaacaaaatcttgatagtttgtttaaatatcaagaaaatgtcgcctctaaaaaagatagcctcttattattaattttaacgctctactctgtagtgggccaaatgttagggtttactatgattgaccttttaagaaacaccgattcaaacaaaatatcgtcacctcttgaatttttcgctctattaattgcgattagcggcattgtcatttcacttattttaggagctcaaagtttataccaatggggtttacagcataaacgaagaaaagcttgggtaaaacaaactgtactttctgccgttaaagagaaagaagataaaaattaaagaaggttattttcaaattcttggcgcgctgcagtaagtgaaatctttatcagcgattttccgattatatcggcgcaactcgaaatatatcagcgatttttaagatatatcagcgcaactcaaaatatatcagcgatttttaagatatatcagcgcaactcaaaatatatcagcgatttttttaatatatcgacttaccgacaaaaaccgacaaatgacagaaccgtataataaaaaaagggtgctccaaaattaaacttggagtaccccttttactataagaattcagtttacttccctgcttcgatttgctctaatgcagcagctacttgctcttccgttaattcatgttgtattacgtagcggttacgtggacttacacgacattcattagaacatgcacgtaaatatttcgcttcgttttcttcagaacataaaattttcttattacattctggatttgaacagtttacatagcgctcacaaggttcacctgtaaagtggtctttaccaacgataacatgttctttttggtttactggtacagcgatacgctcatcgaacacgtaacattgtccatcccaaagctcaccttgtacttctgggtcttttccgtacgttacaattccgccgtgaagctgacttacatcttcatagccttcacgaactaaccaaccagaaaacttctcacaacgaattccgcctgtacaataagttaaaatctttttaccttcaagtacttctttgttttcacgaatccaatctggtaattcacggaaggattcgatatcaggtttaatcgcacctttgaagtgacctaaatcaaattcataatcatttcgtgcatcaatgataactgtatcttcttgtttcattgcttcataaaaatcttttggctctaaatacttcccagttatttcgtgcgggttaatgtcatcttctagacgaagtgtaactaactctggacgaggacgcacgtgcattttcttgaatgcatgaccatcagcttcatctattttaaatacgataccgtcaaaacgtggatcattgttcattgcttccatgtatttctctgtttgctctacagttccagaacaagttccgttaataccttcttttgctacaa

SEQ ID NO: 1017 - DNA, 4300 bp, Bacillus thuringiensis
ctcgattataatcaatccaatgataaagtgtatttccaaccttgaagggaccgctcgttttttcaaagaaaactaccggcatgagggaaggaagcatgaccgcaatagtcaaataaatgaccagtagcgatgtcttgactgtgaatgccccacaacttttaacgttcttttttgattcagcaaatagatagcagcttgttaaaataaatggggacaaataagcaggaatcatctgccagcgatacccttctacgataagctgcacaccaaccacacaaaaggcaactgttagaatgaagacagaccattgttttattttctcactaaaaaacaatatacagcctagaatactaaaattcacaatgattataacagtctcaaaaaaatccatttacattcctcctatacccgtattttatcttcaaggacatcccagccaaattgaaaaaacaatttaaaattacaaacttttcgtttccatctctgattaccttaattcgtaccttcagtaccgaaaaattatttttggtactcattttatattataccgaaatctttcagactgtaaagtataattacccttaagtaaaatcgacataaagtgaaactttaatcagccctcaccaatcggacttttatgggcaggtgatctcccacctaaattctttgctttcactgaattatggggtaggaaatcttactgcccattaaagcgggataaaaataaaaaatgagcgatgctacgttaacctgtatggttattgcgaccctactcattttttatgtacaagtactatttaatccttacttgtgattccatgcaatatgatatcggccatcattgcaagtgactcttgtagagtaatttggttagaggctatactcccctgttcaaaaattgatttcattaacgttttgagtgtttggattagcactggaatgtccattgaacgtaaaacaccgctattgatgccctcttcaactagcccagtaattacctcccattcttcatttatgccttgttctatttttgcccactgctctggatggtaacgtcgcagttcaatcagtaaacgtacgaagctgtgctgaaaatccttaggcacaattaaaagaatcccttttaatttttccggtatggtcaaattcgaattatcgataatttcccgaaaacgtatttgggcttcttcatttatttgctcaactacataaccaataagctcgtccttagatggaaaatgctcgtaaagcgtacttttgcttacacctagatcacgagctaaatcactcattgtgaattttattccccttacatgaaaaagcgcaatagcagttttggcaatccgatctttcatcatttattcacctcataccaaaatagtaaagttattatctctccagtactataatagtacttcgagtacaagaatagtttaactttttatttcttgaaggtcaaacgtgatgaagatgatgacatttcacctcatagcctttaaatgaaaatattatgttttttatggaaaccaagtttatttttatcattgcggggacatcaaaactttaacttgatagggatatggcactaccccaattaataaatattattaactatatgtctatcatattttttataaacaggactaattagatttaaaaaaagacttctttttctttactcgtaataaatcacctgtccatcctttgaatcgcatatacatatacatacccgctgttgtgaaaataataaataagagagcgattaaatagctatatttccattctagttcaggcatgtatttaaaattcataccccataatgctcctaaggctgtcaaaggcgtactcacagcagttaatacagtaagagctttcataatttcattcccacgatgagaagaaacaacttcttgcaaatgaatcatcgtgtctaattcttcttggtactctttaacaagttgtaatccacgctctaattttacgtgtgtttgtttataacaaagggtgtttgttagtttttctaaccaagcttcctccaagccttgtaacacttcttgtattaagcgaaacacatgtgtgttcataaataattcatgacgaatatgataaatcctttctaaaactgctatgttattataatgataaaaatcccataacacatttctgaaattgttttcaaaatagtcaacctttcgtaaatagtgagatataaatatcgataagatggcacatagtccttcagcggaactattacaattttttatacctatagggaatttatgtattaattcttgaaaatcttcttcctctttttcttggaccgttatcagtatcccatgagctacgaaataatgaagaaatttttgaattttggcgtcctttttatcttgatcatataaaaacgaaccatatacacaagtttgacttggtgataacgtataaacatataatccattttcacaaggagaacttattttctttacaaattgagggaaataagatgttacatcacgggggattatagaagaaatttcttcaagctcactagttttcacatgataccaactccatttcgtcatttttatgcattccatattattcttcctttctaaatagttttatgtttgatcgaatcatatccgtaatatgaaatttgtatgtaggtatccatatcttggaggaaaagtttttaaatcatctaaattacaaaataaatgcataggaggtcttattctttaaaaaggaagaccccctatatattagttatttttattctcaattttaaacatttcctctatacaagcactttttatcttttcttatttatatttggaaaagaagccacacaatttggcacgtctattcaacgaactccatttcggtcgtcattataatttggatttatatgcagattgattggtgatgtcctcaaatacttgacttccaataatatagtatccatgaagcgcggcctcttttgaagcgtctaccatacggaaagaaacaatttcaccttgcattttttcaatttgttttttgtggagatctactactcctcctgtccaaataatagtatcatactggtctaacttaaattgttcttgtaatacacgcatgatgtcttggaaatgtgtatccaactctttttgaattaaaatatccacctgacttgtctcataattttcttctttatctccatatcctttttctaatatttttggcatgtcattaatatgcaattgattactttcacccgcatgattctgcaggatattcttaatatttttcaaaggcttgctacatcctagttccgtctcataatgatttaaaatgacattctgtttcatatctgtcatttctaatgtacgaaatccaccatcaataattaagatgcgatcttgttcctgaatgattccctcttttaagaaataggcatgtaaagcgatcggttgctgaagaatcaaagcattttcaaccgtaatattaataaatttcccatcaatttgtacggaagtttctttttttagtgcacgttgtaattgctcatgctgactaccaaaacaagtgactggaagcccggtaacaactaaaggtaacacgacattttctttataatcctttgcaatgcaaccaaatatttgttgtttaaactgttcgctttcataataattttctatttcttcgtcaaatggaggaagaaatgaagcgtcagattgatgtgcttcatttcccatgtagtatgcaaagtctaagtctataaaacttacctttgttaaatcttcactttcagcatgattaggtacaggagctagtgtggcagcttcactcttaatcgtcacctcagaatctacatcctgtcgatatgcccgcttagtaaaaccaattcctacatcaattgcatacagagatttcatacttttttcctcactttctctttttagaattaaatctaagcactctcttctttcccttctttcacatatttcttttcattttccgttttttctccgtctaggttcttactattttgttttatttcattatccttttcatcttttttctttttgttattttcgttttctgttaaatctttaatagtagaaatgacaaccggtgtggctgtaagcagttgtggtaatgtttgttttgcaacattagctgcagttacagagaattgtttacttgtctcggttaccttctctaatgtttcctttatgtttccttcttgtagtttgtcttttacgctttttccttttgtttgtatagctttccgattttctttttttaacagagataccat

SEQ ID NO: 1018 - DNA, 2433 bp, Bacillus thuringiensis
tactaataatacaatctattttttctttataaagatcttctactttcaattgataatagcctgtaatacctacaatctctaatttatctcggaactgtgataaaattttatattttaatagttgtgcacttccttgaccagtcgcacaaactaataagcatcttttcttttgattttgctcctgcaaacggctcatcgctccgccgaagtgaattgcaatataaccaatttcactttcagggatcgattcacccgtatattcaccaatgatatctccaacgagaaccgcaatttcaaaagcatacggataattctttttcacttctgccaaaagaggatttctcgtatttagcttatacttcaaacgatttaataacgtttttaaatgaataccaaatccaaataataattcttcatcataataaaaaataagattccgttcttccgctactttaaaaagaatatgttgcataaatgcatatatatctttccctaatagctcttctacattttcatagcgatctctcgttgtaacagcagtacttaataaatgcatcgtcacatataatacttcttcttctggaaatgaaaatttcaactctttctctaaatctcctaaaatctgcttcgcaattgtatattctttctttagtataagttctgattgctccgcatgcattccttttatataatgttgactttgacaacgctttaatgcgattgcaatatgaatgactaaattatcaatttctatatcagataaatatattgttccgccttcaatatactttaatataattgaacgaatgagtgatatatgaggtagcgataaatatgtctccgtctgctcaaattgctcatgaaacggagtatgatcataacgcggtaaaccatattgtgataaacaagaacgaatattaaattcctctccaacaatacgtataccataatacggtctcttctcaatttgtaattcatagcaaccacatatatctgtaacatctttcataattaaattgaccgttgatttgctcacatacatctcttccgctaattctgaaagcttcacatatccctctgtcattaaaacacgctgcagaatgtacgctattctttcttcataagaagttgggatcttttccgtctgtttttgaaatagactcacacaaaagttttcaaatttcttcttttgtataatttctaattcgtacccattccctctttgcgattcgattttcgctccattttcttccaatatatcatttaataattttatatccttttgaatcgtcttcgttgatacatgtaaacggcctgctaaaaaagctcgatttaacatcgatttctcttctaaaaattcctctaaaatagaaattaatcgctgatgcacctttgtcatagctcttcctctcgctctttatatataaagggggaaaagctgctgaaatcagtagtttttcccctttatattctctctatttctttaatgtaaatccgaatttatcccatgcttgtaaatagtctagtaagaaaatctcttcttctacaattcgaccaactacatttgtttttcctgtattcaccatatcttttaatgcaatttgtaattcgcctttatactggccatattgttcattatcaattaataaatctccacgcttaatttcgcgcgtattatgaggtttaaattcttcttttttatatttcacacgactttgtgtagaacgaatcatatattcagatacatctccgcgataaaaatgtggttcgtctaatacgataattctttctagttctgtcgttgtatcatatatttctatatcaaatgtttgtttctctttatttaatgcacctagtgcttgtaattcttcttctgacgcatatgcgtttgcaataataacatcatcaattaattcagtcgcgaataaatgcttcgcctgtgttgtcatcggtaattcacgatgctgctctaatgtacataacccttctgttactggccaaggtccgtatgttgcatcaaatgatgaaataaaagctgccgttctcataccgtaatctttaaattgtttcgagcatttaatgaaatgatcgtatgataatcctgaataacgatgcggataaaaattatgacaaccaattaaattttcacgatttggtctatgactcataatgttatctacatacttcgtaccattgctcatattaatctcaattttcaaaccatacggattataagtcataattgattcttctaatcctgagaaaccaacatctaaacgaataccgtacgcacctaattcatggaagaatgataaatcattatacgaaatacctaattgttcaaaaacagatggactaatatcaactaatacttggaaccctaatgcattcgcatgagagatcgttactttaaattcaactataattttctct

SEQ ID NO: 1019 - DNA, 3758 bp, Bacillus thuringiensis
ccatcaatatcaactggaatttcacgttctttactacttttaataccttccgttacacttccatcaaatcctaacgggttaccgatggcattgctttctcaccagcacggattttacttgagtcgcctaaacttgcaactttattcacattagccccatcaatttctacaacagctaagtctaaccaagggtccttccccactaatttcgcatcaacttgcttttcattgcttagtttaacagcaagtttattcgcaccatctactacatggttgtttgttacaatatatgctttatttcctgcttttttataaataacacctgatcctgtaccagctgtttgctcttgacctgtcggttgcattgcaaatggatctacactttgttgcatattaataacacctacaacaacatctttcgccccttcaatcataccaggtaaatcagtttcatttttcgctttatttacaactggaactacagtaccttctacttttgaatccgaactaaatgatgatactggcgctccattattttgagcccatggcatatatggtgctgcaaaactaatcgaaaccgctccgactacagcccccactaaacctgtgaagaaatagccttttttactacctgattttctcacttctctcgtctcactatgctcttcatttaaatttggtccgtcgtaatatcccatgttttatttcccctctctggtgaattcgtattttcagtatagtcacgttttgtgtccttcttgtgaactcatcgtgaaatctaattaaaaaaatactcctatctaacattgtagacaaaaaaagtattttttgtacattctaccttcaaaagagagtataaaatcgccatttccctaggctaaattacacaaatcgttctagattattcttcaaatttataaccaactcgaataacagtaccgatatgcttcgctttatctcctagcttatttcgaagttttttaatatgggtatcaaccgttctgtcatcaccgtaatagtcatatccccataactggtctaataaatgttgacgtgataacacaattcctttgttctccattaaataaacgagaagttcaaattctttatgtgtcaatataatttcttctccatctactaaaacagttctagatagacgattcacttctattccagctaaagacatagcattttcttccgctactcctaccgcaccatccgcacgtttcaataacgtctttgcacgagctactaatactttcgggctaaatggtttcgttacatactcatctgcacctaattcaaaacctagcaatgtatcatcctcatccgaacgtgctgtcaacataataattggtactgctgattcttttctaattcttctacaaacagaccatccatctatttccggtaacataatatctaacataattaaatcaatttcatgctctgcaaataactctaacgctttttttccatcttctgcttcgattacttcaaaaccttcattacgaaaataatcactaacaatttcacgtaatcttctttcatcttcaacaagcaatactgttttattcatataatctatcccgcctttttactctttcaatcgaataatacgttgattggagcttccgcgaaatggaagtgttaaatcttttttctcaatttcaaaccttccatcgactaaaacatccccataatgtaacaactctatcatatcattattttgagaactctgtatctcttctaacgtataacctgtatacatccataggttttttttcaaatctttcacgatttttgctacctttttcacttcagcagcttgaaaaaatggatctccacctgaaaatgttacatcagttaatggattacttgcaatctctttcacaatttcttctactgtcatttccgttccattgcaaatattccacgatttcggattatggcaaccaacgcaacgatgcggacagcccgcaaaaaacacgactgtccgcaatccttctccatctactacactatcatgaataatattcatcactttcatttatgtttcacccgatctatctcttcactacgtttcgcactattccacttcgacatatctcctacaagatagcctgttatacggcgaattctttctatattagcctcatctttattcccgcaacttggacattcattcccaataaccccgtgataactacagcacttacaacggtcaacaggatgattaattgaaccgtatccaacgccatgttctgccatggcttgtacaatttgttttaatgcctttttgttatgcattgctgctccatctagttcaatataagtaatgtgtcctccattacagagagcgtggaacgggccttctaaacggattttatttatagcttgaatgttataataaactggaatatggaatgaattcgtatagtaattatggttcgttataccattaatttcaccaaattcttctctatcttttttcacaaacttccctgataatccttctgctggagttgcaattactgagaaattcagttgatgttcttctgtcgctttatccattctatctctcataaaggaaataatttcatacccaagtttccatgattctccatcttccccatgatgctttcctgttaaagctactaaacattccgcaagaccgataaaaccaatacttaacgtcccttgttttaaaatcgaggctacggagtcttcaggctgcaacgtttctccaccacgccatacaccttgtgaatataaaaactgaaaatctcttgctcgtttcgtacattgatacgcatatctttctaatagctgcttaattcctaaatctaaataatagtttagcgcttcaaaaaacgcttcttttgaaccactaattaacgctaatttcactaaattaatagacgtaaatgataaattccctctaccaatcgctgtttcttctccatgtatattagacataacacgggtacgacatcccatgtaacatacttcactttccggtcttccatcataatgtactgcattaaacggagcatctaaaaatgaaaagttagggaacaatcgttcagccgttgtctctaatgctaattcaaataaatcgtagttcggatcactttcttcaaaatttacaccttttttcatcttgaaaatttgaatcggaaaaatcggtgtctctcctttaccaagtccagcttgtgtcgcttttaaaagttgtttaattaacattcttccttcttttgatgtatctgttccataattaatagaaataaatggtacttgtcctccgcccctactatgcatactattcgaattatgaacgaaagcctcacacgcttgatacgtatcattttccgtttctttccatgcaaattcctctatttgttctttcgtaagcggatatgattgtaatcgttttttatgtctctcaattgtttttcgtacataaggtgctaaatcaatatcaaagagtgcaaacgattgaccaccatgctgcatattttgattcgcttgaaaaataatagacgaaagagccaatgcacttttaatgtcttgcggttgtctcatatgtccatgtccagtatgaaaaccgttagcaagcatttgcgctaacggaatttgtgaacaagtcgtcgttcctgtcgcataaaaatctaaatcatgtggatataatatattttcatttatcgcttttttcacttgatctgacaataaattctcaacagcataatattttgcact

SEQ ID NO: 1020 - DNA, 3353 bp, Bacillus thuringiensis
tcgggatgttgttccatatttagaggatgtactactcttagctatggaaaaaggcttttattctattaatataaataccgaaaaactgacacatatttttgaccctgaaccacatttaatagaaaatcgtttcaatgatggaaaatgtgatccagctggtcgtttctgggcaggttctacagatacatacggtatgaatactgcaggttccttgtattgtttacatcataatttaagtgtagagaaaaaagtttcacatgtaaatacatcaaatggaattgcttggtcacctgatcatacatacttttactttatagatacacctactaaaaaagtggttcgctatcaatataatatacgtactggagacattcataatccaattgatgtaatcattttctctgaaaatgatggtctacctgatggtatgacaattgacgaagacggctgtttatggattgcacattggggaggttcaaaaataactagatggaatccctctactggagaaaaaatattaagcattccaattccagctttatatgtaacatcatgtacatttggaggacctaatttaacagatttatatatcacaacagccagaacaagaatgactgatgacgaattaaaagagtatccacatgctggtggtatttttcgaattcaaacaaatgttaaaggctgtcccacctattcattttgcaataaaaatattggagctgaaacaatgtgaaccgtatcgattacataagacaagaagaaaagaaatatcacggcctttgctatgaacaatataaactatttgaaattggctcttggctgtacaaaccggttaaaacagttatggacttgatgggtcactttgaaggacaaaacaacttgcaagtacttgatcttggctctggcatcggtagaaatagcattccaattgcacaaaagataagaaatactagcagcactgttacatgtgttgagttacttaattccgctttaacaaagctacaaacttatagcaaagaacatgatgtattcgaggttataaaaacagaacaagcagcaattgaaaactatcatattgactctaacgcttatgattatatcgttgcagtatccagtttagaacatatcaaatcagaagaagattttaaaaacgtacttcattctatgaaaaaagtgacaaaaaacggcggtattaattgtttgattattaactctaacatacaagaaattgatttaaaaacgaatgaagaattagaagctttaattgaaattaatctctcaaccgaagaactgatacgtctattaaaaaacatttataaaggatggaaagaagtaaaagttgaaataaaagaattagcttataatatagttcgtaatgaaagacacattcaattaaaaacaaatgctattacttttgcctttcagaaataatactataaaaggtaaggatattttctcatatattcataggaacacccttaccttttatcttcataatattatttcgttattagttttcgtatcatctaaaatataattttcattcgaaatactaatcagctattaattgaattcattaactggaagaaatattccgcttcatgagtctcattcagtttataccatgaatgaagtgtatccggcgcaaatacatctaattttctcaatacctccatggcaaattctagaggagctacacccgatgcggtaataaagttttcactggatgatacaggtccctctttataaaaattttctcctttataagtaggacaaaccattttcatatactctaaactattgcttgtgtgatttatagaatccaagtaaccgtaatttgcaagacctatagttgcaccgcaaatggcagccacaattgtaccaagttttaaagcctcatcaactttttgcaaaataggtttatgtatttcttcactccaagtattccctccaggtaaaattaatagatcgttactctcaaggatacattcatctagggaaatatccggctgtatattcaagccccccattgaaataaccatttctttatttattccaactgtgactactttaaaaggcgctacatcttttttaaaatatctccctgtattaagttcagcaattaaatgtccgtactcccaatccgacatcgtgtcaaatacatatagataggcttttcttgtttgcattcaataacactccattcatatactacagttttaattacaaaaattgctcttttcattttaacattttattcaatatttatggtttaaaattccaaataaaagagcacttgtttccgcaagtgctctttttggggattttgagatatcctattaaagaaagttaaggttacttaaagttaataggtacttctattatatgcttgtcctttttatttgtgcataatcaatatataaatatctttaataattcttaataacttttaattatagttctctcttacattttatcgttaaaaaattggctttttctcacgagaaattatctttttatattgtacctatctaatactttttctaacatttctaaagttattggttctgcttcttttattaatcgataaccaatacgcccattcggttccgctgtaacttgctgtaaactctttacatcatggatccctttttctcttaattgcatatatagttgttgctccgacatttttgcctgcatcaaattctcttttacaatctctccgttttcaacaattataatgctacttccatttagaaattgttccaccttctttgatttcaattcaaagaaatgaataataagtagtatgcttgcaaatatgatggccgcaaatatagatgggactacttttctacttaatacaggttctacaataatacggccgattgatacaactataatgatttcagctcttgtcatttggctgacagatgcactacctgtcattttcaagacaattattccagtaaaagttaatataatactttcccaaattatattcataataacccaatcctttaatggtgtattttactatcattcccattaaagttgtgttttacttacctattaagttgttaaatccttcagaccatgatggaaataaaggtatccaaccatactctttacgtgccttattattggaagctcctctttcccaactatttttcccatcttgaactttaggcttaggtgcccctatcgctgctgcatatattggtaaccattctttactagttgctggataattatctacaatatttacgattcctgaaggccaattaagggctagcatagtagctcttgcagcatcttcgacatgtataaacgagcttatcccgtctgatgcg

SEQ ID NO: 1021 - DNA, 2249 bp, Bacillus thuringiensis
gaaatttgttcatggagaagaggcgttcctgcaagctgagaaaattccagcagcgttattagcgaacatattacatcgtgaacagctgatgaaactgatcaaggctttaaagcaacgccaacattccagtcttcaaaatagacgaaaaacatcgtagagtggctagtcgatttagggattgaaccatctagacgacaagcacgcgaggacattaataatggtgcgatttctatgaatggtgagaaagtaacagatgtgggtacagatgttactgtagaaaattcatttgatggaagatttattattattcgtaaagggaagaagaactacagtcttgtgaaattaggataataagtaaggctggaaaatatatcggcgatttttcgaatatatcgaccgtaactcaaattatatcggcgattttcgaaatatatcagcgcaaatccgaatatatcagcgattttcccaatatatcgatttaccgacaaaaagcgacaataagaactgttccgaacgggacagctttcattataaaaagtcagtatatttagataaatttaaagggtatataatttttttgacgaataaataagttagagaaaattacggataaaaaatagcccgaaccatgcagggcatgattcgggcttatattcagattagtaagctaagctgaatagacctttaatgtgtgataagtaacgaacgttacttgcttctttcattaatgatgctggtaagcctttaagtggagtattacttgctccaattgtagcaaccgcatctttacgtcctagactagcaagtgttccagagtttacaggtgcgaactcttccaatgctttgccttctagtgctgcgtataagttgtatccaattaactcacccatttgccaagcgatttgtgcagttggtgggtatggacgtccgtctggagcgaagacaacagcgctgtctccagcaacgaatacgtctttgtgagaagtagattgtaggtatgcatcaactgttgcacgtccacggttaacttcaagacctgattcaccgattaatgggttaccttgtacgccgcctgtccaaacgaatgtgttagcaacaagtttttgaccgtcttttaagtcgatttcattgccagcaacgtttgttacaggaagaccagttaagaatgtaacaccgcgtgcttctaggctagtagttgcacgttcgattaagtggtctggtaatactggaaggatttttggacctgcttcaacaagaagaagtttcacttcttttggatttacgccgtggctttttgcaagtttaggcataatgtcagcaagctcaccaactagctcaacgccagttaatccgccaccaccgattacgattgtagcatcagcttcgtttttcgttttcgcgtattcacgaatacggtcttcaacgtgtttgtagattttgtttgcatcagcagccgattttaataccatgctgttttcttctagtcctggaataccgaagtaagcagttttacttcctaaagcaactacaagtgcatcgtaagataaagtagtgccaccagctagtttgatttctttgctatcaactgagaatgactcaactgttgcgattttaagatcgatgtctttccctttgaaaagctttgtaagtggcattgcaactgcttgctcagacacgttaccagctgcaaggcggtgtagttcagtgatgatttggtgtgttgggtattggttaatcactgtaacttgtgcttctgatttgctgtaatatttacgtacgtttaaagcggcaagaagaccgccataaccagcgcctaagatgacaatttgttttgacatagtatgatatcccccgtctttactaattgttgttataagttaaattatttattgttacgttctgcactaatttgaagatatgcgttcacaaagcggaacattttttgtgcttgtggatcttttagtaattttaacaggccgaataggccgataacttcgttgctttcttcagcacgatctttcgcttcgattgcagttgcagccatgcttttcactgtatcttttacaggttctacaagctctgtaattgcaccaacagtgtcgctttttaatacttcatcagtagcaacagtttgagcgaagtcataagacttagttaaaatgttaacaagctcagttaattttggaagctgttctactagtgttgttaatgattcttgtacctcaggttttaacaactgatcaagtaca

SEQ ID NO: 1022 - DNA, 3527 bp, Bacillus thuringiensis
tttacaacgatagacagcattttcatcaccattttcactattaccaatttatgataaaaacaaacaaaaaatgcacgaatctcttcgtgcattaaaataaaacatcttcttcatataaatattcataagataaatctataaataaaaagttgtcatcatcaatcgggaaagaaaatgttcgtaccatttctcccgtttcaatatctgcatataaatctgaaagcctcgccttattctcaaaacgcattttcatgatattctcgagaaaatacgggcgccaactccagttcttcatataataatccggcatcacaatccattctccatcttttttcataacatttcctgattgttggaaaccatcttcattacaaataaatatacgaaaactacactgtgatacactttgactaaattgtaataaccaatcatttatatcttcattctttttttgttttgataaaacatcgccaatgcgatcgcgtaacatctctgttaaattataaattttttgtaacttcttcttttcatgctgaataaactgatgacattcattacctagtcgctctttcaaaacattcgtttcaataaaatcaggtaaacattctttcaaataattaccttgataatatcttccgccgttcttccaagcatattgcagttgataaaaagcatctatttcttcatataacaaagttgcaccaattcttctagcaagtaatgataaagaatataaaatatcttgataagattgtaaaagtgctgtttgccttaagttcgttaaatctacttttaaaatatcaggtgctaacacgctaatacgctctaaattacttgtgcccgttccgactttattaatcgaaatttgaataccatatgtacgataatacataagcaaatgattaaattgctctatatcttctttacattcatgctctgtaatctctaaaacaatttgttttaaatttaaaccttgttcttcatacctcaataaaagttgaagcaagctttcatcatcatcattcattaatacattagcattccgatgtataaataataataatttttgatcgctttctaaataacgatttaaagctttttctactataatattatccgcttccagttgaaattcacttggaatcgaatcatcgtgaaagaaagaagctaaactttgtatgccctcttctgtttgaatacgtcctactacttcgtatccaattacagtatgctcatcagcactaaaaatagcttgataataaggaaggactttatccaagttactcattacatctaatgcatctatcaacgtgcttccctccctttacttttcaaaaattataacatgatatttacggaaaaataataaaaaatcccttcagttttcctgaagggattagaggggtaaaatgctaaggggaattagcaattctactatgaagaaaaaagaggtcttaaatataacgtatatatgacctcttgtaaacacttttctttcatatgtcacaattccgtcacatttaaccataaaaaaatgaatcaaacattcattttttatcccttttaaaatggatattgatgtaaatgttgtcctccatccattgtcatgcaagttccatttatgtacgcagcttcatctgaacataaataataagctagaccagcgatttcttctggcgtacccagccttccaagcggaacactttgtatcgtccgtttagccatttcttctgaaatccataatttatcagcaccgcccgtacgttcaattggtcctggcgcgatagcgttaactcgtattccatatttacgtccccactcaacagcgagcgtcttcgtcatcgctaatactcctgccttcgctgcagccgaatgaataactcctggaccagcatcccatgcatatgttgctaccatgttaatgatattcccttttatacctttttcaatccaatattttccgacagcatggctacagtaaaatgtaccgtttaatacaatattaatgactgaattccagccattcacagataaatcttctgctggacaaataaagtttccagctgcattatttattaaaacatcaattctaccaaacttctcatcaatctgttcaatcattttctgaatgtcatccgtatttcttacatccatttgtacaggtaatacttgccctggaaattgttcaatttccaactttgtttcctctagtttttcctttgtacgtcctgtaataacaactcgtgccccttcttttgcaaaacgagtcgccattccttttcccattccactcgatccacctgttataataactaccttttctttcacatacatcccctccaaaaaatgaatacacattcattttatcactttatttaatagaaatctttatatttttaaacttttctgatattttaacgtaaagaactttctttttattcatttttttcgtaatctatactactttttattatgtaaagtatattttaaataaactgaaaggagatttgagtagcctataaatggaatgaaaacattgaggtatactcatatttttatgaagcacattacaagaagaaattttttaaaaattggtatgcgcacttgtctctattcatttataaccagtagcatcggatactactatgctaaatatatagagccccatttcatttcttttacacagcacacattaaaatcacaactcatcccaaaaagttttcatggtatgaaaattcttcaattcagcgatttacatctcggatactatttctcgcttcaacatttatctaaagttgtttctaaaattaatgctgtaaatccagatattgtcctttttaccggagatctcattgataattatcaaacgtatactgacactcctttcgttgcatccattttaaaaaatatacaagccccctttggtaaattcgctatttatggtaaccatgatcacggtggatatggaactgaatactatgagcacatcatgcgtgaatcaggatttgagctattgctcaatagtgaaaaaagaattcgtctaatggataatagtgaaatttctattttcggtctcgatgatatactattaggcaaaccaaaaatagagaaaacattagagcatgcacggcaaagtacttataacattgttcttgttcacgaaccagatatcgcgccccaagtttctaaatatccaatcaacttgcaactttctggtcatagtcacggcggacaagtacaaattccttttttaggagctattattacaccttcactcgccaaagactatattgaaggcttctatacaattcaggatttaactctctatgtcaatcgaggcctgggaagaacacgtgtcccatttcgctttatgtcaaaacctgaaatcacaattttcacactccaacattcgtaataattcgcctattttcttacatatcctttcttgtacgcgctcatccacgttttgtttaccatatgataaaagtgagtccaataaaggaggtatgttcatgtatccatattat

SEQ ID NO: 1023 - DNA, 2820 bp, Bacillus thuringiensis
aatgattattagtgatccaaataagctatctgagatttccgtattcattatttatattttctatgtaatgacgtttattggtgtcttcattttaagaaaacgtaataagaataaagagcgtgcatatagtgtaccgttattcccaatcgtaccaatcgtagcgattttaggttcgttttttgtaattggtagtgcgattattaacgatccagtaagttgtttcttatcgattggaattgtatttacgggacttccggtgtattggtatttaaataagaagaaagaaacagaatgatgaaaaggtaggcgtattatacgcctaccttttttactgtaaaaaaattgtacttgcttccattttctattttggttactatagtcgtagtaaccaaaatagaaagcgtggggaaagacttgaattttcgtgtttatattttagctatcgcggcttttgtagtcggaacggttgagctaattataggaggaacgctcgatttagttgccaatgatttaggagtatctattagcgcagctggtcagcttataacaatattttcggtagtatttgctttgtcaggtccagttttattagctttgacagggaagtttgaaagaaaaacattgtatgttggagcattatcgattttcttaatcggaaatattatttcggcatttagtgtgaattacggaatgctaatgttctcaagggttatttgtgcggcgagtggttcattaattattgcactatcggtaacacttgcttctagtgttgtagaaccgcattttcgtgcgcgtgcaattggaatcattttcatgggaattagcggatcactcgtacttggagtaccgctcggtcttgtgctcggaaatgcatacggatggcgtgcaccatttgtattaattgcggtattaacagttatggcaattgcttgtatttcattattcttaacgaaagtaccaccgacatcggtattatcaataaaagaacaacttgctactttaaaagataaaaaaattgtaagtgcacagttaacatcatttttgtttttaacagggcatttaacattgtatgcatatttaacaccgtttttaaaagatgtcatgtatgttgaagcaaactggattagtgtgttttactttattttcggaatcgcagcagtaattggtggcggattcggtggctggcttgctgataaatggggatcgaagaaaagtattatttccatcattatcgtatttgcgtgtgcaatcttcatactgccattaatgacattctcattcccactcttcatcattatgatgggactttggagtatgctgagctgggcgatttcaccagcgcaacaaaactatttaattgaaattgcaccagaatcagctggtattcagcaaagtttaaataactctgcccttcacttaggaattgcacttggttcaacagtaggcggagttgttatcgaaaaatcatctgttatatataatgcttgggtaggcggtggctttattgtattagcactgctttgcgcgattttctcgattacgagaggacgctctactcagttcgtgaaagaagaatctatcgtttgataggttctttttttatttgtaaaaaatcgcaggttttagtagaaaggtggagaatttgtatgtagcgaggtgatgtatatgtatacgaatttttcaattattggtcttctaatttcaatgctccctttgtttcttattattcttgcacttagatgggttcgtttcatctataaaaattcagagaaacaagtagagcaaaatgagaaaatcattgagctgttgatggagataaaggaacaaaacgaaaaggagtctaagtgaaaaactagactcctttttattatttaattagtatcttaatttcattaacaaactcttaatttcctcatcttccataaagaggtcatggtgtttctgggtaatctttgcaagtgcaacgtcatgatagaaaaattctgtaaagaactttacgaatggttgtgacattgttttcattgcttgccatgactcttgttctacgccagcaaataaaatttcacgatcgtcaacgatgagtagcaagtagcgctctaatgcattaggttcttcagctgggattagaaaatgcatgttttctaagtctgtttctacttctccaacaataagggattcaatttgaacaccttgttttgctttttgttctagtaaaggaagatattctaaaagagtatcattccaagctgaaatacggattgattcttttgcactttcaatgagttccttactttgaactcgaatagaagattgcatttttaagctccacacacggtcatctgtaaatgatttttttgatatatttgtttccagttctttaatatttgattggaattctgtcgttaatttttcaattgctagctttagtggtaatgctgtatacagttttttcttttctgaaacagaatccattaccattcctttatcgattaggcgtgctagcacttcatatatttttgcttttggaacacctgaatgcttcacaatcgttgtagcatctaatggttcattgcttgatacgacaacttcataagcttggctttcatattgtgagaaaccgaatttttgtaacatagttccctccgaacgaatgagattatattttaaggataatgaactatttgtttttgcacaagtggtagtccgttttctaattgtattaaggtgagaattaatttcaattttttaattttatctattatacttaatataatgattaataagattttaatttaatgcgaaggggatgctggggggaag

SEQ ID NO: 1024 - DNA, 4096 bp, Bacillus thuringiensis
gtctttcgttcgaaatgatattccaaaaaagaagtttcgtatcaatttgcactaagctgttcgtcgcgaaattaaactacttgaatcttctggaattagagtaatccaagtcgatgagcccgcacttcgtgaaggaatgccactaaaagaaaaagattgggatgcttatattacatgggcagtacaatccttccttttagcaacttcttctgtagcaaatgaaacacaaattcatactcatatgtgttacagtaacttcgaagatattgttgacgcgattcgcgcattagatgcagatgtaatttctatcgaaacatcaagaagtcacggagaatttattgatacattaaaacatacaacatatgaaaaaggcattggcctaggtgtatatgatattcatagcccacgtgtaccgagtaaagatgaaatgtataaaatcgtagaacaatctttagaagtatgtgatcctaaatatttctggattaatcccgattgtggtttaaaaacgagaagaacagaagaagttattccagctttagaacatatggtgcaagcagcgaaagatgctcgttcccttttaaaaacaaacgcataacaaaaatgggttatccttttctcaggataacccattttttattctttactttcaaaaaagaattcatattgtattttatataattcatcatccgttggctcttcaagaggaattgcttgtaatacaactgtatactcaccatttggaataggtatttgaaatttattagaaagaatactcgttataacgatactttcattttcaactgtaaaaggaaccgtaatcgttctaactacttcttctttttcaatatgtttccctggggtcactttcacttcacaagtataatcagaaagtgcttcaaaaataacagttccatctgccttagcataacctctttcaaaatcttcatcagtccaatctacataaggctgctcaccgtcatagttcatcaacattaattgcgaataagaaatcgttaactccatagttccccttctccttcattatgaaatatacaactactacttcacttcaaattttactcgcgtaccatctgggtatttatctaacttattccctacccaagagcctgctccacggttatccgccggacttatatattcaatatgtgctccttttccgccttccttgcacatcgccattggccattcatcacgatcataccctttttttgatggatatggtgctaacgacaatttccttctatctgcagcaccaccacgatcgattgtacaaacttctgaatgcccttcttttatagcatccgtaatatgttttcctgtctctggataacgttctttcggaaattctaacacttgatcatacgtattcgttttctttacacttgtttcctctggcacaagtacttcataaactgctactaaaatagacagaattgcgataattgaaatgataataccttttaattgcttcatgtatacctccatgtttctaccagtttcttttcctccgttattataacaaacttctcctgtatatgttttcagacattattttagttattccttgccattccgccaaaaattttcattttttcactaatgctgtagaaaactaatagccttccgacattctttttcaaaggaagtcctcataaaagattgaaatgatatatacgatactttttggggaggaaatatgatggaagctacctataaaacgaaagatgtcacgaataaaacaggcatcccaaaacatatagttcgcaaatatagtcaactgttagaggaacatggttatatgatttccaaaacagctgatgctcgtatttataaacttgatgatttaaaattattgaaatctatacacgaaagagctgctacattacaagaagatatttcagaaacgataccgattattttaaaagaaaaagaggccccacctgtaccagttatacaagataagcaagagatacaaacgaaagaaaaagaagatgggcgtaactttgaggagttcatgttaaaacttgaaatgctagctcaattaaatgaggcaattattcatcaaaattctactctaattacacaaaatcgtttaaaggatgagaaactagacgaattgatgcaacaagtttatgtaaaagaaggctctcaagaaaaaatgcttcaagagttagtcgatcacgccgttcaaacagatgcattgcaaaaagaaaagatggacttattaatgaatcatatgtataaacgagaatccaaacaggaagaaaaaatgaataaacttgttagtcaaatttataacaaagacagtaaccgtgatgcacagcttatgcaagttattcgagaaattcaagaaacaaaaagaatggttgctgcctcaaaagagcaaagcttctttcaatcatttaaaagtttatttagccgagaaaaacaagaaaaaacaaatgaataaacaatataaaataaaaagttaccttccatcggtaacttttattccttattttgtacagctggtaatataataattgcttcagttccttttccactttcactcttatattccaatgtaccattatgcgcttgtaaaatactaaatgttaccataagtcctaatcctgtccctttttcttttaaagaataatatggttgcccaagccttgctaactgttctttcgtcataccaacaccactatctttaactcttattatgattgtttcatctttttgaatagctgttacttttaaatatcctttatttccttgaattgcttcaataccatttttaacaacattcataatagcttgcttcaattttgtcttatcaccaatcgtataaagactttctgaaatttcaacttgtaaatatacaccttgcatcgctgcaaatgacgacataagagtggtcatttctattaattgggctgataaacaaatgtgttcttttttctcaatttgcggccttgctaaatttaagtaatctgaaataatttgttccgcccgatccaattcagctaatacaagacgcatataatccttattcttcacatcttccgtactttctagcaattggataaatccacgaacaacagttagtggatttcgaacttcatgtgccacacttgctgctaactcacttacaatattaagcttttctgatttttgcatctctgtacgtagcaatgcattttcatttaaatattcagttaaatacacctgaaataccattgtcatgaccatgataagcgaggcaaatataaatccgctatatatttgcgaaatatacggtgtaaatcctgtttccaaaagaacattaatcatgcctaatactaaagaaacaagcacataaaatgatgaaatcataaatgctaaaattaatttcttatcccttgaaaaaagagaccatttctttgataaaaatagcggaactatcaatagaaatattacttctaaaactggaagaaagctcattccctttagtaaccattcatatgcaacaaaaataaccgctgggattaaaccaacaatcccaccatataaaaaaccactgacaattggaatggggtgaaagttatacccacacacattgccaaaacaaatagagtatgtcatggagagaacgagcgtaacgctagataaaaacataataaagtaacgatttggcttcggaggcatttcttgatagcgatttaaacgaatcgcttcatataaaaatagtggcaaaattatgatggcaatttgaatcaataaatcacggataagctccataacctctcatcccctatatgtattttgatatgattatatcattttataggtgtatttgttttaaaattttgatttttcttaacatatttgttaattctttgttaacaactcataataattgttacagattttcgaaatgattgtaaaccctgtaccaaatttccttcgtgcagtatacaatgaatacggattacaaagaaaatataaaaatacttttttagacggacaattatagcaaaatacagcatataatccatactatctatgaatacaaataagtgatcattactttagtaggaggaagataaatatg

SEQ ID NO: 1025 - DNA, 3364 bp, Bacillus thuringiensis
  unsure (1)...(3364): unsure at all n locations
cttctaacggaagctcatttgtttttatgtaactaacagcactattactcatgttttaacttttccttaaccgcatcataaaattttcgttcttcatcaacatttaagtaaacacgacttactgttttagaaaagccgtataacaactgcgctttcactggctcttttaatgttatttcaaaagtagcaggttcttttatgaactccataacagttgcatccaatacctgtttcctttcttttgccgttagcaattcacccttgtagaacgcaatattatcaatttgtgtaaatggcataacaattttctttcctaatccgatttgaatgactacttgttcttctgttacgacaaggggatttttgcgcatcgcttgtatttcagctataaaataaatcatcgcgtatacatttaaaataagtaaaatccatgctattactggattccactgatgtagtaaataatgaaaaccaatgctttcaattattgttgcatgaataatcatgatatacacacctatagcaccagtctttttatgatatgagtatacagatttacctgttggtactttttcacgccacgataaaaacgcataatagattaacttacactctgttagaatggcatctactaacttacttcttttcatagtagcgtcaaacgctgcatcaattgcataagaaaaggaataattttctcttctatattctttatatttttttattattttaggaagcactctaacaattttatagagaaggaataattctagacctacaaatgcaatttcagccgcaacaataatataagagatgaatgaaaaagcttgtaaatagtcacttggaataataaatcttgcaaaaatataaccagctattacaacaggaactatatacgttaacgagtatctttttcgaataatgaagaaatacgtgatgattggaatgacaaacatgcaatctaataatgacccaagcacaacttctttcggcgcaactggtacaattggaagggcatacaataaatagtttaatagcataattaaagatacgagtccaatccaaacaccttttcgccttcgtgatagtgtaacctccatacgttcactcctttatttaaaaacctcatttaaatggtctttataaaatgaaatggcacgttcaaattcttttacttcctctactttcacgacagtttcaagtaataatttcatcgctgattcgtgatcgtttacgttatattttgctaatgataaaaatactttcatcggagcgttctctgggaattttttcaccccagcttctaatactgtaattgccttttcatattcccctatacaacgatatgtacttcctaaaccaatataagcaccgcaaagcgattcgccatcaagtccatttgcgattgcctgctcataatacggaactgcttctgtttctagccccattacatcatgtatccacgcacactgatacagtacttctgcatcctttgtaaagtttgttaatcctataagcatctctttagactgcgcatatttcttttcgtttctaagtttaatagcttgctttaataaatgttccatagaatccactcctcaccaattattctgtgtatagctcttgattggtatacgcttcacattcgtgtaaaagtaaaattcccaccaattaaagtttcgcttacttattactatgcggattcattctcatctaaaaacttaattttaaaaagcagtgacacgattacataataactctaggcttttgacaatttctttcgctgtttcatctttcccattacacaacttccctttaccatcctgtccaattacataatgcacagctccgcgcgaatataaagaatgtggtgaattcgcaatcattacattcgcccttgcttctttcattctattttttgctctttcaaacagttcttcttcatttaaatcactttcaagtttaaaaccaacaagtactgtttctgggtcccattcttttatttgttttaatacttttggagccttttgaaagtgaataatcggtgctatatcacttgaaatttttccgttcatattaagaacattaccatcttgatcacaaattttctccacaatccaatctgatccagccgctgccataatgactgcatcaatcttttcatgtgatatgatacttttcattttatcttgtaaatcaacgattccttcaaatggatgtaattctaaccctctatgtacatcactcggtttctccgcaaaataaccgtgtaaatatataacatgtgcccctttagctagaagttcttctgcgattatccttccgattgtacctttggccatattcgtatgcccgcgtacttgatcccatttttctagacaaccaccgctcgtaattaatacctttttccccttcattgtaaccatcccttactaatttttcttacgaaaccattctgttccaaagtcaactatatcacgctgtttcattagacgacacgttgcattccctatcttcccattttttacagttccttttcgctcaaactccacaccaatttctacaaacttctcagattcgtaatccatttcaaaaaactctttccacactctttcaccgttttctataataggtgctcctacttgtattaactcacatgcaccagaacgcacctcggataaatgaacagacgtattggaatcatatccaacaccaattaataatacgtacccgtctaaatcatatatttttcttaatggagattcttctccaaagctcattgataacgaatggttcattgttatttctactgcatgttttccccatgcagcaaaacttcctaacggatgattactacgtactacattcggatatgtacgaaaacattcaactatttcacccattccccttgttggggttatacgtgaatcaaatgctgggacgttatctcggataatttgccaccagtcttccggtacaggtggtcttgaccaatgtttcggatcggacaaatccgaagattgcgttggcattattatcgttccttcttccgtaacaactttcattaatgcttctactacagcaaccgcaccaccagatatccacccgatagaacttagtgatgaatgaacgataattgtcattcctttttcgactcctaatgcttttaaatcttttggtattgtttcgattgtatttggaaattgtgtacttgctactatttcattcattntcatattggttcccccactagctacgtaaatttaaacttttatataaatatattatcatatttttcttaatttttaacttaatcatttttcacaatttataaaaatagtatttttattaccccaaaaatttt

SEQ ID NO: 1026 - DNA, 2323 bp, Bacillus thuringiensis
cgtctcatgtacaagttagctgatttaatggaagaacataaagaagagctcgcacagctcgaaacattagataacggaaagccaatccgtgaaacaatggcagcagacatcccacttgcaattgagcatatgcgctattacgctggctgggctacgaaaatcgttggtcaaacaattcctgtttccggtgattactttaactatacacgccatgaagctgttggtgtcgttggtcaaattattccttggaacttcccgcttcttatggcaatgtggaaaatgggagcagcgcttgctacaggatgtacaatcgttttaaaacctgcagaacaaactccactatctgctctatacttagctgaattaattgaagaagctggattcccgaaaggtgttattaatatcgtacctggattcggtgaatcagctggacaagctctcgttaatcatccactcgttgataaaattgcatttaccggttctactcctgtcggtaaacaaattatgcgacaagcatccgaatcattaaaacgcgttacacttgagttaggcggtaaatcaccaaatatcatcttgccggatgctgatttatctcgcgcgattcctggtgcactttctggtgttatgtttaaccaaggacaagtatgctctgctggatcacgcttatttgttccgaagaaaatgtatgataatgtcatggctgatctcgtcctctattctaaaaaactaaatcaaggtgtcggtcttaaccctgaaacaacaattggtcctctcgtttctgaagaacaacaaaaacgtgtaatgggctacattgaaaaagggattgaagaaggcgctgaagtactttgcggaggaagtaatccattcgatcaaggctacttcgtttctcctacagtattcgctgacgtaaatgatgaaatgacgatcgcaaaagaagaaattttcggtccagttatttctgcaataccatttaacgatattgatgaagtaattgaacgtgcaaataaatcacaattcggcttagcggctggtgtatggacagaaaatgttaaaacagcacactatgttgcaagcaaagtacgtgcaggtacagtgtgggtaaactgttataacgtttttgatgcagcatctccatttggaggatttaaacaatctggtcttggccgtgaaatgggatcttatgcattaaataactatacagaagtaaagagcgtttggcttaacttaaattaatgaaaagaacctgacctatccggtcaggttcttttcattatgtattcctttaaatttgcagtcctccgctcacatttaatacttcacctgtaatataagatgcgtattctgatgctaaaaaggctgctgcgttcgcaatatcttctggcgttccaattctaccaactggaatagcgccaaccatcttttctttcactttatctggtatcgttttggtcatatctgtatccataaaccccggacaaatcgcattacaagtaataccgaaacttccaacttctttcgctgctgttttcgttaatcctacaactccagctttcgttgcagcataatttgcctgtccaatattcccctctctacttatagaagaaatattaataattcttccatatccttgttgtctcatataaagaagcgctggttgcatacaataaaaaactccagttaaattcacttgtaatacttgttcccaagcagatttctccattttatgtaacattgcgtctcttgtaattccagcattattcaccaaaatatgtaatgtaccaaatttttgaaccgcatattcaattaacgactttgcttcattttgattactcacatcacatcgatatgagcacacttcatatccttcatctgataactcacgtgtcgttttttgtagcgtctcttcatttacatcgctaattaatactttcgcccctagctttgcataaacccttgcaatctcttttccaattccctgtgcagctcctgttacaacagctgttttcccatttaaaaactccattcctatcccccatttctattacttatactgtatatttcggctttttactttccaactcctctttgtataaaaagtctatttgtgtcaaactaactttgcaacgtcgcataaagtgaaactttaattagtgggaagtttgttcatcccccactgattatcagccctcaccaatcgggcatttaatctcccacctagcttctttgttccatctgagttttaaggtgggagttttactacccgttatgcgggataaattgcaaggagattgtgtcgaatgaataaaaaaaatttcaaacaaag

SEQ ID NO: 1027 - DNA, 2345 bp, Bacillus thuringiensis
aaatcgctaatgtagttttaaatattacggcagataatgctgaagtaatcgatgtgaacggaaagttaatcgcacctggattagtagatgtacacgtacatcttcgtgaaccaggtggtgaacataaagaaacaattgaaacaggtacactagcagcggcaaaaggtggattcactacaatttgcgcaatgccaaatacacgcccggtaccagaatgcagagaacatatggaagacttgcaaaaacgtattgaagaaaaagctcatgttaacgtactaccatacggagcaattacagtacgtcaagctggttctgaaatgacagatttcgaaacattaaaagaacttggagcatttgctttcacagatgacggcgtaggcgtacaagatgcgagcatgatgttagcggctatgaaacgtgcagcaaaattagatatggcagtagttgcgcactgtgaagagaatacgcttattaataaaggttgtgtacatgaagggaagttttctgagaaacacgcattaaacggtatcccatcagtatgtgaatctgtacatattgcaagggatatactgcttgctgaagcagcagattgccactatcacgtatgtcatgtaagtacgaaaggttcggtacgtgtaatccgtgatgcgaaacgcgctggaattaaagtaacagcagaagtaacaccgcatcacctagtgttatgtgaagatgatatcccatcagctgatcctaactttaaaatgaacccaccgcttcgtggaaaagaagaccatgcagcattaattgaaggtttattagatggaacgatcgatatgattgcaactgaccatgcaccgcatacagcggaagagaaagcacaaggaattgaaagagcaccgtttggaattactggttttgaaacagcattcccgcttctatacacaaaccttgtgaaaaagggagttattacgctagaacagttaattcaattcttaacagaaaagccagctgatacattcggcttagaagcaggtcgcctaaaagaaggtagagcagctgatattacaatcattgatttagaacaagaagaagagattgacccaacaacattcttatcaaaaggaaaaaatacaccattcgcaggttggaaatgccaaggatggccggtaatgacaatcgttggtggtaagatcgcatggcaaaaggagagtgcattagtatgaaaagacaacttatcttagaagatggaacagtattaattggaacaggtttcggaggcgaaatcgaaaagtcaggtgaggttgtatttacaacaggaatgactggatatcaagaaacattatctgatccatcatattgcggtcaaatcgtaacattcacgtacccattaatcggaaactacggcattaaccgtgacgattttgaatccattcacccatctgtaaatggtttaatcgtaaacgaaatttgtgatcatccatcaaacttccgtaatgaaatttcgttaaatgattacttgaaagaaagaaatatcccaggattagcagggattgatacgagaaaattaacgagaaaaattcgtcaatacggtacattacgcggacgcctttgtaatatggatgcagatgtagagtacattgtaagtcaattaaaagcgacagtatttacagatcatgtaaaacgcgtatcaacgaaagatccatacccaagcccaggtcgtggtcaccgagttgtactagtagacttcggtatgaaacatggtattttacgagaattaaataagcgtgactgtgatgtaattgtagttccttacaacacaacagcagaagaaattttacgccttagcccagatggaattatgttaagtaatggacctggagatccgaaagatgtatcagaagcaattgaaatgttaaaagacattatcggtaaagttcctttattcggaatttgcctaggacatcaattgttcgctctagcatcaggtgcaaatacaagtaagttgaaatttggtcaccgtggtttaaaccatccagtaaaaaatcttgcaactggaaaagtagcaattacatctcaaaatcacggatacgcagtagaagaagaatcagttgaaaatacagatcttgaaattacacatgttgctttaaacgatggaacggtagaaggtcttcgtcataagaagttcccagcatttacagtacaataccatccagaagcttcagcgggaccagaagatgcaaatgatttattcgaagattttcttaacaatgattgaaaacttcaagaaagaaggggaagagttatgccaaaacgcctagacattaacacaattttagtaatcggaccaggaccacttgttattg

SEQ ID NO: 1028 - DNA, 4600 bp, Bacillus thuringiensis
aacatgcgataaaatcaacattctcctctaaaagaaactgaatatcttttttatctttctctgtaatagctggtaaacgaacagccgcacctggtaaattaactcctttatgagatgagatattgccacctgtttttaccttcgtttctattttgtccgtacttatcttttcaacaattaattcaacttctccatcattaattaaaattctactgcctactttcacatcattcggtattccttcataatcaacactcgcttctgtattactccctgtaactggttgtgtatgtaaaataaaagaatctcctgcctgaagtgtaatttgctctcccttcacttcacctaatcttattttaggtccttgtacatcacccaaaaatttaatagagtcatctaatgatttcactaaacgaatgatgtctttatgactttcatgcgtgccatgcgataaattcagtcgaataattttcataccattctttattaactgtgctaatgtttctttattattacttgcgggtccaattgtacaaattcgatcgattgtcatttttgtcaccatcctttttttaataagtttcccatatgaacttaaaaataacagagattctgacatgaatagatttaaatttacatgaatttcataaaattaaacctgtatcccttgctggctaagcattagaagatatattcgcttttttgcaaatgaagacatgttgaatcgaaagtaaaagaaaagttaagtatgggataaaccattgagagtttcgaaattttcatatattgtatgaattgagttcgaactcaaaaatttaaaaaggtgggaaaattagtgaatatgaaaaaatctttatcggtgacaactttagggttagcggttttaggttttggttttactaataacgcaagtgcttcagagatcgatactgtagacaagcagcccgttttagttgactttgatacaattcaatcaacaaaaacatctagtgttcctagtttgactattgcagctgcacctaagaatgactctaacattagcgtatatactcccttttttggtaacccatatgcagttgctaaatcgacatcaactacgaccgaagactatgtttatgcaaaagcaagaactttcaatggcgatagctcattagtaaatacgaaaagtaatagtgcaaaaaaatcatcctttgtaagtgctacagcgaccaacacaagcatttattatggagatgattacgctatcggtaatcatacctataaattaagtggttataatgatgtgaatcacgaaacaaaagctttctggtaagaaagagaaaaaagatatgcatcttgcatatcttttttctctaatattttacatatattgaggtgctatttatgaaacaaatatatattattagcggtgttttacttatttcattacttacaatttatattttgttcaatacttcaatcatacaacctcatccaccttccatagaaaataaacgcgagcaacaaaccaatactatttcttacggattgaaggataatcaaggccaacatattaacaatggcagtacaattactagtgaggataataaaattaatgtaacattatcattcgtacatactattaatgaaaaccgaaaatatggattaattgttctagaagattacgaacaaaaaccttttaaaatagaagatactactaatgaaatatcacactatttttttgatatgaaaccaaacagttcaatgactacgaaaatctctttacacacttctcctaatgcaagtgcattaacctttttaataataaaaaaacctgaatacaaattaaaagataataacttaaataaagcagctattttagaagatattctaagtatgcgatattcaatgcatcctcttcagaaagaaaacgaaaaaataaaactcccccttatagatccagatgctattttaaaagatggtctttacgaaccagtatttgttacgaaccgtgaagagaacttacaaactgtcttctttgaaaaggaaggcaagcaattaattttatcaaacggtaatgaaacaaatgatgaaatgacttacgcaatcgtggcttttaaagattggaaacaagttgaaatatttagcaatagaaaagtcgtttatactaaggttgcacctgaaacaagacaaatctttaatttcacattgccttcagtggatcaagaaagtaattttcaactcgtcgcttttccatttccttataaagttagcgaagaagattatgtcagtcaacaagcattcagttcctttcgcatcgtaattgaaaatgaaaataaataagttatactgtgcacattacaacaacctaaaaaaggcctactcacacgagtaggcttttgaaactatgaaagtttcgtcaataactgatttaaatcttttttcgtttcgtcgttaatgatttcattttattaacatcaatcttttccttctccgcccctacaattaacggatacatactttgaccgattgttttagaatccgtcggatgtgatgcttctagctctttttcaatcacatcccacttttcgttaatttgtttgccaagcttattcactgtttccaatttcggattagcagctaactgcttgtccaagctatcaattaatgctacaacttctttaacattcgttttcacagcaacacttttcttcggatctttcgttgcctttccgttattgtttgtgcttgtacttgtgctttgatctgctgttttcccgctagtcgtttgatcattcgtttttcctgtcgtttctttttcttttgtttttacattttcgttttgagttgacgttttgccgttactttctgttcctgatgattctttcgtattttttgcatccttatctgttttttcatttgaagaagtatttgtttctttttcagtatctttcgctgtttttgaagcttcatctgcacttgtcgtttttgcttctccatccttttgcgcagttactcgctctttcttttccgtttctttatctgctgaaggactacaagctgccatagtaagcattgtacccaatgtaatcgatgcgatagcgacctttttcattttcatataaatccccctatgttttacataatttatcctcccctttacgattcgattcccccttaaaaaatcccttttcatacgaattatcatctttccgacagtaatcttcataataatacgtacaaaaactgataaactcattttaatattcgagtttcttctacttcatttttctgctcacaagtaaaagaaaaagagtatattgtcacattaagaattactatcttcatatgacaatatactcttctatcaaatttttatctttcttgacattttatttatacaaaaaaataaaattttctttcgttttttgtttctcaacatttgttaacataatatttttatgaataaccaccattcgagtgaatgacttgcccagtaacccatttcgcttcttcacttactaaaaaagaaattaagcgcgcagcatccaccggttctcctactttaccttgcgggaatttccatactaaatgatgcttcagctcctctgtaatccatcctgtattcgtcggtcctggatctacagcattcactgtaatccccttctccattgcaactggtgctactgactttgtaaatgcttcaattgcccctttcgttgctgcatatgctagttcatctggcattgggcctactgactgtcctgaagtaagattaataatactcccgcccgttttaagtgaataatgttttataaacattgaacttaatagcatagtagcccgaacattaactgtataatgttcatccaactgctctacatctaattcctcaatcctcgtatgattagaatacactgcattattaactagaatagatggatcacctaaccgttctgataccatataaaacaaacgatttggcgaataagactgcgataaattgatttctgccatttcacatcgaacatcgtaactttcaatttcctttttcagcaaaaagggttcttgatcactcattccccatggcatcgctttatcatactttggccagtacgtgaaaaaaatgtctatccccttttgagcaagcaccttgcatacagctgcaccaattccattcagacgagttgcccctgttacaattgctattttcttcacctttttctcctccatctatacacagatcccctgcatgaatacagaggatctatcttcttattgaatatttgacagtatacgttcagcacctaattttaacattttaataaagatataatttacaatcgtaaacattacaaataaaacgataaacataacccacagtccgacatgaaggaagaagtataatacacttactccccccacaataattaaagctattaaaatattagctaaaaaattccacaaagttgtatatcgacttttaaataatttctgctctgtatcccaatgaatatctgcagtttgtgcgtcccagcgtgttccgattaaattaattaataacaacccgttcgcacttagtaaaaaccacagtatcataaagactggagaaatcccagct

SEQ ID NO: 1029 - DNA, 3912 bp, Bacillus thuringiensis
gatgaaaatgttgcaaaagaaaacggtgtagattatttattttatccgagtgtagaagaaatgtatccagcagaacaaacaacaacggtagaagttgtgaagcgcacggacgtattatgcggtcaacaaagacctggtcattttgctggtgttgcaactgtactaatgaaactatttaatattacgctgccaaagcgtgcttatttcggtatgaaagatgctcaacaagttgcagtaattgaagggtttgtaactgatttcaatattccagttacaatcgtaccagttgatattgtaagggaagaagatggtttagcgaaaagttctcgtaacgtgtacctatcacaagatgaacgtgaagaagctcttcatttataccgcagcctatgtatagcgaaagaaagaattgaggcaggtgaacgtaatcccgaaatcattacaaatcttgtgaaagagtatattgagacgcatacgaaaggcactgtagattatgcagatttatatgcatatccgtcattaacaatggtagagaaagtcaaaggaagaatcattttagctattgcagttaagtttgaaaatgtaagattaattgacaatataacattaacagttaaataagggggagcatctatgtttcgcacaatgatgagagcaaagttacatcgtgcaactgtaacggaggcaaatttaaattatgtaggtagtattacaattgatgaagacttaatggatgcagtaaatattgtagaaaacgaaaaagtccaaattgtaaataataataatggtgctcgcttagagacatacgttattaaaggggaacgcggtagtggtgttgtttgtttaaacggtgctgcggcaaggcttgtacaaccaggggacaaagtaattattatttgttatgggctagttacggaagaagagattcataaacaagaaccaaaaattgcagtattagacgataataatcaaattattgaaatgttaggtgctgaaaaagcgggtacgatattataagtagaaaggctatctccattgcggagatagcttttttgtgcatcttttcattaagatgagataaaacgtggtatagtaacattatataaattattgttgtttgaaaggtaagaaattgaggtgttacatatatgagtaagcgttatgtcgttgttgatttagagacgacagggaactcctggaaagatgggaaggataaaatcacccaaattgcagctgttgtagtagaagatggagagatattgaaaattttttcgtcttttgttaacccaaaagagagagatcccaccatttattacagaattaacagggattgatgaaagtcttgtaaaacaagccccgttatttcaagatgtagccccgatgattgttgagctattacaaggtgcggctttcgttgcgcataatgttcactttgattggaattttttaaatgaagaattaaggcaagctggatatacagaaatacattgtccgaaaatcgacacggttgaattggctcaaattcttttgccgacagccgatagttataaattacgtgatttagctaagaagcatgaactagagcacgatcaaccacatcgtgcggatagtgatgctcttgcaacagcggaattatttttacaatttttaaatgaaattgaaaagttaccacttgtcacgttgcaatcgctttatgaattaagtgatgtgttccaaagcgatatagctgatgtgctttctgaaaatattttaaagaaagtaatgcacggtaaagaagatatagcggagtatgaaatacatcgaaatattgcgctgaaaaagcggaactattccttaaaccttggagaaacgtgttcatcaaagtttgatgctttcttgaataaaacgatggataaattggaatcacatatgccaaagtttgaaagaagagaaagtcaacaactgatgatgaaagagatatatacggcgttaagagattctcgtttttcactaattgaagcgggtacaggaacaggaaagactcttgcttatttgcttcctagtctttattttgcaaagagaaaagaagaacctgtcattataagtacacaaacggtacaactccaacaacaaatattagaaaaagaaattccgttattacaaaaaataatgccattttcatttgaggtagctcttctaaaaggaagaaagcattatttatgcttacataaatttgagtatgctttgcaagaggaagaaaaaaattatgatatggcacttacgaaggcgaagattttagtttggctattgcaaactgaaacaggtgatcgagacgaattaaatattcctgagggcggaaagttactttggaatcgtatttgtagcgatgcgtatagtccaggcggtatgcaaagtaattggtttagtcgttgtttttatcagcgagcgaagaataaagctttatttgcagatatcgttattacaaatcatgcgttattatttcaagatttttcaagtgaagaaccgttgtttgcttcatgcgaacatattatttttgatgaagctcaccatattgaagaagctgcgagtagaacattgggtgaacagttctcttgtatgtattttcaattggttatatctcgtcttgggacgctagaaacagaagatgtactctccaaagtatataaaatgatgaaaaaatcagagcaagcatctcgttcaactttccgtatgataagttatagtttgaaggaacttaagtttgatgcggatgaactcttccaaatgttacgtacttttatatttaaacaaacaaagcaagagcaaggaacgaataatatgccgctcatctataggtataacgcagaactagaaaaaggtaagttgtgggatagtatcgtcgaattaacaaatcgttttatatatgaattaagaagggtagtaactgctcttgagaagcaagtggatatattgcaaagtaagttagaatgggagatgcatgttgtaacaggtgaatttatgcatttaattgagttgctgagaaagatggcagaatcattacagttactcgtattagaaaagaattcgcatgtaacttggatggagactgaaacgaaagggacgattcattcaacagttctatacgcacagcctgtccatattggtgaaagatttgctgatgaatttttaacagaaaaaaagagtgttatttttacatccgcaacactaacagttaacgatacgtttgattatataaaagaggaacttggtttacatgatttcgctccaaatactttaaaggttccgtcaccatttcgttatgatgaacagatgaaattaatggtttcaacggatgtaccttttattaagcaagtaagtaatgagcgatatattgaatctgtatcggaacatattgcaaagatagcaaaagccacaaaaggcagaatgctcgttttattcacttcgtatgaaatgttaaaagaagcgtatgcgaatttaaaaaataatgatgaattagagggttatttattactcacccaaagtgtgaataatagaagtcgaagccgcttaattcgaaagtttcaagagttcgacaaatcaattttattagggacgagcagtttctgggaaggaatagatattcctggagatgccttaagttgtcttgttatagtccgtctaccatttacacctcctcatcagccgatgatggaagcgaaaggtgagtggctaaaaaatcaaggtgaagatgtattcgctaaattagcgctcccacaagcaatattacgtttcaaacaaggattcggccgcttaattcgaacgaatacagatacaggaacggtagtagtgttagatcgtcgtttgacgagttcttcctatggaaaacgatttctacaatcgattcctaacgtacctctttatgaaggaccattagaa

SEQ ID NO: 1030 - DNA, 4900 bp, Bacillus thuringiensis
tgaagatattcaaaaacaggaatcacgatcggttgggagtttttagtgaccgcattctttctctacatggcagataaacaaaagaatggtcgtaaaaaaatggatgacataacatataaagacgcattaattatcggttcatttcaagctgctgctatttttccagccatttcccgttctggaatgacaattgtcgctgcattatggagaaaattagaccgtgaaactgctgcgtacttttcttttttactatcgacaccagccatcgttggagctatcattttgcaatttgtagacgtttttcaagggaaagcagaatctatttctagtacatctttaattgtcggaacgttatcagcagcgttttttggatacatagccgtttcatggatgattcaatatttaaaacgtcactccttaaaagtattcgcgtattacgtatggggattaggtattttaattttaatgttgcaatttactgatgtattttaagtataatgataaagaagttaattagtttaagatcctgtttcattcatacaaggcaggatctctttttattaagggggaaaatatgtttaataaggctatcgttattggtggaagtatggcaggaaagtttgcagcaaaagcattatcaacttcttttaaagaagtaatcattatagaagctggtgaaagatgggatggaaaatcttcgagaaaaagagttccacaaagtaatcatcctcacgtgttattaaaaggtggagaaaacgcaattgaagaattgtttcctaatattacgaacgaattaatagaagcgggtagtattataaacaactttacgcgtgatttgaaatggcatcaattcggtctatggaaacaaccgttcataggggaagtacatatgattcaacaaagtcgtcctttgctagaatggcatattcaaaaacgaatacatcaaatttcaaatattactattaaatatgaaacattggttaaagggttattggtagatgcaaagcttaacaaagtgtgtggagtaaaagttaaatatttagagacaaacacacaagaagaagttcatgcggatcttgtagttgatgcgagtggatttggctcaaaaagtatagagtggctacgagaatacgaaattaaagtacaagaagagaaagttcgtattgatttattttacgcaacgaaaatgttcaaacttaaagaaaatgaggagttagactgttgtaatatgctaatgtctcctagtttccctgataacccttatggcgttcttattcaaacgatagaagataatcgttattttgttacttttagtggatacgcaaatgagaaagcaccacaaacagatgatgagttttatgattttgctgaaaatctatcaatttctaatgttacagacttcttaaataaggctgagggaattactgatataaagacatacaaaattccttatcaagtacgccggcgatttgatttagtgaataatgtaccagaaggattattagttgttggagatgcgcaatgtcgttttgatcccgttttcggccaaggcgtatcagttgctgctatggaggctcaccaattgcaattacttttgcaagatagaaaacaacttgataaaacatttacacaacaattttataaaaaggcagctactataatagaaacgccttgggatatgacaacaacagaaatatcacgtcacccgcaactaaagagagaattaactacaaaacaaaaatttcagctatggtatacgaagcaaatatatcgactatccgcaagtaattctgatgtttatattcggttagtacgagtgatgaatttaattcgtagtccatttcatctctttcatccgaaagtgctactatctgtattacttaatcgaaagaaatagcaggaatataattgattaaaaaagaatgtataacagttagtaaatcaagaaggagaatatggaatggaaatatacatagagcaactaaagaaacaagatgctaaggatttatttacgtttgaacttacaaataaatctttttttgaaacaatggtaccaaatcgtggctcaaaatattttgaatttgaatatttccaaaaactactagacgatttattaatagaacaagcggatggagattcttatttttatttaattcgtaatgaagaaaaagaaattgtagggcgaatcaatttagtagatatagatacggaaactcgaattagttcgctcgggtatcgtgtcggagaaaaatttactaaaaaaggagttgcaacagcagccgtaaaattaattttagatgtagcggaaaataatgaaattactgaagttcatgctaaaacaacgactaataatctcgcatcacaaattgtactagaaaaaagcggattttcttcttatcaaaacgaatcagatataacatctgtagaattaaatggagaacatgtgaagtttgtacactatatttggagaaatacttcacacttataataaggaggacttattcatgaatgatttacgttatccaattggccaatttacatacaaacgtcctataactgaagaaatgattgatacatggattcaagaaattgaagatttacctaatgaactaacaaaggcaattaaagatttagatcagaagcagttagatacaccatatcgcgttggaggttggactgtacgtcaagtagttcatcacgtcgttgatagccatatgaatagctacatacgctttaaattagcactgacagaaaagaatccaactattaagccgtataaagaagagaaatgggcagagttacctgattcaaaattaccggtagatgtttcactagtaatgctagattcattacataaaagatgggttaatcttttatattctctagaaattgaagatttagaaaagacatttaaccatcctgaaactggtgaaacaaaacttgctgttgcaataggactatatgcatggcatgggtcgtcaccataccgctcatattacttctttaagaaagcgtctaaattggtaacatggagattatattagaaaaggtgacagaaactgatgcagaagttatatttcaaatgcaaatagattcatttagctctttattacataaatataaagactatgaaacaaatccagcaaatgaaactattgaaaaaactatttttagaataaataatcccagcagtaatttttataaggtgataatagattcgaaacttgttggagcgatatgtatatccgcaaaagaactaccttataaattttggattagtccaatgtttattcatccaatctatcaagggaaaggaattgctcagaaggtacttattttaattgaagaaatgtttccagaagcacgaagttttgaacttgctacgattttagaagaagaaagaaattgttttctatacgagaaaatggggtataaaagaacagaagtaataaagaaattaaatgataaaactacacttgtttattacaaaaaagaaaggtaaagcatttaaaatacgctttacctttttatgttattttagattaaatatacaaaaacaatgtatgttcttccaaaatactcgggttagtaattttgaaaatgaataaagatacaaaaaccactactttgtcgtaaaggttactagcgctttttgaatgcttaaaatactatcgtcacctttaaattctttcgtaattggttcctccatactagacacccaaattttaagttctgcatctaaatcaaaatgcccagccgtttcgatgctatattgtgtaatacttttataaggaatagaatggtattctgtttttttgccagttactccttgtttatctactaatataagacgacgatttgtaaatacgattagatcacgaattaatttataagcatgctctactttttcatcgtctagcataatcttctctaaatcacgttctacattttcagaactcgtatttgatgcatttcctaaaataccgctaaataaacccatattaaattcctcctttaatatatgtggaatgaattacttatattgtaccatgttactcacaaagatattatcacattactttagtagtttctggttattgttgtaattagtttatataacctcatcttaaaatcttatgctaatatgaaattaagaaaaaagaagcagagggatatagaatgaagaatatcggtttagtattagagggcggaggaatgaaaggtttatatactgcaggtgtactcgaatatttcatggaaaagaacttattctttccatatgtagtcggcgtatcagctggagcctgtatgggagcaacctatttgtcgcgtcaacaagggagaaataagaaagtaaatacagagctagtatcagattacaggtatatatcttatcgaaatttaattcgaaaacgtgaattatttggaatggactttttatttgatgaagtacctaataaaattgttccatttgattttcaaactttcttaaactgtaatgaacaatttgttatagggacgactgattgcgaatcaggacaagccgtttattataataaaacagaacatggaaatggatattttaaaaatcatccgtgcatccagctctgagccgtttatagcacctgctgtagaatatgataatcgaaaattactagatggaggaattatagatcctataccagttttaaaagctcgaactgatggttatgaaaagaccgttgtaattatgacaaagccagaaggagacgagtcgcagcgttatcagctttctggtggactcaatatgctaaatccatgatacccgcgaatcgcgaccatgttaggaggccaccatcgtagttacaaccagtcgacatctgatatcacacaaaaagaacacagagataattcttctgta

SEQ ID NO: 1031 - DNA, 3724 bp, Bacillus thuringiensis
agtttttataacttctggaattctctatgcggttgcaccaaggaatatctattggattatggttacctactatggacttgcttatgtaatgggattcgctttccatttactaatcgtcaatcataagcaaaatgaagcgattcgtaaacaaaacgcggtacttgagcaatatatgtctcaaattgaacgcattacattggcagaagaacggaacagactgtcgaatgagcttcatgatacagttggtcacgcttatacttctattattatggggatggaaacgttgcgtaccgaacttgctactgaaatgggtatacagaggctagattctctgcttgaaatgggacgtaaaagcatcgaggacgtgagaggttacctacatcaaatggattctccatgtcaatcgccttccttaattcaatctctacaaaatcttggagccgaatttcaggagcacgctcaggtaaatgtaagttttaggacattcggagaggaatatcaactatctcggcaagcgaagatcacattcattcgttgcttacaggagtcccttacgaatgcagtacgtcatggtcaagggactgaaattatagtttcattgcagtttgaacaacaatatacgaggttagaagttcaagataatggaaaaggaaatgtagaatggcaggaaggcttcggtatgaatgcgatgaaagaacgggcaatgaacttgcaaggtcatttgtctgtatatacaaagccagaagaaggaatgcttgttacatgcaccataccgcgacaaactgaaataaaaaatggacttattcgtttgttaattgtagacgatcagccatttgttcgagaaagtttgaggacactactcgatagatatgaagatttaaatgtagtcggcttggctgaggatggcaatcaagccatcgatttgtgtgggcgccttcaaccccatgttatacttatggatttagatatgcagcacatggatggaatcgaagcaaccaaaaagattaagcaacaatggccacatatccgcgtattgatttttacaacgtttcaagataccgaacaggcagtggaatcacttcgcaacggtgcggatggttttttacttaaatctattgaatcgttggagctagccaatacgatccgacttattcacaaaggtgggacactaattgatcagggaatgtctcacaaaatatttgagaagtttgatgagaaaaaagagactccacaatcaaaagcaaccgcttatgagctaacagctagggaaatagaaatattacagctagtagcaaaaggacttcgttacactaccatagcatcaaggttatatttatcgaatggtacggtcagaaattatgcttccacagcttatacaaagctaggagtcagtaacaaagaagaagctgttcaaaaggctctagaaattggaattattgaataaaaaagtgttttttgtttctttacagcaagatgaaatgtagttacaaaatacatagaggataaacttatgaatttaattggatatcattttttataggtaaatttcttgaaaaatttaaccctgtttaaaaaatttaaatagcgttgctacatattgaatgtagcaacgctattattttctatattagaaattagacatctttattattgctatagggaaggctgtttcaggtcttttcacatgaagattcctctaagccaaatgccccctccctaatacacttgttgcctctgaaaataactatttaaaaatatggttgctaatttcatttcaatcttccttgcacccaagtggcaatattatttataacatactctgggatattagcaggctataatattcattcgattgacttaattctccatctccttctgtaaagaagtgatttcactttcgatacagtcgataattaatgttatctctctcttaattgttctttccaaaaaggattatctatcattctttatgaataacatcattacattgatctttttttcgagagtacaattcctttatataattgaactgtaatcaagtaataaatcgaataaattactacaaaaataacaagtggtaaccaaatacgagagtacggattgattaaaataggactaaacatgttcataccaaataatatatgagtaatcccgacaattgctgggaataaaaatatgaagtataactctttatagattgagtttgttaataattctcggcggacaacaattttacgaaacgtttgataacgtgccacatcttttgatgctcccgacagaactttaaacattaagcaacttgccatcgttgctaaaaatgcaactccaacgaagaaccccataaacattagtccgctagcaaaatcatgactcacaatattgtgacgaaaaaccgggaaaataataataactagttactattattatttatttgtcacttttaaagcatctaacactatcttggttgcttctgcaataagcttatcatcgtgtttagcattcctctttatcatgattagaaagtatcgcaagaacaattggttttttatttggtggccaaataattgcgatatcatttctggttccataagatcccgagccagtcttatcagctacttcccatcctcctggaactccggcacgaattaagttgtctccggtagtattccttttcatccaatctattaataaatcccgtttctcagttgaaagtacatctcctagcgtaaaagcctgaagactagtagctaatgcctttggggtactagtatcacgtacgtctcctggaggcacttcgtttaattctggttcaaaacgttcaggatttgtaacggtgtctcctacttctcttagtgattttttgaattcactaggtccacctaattgtttaagaataagattttgtgcagtattatcactatatcgaagagaagcatctgcaagctctttcagggtcataccactatcaacatacttttctgtaattggattgtaattaacaagatcttcacgggtatacaaaactctttgatttagatcttctattgatttcttttgtaaaagtactcccacagctaaagctttgtgggtagatgcgtatgcaaaccgttcatctgattgataagtaacggtttgattcgtatcagtgtccaatgcataaataccgagtttagcatcaaattctttttcaagtttaacaaaagaatcattaccagtaatttcttgtttgatttgatttgtttgtttcgtttgtttaggtaattcagattgagtattaccatcagaacagcctataagcgttgcacatgaaagaaatactacaggtaccatctttttgtaatgtaaaatgttaaaaaacttgtttaagactatcatacattttcaacctctttcaagaatatatgttttttagatgttatacatatcgatacaattaaagagtgtatcggatatcactctcttgcatctcacttttcataaaatgagtgaactatcatgaacccctgttttatacgtatacttaatagacaacctaaataacaagtttgttccatttttatcagtagtcgtatctagaaatctaaaaaagtccatttagaaaatctaaatggactttttcactcatataatcctatctatagttaaacgaataagattaaataaatttaatttttcttattttatctaataaactgtttaggcatttctttaacgtgcttatcgt

SEQ ID NO: 1032 - DNA, 3451 bp, Bacillus thuringiensis
cataattatcttttgacgtttttcctcgtttaatgaattacaccttgtcatgataagaataatatgtagtaagaaaagtattcgtttcttgatccatctcccctcctatctctttagtaaatagactctaattaggtttacaccctgactttgtacttttcaacatatttttccttcacgaaactttgttatccccttcttaaaaagctataaaacgtcaacaatgtttgtatagacccacacgactttcgtttgatactctatttatagaaagaaattcctttaaagaaaggtgagtgattaaaatggatactctttctcataaagaagctgataaaggcgctattgtcagcattatggcctacatatttttatcctctatgaaaatcatcatcagttatattaccctctctagcgcattacgtgctgacggtttaaataacttaacggatatcggtgcttctttagcgatattaattggtctaaaaatatctcgtaaacctcgtgacccagatcatccgtatgggcattcgcgggccgaacaaatcgcatcacttgttgcgtccttcattatggcaacagtcggattagaagttgttattagtgccattcaatctttcttaaatccgaaacaagcagcgcctaatatactcgctgcatgggttgctttattttctgctgtcgttatgtactgcgtgtatttgtatacgaaaaaaattgcagcacgaacaaaaagtaaatcattagaagccgctgcaaaggataatttatcagatgcactcgtaagtattggtaccgtagtaggtattgtcggttctcagttccaaatgcctattttagaccctattgccgctttaattgtcggtcttattatttgtaaaactgcatgggagattttcgtagaatcttctcatatgcttacagatggaattgatcctgataaaatggaagaatacgctgatgctattgagcatattggcggtgtggaaaacattgtagatattagagcacgtatgtatgggaatcaaacgtacgttgatattacaattgaagtagatgctcgcatggatgttggagaaagtcactgtattaccgacaacatcgaagctatgcttcgcaaaaagtttggaatttaccatgcacacattcatgttgagccaatgaaaaaagaacctattatgacataggttctttttttatgaacgttttatggaatataacacataaaacgagccagctaccaccagctgcccatcctgctaatatgtcagatggatagtgcacgccaagatatattcggctaactgaaatagataatacaacaaagcttgctataagaataattaacaattttttatgcaacgaaatacgttcttcagtaattgtgacgtatgcaataaatcctaaaaaagcagtagcattcatcgtatgaccgctcggaaaactatatccagttgcagtaacaagctgcgtgacatcaggtcttgctcgttcgtaccatagtttaagcatactgtttaaataacgagatccgtagtaattaattgttagaagtaacgcactaagcaacttttttctaacgagaaaatacattacaagaataatgagtaatggaaaatatattcttttggaaccataaaagacacccaagtaaaataggtcgtcaaataatcgtttcgaaagctttgaataaaatgtgcgactatattgtcaaagttctcaatacaagcggtatgatacgaaagtgataatacgacaaaacaaatgagtaacgtaaaacttagcaagtataaatgtcgatatcgtttcacatacataacctcactatgcaaaaaaaatggagcggttgttttagttttcctctccatttcttttttatgcatagtttattaaaaaatataattattaattttttgcttcatctcagggatatcttctcttgttacagtgaagcgaataaccttctcatcaagatcaagtgcctcagcgaataaaccagctaatccacgtgattttctatctacttccataattatttctaatcggtcgtatgcacgtggcaaaattaataattctaattcatctaatctgccgtagtactctccagaaaccggaataaactcaaattcttgtgcgaatggaacttgtttacgtaatcgatgcggtaattcttcacattctatatgacgtgctttaaaccctaattcatttacactatctaaaacactacttaataatgcattaggtaacacttgaacgtagtcgcggtcacttgggtctatactacgtttaatatcaagacctgtatgaatccaaaccgttttcataccaagtgtaagtggtgcttcaattggcattggaaaagaaaatggaatgtcaactgtttcatttggttctacagaaaaaggttcggttaagcgtactcgctctaaatcatatgttgctgttacttttttatcatccacttctcgtacatacgacgtcgataatgttaagtaaatgctttcaatttgttggctaactgaacctccagttatatgaacctttccaactatttcttccccaacaatatactcatctttttcaagaacagtatctacctttgcacttccaataccaacgcttgctaaaaacttttgaaacatggagtctccatcctttctaaagcagaagctacatcttgttttaaatcttgtacattctcatagtacggcgtttttatttgtaacattcgcataagcatttcacgattataattttccaaagttaattcttcgtaccatggtttttcctgtttttcattagattcatatcctgcatataataaaaataatgagaaatgaccgagcgcataaaagtcgctacgaaattgaacttctcgcatcaaagcttgttcaccttcgtaagttgtagctcgctcatcatcctcacctttccatttagctaatccaaaatcaataatactaatttgattttctttcattaatatgtttggaatgcgtaaatctcggtgaataatgccttcactatgaaacaccgatacaatttctaatatttcatataaaatttcaaaaacttcacgttctgtatatacatacccatctatgaaaatataatcttcaaaatttttaccagacatgtactccatcacaaagaagctctttttctcccatatgaaatgatcatatagactaggaattgcatgatgatttaatgtttgtaaaatcattttctcttgttcaaatgattttctaccagactcatatctttgtttactttgtcttaattgttttaagactttatatctatttatctgcaaatcattaacgacatatgtaaccccataactgcccattccaattactgattcaagtgtataatgctctgcaacaattgtatttttcgcagtgggctatcaaataatgctagtacacgacgccatttcatcagc

SEQ ID NO: 1033 - DNA, 3814 bp, Bacillus thuringiensis
  unsure (1)...(3814): unsure at all n locations
aaggaaagaaatatccagatatcgtcgctcattactataaaggcgttgaaataaagacgatgaatgattatgaaggaaaattgatggtgaagaaataggtgtcagaactctggcgtctattttttttatgtaaaatagaataattttccattaattgtttgatataataggataaaaagacatttgggggagacgaaatggcgctactggagttgaaacagttagggaaggcgaaccagttaccggaaattgagctaaaggttgaaaaaggacaatgtattgttttgcaatgcaataatcatacagctaaagtgttacaccgcattattattggtcaagaagaagcttcaactggcaacgtactgtttgaaggggaagcaattggaaagaaaaattattcccgcataggcttttgttttttgaaggatgaagcatatgatcgtttgaaggtgaaggaatactttaagtttttaatagggctttatgaatcaaagataagtataaaagaagttgtgcagtctgttggtctcctagataagctaaacgttaaaatagaaaaactatcattttcagagaagcgtcgtcttcatattggacgaatgatgattcataatccggatttaatcattttggaagaaccggagcaaaatgtagatatagagagtacggttattattcgaaaagcaattatgagaatgaaagaacaaggaaaggcaatttttattacgtcatcttttctatcggatgccctttcgttaacagaggatgtatacatattaaacaacgatggtgtgaaaaaagtagaaattgaacaagaggaagcagaagaagtcgatgaagagaaggtcgttcaaataattccgcaaatgaagttagaaagaatacctgcgaaagtgaacgataaaatcattttacttgatccgatggaaatccatttcattgaaacacaaaacggagtaacacatattcacgttcgtgaaggagatttcgtatgtgcattaacattaagcgaactagaagcaaggttaacaggttttggtttctttagatgtcatcgctcgtaccttgtgaatttacaaagagtgcgagaagtgattacttggactcgtaacagttttagcttaattttagacgacgaaagaaaaagttcaatcccgctttcaaaaggacgaatggatgaattaaaaggtgttattggactataaaagtgctccaataagctcaatatgcgattcattcaccggtaaaaatactccttttaccggtattttaatgcgcctaccctttgtttttcatatgattgagtcaagaaaagcgaaacaaacgaacgaaaagcgctaaagcgactttcatctataaagaagaaaaacaaaggggatgaagaaatgacattggcaattgaaatgaaagatgtaatgaaaagtttcagtggaaaaacggcacttcgaaatgtaaatattgaggtgaagcaaggagagatattcggattccttggaccgagtggatctggtaagacgacaacagtaaaaattttaacttctcaattgcttcatagtgttggaacggtaagagtattagggaaagatattacaggaccaagtagcatcgattacaaacgaattggtattttaacagataacagcggcttatatgaaagacttagcatttatgataacttactattattttgtgacttatacgattgcaaaaaagaacgaatcgatgaagtactagcacaagtgaatttattagatgataaaaaaacaccagtaaaaaaattatcaaagggaatgaagcaacgcgtcacactagcaagagcaatccttcataaaccagatatcctcttcttagacgaaccaacatctgcacttgatccagtaaacgtacaaaacattcataaaatcttaaaagacttaaataaagaaggaacgacgattttcttaacgactcacaacatggacgaagcagaaacgctttgtaaccgcattgccttcctgtgtggcggagagattgtagcacttgatacaccggagaaccttcgcttacaatacgcgaaagatcaaatacaagtcgtgttaaaggataagaagaaagaaacggtacaaaaagatgaattaggtgcaaaacgtatttcagaatggatgaacaaaggagaattactatccattcattcacacgaaccaactttaggcgatatctttattgaagttactgggaggggattataatgacattttcaatgagacgtgtatcagctatttttagaaaagaagtacaagattttaagacaaattcacaagtgttgttaatggcatttttaccaattatactttcatttttgtttagcagatttggagtgggaaaggaaatgttaggcattactactataacggccttcctatttgtcgcagggtttgttcaatctatggtaattgcagaagaaaaagaaaaacatacattgcgtgtattaatgctatcaccggcatcttcggttgaagttctacttggaaaaagtatattaacagtatgtttgacattgggcatttgtattgtgaacttatttattttggatcaattcagtggaaatctattattgctaggatttattttcttatgtggaacaattttatttattgtgattggaacaatgattggattgttagctgcatctgtaccacaaacatcaataattggaatgccgatattaatgacgatgtatttggctgtacagtttgagccaatggttgaaaataaagtaattaagacgatgattggatatcttccaacatctcatattgtgaaagcacttaacagtttagtaggtggggcgggatttggtagtattagtgggcatgtattaaatgttgcagtttggcttattatatcgctctttgtatgtttaatcgtatataaaaagaaacaattagattaaaaactgagccaaaagtgctcagttttttcttttttctatcatttcctcggaaattttacaattcttatacatatttttacagattttgtcgaaaagtaattagttatacgttgcataggatacgtgaatattgttcaaaatgattgctgaggtgatgatggaatgcgaggaagaaataataaaaagtcgcaaaaggtagtacatttatttcaaaaaagatgggtgtttccggcactatacattgcttgtgcagcggtaatcttaatggttgcgctatggttccaaggagctaatccgaagaagactccaaaccacgatcaagcaacaccgtatacacaatcggaagatccagcagtaccagtaacaaaatcttcagaagtagtgaaaatgccagctgccgcgaatgcggaagtagtcgtacagaagaaattctatgaagatgcagcaactgaggcggaacaagaaaaagcacttgtcttttataacaacacatattccccgaataaaggaattgacattgctgcgaagaatggaaaagaattcaatgttgctgctgctttaagtggtacagtaacgaaagctgaaaaagattcacttcttggttatgttgtaacagttgatagtggaaatggtgtagcggtatcttatcaaagcttaggcagtgtgaaagtagaaaaaggtgcaagagttgcacaaggtgaagtattaggaacatccggtctaagtgcaatgaataaagaggcagggttctcacggttcactnttgaaggtacgtaaagacaantgtggcttgtgaacccctgaacgnttacttaaataaatcagntaacagaaatctacacgctgatgcaggtgctgcaaaggcnntacgaaataattctg

SEQ ID NO: 1034 - DNA, 3554 bp, Bacillus thuringiensis
aacgttcttaaaaatgctatacctcgttgtacaaattccgttcctttaattcgattcacatattcatctaacgcacttgctacattataatcccttttctttataccattttctaacttagatagtgctactttaaacccttcttcatttccaccaagttcaatttcagcatcccataaaaccattcctgcattcatgaggaaatcttgactcttttcaatttgcttctcaagaccaagaatatattcttttgcttccttatattgttctcttgccatataaacttgtgtaagtccgaagtgagaataaacatcctcatcattttcttctaaagcacgcttatacaatacttctgcttcttccaagctatcattttgaaaatgataatcacctaattttacgtaaagaggtgctttatcatcacaattctcaataccgtttaataaaatttctttcgcactttcctcatccttcaaatcagattcgtatatttccgaaagtttcgtataaatgtaaggtgcattactatccaaatgaatcgctactttaagcccttttattgctaaatataatttccctagttgatgtgcacatctcgctcgttcataccatacatgcgcttcatatttgtactcttttaacaagtcattaaagattacatatgcttcttcatatctttctaaatctattaatattaaaccgtgatttgttaaagtgaacctttcaggactacgctctaacgcaacttgagagtattgcaatgctttttcagattgatcaatatacatataggataaagctagaaaactccaagcaataggctgatctgcgtctaattgtaacgataaacgaaagcttgaaatcgcttctagataactttcctgttcaaacgcatatcttccgtttattaaatgatataaagcacgattatttttcttctcaacgcttgtcagcatttgctccgctttctctacttcctgaagacgaataaaacactgtgcaccatgcaatttaacaaagtccgagttcggaaacttttccattaacttatcgatacaatataaaataaattctttatctacttcaacatctaagtgctttatcgtatataaccacgtatttggattatcactcgtttcttttaaaaattgtactaggttactaattccctctttgtcatgttcatctaaatgatcagtaagagaaaaaatagatttaaaataacgattttcttcttcacttagaaactctagttgctccttcttttctttcggaacaaacgtgattgctaaacagcctgtataacgatatttttcttgtactttactatattccacaagaactggctctataaagtttggatcttgaacatagaaagcttgcaatgtatcatcatatccagatagaacttgtacgtgtgaagcatgctcaatatctatacttaataaaacaggaattccttcgtcaatcagtctcttataattctcttcattccctttaaaataacgatattcataacctaattcttctaaataagaaacagtatctgaaaacttcgaacctgtcatatcaaaaataaactctgctatttcatcttgtgtacgtttctctccccatatacgcaacgtcatctctaaacttgtcggaacacaataattatccttttgtacaataggaactatcggcaagtgaaccttttttccatccggatttttttctaaattatgatataaagattcttttaaactcttttcttcttttaatagtttttgtaaatctgcaaatttattcattttgtacagcgcttctgcacgtaaatgtacaaagtaagtattataggcatgatatggcagctgagtatttatattatctattaccgctaacatctcttcatattgctctaaatctaataaatactttatcttctcaaaatgaaaatatggtacttgtgggaattttacaatcgcatcattgattaactgtatcgcgcgtttttgttctcctttattcgcatacaattgtgataataaataggtagataactcttcacaatcttcatgctgcatgccagcaataaattgttcttccgctttctcccattcacctgtatgcatataaacgtagccccatttatcaaacactgcgcgcgcactgtactcctctgctttttgcatatacattaacgcttcttcgtttcgtttcatttctaaaagacatcgtactaacgtaaaatatgttttcgctaaaaaatctgcatctatttcttctttacttaactcttctaaagaagattttaacaactgctccgcttcaagaattttccgctcatcaattaactcatcacaatataaagagagcgttctcatatttgggaattttttataagcgtaacgaatgaggaatgaactgtattggtgcataagcccttcatcagtaaggcgaatcaatatatcgaactccttatgcgaaggaatattggcaagccaattcttcacataggataaagtattcgtttcttttatatatgcaatttcattatttatttcctgtaatccatctacaaatctcttgtcttttaaacaagtttctaactgcttaaaatctagcatgcattcacctcgaatttatatttaaactgctacttgcttagattttacacaccatatagtatgtattcaactaaaatctcttataatagatgttattaattaatattattcaaatttataacaaaatatagtaaaaatgattgtttttctccgtattttgtttaattatatggaataacgtaacatgcggttttaatcttgtagaagctgaaattagtacataaaattatatcggcgattttcaaattatatcgaccgattcttaacatatatcagcgattatatgtcgaatatcgacttatcgacattaaacgacaagccttatacatcataccttttaacaaactatgtcaccaaatgtaattttcatattgggagcgtatacaaaagaagaatacacatgaaatattttaaaaaatcgtagttcagcttcatattgagctagcgcattatcatatgttaatcctctggctattaaacgttctacaaattgttgcttatcacccggatcacctgcaatcccctcttcttttaatgattgatacaaatcgtttttatcattgtgatgcatatttgaatctaaaaagttcactttatcgcttactctacattcaatatttttcacacctaattcacttaaatatatcggtattttcatgcctatattgccatctttaccatttctttgcgtatcactttcaaataatttctgcaaaacacctagctgaataaattccgattgtttctccccatctagtaaataagaagccatattagaaatccaatgtggttcaaaacagattatttttccgcctccttttatatacaaaactaaagttctctatataatagccgtattcctacacttttcttaaaatttcaaagcaaaaaagctagtgtatttttaataatacactagctttttatttggaagaaaaaattaac

SEQ ID NO: 1035 - DNA, 3614 bp, Bacillus thuringiensis
ctctgtatgagaaaaaggacggagcctaaaaagacccgtttctttttctactcattaactaacttactctctggggaaaatttaaatagtaatgctcatttatagacgtctgattatgcattaaacatgcttgctttgcttactgtcgaaaaaattaaagcgaatagtcaaatatgtcctttcattactttatattgaaatacataatgattcaaagatattttgtgaaaattactcaaaaaatcccaattcgtcgtttgcctaacaatagataatatagataaagagaatatactaaaggatatcacagtgtagtagtctctagtatcttttcatagtattttagcggctatgcaatacggagggataaaaaaaggacctcttacggaaagataagaggtcatcaaaaagataaaaatgttgtatttgaaacacgcgagtttctaattcacatcataacacaatatatttatatattcaatatatacattaaagataagtaatgtatgttcaaaaaacacatggaatattaatttgtaacagtatatattttcctcttttattctatttcttctacaatgccgtgattgtaacaaatatccctctttcttttttggatgattacgaataaaaatactacatgttttctgtctcacttggaataaagcatcatggtaaaaatacaatgctgacaagtaaaatacttaatacaatcaaccctatccctaacatcatccattcaccctttttagaattttaaaatttagcccttcactttcatatacttctcttttacatgagccaataagtccctcagcttattctctgaagggtgttcttgattttctggaacttctctgccataggatgaaaagttttgtgagcatgcactagttgttactttcaatttcgcgtatgaggatgtacgctcatcataactggattacgtcttcttggggataaaggggacaggaaagttgctaagctagcgtaaggtgctaaattccctcaaattatctcaaaatttggatactcatttaatatttctatactctccaacttataacaaaacacatcgcaaaatatttttacgatgtgttttaaaagggaaatcatcatcaagtttttcacccatatttttataaggagttttaccattgaggataaacgccttcatttcaaaacagttcttttcatttgtatacgatatgtctcacacatatagtatacaaattattacacttacttttcttcaccgcttgcttgcatggaattaaaagtccaatttaatttcaacgcatctccttgtacagcttttgcttgtaatttctcaccatctacttttgttaagcggaacgatggaatagatgcagtactttccccaagataacttgtaatttcaccatctacattgttatatacgattactgcctttgcgcctgcttccttagcatgcttaatatttattgaagaaaaggtgatgcatacaataatcaaatctaattaacatattatttaattatcggtagcgagattaaagagactccctactctcaggaagggacctccaattcatattattccccctatttctatgtttcttatttgattctaattaactaactgattagggttattgcaaatcaaaataataaaaccacatctccaattattagataactatctaatacattggaggtgcggttcacttaggtcattgatgtttcagctattctctttatttgaaaattacatctaccatattaatttaatattatattcctcaagccaactattaacttgaagtaaataatctattatacctcgtgcatcattacctgaaattacttcgtcttttccttctgcaatagcacgaactctttctacattaattaatggcaaaataggtgattcaggattgttcaacacatgtaacatccaatcactaataccttgtagataagaggcatccttagtgcttggatatgcactttttttgcgataacgtacatcctctggaagtacattttcaaaagctctacgtaaaatacctttttcaatattgtctatgcttttcatttcgaatgggacattccataggtattctacaagtcgataatcgcaaaatggaactcgtacttcaaagccattcatcatacttgtgcgatcttttcgttctagcataaatggcaagaaacgtgtaataaacatgtaagacatttgacgttgcttcatttgcagatcactttcaccttctaaaaagggaacctcagcaactgcatcttcaaatttttgtttttgatatttttcagggctaatcttcgctttaaaatcctctgataaaatttctgtactataccataaattaacactccaagggaatatctctgcatctagaaacttctcttgatggaaccatggatatcctgagaatacttcatctgcggattcgcctgaaagtgcaactgttgcatcttttttcatttccttaaataacaaataaagagacgtttctaattctccaactccaggtagatcacgcgctcgcattggagttaataaatgctctattaaactatctgatcctaactctatagaatgatgctttgttcctacatattcagccacacgtttcacccaaggttcatcacgatcaaaacgaaggaagtcttgctcaaaatctttttcatcattgatgaaattcagggaatatgtatgaagacgttcccccttattcccaaattcgtttcctgctaaacctgttaaaccactggaatctaaacctccagaaagcatagataccactggtttatcagcaattaactgacgttttaccgtatcttgtaaaatggaacggattgtctcaactgttgtatcaatatcatctacatgttctttactttcaagtttccaatactgtgtcgtagtcgagccattagaggtaaacgtcatgtaatgcccagcacgcacttcatgtatatccttgaaaatagcatgaccaggagtacgtgttggcccaagacaaaatatttcagaaagtccttctttatctacctctgcatctacaaatggatgcgaaagtaaaacttttaactctgaaccaaagagaattgcgcttcccctttgagcaaaaaataaaggcttcacacctagatgatcacgaccaagcatcaatttcccaaatctttcatcccaaataccaaaagcaaaaatcccatttagatgttgaacacaatcttcttgccattctaagtaagcatgtagtaatacctctgtatccgacttggtctgaaatttatgacctttctcctcaagttctttacgtaattcttgatagttataaatttctccattgaacgtaaggccaatcatatcatttccatctttatagagcataggttgaaggccaccttcaggatcaatgacgatgagacgtcgatgacctaatgccgctcgttttgaaaaccaatgcccctctgcgtcaggtcctcggtgaatgatagcatctgtcattttttttaacgtttcttgttcattagacaggtctttagaccagtctatccaccctacaattccacacatagtgtctaccttctctcagatagtaagaaaca

SEQ ID NO: 1036 - DNA, 1774 bp, Bacillus thuringiensis
gatctttaacttatctgggccgataacacgtacaccttcgttttccttaataattttaacacccatttcttccatttttgctgtaattgagcgtaaatgttcaggtacagcattttcaattaagatgtctccaccagtaattgctgctgcaaccatgaatgttcccgcttcaatacggtcaggaataatagaatggtttgcaccatataatttatcaacgccttcgatacgaatcgttccagttccagctccgcgtactttcgctcccatcgcatttaagaagttagctaagtcaacgatttctggttctttcgctgcgttttcaagaattgttgtcccttttgctaatgtagctgcagacataatgttttctgtcgcgcctacgcttgggaagtctaagtagattttagctccttttagttctccctcaacatatgcctcaacaaaaccgttaccaacctgtactttcgctcccattgcttcgaagccttttaaatgttgatcaattggacgtgaaccaattgcacatccaccaggaagtgcaatacgagcacgaccgttacgtgctaataatggtcccattacttgaacagatgcacgcattttacgtacatattcaaatggtgcttcaatgtttagttctttagaagaatcgattgttacttgattattttcaaatacgacttcagcatttaaatgacgtaatacctcattaattgtgtatacatcagacaaaactggtacttcagatagtacattctttccatcactcgctaatagggctgcagcgattataggtaatacagcattttttgcgccctcaacacgcactgtgccgtttaaccgctttccgccacggacgatgatcttttccaaattattcccctccgtgtccttttttcagtatctattcactcaatactcagaagttatgatcggtgtgccaaccacaattgtatctttgttgtctgtagaacgtattgctatttgcacatttattttctctctatttgttgaaagagcgtcatcccactttttattgtatgcggagactgacacaaatgctctttcttctacttgttcgatcgctcttgctgaaagatctttcaaaacctgattggttttattttgcaaaacaccttcaatcttatcattcagtacaccttgaacacaagtgtaaattataggtttttcactaaaaattttattcatgttttgaacatacttcgggtcccatttcgccccacttacttcaaagataatgaaagtgttttctttagtattttctttactccaagttactactactcgttcttcataagaagaaagctttttataggatgtagctttatatccatctggagattgctctacttcccacttttgaatatttgccttttccttcacatcgtttaacaacttttgaaacgtatgtatgttagaaattgtttttgtttctctcgctaaccatgaccatttttctactttagcatcatttttctctaaagccttgatcatgctctccattttctgttcatcgcttatcggtttcatctctctatatccaaccaaaaataaaacaacactaagtgcaacaataagaatggctttaagcttcaatttcatcccctcctatccccattgttaacggagatttgaggttctatacacttactttactaaatacgttaaactcttcgaatagcctaaataatcaaggaaaaagttacttacagatgtcccaattgcaattgtaattaagatgagtaatact

SEQ ID NO: 1037 - DNA, 3379 bp, Bacillus thuringiensis
catttagaaaagtagaagcgatatcgtttgctttcatgccacctattattccggctgtaattgctatgaaaataaaagtagcggtcatttctgcgtccgtccaatgtagacgaaaagcgcctattaaaaatgcaattaatgataaagctgaaacgagtaaaattaatttatgacgtatcgtccaaggaacttcttttttctctgcttccttttcgcttgaaagagcgttacttggaaaccagttgtcgccaagaatgcttcctttattcaattttttcaagcgctttacataccaattaatataaaggatagtggcaagtaaaaaagatatatagatagctgtgcgtaaaccaattcccgaaaacatcggaagttctgcgatcttttgtgaaatgcctaaaggtgagggggataaaatagtagcgttaaaaccagcataagtgcctaaataaataattgctacaccgacgatagcgtcccattttaatgtgcgtgcaacgatgataccgatggggataaaaccgataactgaattaacgataatgccagtcgttccgagaatagaaaaaagtgcggcaacgatacaaatgaaaagtaattgctgattacgaaatttgtttataacatgatagattaaaccgtcaagagcacctgttttttcaagaatggcaatggcaccgcctgtaaataaaattaaaaagatgatcggagcagcaagtgtcattcctttttcaatagcggtaaaaaaagaaacaaatcctacaggtgattgcggaacagaatgatagctacctggtattgtcgttgtaacggtcccgtttgtaactcttttaaattctccagcaggaacgaaatacgtagcaatagcgcaaagtaaggcaataaaaaatagtagtacgtacgcatcaggcattttaaacttttgtttactaggttgtttttttgcctcagtttgtatttgcataaaattcctccttcttcactttattaattttaatattctgaattcaatccgtgaaatagattataataaaggtagcttcttaaggcaatagtttttgtatccttttcccgtacatacaaattattgcaatattagacagggaaacgataataagccaagaatatgttatgtagaaagaaaaaggaaaagagggaacaagatgtggaaaactacagatctatgtgatgagtttgaaaaggaattacaaatatgtcgccagtcttttcggtcttttgggaagaaagaacaattccacgggaaaattgcaactgtaaaagtgaaagatgataatgtactagtgaaggaaggattgcaaacattaccagaaggaacagtattagttgttgatggcggagcgtctactaattgtgcgttacttggtgataatttggcagctattgcggaagaaagaaagctagcaggaattattgtgaatgggtatgttcgtgattctagtgaactaaagaatattaatattggtattttagcgttaggaacgatgccaaatagaagtgtgaaagaaggaaaaggagaacgaaatatttcattgcactttggacaagtggattggaatccaaatgaatatgtctatgcggatgaagatggcgtcattattagtgaaaagagtttacatagttaagagttaataagttattattcttagaaaataaatccgataaagcatggacaaaattctttgtcaatagtaaaataatacagaaatttaaaatttacagaatgtataggtttatcgttttacgataacttaaatggaagtaagttgtgccaagaaaagtgaatgttatcacaatgatacgttcataaacaaaattatttttcctatacaaatatagccgcgaataatgcgggtaggaggtgttgtacatttttgttcgacacttacaaaaagagagtgtcaatcgcacgcccttgaagggcctttttttgtgtaaatggtagtaagggaggaaattttgggatggcaatgttgaaaaagtggctgcttacgtcgttaatggcagtgacacttgtatttgtttcttttgcgaatacagtacatattacgtttgctgaagaaaatacagcaaaacttgcaattattggggaatcacaaaaaggcattatgttatgtccgaaagaagagcaaattaaagatggggaaacagctttaatttgctgcaaaaggtcatgggggacaaggtagaatctgaaacgatgtcgtttggaacatatgtaaaaggcatcgatggtttaatggccggggctacaagtgcttggctgtatgatgtaaatgataagtctgcagaagtcggagcagatagttataaattaaaatctggagatgttgttgtctttcgctttgtttcagactggagcaatataagccaggaaacattgaaagaaacgttagataagttcgggacgtgtaaaacagaagaacctaacggtggcaaaacagaagaaccaaaatcaaaaggtcaagacggtaaaacgccagatgagaaaaaccaaggtgaccaagacggtaaaacgccagatgagaaaaaccaaggtgatcaagatggtaaaacgctagatgggaaaaaccaaggtgaccaagacgataaaacgctagatgggaaaaaccaaggtgaccaagacgataaaacgctagatgggaaaaaccaaggtgaccaagacgataaaacgctagatgggaaaaatcaaggtgaccaagatggtaaaaaaccagaacaaccacagcaagagaacattcaagttccaagtgcacaattaaacgaagccatttctaaaacatcagataagatgttacaagatggaattgaaagtgactgggtagctgtagcgctttctcgttctggaaagaatgtgccaattgaggcaaaattaaattatgttaagtcagtaactgaaaaagtagaaaagcgtattaaccgtttttcagcgacagatttagctagaacaattattatgatgaatgcaatgagtgcagaccctaaaaatgtaggtggacataatttagttcaaaaattgtatgagtcagataaagtgaattctgttacaggttatgcatttgctttacttgcatttgatacgaagaagtatgagattccagttgaatcaaaatggaacagagttgctctagtggaagcactgttaaataatcagcatacagacggtggatggacttataatagtttatgtagtatagatcgtgcttgttccgtctatgtaaccggtttggttttatcagcattagctccttatcaagagcgatcagattgtgaaaccagctttacaaaaagctgttgcgttttatttatacaaacaactggaaaatgggggtttttcagctgatggacaaaatattcaaat

SEQ ID NO: 1038 - DNA, 3748 bp, Bacillus thuringiensis
tcatatttttgaagaactgattcatcaaagttttgtgttcctgttttacctgctacgtcaacacctgaaacgtatgctgttggacctgtaccaccagaaccaggttttactacgtcacgaagaacgtcagtaaccatataagctgtatagtcttgcattgcgcgatgttctttcggtttaaagcttttctttttcccgtccgggaaggttacttcttttacgaagtgtggtttattatagttaccactattaccaaaggttgcatatgcacctgctacttctaatggagaactatcgttactaccgattgctgttgattcgtagacttttccttctttaaaggtcatgcctaaaccttcagcaaattcttttgacttattaagaccaactgtttgtgctgtctttaaagctggaatgtttaatgattttttcaaagcttcacgtagtgaaacgtcacctttgtaactctttgttgcattttgtattttcttaccattggaatacgtatactctgagtcgtttaattgatggtatgtagaccattgtaaattttcaattgccggaccgtagtcgaaaattggtttcattgttgaaccaacttggcgttttaaatcagttgccatattatgacctttgaaagtagacttactttctttacgtccagcaccaattgctcgaacttctccagactgtgtatccataaatacgaatgacccttggaattgatcgtccggatacttaataagattgccatccataattttgtcggcgtaatcttgagcatcttgatcaagtgttgtatgaatcgttaaaccatctgaaccgatatttacatcaggatattctttttcaacttcttttacaactgcatctaaaaatgcttgatacttcatctcagttacttctgaagacggttgaaggccctcagttactggaatcttaacggcgttattcatttcttcttttgttatataaccatgtcgattcattaatgataatacgacattacgacgatttgttgctcgttcaacattttccttttttgttggatcataaatgtttggaccttggggtaaaccagcgagcatagcagcttcatgtaattgcaagtcttttaaatctttaccataatatttttgcgctgctgtcgcaataccgtatgaacggttacctaaattaatcttatttaagtacatttctaaaatctcatgtttagagtattgttgctctaatttgtaagataagtaccattcttgcacttttcttttagcagttttgtccatcgttagaaagtagtttttaacgacttgctgtgtaatcgtactaccaccttgggaaccgaaaccaccagtgacattttccataactgcttttgtagttcgtttaaaatcaattccattatgatcatagaaacgcgaatcctcagttgcaagaaatgcattttcaactacttttggaatttgatcataagtaacatgtgttcgtttttcagcaccgtattcatagaagaaatttccgtttttatcgagaaactttgttgataaaggattaacaagtttggatttgtctaattttggagcgtcctttaccataacaaagaaagcggaaacgccggctacaagaccaacgataccaagaagtagacaacctataaggaatttcttgaaaaaggagccttttttctttggtttttcttctttatgtgtttttttctcttgatttttcacatgatttcgttctgtacgagaacgataattatctgacattatactttctcctacctttcattctctcccccaaaagtcgaaaaaagagccttagtgatgactctatcacgaaaaataaaccatgtctagtacacggatatagtcaatccgagggtgataaccgcatgataataaggatccatgctcttctatttcttctttcgtaatcgacttgcgtccaccagtattttgacgattccaaaatgcaataatatgttttgcatctagtaaataaaattcatcaaaaagtgtaaatttaataataacaaatgcaattccattatgagcaacgacttgcttcatatgttcaatttgatgaaggtggaagttttgaagtgggaaactagttttatttttggtttcctttgcttcaaaatcgatgtatttccctttgtatacaccgttgtaatctgttgtagaaggttgtttaaaatacgcttcttttaccactgcagcacttcgagcggggtaatctacttttacaatttgaagaggtgtaggctttttatgtacacatgcaatattatgggttaagtaatattgatttgtttcattcaattcctcttcaagggacatacctctattactataagtatgtgtttttataggtgttttttgaggttgtgaagcttgattatacctttttccatttgggtaacgaatggtcatagtgtgtccacccccaacttgctaagaattacttacaaaggtgattatatcaaaaaatgaaaaaagatgtgacctttttgatgaaaggtatgatgacttatttatgtttacatggaatgattatatgaaaattaaacaaaatcgagaaaaaaatttttgtgcagaggaagaaaaagcaatcattcacaatattaaaaagaaaacagaaatagctaatgtggacaatatttctcggacacaatcttatcaagaatattatttaagaaatagtgaaatcaggtgggcctttttagcgagtatggtttcgagaaatgcgggctggaatatgactgatttagaagggagatattatgctactgttttacctagaacggtaaaaaaacatttatttcttctgtacgaacaggctaattggattatttttttagatgcatttcctcagctattattgtatgaggaaagtaagaagagacatgcacctctctttcatttgttgcaatacttcaacgtatcaatttttatggaaaaagaatggttacttttctgggaaagaagagatacgaatagacttatgacagcgcttattataaatgaacaaaataaaattcaaaaaccagtcattgagaatacatattttaaaaaacatgtattccatactgcactttttaaagtacaagaaagacttcatattagtgcagttatcttcccaacaattgaagggagaatgtatgggttttcggtttatcaatttgaaacgttacaaaagcgtatagaactaggaaaaaaattagcatggttattgtttcatccaatttataatggttcgttttataagtttgcactgcaaactacacatactgggtctagagaagattatgaagtttacgcaaaggaaactcgaaagtcttatacgccaacacttagagatatttatcctgttattttacatgaagaaataaaaatgagagattggttttgtgcaaatatgaaaatgaatgtgctatttgtacttgaagaacctaaaggggaagttaatataacagaatggtatagaagaaagagagaacaaatctataggctatctatcgtaaaccgttttgctaaaaggatcgatgagttcatgatataataaaaaagaagtcccgtcttccattttgaagacgggacttcttaatttgaaaaaatcctgctatgcgtgctacaactttaatttcaaaacgtaatgctagtaggagattaaggatgatttgaaatttaaatgttcgtaataaagtctcgctttatgtagcagggaagtttggaccatctagctt

SEQ ID NO: 1039 - DNA, 1969 bp, Bacillus thuringiensis
attggagcttagctttttctttggccatgtatagattgctccctttttctttgattttagggcatctaatccttctgtttcataagctactttccattttcggagtgtttcgcaagaaggaatattaaaaaaagcagctgtttctctcagagatgtcccattttcattcatataatgaattacatctagtttatactcgagagggtaagttgtatagcgtttttcaaacgccttttcccctgaaaattcaaaccgtttaatccattgataaagttctctaggatgaacccctatagaattagcaatggtttttccgccttccgtaccttctagatatcgttttactgcttgtattttatcttttgaagaaaatttagccataaaaaatgcacctccaattgttagttatgtgtctaacaattggggtgcacttcatttatcggtggtcttttattgagaaaaaatatatatgcataaaagcatattttatcctacccattatcgtatacaatattaattgtaacaaaactgattacaactaataaggaggctttttctattatgaaaaaaatgattttagcaggtgcattaactttagcaggaattactggagctactgcgtttattcctgaaacaaaagtcgctgctgccgctcaagaacaaagctttacaaaattttattctttgcaaactggaggtagttctgaacaagaacctattttccttcaaaaaggacaagaactaacaattcatcctaacagcaaaactcctagttacagtgtttatgactcaaatcataacctaattggacgttattctgatggttacggccgaattttcactgcaaaaacagatggaaatatgtatgttcaatttcatgcaccttacgtttactatagtcctgttagtttttctgttacttatactattcaataaaaaagaggtcctttatagggccccttttatttctcttgccaattcacttttacaaatccatcttttactgttaatccgcttatattcaatacatattcttcatttgcttttaaagtaactgtaaaagtaccttttttcgattcacaaatttcctttaactcttttataccttctccttgtctttcatacacactaaaacataagtttcctcgttttgcatctgtctcataagaaaatgtcacttctgtatccttttcatactgaaattcaatatccttactggcaatatcccatgatgagaattttgcctcataacttgttttcccttgcttctcatttgctaaatatatatccccggctctccatgcatcatctaacgtttgtgcaaaagtaaaagcactaagtaatacaaacattgtgcttgccaatatcgcaactaatgttactttctgttttttaacaaaattcaccttacattctccttcaaccttctttttacttcttcttaccatatataataaaaacccaataaagaatggcaatataactgctaaaatactccatcctttgctcatttgatgtgctttagcatctgtatatacccatgatgcaacacatattaaaagtgctataaaagctaaaaacatcgtcactccagctacttcaaatagtacaaacggattagcgaactctttcatgtaatctatactccttctttaaaaatgactgtattacaacatatatcggaatgtatacatgcatcataatcacaatggctatcaacataggaattttataatccaaatgtgtgacaaattgttctataacaattgttaacaaaacaatccaaatggtgtgaatacaaatcatccatttcctctctaacttctgagcctttcgcacgccctgcttcgtgttatttattagctcttcgcttggagttatctcttctgctaagctactctttaccttctgttcaaatttatcttctgtcataatcgaacccctccaaatgttctagaataagcttctt

SEQ ID NO: 1040 - DNA, 2851 bp, Bacillus thuringiensis
ggacaaaaacaacgtgtatcaattgcaagggctcttgtgagaaaaccaccgattctcatattagatgattctacatcagcagttgatgcaaaatcagaggctactattcaaacagctttaaaaacaaaatataaaggcacaacgacattattaatcgcgtccaaaatttcttccataatggatgcggataaaatacttgtattagataatggtgaattagttggcaatggtacacatgaacaattgttagaacgaagtgaggtttatcaggaaatttatctttcccaaggtggtaatttgcataaagaaggtggggaagaacatgcgtaattttcaagggcaatttgctaataaaggtggacgaaacacaccgaagatgggaaaagctaaaaatgcccaaggaactgtaatgcggatatggaactatatgggctatcaaaaagctgctctaatgtttgttatatttctagtcgttgttactactttacttggattattaggtccctattttatgggagtcattatagatcaatatattgtaccgaaagatttaagtggtacagcaagaatgtgtatgttacttatcgcgatttacggtgtaactgtacttttaacatggttacaaacatttgtcatgattaacgttgcattaaaaacaattcaaaaaatacgacaagatatttttgagaaaatccaaacgctttctttacggttctttgatgtgcgttctcaaggtgatttaatgagccgtgtgacaaatgatatagataatttgaaccaagctttgacacaaagtgttgtacaaattatttcatcagcgctaacttttataggtgtaacgattgcgatgttcgccttaaattggattttagcaattgtaactttaattacagtacctattatgttttacgttacaaaaaaactagttgcatatagtggtaaaaactttgcgaagcgtcaaaaagatttaggtgaattaaatggatttattgaggaagcaattacaggtgcggatgttacgacgttgtatggaaaagaaaaagaaactgtacaaaatttcaataaaattaatgaacagctaagagtttcagctacgaaggctgatacattttcagcttttatttttccaagtatgaactttattaataacttaggtatggggcttgtcattgggactggatcagttatggtcttaaacggaatgacaacagtgggtgttattgcggcttttattaattattctcgtcaattctcaagaccgttaagtcaatttgcgactttaatgaatacaattcaagcggcagttgctggtggagaacgtgtttttgagattatggatgaggtaccagaaattcaaaataaaaaagacgcatttgttgtacaaaatttacaagggcatgttgcacttgagaatgtttcatttggctatgcagagaataaaacgattttaaaagaagtgagtcttaaagcgcagccaggagagacaattgctttagttggcccgactggatcagggaaaacaacaatcattaatttgttaactcgcttttacgatatacagcaaggacaaattcatattgatggaaaagatataaaagattatgatattaattctttacgaagtaaaataggagtagttttacaggatacgtatttatttgctggttcgattatggataatatccgttatggacgcttagatgctactgatgaagaagttatcactgcagctaaggcagcatctgcacattcttttattaagcatttgccaaatcaatatgaaacagaaattgcttcagaaggatcgaatttaagtcaaggacaaaaacaacttcttgcgattgcacgagcaattttagcagatgcagatatattaattctcgatgaagcgacatctaatattgacacaagaacagaattacaaatacaagcaggactaaataatttaatgagaggtcgcacaagttttgtaatcgctcaccgacttaaaacaattgaaaaagcagatcaaatccttgttataaaggatggaagaattttagaaagagggaatcatgagtctcttatggaagatagagggttttattttgatctgtatacgagtcagtttaaaatttaataaaaaaaatgaggtttctctagaaaagagaagcctcatttttttatttgtaaactttatgaattacttttctaaccaaattaattatccgacctgaaaaatacttatacttgcagatacatttgttaaagagccaccatcactatttgagagagtgatagtacctgctgaagaggtgttatttattaaagtcaatgttgaaggaacaactgttacggtaaaagcagcagtaccttgatttattgaatgtggtgaccccgtaccaaaacgcccacctggaattggtgtaccatttagttcgagggagaattggttttcgcgagaagcttgtaattgaaactctgctacatatgttcctagtgtattaattataatatttccagtacctgtgatgtggctaagggcagttcctgttataggtccatttgtgttaaaagtaacactacttcctactgcaattgattggttagtagtatcaaaaacatatagatagtttgttaatcctacactagccgccccggtaggcccagtggagccagtgaagccagtaggtccagtggaaccggtagccccggtagccccggtagccccggtagccccggtagccccggtagccccggtagcccccggtagccccggtagccccggtagccccggtagccccggtagccccggttgcctccgtagcccccgtagccccgggagccccggtagcccccgtagccccggtag

SEQ ID NO: 1041 - DNA, 2892 bp, Bacillus thuringiensis
gaataaggagtgttcgatttttaatgaatgggaaagtgctgactgcccagttttagtagcgctaatgggattatcagaagaaaaatcaaaagtacaaaccaaatttgtaccaattcatagaacagcaacgatggtggatgatcgatacaatattacggaagaagaaaatgatgaagtattaaaagctcattttacagaagggttagatggacctctctctaaatttccgaagaaacaaaagcgtaaattaattatattgcgtcatttagtgaagaagtttgatagtaataaaaagtatactgaaaaagaagtaaatacagtgatagaaaatgtataccctgatttcgtaacgttaagaagatatttaatcgaatatggatttttagatcgaacagccgatggaagtcaatattgggtgaagttataatcatatgaaaagaaaatgaatagaagcacagtattataacaactatacaaagagatagatattgaaaatagatttttaagaaaaggagaaatgaaatttgaaaccacctgcagataacaataaagaaggtgcggagtcacataagttggaaagtgagagtaaaccaatttggaaatcgatgtcgatgtttttagtaccgttattattaagtaatgtactacaatcagttggacaattatttggtatggtagtagtaggaagatggcttggagttaatgatttagcggccatatcagcattcttcccattatttttcttgctcgtttcatttgtaattggtatcggttcagggagctctattttaattggtcaggcgtttggtgctaaaaacgaagatcgtttaaaagctatcgttggtacgacgctgacatttacctttattattggagttgtgttggcgataataggaagtatttttgcgatggatattatgcgcctaatgggaacgccagaaaatattattgaaataagtgtacattatgcacggattttatttatatcgatgccagtattatttttatatttcgcatatacaacatttatgagaggtacaggagattctaaaacgccattttactttttaattgtaagtacagcactaaatatgattttattaccagttcttatttttggatggttaggagctccgaaattagatgtgtatggagcagcctatgcatctgttatatctacagttattacgtttattgtcttgcttgtgtatttaaagaagaaaaatcacccattacaactagatggcacggttagaaaataccttcgaatggatggggagttattaaagctattgctaaggctcggtataccggcaagtataaatatgatattagtttcattatctgagattgccgtaatcgcatttgtaaatcgttacggttcggatgcaacagctgcttacggcgttgtgaatcaagttgcaagttatgtacaaatgccagcagttagccttggtattacagtttctatttttgcagcacaatcaattggggcgaatcaatttgatcgattgcagaaagttgtgaaggccggaattattatgaactacgtcatcggtggtgtgttaatatctcttatttatttattctcaagagacattttatcactatttttaacgagtcaaactacaattgaaattgctcatagcttagttatgattacgttatggagttatttaattttcggtcatgcacaaattattagtgcgacaatgcgagcgagcggtacagtactttggccaactgttattggagttgtttcaatttggcttgtagaagtacccgtagcatattatctttcttaccatacaagtcttggaatagaaggcatttggatcgggtatccagcagcatttattgtcagcttactattgcagtatgcatattataagctttcatggcaaaagaaacgaattacacgattagttagttaaatagaaaaatgtccctaagttattagacttagggacattttttcgtaagtgcaggtttacaaatagctttttaaagttatatcaaaatgttgtctaatgagtgttttatcactcatataaaactcccacgctttttccggttcaccgataatctcaaaggattcctctgtaatatataaagcgcaattatcctccagtgcaattccttctatattcccttgatgattttgtaaaaaggaatggaaggcgttcattctgtttaattgattataatgtggacaaaatcttttattaacaataccccatccgttactctctatgtaaccagaaccttcataatctgatcggatactagacgtgaaccaacacatagcaccagcgctataaccagcaataagtgttccttgttgcagagccaataataatttttcatcaagtctatgttctttccattgcgtaagcatgtgaatatagtttccgccacctagataaattaaatcggctgaatgaatcatctcctctatttcatacttagaaggtgaatctgttgtaatgcgtaaaatttgtacttcacaatgtaattgtttttcaaacgtgtctaaaaataattttatatagctttcatcatcatgactagccgttggaataaacaatacttttggatactgtttatttgttaattctataaggcgttcattaataggcaagtgatttgaatcttgtaaatcaccgccaccaatgacagctaatttcatagtaaagcaccacctaatcatttttgttatataaaaattcgatagaagagagttacattccttccgtaatgtaatcaataattagaaaatgtagcttaagtatatcggaatagtaaagaaactaccgactatatataccaatacattagaaaccattcatatgatatataatatttcatactaatgtttcaaaaaatggaaaa

SEQ ID NO: 1042 - DNA, 2405 bp, Bacillus thuringiensis
tgatgaagctttaaatgctgagattatggtcgagaaggaagaagatcaaaaagagaaagttcttgagatgactatcgaagaactagacctttctgttcgttcttataattgcctaaaacgtgcaggaattaatactgtacaagagcttgcgaacaaaacagaagaagatatgatgaaagttcgtaacttaggacgtaaatccttagaagaagttaaacataaacttgaggaattaggtttaggtttacgtaaagacgactgaggatttaaacccatcaacaaaggagggaactacgaatggcatacagaaaattaggccgtacaagtgcgcaacgtaaagctatgttacgtgatttagctactgatttaattatcaacgagcgcatccaaacgacagaaactcgtgcaaaagaacttcgttctgtagtggaaaaaatgatcactttaggtaaacgcggagatcttcatgctcgtcgtcaagcagcagctttcattcgcaatgaagtagctaacgctgagactggtcaagatgcacttcaaaaactattcgctgatgtagctccacgctatgctgagcgccaaggcggatacactcgtattgcaaaaattggtccacgtcgcggagacgcagcaccaatggtaattatcgagttagtataatgataattaaaagggcaggacagttcttttcaagaaactggtcatggcccttttttttaaatataaaaataggctaactgtgcgaaggaaagggtgccttatattgaaaaaagagaaacttcggatagaaaatatatcatttcaatatcctggggcagccacttatgcattaaaagatgtttcattttccttatatgagggagaatgggtatctattattggacaaaacggttcaggaaagtctacacttgcaaaattattgaatggtttgtttttgccagaagcagggactattacagtaaatgatacaatggttttatcagaggaaacggtatgggatgttcgaaaacaaattggaatggtatttcaaaatccagataatcaatttgttggaacaacagtgcaagatgatgttgtatttggcttagagaatatcggaatgccaagagaacaaatgattgaaagattagaacaggccttgcgacttgtccgtatggaagattttcttaatgatgagcctcattccttatctggtgggcaaaagcagcgagtggcaatagcaggcgttttagcacttcaaccatctattttaatattagatgaagcaacgtcaatgctagaccctcaagggagacgtgaagtagtagaaacggttagacaacttgttactcaaaaaggtattaccgtgttatcgattacgcacgatttagaagaagcggcacagtcagatcgtgtcattattttaaataagggagaaatattagaggaagggactccagaaaaaattttcaaatcctctcatatgctccaagaaattggcttagatgtaccgttttcagtgaaaatagcagaattattaaaaagaaatgaaattctcttgcaaaatacgcatcttacaatggaaagcttggtgaacgaactttggagattacattccaaaaagtagagcatcgttatcaatataaaactccatttgaaagacgcgcactttatgatgtagatgtgtcgtttccaagtgggggctattatgccattattggtcatactggttcaggtaagtcaacgatgattcaacatttaaatggtttattgcagccgacaaatggtacagttcaaattggtgaacatttgatttcggcaggaaagaaagaaaaaaagttaaagccactacgtaaaaaagtaggggttgtctttcaattcccagaacatcagttgtttgaagagactgtggagaaagatatttgtttcggccctactaattttggagtatctgtagacgaagcaaggcaaaaggctagaaaggcaattgaacttgtagggctagaaccggaactgttaacacgttctccgttcgaattaagtggtggacaaatgagacgtgttgctatagcgggtgtactggcgatggaacctgaagtgcttgtattagatgaacctacagcaggactagatccaaaagggcagaacgaacttatggagatgttttataagctgcacaaggaaaaggggcttacagttatccttgtaacgcataatatggaggatgctgctcagtatgcggagcagattgtagttatgcataaaggaacggtctttttgcaaggaagtgcagaggaagtattttcacatgccgatgaactagagaaaattggtgtggatcttcctatgtcattacagcataaacgtgcaattgaagagaagaagaaaatttcaattccaaaggctaccttatctttagatcacga

SEQ ID NO: 1043 - DNA, 3872 bp, Bacillus thuringiensis
aaccaaaagggttttacactgcttgaacgattatccttcttactgtataaactccttttttcagatccgaaacaaatatgttgtctcatgatccatctttttatataggaatagaaccaaactctttatggtatgaataacttacccgatctattacagatataaaaaaagacttcgagcaaaaagaaaaagaaggtacatttttctttcagtatgaaaagggagaagcgagtggaaattatgtctttgaaaatgatttaattctcgttgctttgcagtgtacactcaaacaggaagctttctatacggtgagttttcggtatagaaaaaaggatgggaaaatagtcgattggatagaaggataatatgtaaaatatatatatagataaaccaggatttcctattgtaaattgaattgattttttagaagaaatggataaatataatgattaaaagtttaaattttctcaaaaaagagaaaggtagaaagaatatgatatattcatgctatccaatcattatttttagggagaatagggaaatgacaaacaacaatcaaataggtgaaaataaggaacaaactatttttgatcataaaggaaatacgattatgacagaagatagagaaatacacattatttcaaaattcgaagaacctcttattgtcgtattagcaaatgtactaagtgatgaagagtgtgatgaattaattgaaatgtctaaaaataaaatgaaacgttctaaagttggttcagcacgtgatgtaaatgatattcgaacaagtagcggtgcatttttggaagacaatgaacttacttcaaagattgaaaaacgaatttcatctatcatgaatgttcctgcgtcgcatggtgaaggattgcacattttaaattatgaagtggatcaacaatataaagcacactatgattattttgcggaacatagtagatcagctgctaacaatcgtattagtacgcttgtaatgtatttaaatgatgtagaagaaggcggagaaacgtacttcccaaaattaaatctttctgtacaccctagaaagggaatggcagtatactttgagtatttttatcaagatcaatcattaaacgagcttacgttacacggaggggcacctgtaacgaaaggcgagaaatggattgcaacgcagtgggtgagaagaggcacttataagtaaaagcgagtgttacgttttgttcttcatagtataagaacaaaacgtttttttattaaacaaagtagcatctttcgttataataacaattaataaatgacgattgagaggacaagaaatgaaatctatatacataaccggctacatgggagcagggaaaacaacaattggaaaagcgttaagtaaagaacttcaaatggatgttgtagatactgatcaaaaaatcgaagagaagcaagagaaggcaattcgaaaaatttttgccgaagaaggcgaaatggcttttcgggaatatgaaagcgaaatgttacgtgcgctaccagtccataatgttattattacaactggtgggggaattattgaacgagcggaaaatcgcaagtggatgaaagagaacggaactgtcgtgtatttatattgtgatccgcatgtaattgcagaaaggcttcgtgaagatacgacacgtccactatttcaaaagaaagatatagatgcattcgtaaagaaatttgaatcacgccgagcttattatgaagaggctcatattcatatcgatacgacaaataagtctgtaaagcaaattatgaatgaattaaaggaaaagattaatgtataaaaaagtggacatactaatcaagtagaggtgatgataatatgtctactaatgattatgttcgctttgtgacgcagcagtttgtgtcgtatatggatgctccaaaagaagatcgaaaacaaaagaaagaacaacgccgtgctgaaaaagagccatttatgaataagtggtttggtgttatgccgctgagtgctgctttgttttaccgaaatgtaaaaagtaaaagaaaaaaatcaagttaaattttagtcatatgtttaacaaaccaaaaatcccctagtgtcgtattacactaggggatttttatttactgcacggattcttgttctttcgtaacggcatgtattttattatttacccaaacaaatccaattccgatacaaatggaaatgccccatccaacagcggtcataatcgctctcatttcaccatagccatctacaccgaaaacagagatgaaataaatttttaagaagctttttaatatgaattgtagaccgaaaaatagcgttaaatattgtagtgctggataaatacgactatcacgataaagctcacgacttttatcacggtcatggccttgcagtgcggcaatatccgcagcgaaatataacataagtggtttctttataaaaattgtacatatgacgataataccgagtacgatgtgataatatgcatcattccacaacattcgttcagctgacccagataataaatctaccgttgtattagaaatgagtgtaattaaaataaagaaccctgtcacgttaaactgtttttcttttttaaaggtatacagtgtataaataatccccggaacagaggaaagtaacatcgcgtaataaggatcgatataaggttttgcaaatttccaaatgaggaatgggattacgagataaaagacaagatctaatatagcttttttattttgattcatacaaagcctccttaagtcatacatatattttataatataatttctgaaaattgtataaggtttaatgggaaaagaaaaaatatatcaattttcgaggggagagtagattgaaaaaaattgcccctagcgtagtaagtttttttagtatataataaaggaaacgctttcatttttaatttgttcacaaaatggacggaaaatcacatatttactatcgatatgttgctttataatgaaactaattaaatatacatgcatacaatattgtgaaataaataacataaataatctatataaatgtaaacgttatcaaaatagagaggtggagacaatgagtaaatttttcttcaatcataatccagcaacagtagaggatggaaggcttgttaaatatgctgaaattatttatggagaaggtggccgttctgtattagaaaatttaatggtgaaggcatctatcagattgcgtgatcgttatccgaataaatctgacgagcagatctcgaacctagtaaataaaggcatccatgatatgtttcaaaaatatgtgagcgagtaagagtggccaatggctgctcttatttttttgtataaggattgtaactctagctgaaaataaacatgtattctgaaaaacgtaaaaaggagtgggaaagatgagcaatggaattggacgttcgaaagaaaatcttccaactgatgcaaatcatgtgagcgcgaaggatcgtgcgtatcaaaaacgcatggcaaagcaaaaacaacaagagcgtaatgaggatagagaataactcgaaataaagctccttctaaagcagaaggagctttatttcgatagaaaatgattcgcggtaacataaaagagtccaccgttaataatttgcactgtaatacgtggttcatactgttcttgcagagcttgtttttcaatttcatagctctcaggaagttcgtcactttcttcataaaaacggtttaaaaggtctaaatcatgattccaacgcactcttgcttcttttgcccacgtatggtcatcttctgcaattatattttttaaagcgtcttctatgcgttgtaaaccactttgaggtttaatgatgggcgagagcgtaaaacaaaaatcaggtattttt

SEQ ID NO: 1044 - DNA, 1877 bp, Bacillus thuringiensis
agtgtgatttatttcgaaaatgatgacatccatagattgaattagaaagtaacttttattcaattgaatcgctattgataatcattttcatttgaacatcctgttaattagtatagtcattaattctgtgaaaatcttgtgaatcgtatcaattcataaaatcaagcataaaaagtaatatgtgcggtcaggactgttgattagccttcattaaatactttctcaacgaatacgggacagagaccttcccttacaaaatacgcgcagtaatagctaatatttcacagaaactactttattatcttatttttatcattcaaccattgaatagcctctgccatgtatcgtttgaatatatctatctttcttctcgcactttagcttttttcttacatacccaatatataagtctactacattcggatttactactacgtcatatccccaaacttgattcaaaagcatttcacggcttaatatcgtatttttattcttaattaaaaatacaagtaaatcgtactcgcgcttcgtaagcgagagatttttgccaccttttttcacaatattgctagatgcatcaacaaagagatctttaaactgaaaaaagtttgtctcattttgctggttatagtcacttcttcttaaaatagcttgaactctcgctactaattcttccttcacaaatggttttctaatataatcatctgctcctgcttgtaaccctgctatgcaatcctcgctagaaatattgttggtcacaataatgattggtgtcgttttaacaagtcgtatttgtctacaaatttctggtcccgatatacttaatgaatcccaatccaatatgataatatcccaatcttgctcatatgctatatttaaaccttggttttcattgtgaagttttaaaatgaaatggccctcttgcgttaaaccgcttacgattttctttgctgaagaccgttcatttttaatcaccaacacctgcttcaccgatggttcacctctacttcaatataaattatttagataaaaaattatcccgaaaaaacaatttaagatttataaatttaaaacccctaaataatccattaaaacagtttattaggagaactctatataatcttacaataggtatggataaaaacacaaaacatatggagattcaaataaaatgaagtattaattaatcaaacagagatgttcatccccactaattatcagtcctcaccaatcgggctttgacgggataaaattgtgatcattaagggataacacacaagatacattgaggatgtaagtgaaagaaccaaagaattagatacattctatttttagaactataacctttccagaaacaaaaaagaaccataacctcgccaacctggcaaagttatggttcatatcatacaatgtcattttacctataagttggccgcagttggaagcataagttggccagaaaacacttatttttgtagataatcatctaattattcaaccgaatcggaagcataaattgaccgtgtgttaattattaacccataagcttgccgtgtgttttattaatgtagctttggaataatgtttggccaaattgatactaataaccttaataaacgagcaaatggaagtgacgctttcgttagttaataggtcactttgctctcttgatatgctttctttacccgttcaatttgagcgaggtgtccttgtatatattgaagatctttcaagggctagaaggggcacctgtgctgggaagtgcacagtagattccagttaaaggataaaaagtgtacggggcactttttaaaaaggttttattgaatcattttgcagcaccgttaaggtatttatagtggtgcaattttctatct

SEQ ID NO: 1045 - DNA, 4206 bp, Bacillus thuringiensis
  unsure (1)...(4206): unsure at all n locations
tgcagaagaagaaaaagagttgttagaaggattgaatacttttcaaacgggcatagacttgtttcaatcatttcaagatttgtttgaagcgcaagtattaaaaactccagatcaaattgctgttgtttgtaatgatcaatctttgacatatagagaattgaataagaaagcgaatcaattggcttctattcttcaaagtaaaggtgtttcaaaagaaagtattattggtgttatggtagatcggtcattagaaatgattattggtatgatggggattttaaaagcaggagcagcgtatttaccaatcgaccctaactacccaactgaacgaattgaatatatgttacaagatagtcaagcaaaatatttacttagtaagcgaacagaggaagtattgccacaatttgcaggtgaagtactgtatcttgataaagaatatctttttcaaggtgaagaaagtaatttagttcgagaacataatcctaatgatttagcttatgttatttacacatcaggatcgacaggaaatccaaaaggggtaatgatagaacaaaaatcgctagttcattttttaaatgtaatgagagaaaaagtaaaagctaatcaatcattcttgtttcttgctagtgtatcttttgatatttccttgttagaaatatgtcttcctttaacgcaaggttcaaaagtagtaattgctacagaggaccagtttgcaacaaaagaattgtctcatttggtcaaaaaacataaggtggatttatgggaatcaacgccatcgcgaatggaagtgattttgagtgatccagaaggggcgatttttctaaaagatttaaaatctattttattagcaggagaatcattttccattgatttggttgaaaaaattcgttgtatcagtgaagcaacaattttaaatatttatggtcccacagaaacaaccatttgcgcaacagtaaaagacttgagcacttccaaagaagttacgattggcaaacctaacccgaattatcattcctatatattgaataagtatggccaattaaaaccatttggaattcctggtgaactctgcattgctggcgtagcggtagcacgagggtatcttggtaaaaataaactgacagatgaaaaatttgtaccgagtccttttgcggcaggggaaatgatgtatcatacaggtgatctcgttcgttggttgcctaatggagaacttgaatatttaggtagaatggatcatcaagtgaaaattcgggggtatcggattgaattaagagaaatcgaaactcaattaagggaatatccagaaataaaccaggctatcgttgttgatcaagtatatggaaataggaaattattagctgcctactatgtatcggataacaaggtgtcttttggtgaaatcagaaaatatttaagtgataaattacctgagtttatgattcctgaaaaaatgattcaggtagaagagattccattgaatccaaatggaaaagtggatagaaaaagattgttggatataacacaaacggattatgtatcaattccatacgttgctccgcgcaatgaaattgaacaaaaattagtgcgtgcatgggaaaaagttatggagattgagggaatcggtattcatgataatttttttgcattaaaaggagaatctattaaagcacttcaggtaattaatttattaagaaaagactgcttaaaaataagtacaacagatttttttaagcaccccacaatcgctcaattgagttcttgtgtaaagttagagcataaagaggaaaaccttgaaagtagaccaactcatgttaaagatttgtctaagccattttccttaacagaagttcagacagcgtatatgataggacggaattcacagtttgaattaagcggtatttcacctcaaacatattttgaatatgaaacagcattggatatcaatcgtctttcaaaaagttttcaaaaggtaattcatcgtcatccaatgttgcgagctgtaattttaccagagggaaaacagcaaatattacaaagcgttcctgattacgagattgaaatagtgagtctcatagatttagatgataggaatcaacatgctcgcttacaagaagagcgttctcgaatgactaaccatgtattccctttggggcaatggcctttgtttgaattgaaagcttttcttttaaaagaagacacgtatttattatgttttcgatacgatgctttattaatggacggagcaagcatgaacattgttggacaggatttgttgcattattattataaaccaaatcaaaaattagaatctttatcttttgattttcaagattatatgtttatctatgatgaaatggaacaaagcgaagaatataaaacagcaaaagattattggacaagtaagcttcctgactttccgtttgcaccttctttgctgttaaaaaaggatccagcagagattgctactcgggtgtttttgcccatcccctcgaaaagggggaataagaaaaaataggatgtttttgtagatggagcgccagagttactgtcgtggactgaaaaatatcattcaatacaattgtgcagtacatttttttaaaaatttgtagtaaatattttggtaacagtgatctgtgtgacaatagaaccgaatcatgaaataaagcgttagcggagattaacgagcaataataagaggcgtttactatcttttcaaataaatgtttttgtacttatggtatactatatgtactttcgtttttacgaaatccctagaaagtatgtagaaaaggttctgacttttttgttagaaccttttcttattttttcgtaacaaatgcttcttttaaatttctgatccaaacagctttatgtaaatcggtatgagaaatccaattccctgattcatgagaaccgacaaattccttataaatgggatgccaaataataagatatgtttcattttcatattgtatctcatcaaattgccgcagcgattttcctaatatatcggattggccgataggtatggcccctttttctaaaatttctttaaactgtttcaaaggcatcacactccttagcataggtatatgtatatattttttaaagatgtattttttcctcttttattatagtaaatgaagagtggatattttaaaaatacatgtagaaaatgccctctatacataaggggtgaatgtcagctttgttatattactatgtatataatgaaagatttattgataggttgataggttattagataagtaaattagttataattaatatatagttttaattatataaaaaaccataataaagaaaggagttcaatcttcattagagtgaactccttcctttactatattttatattaagacatagaagaacctttaaatctttgttaggggtaaagatttaaagaaaagtttagcttaatgtcattttacatcattgcgtttctaataaaattgataattaatattctcattattaagattatttaggtgtataatacaaaagtataaatgctaacttaaatatgtacattaacgcttgaataaatatgtacattttcaattggattctccatactgactctgaggtggttagtatgtatattaagctagatattcaaacagaatttgaggttaaaagtctttcagacttaccaaattttaaaaaactaatggggaacttaaaaatgaagataaataaaagtcaattagccagagaattgaatgtggatcggcgtaccatagataagtatttgaatggttttacaccaaaagggacaaaaaataaaacatcgaaaatcgatacatattatgaagtgattgcagctcttttatctagtgattctaaacaaatcttctactacaaacgagtgttatggcagtatctaacagacaatcacggtttaaaatgttcacagtctgcatttcgtgcttatattaatagaaagcctgaatttaaaacatattttgatgaggggaagcgtattttatcaggtcattcagtgggtgtccgttatgagacacctccaggagaacaagctcaattagattggaaagaaagcatacgatttgtggccaaaagtggcggggtcgtatatgtgaatgtcgctgtaccccccttgtcctcctcgngctttccagtttttcatttatttctttcaaaatcncnnagtgttttcctgtcatt

SEQ ID NO: 1046 - DNA, 2849 bp, Bacillus thuringiensis
actgaagaaaggatttgtaatccttggaactagcaccgcaattgtttccgttttttgtttacgaagccttctcgccgcagaattaggaacgaagcctaaatgcttcattgctaattgaaccctttttttcttctcatctgaaacatatggatgattattaatcaccctagaaaccgttgtccttgataaccccgctaatttcgccacgtcctctatagtcgacacgaaattctccccctttgcatgaaaacgttttcttaaattgattatatagtatattattggaaactgcaatatcggttgttatgattttactatattaatattatacataggtaaaagtctgttaatgcatgggcaatatactgcttttagaaatttacgttatgtacattccttttcttaataccatatatcctttattcaatataaaaccccatcaatacgtcatctccatatgatccatcttcatactttatttgctttcgttgtctgccttcttctacaaagcccatacgtttgtacactttaattgcccgatcattaacagaaactacacctaaacaaattttctctaaacctttctgccctttcgcccaactaataagaaattcaattaatttcgtgccgatgccttgattacaatacgcctctttaatccccattcccattgtgcctgcgtgttgtaaccgttctagttcatatcggttgaaaattaaaaagccaactaccttcccatctacttcatacacgatataaagattacctttctcattacttttccgtatcttttctctttctgcattcatatcattcggtaacttctttggggatactatgaaaaattttgtagtagtttccgataatataatttcttttctaatattcataattgcttctgcatcagtctcttttactaaccgtatcattaaatcacctcgtactttttcttttgaaaaataatattacaactataaaacgcccaatatgcaatattacatattgagaatctttttactcttgatacaatattcatacatcaaaataaaaggaatgtatgcaatgaatccaatcttaacagctgcaaaacaactattacataaagaagaaaaggttttatctactttaaaatgttcacttactggctatatgattacgcataaagtcccgtatcctggcatgttacttgctactaatcaaagacttctcttttttagccaatataaaaacacattcattgccgaatttgattatgaaaaaattctatccatagaaacgaagagaagaatctttgacaaaaaaataatattttactatgaagatgaatatataacgcttggatacattacaagttcgaatgttgaagcgttcatagacttactacaaagaaacagcaagactagcacaggcttataatcagcggggatcccctcgctgattcattattttaactcctcccacttcgtccaaacttccctcccgtttatacagtacatattatcctctctattcataaacccctgtacaataaattcacgtctaattgtacaaaaatcatcatgatattgttttataaatgtattcatttctttttctgtatattgattttcagcatttaacttgctaattaaatgctctaacaatactagttttttcttcttttgacctggaatcgattttaaacgatcctctttatcgaaaaagttacgaatggtcgtatcccggaatttcatttcactttcagtcattttattgtcctccattaatttttatacaacaaaactttattgtttgtccttactattcttcttcattctttcacttacaacatccataaagtaatacccactaataagcacatagtaaactacaagtattcctagtgcatctttcatatttatatatttttctttatgaaataagataggtgaaagggcgtaaacaagaaagatgattagcggatttaagataaaataataagtaagatttcctttcatcatatcaactcctctattctagttttctctgtaaattgttgtaaatccttttctttcgtttaaactgcacatgcgatatggtgaaattaaggagaaggatgattataaatgatatttcactctaaaattgataaatttttcttattcattatcttttttgctatttttcaccataggtgcttcaacactgcttcctctcttattcgataatgaagctactacgacagacgtatatattctactacctattttctttgtatcttctggtttcctattatggaattccttttcatttttactcctctcacccacactttcttcaaactgacttaccacttttacatttgcaacctattattcaaattaacaaattaaaaatggtaaattatgttacaattaacttatacatactttggagggtacatagtgaaaaaagctattatagtattaagcattctatatcttattttaaccgtacatacaggagctgttcttttaggaaaagaagattatagaagtgctatcaatacattaaaagaaacgaaagaagtctcttcatttcaatctgcaaaagacggtgtgattttattaaaaggagcattaactactgcgcaacctattacagaggaaaaacttcaaaataaagaattcgcactccttgaaattaatacgtataaacgacgaaaagcaaattggataaacattgatacagagcaacatattgcaaagcagctcttactaaataatgaggttcttcctgcattaaaagaaattcgtttttcgatggaaccaattacactgtcaggaaaagatatttccatcgaagattactcactaaaaaaggatgatact

SEQ ID NO: 1047 - DNA, 3305 bp, Bacillus thuringiensis
cagaagtaaatggattattgtataacataattggtatatttacagagtttgagatttctttaaaatgaaaataaatctcctcttccttcggtttacaatagtaagagtttataattaatgcacaatccgctccgtgcgcttctgcatgtttcgtatattcaattgtttctttcgtcgtctctgctgcagttccaacaataactggaatacggccatcaatttctttcaacacggttgctaccattttaaatcgttcttcttttgataaacttacaaattctcctgtacttccattaatgatgatacctgcaacgttttgttcgataaagtaatttacattttgctttaccccatcccaattaatttcctgaaattcatccatcggtgttattaatactggaaatgcccctttaattttttgcatatttatctctccttatcacattttattttaataagaaacctgccggaaacggatccgtagggtctaatagaaacgtctgcatccctgtaataaaccctctactttcaaaacggaaaatgtatcctagttcctccttcttcactttctccacagttataaaactattaaatatactttcatttttaaaaggtttatccgccatataatcatttttaaataacgcatgaacataggaaacaatagtagaaacaaaacctggcgaatgtacgataaagttatcttcatgaaatgtaatcgattttatatggttcttttctttttgcgaaggatctactaaaataagcctttttattagcgactgtttttgtatagtctgtagtgtagcttctccccatcttttcaattcagaaatgttttccatgcgaatttctggcgaatacgcacctttctctacaactgcatatactttatctgcttgtatgagagaataacttacattaccaacctgtaaatttccctcaatcatatagcatagtttgctttcaaacgaaaccgatataacttcatcattctctacatacgcatgaactaaaaatattccagataacgtttcaattttgtattgattggactctctcttttttaaatacccactttcgagtaacatcgttattactgcaacaatgcctccataatgaagcggaaccgaaccttcatgattaaaaaataatacagctgcatccacttcgttatagatagatggaacgacaatacacccattcaaaccgataaaaccacgtggttcatttaataaaagcttcatctcttctgctaattcacctgaaaattgttcatttaattgctccaaactgtagtagtatttgcatggtacgtctttcattacacgaaatgcctcgccatttacatgtacgtctactgctgtatacattttttgaatgttcattttatatcctccgtttcatgttccatcggcggaattagcaaaaatccttctttaagtggatccatttcattgtaaaaaaatctatgcatacccataagccaagctgatcccgtaattttcgttatgacagcttcaatattttcaacatgtgtcgtattcatgacatatcctttaaataaagaaccaacgatactctcatgaatgaactcttcaccaatttcgatttctttctgagcgtataatacagctagcttcgcagatgttcctgtaccgcatggagatcgatctattccgcctggtggtacaacaactgtatttttcacatgcgcacattcatgagtaggatctgtataaaattcaacatgtgttaatcctcttataaacgaatactctggatgagtgatttcaaacttctcattaattgtgtttcttatatgaatcgccttatcgatgattgtagatgcattttctggtactaattctagatctactgatttcgcatcaataatggcataaaaattccctccatacgcaatatcagcctctatagtcccaatgtctttcacttgtacagtaatatttttcaataaaaaagctggtatgttacagaaagatacttcttttgcttttccatcttgaacagcaatatctacttcaactaagccagccggtgtatctagttttaaagaagtaatcggttcaactaccggaattaaacctgattcaactaacgctgtacatacaccgattgtatcgtgaccacacatcggtaaatatccacctgtctctatgtatataacacctatatcagcctcaggatgacatgggtctgttaataatgctcctgacattacatcatgaccacgcggttcattcattaacaattttcgaatccaatcatactcctttttcatatgtaacatcttctctgccatcgtctctccaatcaactttggaagtccactaattaatgtcctcgttggattcccacctgtgtgtgtatcaatcgtcgtaaagactctttgtgacctcatccgtttaacaccctttctgtaaaacgactcaaacgaagtggttcaataggaataattgtctctttttcatttaataactcttcaattacttttccagtaactgctgcaagactaatcccatcaccttcatgtccagcggcaatgaaataattcggaatatgttccactcgtgaaataatcggtaaatgatcttctgtccacggacgtaaaccagcgtaagaacgaattaccatcatatctgccattttcggataaaagcgaattgctctatttgcgatacatttaatgacttcattatttatcctcgtatgaaatcctacaaattcacgactactaccaattaagaaattttgactttcagtaggctcaaatacgagcgcaaccccgtatttttcagttaaagcatccacttttcgttttccgccaaatttagaaattaaataaccgaattccattactttacggcatcctacgtgttgttgccttgaagctacaataatatgcccttttctcggttcaattggtatatttatatttaacatctgaccaatcttaggagcccacacaccggctgcatttacaacttgttttgctgtaaaagttccattcgtagtttctacaacaaatgaaccatccgtctctatttccatactctttacttccgtctgcttaaaagcttttgcgccaaacttttgtgcctctgacagaagcgagaaagcaaggagatatggattcacagttgaatccgtcgcacattctaaaccgcctaataaatcatcagcaaaaaaaggcgactcttcccttatatcttgcctatcaagcattcgaaacggtaatccagcttcttgttgccgatttacccattgctgcgcagcttccattt

SEQ ID NO: 1048 - DNA, 3253 bp, Bacillus thuringiensis
agatcgttttaatattttctactccaattttctttaacgtttcatttgtaatatcaattaattgttcataatttggatttgcgtaatctacgacgtgaataagtaaatctgcttccgctacttcttctaacgttgaacggaacgccttcacaagatgatgtggtaatttacttacaaatccaactgtatctgttaataaaaatgatttattatctggcaaatcaatatttcgtacagatgtttctaacgtcgcaaataacatatctttttcaaatacttgtttttcttctgtaccattataaatttcaagcattgcattcatcgtcgttgactttcctgcattcgtataacctactaatgctacaacaggtatttcatttttcttacgttgctttcgctgcgtttgacgctgggcaacgagcgcttctaaatctttattcaaaactgaaatttgttcttcaattttacgacggtctaactctagcttcttctcaccgacacctttatttttcgtaccaacgccgccgctctgtctccctaacgattcacgaagaccaattaaacgaggcatcatgtactgaaggtgtgctacttctacttgcagctgtgcttctttcgttttcgcacgttgcgcaaaaatatctaaaattaaaatggtacgatcaatcaccttacaatctaaatcctcttctaaatttcgaatttgtgaaggagataattcatcattaaagatgaccatattcgcatctatttcttgtacatacgctgctacttcttcaatctttccttttccgatataatgcgatggatttactcgttgtaaattttgcgttacttgcccaattacctctacatcacaagcttccgcaagatttgttaactcttccatcgaatatgcaaaatcatcttcattacctacatttactccaactaaaactgctctttgtaatacttcttccatatatttattcctccatttcgattacgtaaaataaaaaacacaggtcgctgcctgtgttttcgtaaacggataagggttcaccaaagaaatagaagaaagctatgctttcatcctattttatagtcaaaaagtcccaagatcgtatacgtatacacaataagcgttcacctatacaatcccattctatttataaaggcaaaacaaaaagagggcgtattcgtccctccctctttttcacatataagcttaataaagggttcctttaaaataggcagaccaatcccgttcactctgtacacagacagagcctttgagcgctattcaattattggcacaaagtattgagacgtaatctgattaagatcaaaggaagcccctccgttcattttaagttacataaagtgtagcataagtaattcgctttcacaaggtttaacaacctatatcacactaaagaaaatcgttatttttttactttaatcgtcattttttgcgagtttttctcacaataaaaataacaaaagcaattatcaattttagaaacttctcgtatattatttttacagcactcgccaaattccttcatagtaagttaagtattatcgttttaatacaacaaaaatctatattgacatttttataacctaatattagtatcaggttataaaaataaaaattaggagatgttcctatgcattctaaatctcgtattactgcaattggtacttatgttccagatcaaatattgtctaataacgatttagaaaagatggtccatacgaatgatgaatggattgtacaaagaacaggaatgaaggaaagaagaatcgctagcgaagaagaatattcctcaaacttagccattaaagcaattaaaaatttatgtacaacatataagaaaaacttagaagatgtcgactgtatcattgtcgctactactactgctgattacgttttccctagtgttgcttgccaaatacaacaatacttcaacatacctcatacactagcttttgatttaaatgcaacttgtgctggttttacatatggactacacgtcggtaatagcttaatcacttctggatcacatgaaaaaatacttgtcgtagcgacagagacattatctaaagttactgattataccgatagaacgacctgtattttattcggtgatggtgctggagctattttattagaaagagatgaagacatcccaagctttatcgctgctcacatgggaacaaacggtgatggcggcattcatctatatagcacaaacttatctactactatgaatggcacaccactgcaaacaaatgaaaaaatcgttcaaaatggaagagaagtatataaatgggcaacacgaacagtgccaaaaggcataaaaaatttattacataacgcaaatatgcaaggggatgatatagactggttcataccccacagcgctaacttacgaatgattgaatctatttgcgaaaaatctcaaattccaatacaaaaaacattaacgagcgtggaatatatggggaatacctcttcagtcaccattccactcgctctagatttagctataaaagaaggaaagttaaataatggagacacacttttactatacggattcggtggtggtcttacacatttagggcttattgtagagtggaatttaatttaagtgtataaaaagaggctctagtcagtaactagaacctctttttcatttaatttcttgccccttttcgagaccatatcacaacaggaataagtaataacgctaacacgcctccagccaatgacaatgccgcataacttgaattcgctactaccatacctgacatcgctccaccagaagctccagctagcgcaataaaaacatctattttcccttgtgttttagcacgtgtagacggtgttgtggaatcaacgatttgtgctgtaccactaatcaatccgaggttccatcctagcccaagtaaagacagagcaacgattaatagtaataaagaatcacttggcgctatcgcagctatgacacccgctgcaagtaaaatcactccaccagctatgctcattgtagttcggccaattttatcaattaacattcctgtaacgagagatggaagatacattgcacctacatgaaaacctatcacaagtcctactgcacttaaaccgtgaccgtggtgtcccatatgaactggcgtcatcgtcataatcccaaccatcacgatttgcgtaagtatcattacgattgctccaactgtaatacctcgattattttctttcgcttcg

SEQ ID NO: 1049 - DNA, 2709 bp, Bacillus thuringiensis
attcattagaaggaacttactagaattaattacggcatcacaaaatgaagtggcaaataaagaggggataattgataatattgaaaaggatcttaaaaaatatgattctttattaaaagaatatgatgatggttttaatttaagtaagcaagaggatgaactatttcagaagatgaagaaatctttgccaagttataaagatacatataaaaaattatttgaaaaggcgaaggcaacaaatgagccacaaatggtaaatgaatttcagaaggaattaaaaccgaagggaatagagttagctggttatgcagtggatctagaatcgtatgtttcaaatttagctgaccaagtatttaaagattctcaaaaaatgattgatcgttccgttattacctttatcattcttgtagtagttactacaatcgttatatgtatagtaagttatattattagcaagctcatagttgctcctttacaaacggttagtcgtatgatggaaagagcgaaagaaggagatttaaccgtacatggtgagtatactgctaaggatgaattaggtatattagtaagtaattttaacgagatgattgcagggctaagaacaaatatgcaagaagtagagaataatattcagcttttattccaacatgcagacggagtagtatctgcatcagaagtatctagtagtgcagcgaagaaaatcactatggatattgaagaagttgcaaatggtgcagagagtcaaatgcaagcaatggaacaaactgcgggtgcgatggaagagttgacgcaaggaatgcagagtatagtcaatacatcatcctctgtaaatgaattatctgctcaatcagcattagatgcagagagtggtaacaaattaatgaaacaaatgattcaacagatggatacaatccaaaattcggtacatagcggtgtgaaacaagtagagactatgaaagaacaatcagaagaaattgttaaaatcattgatgttatgcaaggtattacctcccagattaacttattagcattaaacgccgcaattgaggctgcacgtgctggtgaaagtggtagaggatttgcaattgtggcagatgaagtgcggaaattagcagaacaatctagtgattctgcaaaacaaattgagaatcttattactcaagttatgggaacaacgaaccatacggtacatatgatggggaaagtagataatgaggtacaggcaggtacacaagtagtaatgcatacagaaaaagtatttggaacaattacagaaaaagtacagcaagtatctgagcaaattcaaacggtatctatgtctacagatgaaattgcagcgagtagtgaggaaatctcggcttctgcagaagacatggctcaaatttcccaaagatcatctgaccgaactgatagggtaaaagagtctattcaacagcaagaaaaatctgttcaagagatttcggtttcaattgaacatatgcataacgcagcaggaaaattaaaacaaatagttgcccaatttactcttcaaaagtagtagcatatttgagtgttaataaatataaaaaaatcatcctcttttaagaaaaaaggatgatttttttatcccgttatttgctgggcagtaagacccccacctcaaaattcagcgaaagcgagttatcagtgaagggggatgctacctctgaaatataaaccatgaatatagtaatctccataggcatctcctttaggtgccaataaagggaagttataaagtgaaaaggagtttataaagagattgtagaatgttttagtatataacaccttagatgtgacaacttcctttttgaaaaagaaagaagggggtataaagcagaaaggtagtgggaatatttcttctagaagatttgcattttatcttacattcacaaaaaaaatagtactcctgaaacaatgaagttcattttatttgaatgaaatagggagagaggataatgaagaaaaaaatattgggtgtaatgatgattgcgacaatggcaggaggtatatttgcaggggcgaatgtgacacctgtaaaagcggaagagtatccacaaatgattgtgtttgaagatgttccatacggattttgggcatatgatgctattatggatttagcgtatcataaaattatattagggtatggaaacgggaagtatggtgttggcgatcttataacacgtgagcaagtagctgggactatttacagaacacttgagataaaagaagaagggccagtagcgaatccatataaagatgtttctgatagtacaaccacttttaaaaaggaaattttagcgttaacaaaacgtggtgtttttacaggggatggccaaggggattttaggccgaaagcaccaatctctagagcggaaatggctgtcattttaaaacgagcatttaattttgaaacgaaacaaaaacatacatttaaagatattccaaaaggtcactgggcagaagatgcaattagtgcgttacaatctaagcgcgttgtgagaggaactgggaatggcatgtatgaatttaaactcggccctggtaacttagagagcagatatgctcagtttattaataatgcgatggttaattatcatttgaaagaggattgtaagtagagtcaaatatgaaagctctaatagaaaagtttaaaattaaatgtttgtttaaaaaagaatatctgaattc

SEQ ID NO: 1050 - DNA, 3793 bp, Bacillus thuringiensis
atttagccgttccttcatcatttaataatgaatcacatcttttcttttttgttacacgtcataaagaaagcagaccatttatttataagtccccattgcgtcctaaaaacacgatcataaaaaaactagaagccctttatattgttttttattgaacgtgcggagcatcccctgattcgtatagttctttcgctttttcctccccgaatgtagttaaaatataatgttgctcttctaacgcatccattgctctagttgctttacaaacgctatcttcttgagcatccgagaaataattgtgatcttctacaattttactaaaatcttttttcgcccatctatcagcaattgctaaaagttcatttttcttcgcaaagctactcttatttataatttcttttaattttttagcattactttgaatcattgggatagagcccgattttcgttctgccaccactttttgatgagtcatgcgatgcatcgctgtaatgacttcgctttcagtagaattttcagtaacatacacatcaacaaagaccccatctacctctctacctactattgtttggtcttcttttttatctatttgagcgctcacttctttatctacgggattatctgcaagttctaacattccaaatgtaactgcaatagcaagaactcccatagctgctactattcctagccaagttgaaattttattttccattccccttctccctatctatatctattttattgccttataaaaaactcacttacatgtaatattactaaaaataggttttattttccatactatcaaataatctctttttctcaacaaaataaaaagaccaacgaattataacattcattggtctttaaataaaaagttcattggttttaaatttgatatcgagtatcaatttcaagaattattaagctttactaaaacttaaatcccttactacttttactctcaactagctttatgttcaagtctcagcttatccgcaaccattgcgataaactcagaattcgtagagttttgcttttgacatggatactgtataaccgaataaggacgaaatagaatcaatattcccacggctccaagctacttcaattgcgtgacgaattgcgcgctccacacggcttgctgttgtattatatttctttgcgatatctggatacaatactttcgtaatcgatcctaataattcgatatcattgtataccatggagattgcttctcgtaaatacatatatcctttaatatgagcgggtacaccaatttcatgaatgatactcgtaatactcgcatctaagtttttcggttttccatctactgttgtggctgatcggaatgatggtagtggacgcttaatcatagtgtttgctttaccactcacttgacgaatatgactcgttaaattctccatatcaaatggttttaatatgaaatatgaggcacctaagtcaactgcttttttcgtcacatcttcttggccaaatgctgtcaacataattacgctaggctgttttaacctttcaatatgtcgcattttctccaatacagctaaaccatctaagtgtggcataataatgtctaaaacgagtacatcaggttgcttatctgttaataagtttaaacactcttgaccattataagcagtaccgattacttccatatcatcttgagcggctacatagctctctaacattgatactagttctttattatcatccacaagacatactttaattttctccacagcttttcctcccttaccgaatcgattctccgacatgtgtatccttctaggctacatgaattgttcgacaattgtgtgaaaattcccttttaaagtttcttactttccgataaaatcacaaaaaaatatgtttatcgctcatttattccctttcgcaacacattccatcatagaaatacaacgaaacgttcaaccctttccttttattttacaacaaaaaacacctcttgcggagcttttacaaaatttcaacgaatttttcaacagaaaaagcgagctaataatatatattagctcgcttttttctcttgatcataaatattaattccagcttgatgtaacatccattcaatatgaacaccatatcctgatgttggatcatttacaaatacatgtgtaacagcaccaattacttttccattttgtacaattggacttccgctcattccttgtacgataccgcccgttttcgctaatagacgtttatctgttacttttattaccataccctttgtggctgggaatttttgctgcactgtactaacaacttcaatatcaaacgcttctactttatcttgatcaataactgttaatatttttgccggtccttcttttacttgatgagataatgcgataggcattgctttatccattataccgtttttcatattcgtatttaattttccaaaaataccatatggactattaattgtaatattgccaatcacttcacggtctggtgagaatcttgctaatttctcccctggattcccatgactacctctttcaattgatgtaactgtcgagcgcataatttgtccatcttcgacttgaatcggctttttcgtatcattatcagaaataacatgaccaagtgccccatatttcatagaatctggatgaacaaatgtcatcgttccaattccagctgccgaatcacggatatacaagccaattcgataagacgattcaccgttgtctttttgtggagttagcttcgtacgaatatattttccatctcttaacaatacaagagtaagcggttcacctgtttctccactattatgaataaacggtgctacatcactcattctttcaattgttttaccattaatttcagtaatcatatctccaatttgtacacctgctgtttcaccaggagatattttacctttttcagtttgaattaaatgatggcctacaacaagtacaccttttgtatttaatttcacaccaattgattgtccacctggaatcactttaaaatcttttaacactttcacatttacttttttcactggaaaaccagcaagctgaaataccatatcagcttcaccattttgatgagaatttaccataagtccttgtttttgttcattcgaactcactgtaaatacatgacgatttgtggatgaagctttgaaaactggtaatgatgatatttctgattgttgcccttcaaaaacaacaagttgtttcggtgatgaaataaacgttcgaagcggtttaaaacatccaataaaaactaaagaaacaaggagacaaagacctattatttttcgaaatttttctaatttcaacttgttcactctcctcgctcctaccccacattcagcctcttggcttcactttttaatctctccttgcagtgctttatttataaccggaagaattaagaaatcgtcatttgagaaaaaaagctatccattactggatagcctctgctgtctgtttaaaatgatgcgcttgcgtaagtaattctttcgcatgctctgtcgttaaatctgtgatttccacaccagaaatcattcgagctatttctgttactttatcctccatagttaaaacagtaactgatgtaattgtccgatcattcgctacttgttttcgaataaataaatgtgaatccgccattgaagctacttgaggtaagtgcgtaatacaaagtacttgcgagtttactgatactcgataaattttttccgcaatagcctgtgcgacccggccacttacaacacgtatccacttcatca

SEQ ID NO: 1051 - DNA, 2597 bp, Bacillus thuringiensis
atgagtattattttacgcccgtcaatccctgttccttttggtgaatgccattttctgcttaaacgacctcttcccgctgtttgttcttctgctacaacgacagttccttcttctgcaccttcataagcaagttttgctgcaatgtgctgcgttgattcaacagtttcttcaaaatacactgttctaccaatccgcttcgtttgtagccctaactgaatttcattagcagtcactttgtctggcttacttgcaattcggtaacctaatcggcgcacagcttcaagttcatatccctcactccgcagatcctccatatgtttccacacagcagttcttgaacaaccaagtttatcactaattgtttggccggatacaaactcgccatccgcttcagaaaaaacttgcaataactgctttcttatagtagattgcatccttgcagccactcccttatacgctctttctcattaactacgtttccttgtacgattgcttcttcgattttctgaagcatttcagcaacccacggaccaggctttttgtttgcccagtttaataaatcattaccagtcacattcatttcttgacgttcctggattggcaatgcatgaaacattaattgtactcgttcaacagatgtagggtcatagctttcaatcatcgcttcatatactctctctgccatttcagcgatatgaattcccgttttataaagaaggactgtatcccaatccttctcctttctagtacgaattgccaataaaactgcaacaatatcttttatttttttattcgaaaacttccattgacgtaaaaagacagatggatgttcttctccgatacaatataagaaaaatgcccacgcctcaatatccgtttcgaaagaatcccatttatactgcgtagcttttaacagtctctcttctgacatttgtaaatatggcaaatgagaaaatagcttcgtctctactaattctttgagacctttcacacaatatgtaccagttaacagtttctcaaactctactgtaatacgctcaattgctatatgttctagcaaatgcccatgcgtttcaatcgcttgcttcgttttcatttctaatgaaaaacctaacgtgcttacaaaccgaataccacgcatcattcgcagggcatcttcttgaaaacgatccgcagcatttccaactgtcacaatttctctctgttgaatggcttcctgtccagcaaataaatcaaccattttgccttcttctgtcatagcaattgcattcatcgtgaaatcacgacgttttaaatcctcttctaatgaacgaacaaattgaacactactaggtcttcgaaaatcttcatattcgctttctgttcgaaaagtagttacctcataaggctcaccattttctacaacaattacagttccatgctcaagaccaacaggaacatttcttgggaatatagccatcacttcttctggtagagcagatgtcgcaatatcaatatctccaatcggcctatcgataataagatctcgtacgctcccaccaacaaagtaagcctcatgtccttgttgctttaatgtctcaataatagaactagcttttttaaatctttccatttttgtcatcccttagtacgtcatagtaaatcgtttcatattgtgaaacaattttttctgagcgaaattgctcataaacactttctcttgctcgttctcccatattacggtgaagttcctcgtcctttaatagctgaatagcttgatttgccactcctgttgtatcgccaacttcacataaatatcctgtttccccgtgttgaataacctctggaatacctccaacccgcgttccgatacaaggtacaccacacgccattgcttctaataaaacaagaccaaaactttccttctctgatagaagcaacattaaatcactcatcgcaagtagttctgcaacattatcttgcttccctaggaataaaacgcgatcttcaatatgtaaattcttcactatctgtaaaatcgtacagaattctggtccgtctccaacaagaagcaacttcgcatctacttctttaacaattttagcaaatgcctgaacaacatcctgcacacgtttcactttacggaaattcgaaatatgaataagtactttttcactctcacttataccatattctttctttaattgagacatattacgcttgaaatatacacgttcgtctataaagttatataccgtttgaatttctttacttggttttacaagctcatgtgtttcgttaattaatgaatgcgagacagcagtgacaacatctgattgctcaataccaaaacgaattaaattatttaacgaagggtcggaacctaacacagtaatatctgttccatgtaaggttgtaacaattttaatacgctctccgatcatttgttttgctaaatatgcacaaattgcatgtggtattgcgtaatgcacatgtacaatgtctaagttttctctttgtgcaacctcggccattgtactggctagcgctaaatagtatggagaaaattcaaatacagagtattgattggccgacgaggcgtgaatatcaatgtttgg

SEQ ID NO: 1052 - DNA, 4175 bp, Bacillus thuringiensis
  unsure (1)...(4175): unsure at all n locations
tgtaagtacactttttaaatttgttattatactccttgttttgcttactttaaagcgctctgggtacggtaactgtatcgggaatttctatcaattttacttaattgagcattatggtttatctataaaaaatgcccagtatttcgtattcgcatttatgattgctggtgtgttaggcactttcttcgggggaccgttagcagatcgatttggtaagaaaaacatcatcgtattttcaatgttaggttcagcgccacttgcgctgttattaccacatgtctcacttgtgtgggtcgtacctttatttttatgtatcggttttattagttcaagtagttttagtgtaattgttgtatacgcgcaagagcttgttccgggaaaagtagggatggtatcaggtctaattgtaggtcttgcgttcggccttggtgctctaggtgctgtagtactaggaaagttagctgatatatatagccttcagttcattatgatattatgtagttgtttaccgttaattggacttacttcatggttattaccaagtgataagaaaacgatagaataggggatgcactatgaaattatgtgaaaacgtaacagaattaataggagatacacctgtcgtccgattatctaaatttattccggaagacgcagcggacgtgtatgtgaaactagaaatgtttaatccatcacgtagtgtgaaagaccgtgctgcttataatttacttcacgttgcagaagaaaatggtctcattaaaccaggggatacaattattgaaccgacaagcgggaatacaggaattggtttagcgatgaacgcagcagctaaagggtataaagcgattttaattatgccagacaatatgtcaaaagagcgtattaatttattgaaagcatacggggcagaagtagttttaacaccagcagaacaaagaatgccaggagcaattgcgaaggcgttagaactgcaaaaacaaataccgaatagttttatcccgcaacaatttgaaaatccagctaatccgaatattcaccgttatacgactgcacttgaaatttacgaacaaatggagggagagcttgatgcttttgttgcaacggcaggaacaggcggaacgattacaggggctggtgaaacgttaaaagagaaattgccaaacttatatattgcagtagtggaaccgaaaggatctcccgttttatccggtggtgtaccaggtcctcataaactagtaggaacaagcccaggatttattccgaaaaacttaaatacagaagtgtataacgaaattattcaaattgcagacgaagaggctttaacgacaatgagaaacttagctagacaagaaggattattagttgggccatcttctggagcatctgtttacgctgcaatcatgatagcgaaacgtctaggcgttggtaaaaaagttttatgtattgcgcctgatacaggtgaacgttatttgagcatggggttatttgaataaaaaggatagaaacaccttaatagtgaatagctgctattaaggtgtttgttttatggaatgaagagggggagaagaacaatgaaactattaaaaccaatccatgaatatagtgagcgtattacggcgtatagacaagcgtttttacactcaggggaacaaccacatggaagtagttctttacaaaactttgattctcttgatgaatggtttgaaaaagtgagtaaacaagaactaggagaaaatttactagctaatcgagtgccatctagtcagtttttaagttttgaaaaaggggaacttataggttttttgaatattagacatagattaaatccagaattattacgggaaagcggtcatattggatatagtgtccatccgaataaacgtcgccacggttacgctacgaaacaactacaacttgcattagctgaagcgcaaaaattaggattgcagaaagtattaataacttgcgataaatccaatatcggttctgctaaaacgattcaaaaggttggaggtgtgttagaaaatgaagtagtttcttctcgtactggtgaagttattcagcgctattggatagaaatatgattaagtaggaatttgaaaaggtaatgcaagctgtaatatcgaaatagataaatgaaatataggggattactgcaattttagggggaaatgaaatgggattaaaagagagagcgatagagatgtcagagatttataggcaaaatccgaaagtagaagctattattttagcgggttcagtagctagaaagcttgaagatgaacattcagatatagaattacatattttatggtcaacaccgccggaagatgaggatcgtagggcccctatttatcatattgatgggaaaatattatcgtatcatccgtatgaggaagaagaatggtcggaaacgtatttaacgaaagagggaattaaattagagattagtaactttttaacagagacagtagagaaagtaatttcggatgtggtggatcaatatgatataaattatgaaaaacaatgtattgtatcatccattcatgatggtgttagtttgtatggagaagggaaagcgaatgaattaaaagaaaaagtagcggcatatccagatgaactagcaaaactgatgatttcagaaaatctatggttaagtaatcgttggcacaatcgaaaggcgcttttaaaacggaaagattggcttatgctttatgacgttatttgcgaagtacaaaggaacgtattcggtgttttatttggtttgaataaaatgtacgtacatcatccagcgtttaaatggatgcctaataatgtggaacgaatgactattaaacctgaaaaattatatgaacgtatggcggacacattaatagggaatccagaaaaaagtgtgcaggagttagagttgctaatagaagaagtgttgcaacaagttcatacatacgcgccaggagtaaatgtggatgagcaagaaaaatctattttttattttgtgaaatagaaaatagtaataagggggaagttatgggtttttttaataggttttttaaaaaagttgaaaaagtaaatgagcaagaagctactcttcatgaattaagtgaagaattgtatgttgaatcaccggtagaggaagcgactagttactgggtatcaatggcacaaaatataattgttaatgctgtaaaagcggctgacaatgatgtggaacgtgccttcgtgttattgaatttgaagaaaggtgaggcttcatttgatattttttatcaaataaatgggcaattgtatttctgggatcagctagaaaatgagacgataagaaatagaattcagaacgagttgttaccgcaagctccagaagtttcaaatgcagtaaatgagcaatttcgtggagctgatcaccctataatttcgttcgcacaattgcagtttgaatgggaaacgaaagcctggttctcacatgtaatttgggaagatagccttgctgctcaattgcccaaaactcaaattctaaatgaatggtttcgtgtaattaaagaagaaacgaaaaatagaccactggatagtgatgcgaaattttcttggtatccatcaaactcttaaaaaatgaatacagagagacaggttatgtttctagatgatttgtattattgaataagtatcaataatacgtaattctttttctattgcctgttagaattcgttatgtactaagctacttgttttctaaactaaaacttatatttcgaatttttaaatagattgtaatacataaaaattcgaaatataagttgacactatttttaatgtgtgataaaaatgatagtaatcaattcggaaaataatatttgggcaatgaaagggtatagtagtgaatatctccctatttcagagagctgatggttggtgtgaatcagtatatagattattcatgaagttcgtcctggagcatctttcataaatctcatattttgaggaaatgaaagacggtagtttataccgttatcaaataaagtggtgaagattttttcacaactagggtggtaccgcgatatttatcgtccctacgtatttacgtagggacgttttttatttaggtcctaactatggtgccccttcatatctagggtggtnccgcgatataattntagtccctncgtttttgcgtaggggag

SEQ ID NO: 1053 - DNA, 1529 bp, Bacillus thuringiensis
tttcccatttagttcgctctccaagcgtatactatagtggcaaagtggataaaaacggaaaacgtggttttactgctactgtaattccaaaccgcggagcttggttagagtatgagacagatgctaaggatgttgtatatgtgcgtattgaccgtacgcgtaaacttcctgtaactgttttgttacgcgcattagggtttggctctgatcaagaaatcaccgagcttttaggtgataacgaatacttaagcaacacattagaaaaagacaacacagatagcacagaaaaagcattgcttgaaatttatgagcgtctacgtcctggtgaaccaccaacagtagaaaatgctaagagcttacttgtgtctcgtttcttcgatccaaagcgctacgatttagcaaatgtaggtcgctataagatcaacaagaagttacacattaaaaacagattgtttaatcaacgtttagctgaaacattagtggatccagaaactggtgaaattttagcggcagaaggaacaatcttagatcgtcgtacacttgatcgcattttaccttacttagagaaaaacattggattcaaaacagcgaaaccaatgggtggagtggtagaaggcgatgttgagctgcaatctattaagatttatgctcctgagtcggaaggcgaacgcgtaattaatgtaattggtaatgcaaacattactcgtgatgtgaaacacatcacaccaggtgatatccttgcttctatcagttacttcttcaacctactatacaaagtaggggatacagatgatattgaccatttaggaaaccgtcgtctgcgttctgttggagaactattacaaaatcaattccgtatcggtctttctcgtatggaacgtgttgttcgtgagagaatgtcgatccaagatacaaatgcgattacaccacaggcactaattaatattcgtcctgttattgcatctattaaagagttcttcggaagttctcagttatttcaatttatggaccaaacaaatccattagcagagttaactcacaaacgaagactatctgcattaggacctggtggtttaacgcgtgagcgcgcaggctttgaagtgcgtgacgttcattactctcactacggtcgtatgtgtccgattgaaacaccagagggaccaaacatcggtttgattaactcattatcttcgttcgcgaaagtaaatgagtttggtttcattgaaacaccataccgtcgtgttgacccagaaactggtcttgtaacagggcatgttgattacttaacagcagatgaagaagataattatgttgtagcccaagcgaatatgaaattatctgacgaaggtgaattcctaagtgaagatatcgtagctcgtttccgtggtgaaaacattgtcacaaatagagaacgcatcgactacatggatgtatctccaaaacaagtagtgtcggcagcgacagcttgtattccgttcttagaaaacgatgactctaaccgcgcacttatgggagcgaacatgcaacgt

SEQ ID NO: 1054 - DNA, 3108 bp, Bacillus thuringiensis
aacaaataaaaatcttcttataataagttgaagtacattatattaaaagttaaataacgaaaaacgttgatagagaagagtaacttacaaaatcgccatatagggagagagtgccgtagactgaaagcattcttatggtagacggaagtgaattcacctctggagttgacgccaggaccatgtatatgtaaaggcgttccggtcagaattgatcgttataactaatgagtgggcagacttgttctgtcaatttagggtggtaccgcgaatttacctcgtccctttttgggagcgaggtttttttatttttaaaattaggagggttccaaaatggaagcacgtttaaaagagctaaagcaaaaagcgttagagcttattgaagaagcgaaagagctaaagggcttaaacgacgtacgcgtagcgtatttaggaaaaaaaggcccaattacagaagtattacgcggcatgggaaaattgtcagcagaagagcgtccacgtatgggagcattagtaaatgaagtgcgtgaagcgattcaaacgcgtttagatgacaaaattagtaacttagaaaaagcagtaatcgaagcgaaattagctactgaaacaatcgatgttacactgccaggtcgtcctgttgaaacaggttgtcaccatccgttaacagctgttgttgagcaaattgaagatgtattcatcggtatgggttatgaagtagctgaaggaacagaagtagaaaaagactactacaacttcgaagcactaaacttaccgaaagatcacccagcgcgtgatatgcaagatacattctacattacagaagaaacgttactacgtacacatacatcttctgtgcaagcacgtacgatggaaaataataaagaaaaaggcccaatcaaaattatttgtcctggtaaagtgtatcgccgtgatgacgacgatgcgacgcattcgcatcagttcatgcaaattgaaggtcttgtaattgataaaaacattcgtatgagtgacttaaaaggtacactgcaagtattcgtgaaaaagatgttcggtgaagatcgtgaaatccgtcttcgtccaagtttcttcccattcacagagccatctgtagagatggatatttcttgtatgatgtgtcatggcaaaggttgcggcacttgtaaaggaactggctggattgaaattctaggcgcaggtatggttcacccgaacgtacttgaaatggctggttatgattcaaaagaatatcaaggtttcgcattcggtatgggcgcagagcgtatcgcaatgttgaaatacggagtagatgacattcgtcatttctatacaaatgatgtacgtttcttacaacaattcaaacgagcgtaagggaaggagaggataaatatgttcgtatcatatcgttggttacaagagtatgtagatattaaagatgtaacagcacaagaactagcagacaaaatcacgaaaagtggtattgaagtagaaggcgttgaagtattaaataaaggtgtaaaaggtgttgtagttggtcacgtattagaatgtgaaaaacacccagaagctgataaattaagcaaatgcttaatcgatatcggtgaagaagagccagttcaaattatttgtggagctgctaacattgcaaaaggtttaaaagtaccagttgcaaaagttggtgctgtacttcctggtaacttcaaaattaaaaaagcaaaactacgtggtgaagcttctcacggtatggtttgtgctcttcaagagcttggcattgatggaaagttagtttcaaaagaatatgcagatggtatcttcatcttcccaagtgacgctgaagttggtgcagatgcacttgaaattttaaacttacacgatgaagtacttgagcttggtttaacaccaaaccgtgcagattgcctaaacatgttaggtgttgcatatgaagtagctgctatttatggccgcgaagtaaaacttccagctatcgacttacaagaaacagcagaaaaaacttctgattatatttctgtaagtgtagaagcgaaagaagaaaacccgttatacattgcaaaaatggttaaaaacgtaaagattggtccatcaccaatgtggatgcaaactcgtcttatggcagctggcattcgtccaattaccaacgtagttgatattacaaactacattttaatggaatacggtcaaccgttacatgcattcgattacgataaattaggttcaaaagaaatcgttgttcgtcttgcaaaagaaggcgaaaaaattgaaacgttagatgatcaagagcgtacattacaaagccaccatcttgtaattacaaacggcacgaaagctttagctgttgctggtgtaatgggcggggcggattctgaagttacaaatgagacagtaaacgttctaattgagtctgcatactttgcaggtcaaacagtacgtcgtacatcaaaagacttaggtcttcgtagtgaatcaagtgcacgtttcgaaaaaggaatcgatccaacacgtacatttgaagcaattcaacacgcagctgctttaatggcgaaatatgctggcggtgaagcacttgaaggtgtagtagaagctgacaacttacaagtacaagagcgtacagtatctgttactgctgaaaaagtaaaccgtgtattaggtacaaatatttctgcgagtgaaatgggtacaatgttcacaaacttgaaattcccatttacagaagtagaaggaacattccatgtaaatgtaccagcacgtcgtcctgatattacaatttcagaagacttagtagaagaagtgggccgtctatacggttatgaccacattccagttacattaccttctggaacgatgactcgtggtaaattaacatcagcacaaacgaaacgtcgtaaagtacgccgcttcttagagggtgctggtttatatgaagcaattacgtattcattaacaagcgctgtcaaagcgaaacaatatatggttgagccaagcgaaaaggcgcctgtaggtcttgcacttccaatgagtgaagaacgtagccaacttcgtttaagcttagtaccgcaattactagaagcagtttcatgcaatgtcgctcgtaaaaac

SEQ ID NO: 1055 - DNA, 3613 bp, Bacillus thuringiensis
tgacaatgttagacgatgaagtagtaaataaattagataatgaatatcaaactgaaaaaccttctgttgcagatgagtttgaagtagaagaaaaagttgttcgcagtaaaaagaacagcaataagaaaaagaaaaaaggcaaaggaaacgaagacaaacgtcaagagaactttgctggtagacaacaaactcaaattgtagaaacaccagataaaattactttctctggaagccttacagtaggagatcttgctaaaaaattaagcaaagagccatctgaaattattaagaagctcttcatgcttggaattatggcaacaattaaccaagacttggataaagatacaattgagttaattgctaacgactacggtattgaagtagaagaagaagtaattgtaagcgagactgagtttgaaacattcattgatgagcaagatgatgaagagaacttaaaagaacgtccagctgtagttacaatcatgggacacgttgaccatggtaaaacaacattactggattctattcgtaactcaaaagtaactgcaggcgaagcgggtggaattactcagcatatcggtgcatatcaagttgaagtaaacgataagaagattacattcttagatacacctggtcacgcagcatttacaacgatgcgtgctcgtggagcacaagtaacggatattacaatccttgttgttgcagcggatgacggtgttatgccacaaacggttgaagcaattaaccatgcgaaggcagcaggagtaccaattattgttgctgtgaataaaatggataaaccagctgcaaaccctgatcgcgtaatgcaagaactaactgaatatgaattagttccagaagcttggggcggagatactattttcgtaccaatttctgcaattcaaggcgaaggcattgacaacttactagaaatgatccttcttgtaagtgaagtagaagaatataaagcaaatccaaaccgctatgcaactggtacagtaatcgaagcacagcttgataaaggtaaaggaactatcgcgacattacttgttcaaaatggtacgcttcgagttggagatccaatcgttgttggaacttcattcggacgtgttcgtgcaatggtaagtgatattggtcgtcgtgtaaaagttgctggtccatcaactcctgttgaaattactggtttaaacgaagtaccacaggctggagatcgtttcatggcatttgctgatgagaagaaagctcgtcaaattggtgaatcacgtgcacaagaagcgttagttgcacaacgtggtgagaaatctaaattaagccttgaagatttattccaacaaatccaagagggcgatgtaaaagaaattaacttaatcgtaaaagcagacgtacaaggttctgttgaagcgatggcagcatcacttcgtaaaattgatgttgaaggcgtaaaagttaaaatcattcacactggtgtaggtgcgattacagaatctgatatcattttagcttctgcatctaatgcaattgtaattggatttaacgtacgtccagatgtgaacgcgaagcgtacagctgaattagagaacgttgatattcgtttacaccgtattatttataaagtaatcgaagagattgaagcagctatgcaaggtatgcctgttccagaattcgaagaaaaagtaatcggtcaagcagaagttcgtcaaacgtttaaagtaacaaaagttggaacaatcgcaggttgttacgtaacagacggtaaaattacgcgtgatagtggcgtacgtattatccgtgacggcgtagtaattttcgaaggacaacttgatacgttaaaacgtttcaaagacgacgtaaaagaagttgcacaaaactatgagtgtggtattacaattgagagatataatgatcttaaagaaggggacatcattgaagcgtacattatggaagaagtgaagcgatgattatcgcttcactctcattcgagtgtatgatttacgatgtgcattctttaaaagagaaacgtgcaattttacaacgtgtgttaactcgtgtaaaacagcgctataatgtagctgtttctgaagttgggcaccaagatgtatggcaacgtacagaaattgcaattgtttccgtatcctcaaatcgtgttatctgtgagaaagaaatgaatcgtgtacttgagtacatcgattcatttcctgaaattgaacgtacaataacacatttggaatggtattgaatgaggtgaagagttatgaaattacgtgcgaaccgtgtgggcgagcaaatgaaaaaagaattaggcgacattatcagtcgtaaaattaaagacccacgtattggatttgttacagtaactgatgtacaagtgagtggtgatttacaaattgctaaagtatatatttctgttttaggtgatgaagaacagaaagaaaatactttaaaaggtttagcgaaggcaaaaggctttattcgttcagaaattggccaacgtattcgtcttcgtaaaacaccagaaattacctttgagtttgatgagtctatcggatatggtcatcgaattgatacacttttacatgaaattaataaagacggtaaacgtgaagaataatggatagacatttgtctatccattttttcaatgcaaaataagttttggatatttactacgagagaattatgatgaggtgaacatatatggaaggtgtagtattattacataagccaaaaggcatgacatcacatgattgtgtatttaaattaagaaagatattgcgagaaaagagaattggtcatacgggaacattagaccctgatgtaacaggagtattaccaatttgcgttggaagagcaacgaaaattgcacaatttttaacaagtgaaacgaaaacatatgaaggtgaagtaacattagggttttcaacgacaactgaagatgcttctggtgaggttgttgaaacgaaaaatgtagatcgtactattactcgtaaggaagtagagaaagtccttgcggaattaacaggcacgattgaacaaatgccaccaatgttctcggctgtaaaagtaaacgggaaaaaattatacgaatatgcaagagcagggcaagaggtggaacgtccagttcgtacaattacaattcatgaattcatattacttgatgatcgtgaagtttttgaaggagaaaatatttcattccgtttccgtgtaacgtgtagtaaaggaacatatgtaagaacgttagctgtaatgatcggggaaaaacttggtttcccatcacatatgtcgcaccttataagaacggcatctggtgaatttttattagaagattgcatatcatttgaagaaattgaagaaaacgtgcaaaatggaacagtagagtctatcttcatttcaattgatgaagcattaagtaagtttccaaaaatggttgtagatgaaaagcaagcagagaaaataaagaatggtatgttcttaaaaaatgaattagaaataacagcaccatttattacagtgtttgataaaaatgatcgttgcttagccatttatgaacatcatccgccacatcctggtatgttaaagccgataaaaaaacttgtgaataatcaagaactaaagc

SEQ ID NO: 1056 - DNA, 4208 bp, Bacillus thuringiensis
tttctatcaaattgttgaaccagaacttgcgacatatggtatttcaaactatgaatatggtgttcgtaatattacttcagcaacgatgcgtcaaattatcggtaaaatggaactggatgaaacgttatctggtcgtgaaaaaatttcaacagaaatccgcttagcgcttgatgaagcaacagaaaaatggggcgtacgtattgaacgtgtcgaagttgttgatattaacccgccaaaagatgtgcaagcatcaatggaaaaacaaatgaaggctgagcgtaataaacgtgcgattattttagaagctgaagcagcaaaacaagataaagtccttcgtgctgaaggggaaaagcaaagtaaaatcttgatggctgaaggggataaagaagcgcgtattcgcgaagctgaaggtataaaagaagcaaaagaattagaagcgcaaggggaagcaagggcaattgaagaaatcgcaaaagcagaacaaaatcgtattgaattgcttcgtgaagcgaatttggatgagcgtatacttgcttacaaatcatttgaatcattagctgaagttgcaaaaggaccagcaaataaagtctttattccgtctaatgcaattgaaacacttggtactcttggggcaattggagaaatatttaaagaaaaacaagtgaagaaactaccttcaaatgatacaggaaaagaacaataaaagtgaggaagagaaatgggataccatttctcttttttttgcgtatattccgaaaagcttgtacatatccatgtataaagaaggtgatgcagtgaaaaagtatgcaactcgaatacatgggaagaaactgatttcgttactccttttatatgcgctaatagtaattatgatagcgtcgattttgacgtcatttttacatacaatgaaatcgaattatgcaaatcaatggtttggaaaagtatcgatgcaaggttttgttcaaatgatagaaagtgagaatcgctattacggatttgattattttaagaagaataaaagagagtcagttggaaatttaatgttctctattgcgacagatttgaaaattaaagatttaagaacattcgtcggtaaagaagtacctggtatgtcaaagtattattctaatattatcgtagctggggaagggacaaacttgacgaatatcccaaatgaatctagtgtaccgattgaagaagtaacgaaagaacgggaagtagcaaaagataaagttacagaagcggaaaagaataatccggttcagaaaaagaacggagcgaaaaaaggtgaaagtgcagtatatatttatcatacacatagctgggaatccttctttccattattaccaggggctacggatccatcaagtccagatgtaaatgtgtccttactagggaaacgtatgaaagagcaacttgaaggacaaggaattccggtagttcacgataaaacgaatatgggtgatttattagcgagtaaaaaatggaaatggccgcaatcatataaagcgtctcatgaatatgtaaaagaagcattagcacaaaataataaaattgcgtttccaattgatatacaccgtgacgatcagcgtaagaaagtaacaacaaaagtaattaacggaaaatcgtatgcaagattatattttataattgggatggaaaatgaaggccgtgctgaaaatgaaaaaattgcaagagcgatcaatagttatttagatgaaaactactacggattaagtagagggatttttcccaagtataaaaaagatggaaatggcgtttataatcaagatttatcgaaaaatgcgatgttaattgaagttggtggtgttgataatacgttagatgaattatataacacaattgatgtgttaacagaagcgtttagtaaatattattggaatgatgcggaaaaagtgaatggatgagggacgggagaccgttccttttttattttggaatcttaaaatgtgatataatggaattttatgaatgttaaataaagggagagagaaacatgcaaatactactaatacgccacggagaatcagaagctgatattttacatgtgcatgaaggtcgagctgattttgagttaactgacaaagggagacaacaagtacaaagacttgtacagaaagtgaaaaaagattttgcgccagatttcatttgggcaagcacattaaaacgcgctcgtgaaacgggtgaaatattagcagaagcaattggttgtccaattcaattagaagaggaattaatggagtttaataatggagtgcaagcaggcgtatcatttgaagaagcaaagaaatatccagagccaaagtttcttcatgaccgttttgaaaacggagaatcatttattgagtttcgaatgagaatagaaggaatcttttctaaaattatgatagagaatacatatgatcgaattgcaattgttgcccatggaggcgtaattaatagtctattacgtgcatttttcaaaatgccaatttcaatggactactatttcaaaatgggagatacgggaataagtttaattgaaattgagggtgaacaaaaaacggtgcatttcattaatgatacgaatcatttggacgggatgtaaagacttatgtacaaagttgtatttttcgatgttgacggtacgttattaagtgagattgatagaagcatgcacgaaagtacaaaagaagcgatacgaaggttaatagataaaggaattcacgtagttgttacaactggaagaccgtatagtttatgctcacaatttaaggaactaggtataaatacgtttatttcagcaaatggtgcacatataaaatgtgggaaagaagttatacataaatcagtactttcaagcgaaatcgttcatgatatttcaaattttgctgaattacatggtcacagtgtttcttactttacagaagaatttgcaatgaataatattgcttccaaagatgaacgtgtcatgcgagcgttaaatgaaactttaaatttagagcggtatcctgacaaagttagaaacttatcagatgagatgtattgcatatgtctgtatgctgatgatacagaagctcaaaaattcattgaaagatatccagcacttacgtttgagcgttttcatggttacgttataaatgtattggaagatagtaaagtatcgaagctaactgcaattcaaaaagtattggaacatttaaacattagtaaattagaagccattgcttttggcgatggtggaaatgatattgagatgttgcagtatgtaggattaggagttgcgatgggaaatggtggagaggagttgaagagaagggctgatttcgttacaacgaaggcgagtgaaggcggaatttcttatgccttaaagaagttgcgaattatttaaaactaatagttagtcagtgtgaaaaatcctgttttaataatggcttttgttaatatgtatactgttttagggaattatttgagctctcctacttacaatttaactgcagaacaaatcctttattttcgcttagcagggctgtttggtatgttgctgtcaccacttgcaggtcttttaacaaagaggtttgaagtaaggaaagttcttcaaggaggattgttgattgttatttttagtctaagttcaatgggctttgtttcggatctatctctacttgtaatgatgagtgtctgttttgtaataggtattgctatatccgttccgtctttagtttctcttggaggtcaattaggagggaaagcaaggggaatatacttttattttatttttaggtactagtataggacctatcatttctatttatcttatgaaaataggaggttatgctcaaacatttattttattaggaatgatactttttattggttttgtagctaattaatgaatgagtggaaaatcactcaaataaaggaatgcgaggatctttcatatgctcgcataataaaatatgaatttgtccacgatgatgataaaagtgtgcaacgatttcaagtaaccattcaaagcgcgaataagaaatcccccaataggcagtcataacttttgctaattctatttgggagtaggaaagaaatgttttagagagaaggttgtatccttcaatcatcgtttgttgcatgtgagcaactgttacgggtgtatgttctatataaaaggtatgtaattctttttctgaaataccattttaaatgagtaa

SEQ ID NO: 1057 - DNA, 2134 bp, Bacillus thuringiensis
gccatgtgtatggaaaactcattgccattattatatgttcttccacgatgtttaagatgcgccaacttctgttgcaaaagcacaaaagagaactaagcgaatataaagcaattgggatgattcaagatcatctatccctgttatatcaagcgatacagagaaacacccgtataataacaaaggttttaatccgcctgtttaccctactaaagaaaaatggccggaaatcccatcgatatgagaagaaaactatctttgatattatgggtgttgtctatgagtataatggattgagaaaacaaaagaaagctgcataagaaaaaaatgaaacccgttagggtttatttcgtatgctcatttttaagaggattatactgtttaaaagtttgttcatttcaattaatggaaaaccgtagagtttctatccttaagttgatgggcatgggttatagccccttactgtaatcttttgtcataaccgtcactattacgagaatacctctaaatgagcacttcacagcacttcgctatcattttaaatcatatctttttgaaatgcctctaacgcaatatgaacagtctcatctgaaatagatacgacattcactaccccatattcctgcataagcaccatatgaattgctcctgcatttgctttcttatcttgtttcatcaattgaacgaggcgctctacattcaaatcccttggcatttttggatagccgtatttcaagaaccactgcttcatatcttcataagcaagatcaaccttgtacacttgctcacttaaaaatatggcgaataacattccaaccgctacaccgtcaccgtgagtaatatttccataccctagctctttttcaagagcatgtcctaacgtatgtccaaagttcaaatgagcacgtacacccttctctgtttcatcttgtgacacaacatttgcctttacaggaatcgccttcgttaatatatggattaacttctcatcatgaagatccgctaatgtttgcacttcttcttttaaccaatggtatagctccacatcaccgataagagcatgctttatcacctctgcataacctgaacgccactctttttcaggaagagactgtaaaaacggtgtatgatatacaactgcttctggctgatggaatgcaccaatcatatttttacctaacggatggttaatcgctactttcccacccacagcgctatcgtgcgctaataaagttgtcggaacctgcacaaagcgaataccacgcataaacgatgcagcaacaaaaccagctaaatctccaatcattccgcctccaagtgcaagaattaaagaatttctatctaatttattttcaagagctgacgtatgagccgcatagaaattttcgaaagacttctctttttcgccacttggtacaacaaacgaaaacacgtgctgctctacttgtaatgcatcgataactgtctgtaaatgtagtgatgcaacagcttcatctgaaatgatcattacgttagataccgctggctgcatattttgaacgatcgttgttaagtttgacaacgcttctttaccaacatgtacatcatattcttttgatttcgtttgaatatgtatgtttcccattaaaatcccctcgcatattcattatgtttctcaatattttcacgaattagttccatacgatctaatccgaattgttctattaaagctgtcgctaattcccaagccacaaccgcttctgcaacgacactagctgctggcactgcacaactatctgaacgttcaatactcgctgtaaaaggctctttcgtatcaatatctacactttgaagaggtttataaagtgtaggtatcggtttcatcacaccgcgcacaacaattggcattccagtcgtcataccgccttctagtccacctgcattatttgttcttcgtgtatatccatgctcctcatcccacagaatttcatcatgaacttcacttcctggtctatgcgctgcttcaaaaccaattccaatctcgacacctttaaaagcattaatactcataattgcagctgctaatttcgcatccagttttcgatcataatgcacgtagctacctactccaattggcatcccttccacaattactaca

SEQ ID NO: 1058 - DNA, 3924 bp, Bacillus thuringiensis
cacctttgaaaattcctactagcttttctgaaataacagctagtacttcttttggatcttgaatgctacgacgttgtacttcttctttcaattggccaattaattccattaccgtcgcaacgccaacgtctgcaccgattaaaatttcttctaactcttccaagaaatcttcgtccactttacggtaacgatacactaaatcattcactttatccgcaaatgaatttctcgttttttctaatccttgtttaaatttctctgtaactgtatccgtttgttttgaaattttttcttttagttttttaaaaaaactcatactttcccatccttcctattcacttgcaataagttcttctccggcgtctaaacgaaccgaaacaagtttagatacccccgattcttgcattgttacaccgtacaacacatcagactcttccattgtaccttttctatgtgtaattacaataaactgcgtctcatcactgaatttctttaaatactgtgcaaaacgagctacattcgcctcatcaagggctgcctctacctcatctagtacacagaacggtactgggcgtacttttaaaataccaaataaaagcgcaattgctgttaaagcacgctctccacctgaaagtaaacctaagttctgcagtttcttccctggcggttgtgctacaatatcaatacccgtatttagtaaatcctctggattagtcattactaaatccgctctaccgcctccaaataattcagagaataccgattgaaactccattctaatgccttcaaacgtagtagaaaagcgttttttcatttcttcatccatttcggtaataagctggtgcaatgtcgctttcgcttcttctaagtcgtctctctgctctagtaagaatgtatgacgctccgctacacgttcatattcatcaattgcccctaggttcactgtacctaactcttctatggataatttgattaattttactttcttacgcgcatcttctgcaggcattgtcattgtatattttagttttgccgcttcaaatgaaatcgtatatgtttcacgtaaatgttgtaatctattttccaactctacatccagtcgatttattctcacttcttgatctttcaacatttcaagaacatatttatgtttacctgtcgtttctttcaaattgcgctctaaatgttctactctctcttgcaacgatacacgttgttcacgacgagagcgaattaattctgaagtttgattacgatcatatgctttcttctcaatcatattcgtaatttgctcttcaccacttgaattagatgtcatttcttgttttaagaacgctaaatcctctttcgtttttacaagtgtcgcatccgtttcttctttttccttcgtcaatcgttcaactttttctttttgattagataagcgttgttgcttttcagctgccagcacttttaactcagtcatttctttttgaactttttctttcgaagaatgttgctcacttttttgttttgttaaagctacaattttactatctaacttagtgatttcagcttgaagattcgttaaaaccccttctaactcctctttacgcccttgcatttttactcgatcttgtaaaaacccttcaatctctaaatcataaatagacaaccgatcattaatacgatgttcttctaattctaaacgattaatctcttctcttaatttctgctcatctacacgatctgcttctacagtttgccttagttcgcgtattttcacttctttttcttgaatctcttgttttactgctttaacaaagttttctaacttcgttgttttttcttccatatcagttaacttgcgagtccactcttccagttcacgttggcgtcctaataaagaagatttcgcttgctttaccgccccaccagtcatagaaccgccaggattcactacgtcgccttcgattgttacaatgcgataacggtattgcagttgtttcgccaactcatttgctccacgtaaatctttcgcaacaataacagtacctaataaatttgaaactacattttcatatttattgttgtactgcacaagttctgccgccacacctacaaacgatgggtgttgatttgcaatgcgtaattgctcaaatgataacgatctgcttttaataacagcttgcggtaaaaacgttgcacgtccatgtttattttgctttagaaatgcaatcgcattacgagcatgttcctctgtttgtacaacaatatgctgcatcgctgcacctagagcgatttccattgcaacttcgtattctttcggtaccgttaacagttccgcaacagcaccctcgataccttgcaacctattttctctagctttcaatacttcacgtacaccttgatagaatccagaataatcttcttgcatctcttcaagcatttcttttcgagaacgtgcctgttgcacaaattgatatgcttgatacagttttgtttcattttcactatactgcgtcttacatttcccaagcgccgcctctgtcttctgtatatttgagagaatgccagctactttttctttcgcttgttcgtaactttctacaagtttcgtctttttcgctgtaatttccatacgcatttctacatatttcgcattctcttcatctagacgctcgtttttagacgtttgctgtttcgattgttcttcaatcatagataattcattacgatgactagcttgttgatttaaaagctcaatatagtcaccttttaaattctcaatctgttcctctaaattgtcagcaaaagtagcaagcagttgctcattatcatgcaatttttgctccaactcttttacttcattcacaaattgcattaaagattctgtacttgactcaatctcaccatcgtaacttttagctttctcagttaattcaacaattaactgctcaagttgcgcacaatgcgtcgtagcattttgctttctttcttttaacaactcacgctgcccttctagtttttctagctctttactagaaagaagaagtacttcttgcaacgagtctacagactcgtctaccgcttgtaattgtcctcgtaattcctcaagctcttcttcacttttttgtaaattcgttgacattttagcttcttcgtttttattatgcccaaactgatttcgaagcgcttcccatttctcatgcaattcttcaatttcatgaacaataagcgcagcttctactttctctaattcttctttattctcaagataatctttcgcaatagaagcttgtctttctaaaggttctacttgactacttaattcatgaattatatcttgtacacgatttaagttttcttgtgtttctgctagtttcccttcagctttctttttgcgaagtttgtattttagtacgcctgccgcttcttcaaatacacctcgacgctcttgttagtgataggtaaggatttgaagttatctctaccttttcccccactccacaccgtacgtgagactttcacctcatacggcgctccatctaatttgtttattgtttaattttttctaaattacaagctcttcgatattggtttattcgtttaacttgttccacagtcaacgagtgtttttgaaagtaggattcaatcgtttgtttatttgtcatgtgaattaatctatgaatttctttatgaatgattctaagattttcatactcatctgttccgcctaatcccttcggaatatagtggtggcaatgtagctcacttgctggtaaaaattctttaagtatctcacattttccattcaacatagaataccttgccattcgattatccaagtgctctatactttcattagggatatttgcacttagtagtttcttaatttcgcgtaataaacaattatttaaaaaaatatgtttggcaatctttcgg

SEQ ID NO: 1059 - DNA, 2925 bp, Bacillus thuringiensis
ctaataaccataaagtctaccggaaaagtcggaataagattgttacccctcaaaaacatctatttttttctgattaaaaccgacttttccgattggctataaatgtgctgtgggaggcatacataagctaataagttcaagggtataactattaaacagttagggtggggacaatgaagaaaaagacaaaaaaatgggctggtgtattttcagtattactgagtagttcgcttgtgttatctgcttgtgggggacaggaggatacggcttctacagagccggttaagcagcaggatttaaaaaatgtgaaaattgaaaagattgccgcgacagataaaacgaaagtgccagacaaagcgaagaatagaaaagatacgttagtagttggtattagtaagccaggcggcgtatttttaccatactttcaacaaaatggttgggatggaaacgtaacttcagttatttttgcatctctcgtatcaaccgataaacaagggaaaccaattccagaattagctgagaagtgggacgtttcttctgatcagttaacatatacattccatttacgtaaaaatttgaaatttagtgatggatcgccattaacggcggatgatgtagctttcacattgacgcttttacatgataaggcatatgaaggtgaagtagatatctctcaatatgccgttaaaggtggtaaagaatataaagaaggaaaagcaacttcaattgaaggtattcaagttgttgatccacaaacaattaaaattacaactgaaaaagtgaattcacaagctatatttgttttaggaggtacagtactatcaaaagcttattatggaaaagattataagcaaaatacaagcttagattacttaaaagatttatatggaaagccattagctgcgggtccatataaatttgaaaagtatattccaggtcaagaagttcgttttgttgctaacgaaaattattatgcgggtaaaccaaaaattcaaaactttatttataaaattacttctggtgatacgaagcttcagttattccaaacaggagaagttgaccatactggcttaggtaccggtgatgaggttcttgaacaggctaaggctttagaattcgcaaatatccaaatcgaaacagcgccgtcatttagttatatttatatgaataataataagccttacttaaaggataaaaaggttcgccaagcacttatttacggattagaccgcaaaaaatatgttgatacagcgttaaaaggatacggtacagtagccaatgtaccaattcatccaacttcttgggcttatacggaagaaggagttaataaatacgaatacgataaagaaaaagcgaaaaaattattagatgaagcagggtggaaagttggttcggatggaattcgtgaaaaagatggtcaaaaattaaaactttcttatttcggtccaagttcggctaaagatagtgatttattaattccgattgcgaaagagaattataaagaaataggtgtagagtttaatcctgaatttatggactttaatacgatgctttctaaggtaaacaaaggagattatgatttagcttctgtttcgacaccgattacaagtgacccgagtgaaacagctggtgaatatttgtctactgcaaatgaaactagtcttggttataagaatgcaaaagtagatgagctaattcaaaaaggtattgaaactgtagatatcgaaaagcgtaaacctatttataaagaattgtataaagaattaagtgatgatccaccagtaattctattaaactaccgtagaacaattactggttataacgggaatataaaaggaattgatcctgaaaagtacaacagtattagtgcaaacttaccagtattatcatttgaaaaataacgataagaatgtataagtagaagacattttttcattcggttagtaatgtgccgctttgaaaaaatgttcttctattttaagcataagattggagagaaaaagggtgaaaacatatattgttcgtaggttgttacaaatgattcctacactgcttggtacatcaattattatcttcgtcctgttcgcacttcttcctggggattatattgattcaaacccgaaaattacaccggaaagagcagctgaactgagggaattatatgggttgaacaaaccaattgttgagcgttattttcattggttaggtaatgcattgcaaggggactttggcttctcgcttcaatatcaagagcctgtaacgtcattattaaataaatttatttggaattcttttagtgtagcaattattgcattgttttttatttggctaattgcacttattatcggtgtattctcggcgacgaagcaacattctttattcgataaacttgtaacaatcggtgtttttgcagcaatgtcatttccttcattctttatcggcttgtttttaattaaggtgtttgcggttgactttaagttattaccgataggtggaatgattgatgttggcagtaattcaacaggatttgcttacgtgatagaagttgcaaaacatatgattttaccagtatttattttaacacttcttggggtcggctcgcatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgag

SEQ ID NO: 1060 - DNA, 3656 bp, Bacillus thuringiensis
taattttatttttacagttttgtttaacatgaggagatgaacaggaatggaagttagaaatgaaataaagaaaaaagggagttggaggcagtttttacgccttattcaagatacaaatcctccgaaaggaattttagtttttgcgttgttaatgagtttgctttctacgggagcgagtttatttattcctatgctgacaaaaggattagtagataatttttcgctttcttcaattagtgcaggacaaattgttgggttaattgctttctttgtaatgcaaactattgcggcagggttgtctatatatttactaaattatattgggcagaagattgtagcgggactaagagaacgtttgtggaaaaaggtacttatcttgccggtatcttattacgatcaaaatagaacaggtgatacgattagccgtatgacgaatgatacaggtgttgtgaaaacgttaatttctgagcatttgtcaaacttattaacaggtggtatttcaattgttggatcgttaattgtattatttgttttagattggaaaatgactgcgttacttttaacggttattccgttgtctgtgttaattttagttccacttggacgaaaaatgtataagatttcaaaagcacttcaagatgaaactgcatcttttacaagtgtgttaacgcaagtgttatcagaaattcgtttagtgaaatcttcaaatacagaaaagagagaatatgaaacgggtaatacaggtatacaaaagttattacaatttggtttgaaagaaggaaaagtgcaagcattaatttcgccagttatgtcgtttgttttaatggcactacttgttattatcgtagggtatggcgggatgcgagtttctagcggtgcattaacaaccggtgaacttgtagcgtttattttgtatttagttcaaattgtaatgccaatgagtcaattatctatgttctttacacaattccaaaaggcaattggtgcaacggaaagaattagtacgattttagaatatgaagtagaagatcatgaaactggtgtgaaagtgacaaatgctaagcaaccgatcgttcttgaaaatgtacattttgagtataacgaagaagagcaagttttgaaaaatattgatttcacaattgaatctggaaaagtgacagcgattgtaggaccaagtggtagtgggaaaacaactttattctcattattggaacgtttttatgagccaactagtggcgccattaaattaggggaagaatcaattacgagttattcattacagtcatggcgacgtcaaatcggttacgtatcacaagatagtccgttaattgatggaacaattcgtgataatatttgttatggcgtcgagggcgaagtaacggatgaagaaattgaaaaagtagcagcaatggcatatgttgatgcatttattcatgacttaccaaacggttatgcaacagaagttggagaacgcggtgtgaagctttctgggggacaaagacagcgaattgccattgcccgagcgttacttcgaaatccgcaaattcttatgctagatgaggcgacttcaagcttagatagtaaatctgagtctgtcgttcaaaaagcgttaaataacttaatgaaaggcagaacaacgttagtgattgcgcatagactttctactgttgtagatgcagataaaattgtctttattgaaaaagggaatcttacaggtagtggtacgcatgatgaattattacagacgcatgatatgtatcgtgagtttgcaacgcagcaattgaaaattaaagagggtgcattataaaatgaatcatcagtgggattttactccactgatgattcatttttaaacaatatattagatgctaagtagaaaggaaatggttcctttgatacctaaaattttaatagtagatgacgatccacacattagagaactcgtttctgtatttttagaacgagaaggttttcaaacatatgaggcaattgatggagtagatgcacttcagaaaatggatgacgtaaaagtcgatatggttattcttgatatcatgatgccaaatatggatggatttgatgtatgttttgaattaagaaaatactatgatatcccggttctgatgctaactgccaaaggggaaacatcacaaaaagtaaaaggatttcaccttgggacagatgattatcttgtaaaaccatttgaccctatagaattagtagtgagagtaaaggcattattgaaacgttaccaaattacagtttcccaatcgattcaagttggaaatgtattattaaatcgtaaaacattcgaagttacatctggagaacaaacggttacattaccgttaaaagaatttgagctgctctttactttagggtctaaatcgggaagaacttgttcgagagagcaattaattgaagaaatatggggatatgattttgaagggaatgaacgtacactagacgttcatattaatcggttacgtgagaagtttcaagaagagcagtcgaaatttagtattaaaacaataagaggattagggtatcgcttagaggtaagtaaatgagaaaaagaaaacgaatgagtaagttgaagatgctgaaagtatttggagcggtattagcgctcttttcttttcttactataatttggtctatcgcattttatgtagcaactagtatattgaatgcttttgacgtaaacgtatcgccgtttgttgcttttctaattagtgatatggtcggttttgtctttattattcttatttggacattgattggaatattaatgagaccaaaacgagaggcgatgatttggactattattgaaccgatacaaaaaattgcaaaaggagacttctccgtaaaaataagaaatgaagaaaagtatgatggtgaaattggcgtgctcgtaaaaagtataaatgatatgacagatgaactgaatacgatggagaaaatgagacaagagtttgtatcgaatgtttctcatgaaatacagtcaccgttaacttctataaaaggatttgctagagcactacaagacgataatctttctgaggaaaaaagaaagcattatcttaccattattgaaactgaaacaacgagattatctaaactaagtcaaaatttactaaagctaactcttttagaatcagaagagtatacaccagaaagagtgagctatcgattagatcaacaattaaagcaaattgtgttaaatagtgaaccactctgggctgaaaaagaaattgagttagaactagatttagaaaaagtatatgttattgctgaccaagaaagtatgagtcaagtgtggattaatttaattcataatagtattaaatttactccaagcggtggtacgattactattcagttaaaggaacatgagacagtagtggaagtgcgtatccgtgattcaggaattggtatatcagaagaacagaaacaacatatttttgagcgtttttataaagcggattcttcacgaaatcgtgcctatggaggaagtggcttaggtttagctattgtaaagaaagtacttgaccttcatcaaggagagataaaagtggagagtgaggaaggaaaaggtactgaatttattgtgcgtatgccgaatcatgaagagaaatagtgttagaaggagaacc

SEQ ID NO: 1061 - DNA, 3512 bp, Bacillus thuringiensis
aagattcattaccattccttctcgagccaaagcacgagtcatacgtttatacccatagtaggggtcctcacgatgaatagaatcgatatgttcttaatgccacaaatccctcttctgacgtaaacgctgcacgttatgatatttccgccatttatagtagccagccttagaaacttccccgatttgaagcaaccatcggagtggataggcttggcgtaatgaatcgataagagaaaatcgttctttctttaggaccattccttcccgtgtagatttggattgcgcttttttaaatactcaacctgtgccttcaaataagcattttcttcttctagactattaaaattctttcgattccagacaccacgttgatcatcaaaggactccccttgttgcgcacgttttacccactcaataatctgggcatcgctcttcacaccgagttgttcacgaatttctcgcaatgattttctctcttctaatcgaagacgaactgcttctcgctttagttcttctgtatatttttgaaatgattgtccttttcttgccataaaaaaatcccctccagataaaacagtattgagtccatcatatcagatggactctttttttactttctacctataggggataataccagtagctcaaagagttatcctctctttttattgtgtaaacgaatggtttacagtgaattttactaatggtttctttcttttatatctctttttatgtaataatttgttaaaggaggggacgttatgaatttaggagaacagttaaaaaaactacgagagtcaaagggattttcacaagaggatgttgctaaaaagattggtgtaacgaggcaagcgatatataaatgggaaaatgataaaagttatcctgatattgataatttaattttactgagcgaaatgtataatgttacgctagatgagttgataaaagggaatcaagatttcaaaaagaaaatacatagtgatgcagaagatgaggattttgagaaaggaaatgaatttggtttttatattggatgtggtttgctaattttaagtgctttcgttgattatgaaggaatgcaagaaatcttattaggaatagcactattcatgatagttttttactctgacgtgaagaaagttattttgaatgagttcagatcgttttttaaaagaaaagatatatatgataagaggtgagaagaatcagttatatttcctaggaaagagtataagaagtaattgaattgttttataatgattttaggatgttgatagtgtgttaaaaagttcaaacaagcataaccccgttctaaagctaggacggggttcaaaatctaagttttatgaagcgagaatttctttcaaatatttttactttagtaaagacttcttataaaatattacttatttattaccgagttcttccgctaaaccgattaaaattccttcgactccacgaatgtagcagagacgatacgagttctcatactgaactacttcaccaacgagctctgcaccatgcttagtgagtctcgataccatttcgtcaatgtcttcaacggtgaacatgacgcgtagataaccgagggcgtttacaggagcatttcggttatctgatatagtaggtggggtgagaaatcgcgaaagttcaattcggctgtggccatctggagtgaccatcatagcgatctctacgcactgagaaccgagtccagttacgcgaccagcccattcaccttcgacattggctcgaccttcgagattcaagccaatctcctcaaagaaagagattgcgttatcaagggattctacaacgatgctgacattgtccattcgtagtaatttgttttttgccatagtcttatctccttatgtataaaagtctattatttaattatcctcataattatactactaagtagttacaaattcctttcagtcaaaaacaccttgtcacagtataggaaaatgtgacaaggtgttttttaatatgtcatatagcatcgtgttaacgaacagctttttatttaataggaaggtaatacattaatatgatttttttagcattactaaatatatcagattagctcatttgcactaaaggctcaattttcgccataaatgattgatgcagcgcctcaacgcctgttactaaatgaaggcggtcaataacgacagacactttaatttctgatgtacttaccattttaatatgaatatcttcttcttttaaagtagtgaacatatttgcagcgacacctgggttagataccatgccagatcctacgattgatacttttgctaagtgattttcatgttctacagattcatagtgaagagtttcttgattttgttccaaaacttctaaagtttctcttaaatcattcgaatgaatggagaaggagaggtgtacagttccttcatttgtaatactttgaatgatgatatctacattaatgtgtgctgctgctaatgtagagaaaactgttgaaagcgagccttgttctaatcctttaattgtgacacgtgtaatgttatcctcaaatgcaatacctttaacgattgattgttgttccatgttacattctccttttacaattgttccgttttcttgttccatacttgagcgaacttctaaaactacattatgatttttagcaaactcaacagcgcgcgggtgtaatacgccagcaccgagattagcaagctctaacatttcgtcataagaaatttcgtctaatttgtaagcatcttttacaactcgtgggtccgtcgtatatacacctgtcacatccgtataaatatcacatttttttgctttaagtgcagcagctaatgcgacagcagtcgtatcagagccaccacggccaagcgttgtaatttcattttctacacttataccttggaaaccagctacgataacaatcgtaccttcagcaagataagattgaatacgatctgtatgaatgtcagtaatccgtgcactactatgtacagattctgtcgtaatacctgcttgccaccctgttaatgaaattgcatgatagccttttgcttgcagtgccattgttaataatgaaatagttacttgttctcctgtagatagaagcatatccatttcacgtttacttggattttctgtgatagcgttagcgagtgcgacaagttcatctgtgctttttcccattgctgaaacgacagagacaatgctatgacctcgttcatattcttcaataattaaatttgctacatgttgaatgcgttcgacgcttccgacagaagtgccaccaaatttttgaacaattgtttccattacaaattccttctttcgtctatttttaagaatagattaggaaatatataaatccccaatactcctgtagttaccagaaagacaaacaaaaaacaccatctcaaataagtgaggatggtgctgatacaggaaaagggaaacagaaaacggagctaataaaaaaaccgccaaaaaggaatatcataaaaaatgat

SEQ ID NO: 1062 - DNA, 3917 bp, Bacillus thuringiensis
  unsure (1)...(3917): unsure at all n locations
caacatactgtgtggatgctattatcttctgtaggtattggagcgtcattacaacattacaacccaatcgtagatgctgaagtgaaagaaacttggaacattccggcagagtggagcttagtaggtcaaatgccatttggtgaaccaaacgaacaaccagcagaaagaacgttcttacctactgaagatgtagtgaaattttattaagaaatacaatatgtaacgagaaggaagctgtgcttaaaaacagcttccttttttgtagtggtgttaatttatgcgtatttagggaagaaatataagaaataatacggtgagaagggaattagaaaaatgaatgatgagaaaaaatatacagtgntaggtactgatgttgaggaagtaaagcgtttaaataaaaattcagggttaacctataaccaagtgaaggaattgttagcgaagcgaatggaaaaaaagcaatgatttgattggaataattaattgtatcatttagcattttgtctagagagagttaagaagataactctcttttttcaatctgaaaatttactagtgagcaacttgtagattggagagaacaacatgaaaaaatggaatagcattaaatgctgttacagagattaatcctaatgcgatggaagtggcgcgaaagttagacaaagagagagcgttaaataagaaatcgaacttatatagtattcctgtaatcgtaatggtaggttatgacgaaaaagatactatgacagaaaaaacgaaagataaagatagaattgataaagtagtttttagaaaagtattagatgaaaaaatccgacaataaaaaagaaaaaaggattcttcccaattagtaagaaagattgtctataggagttcataaaatgtaatatattcaatttccatccattgaagggggaggttaattcttaatgaatgaagtaaagagtttttttcgaagtagagggtttcaacggtttctcgttttaataatagtagcgcttgtattatacgcattaaaaagtatgattaatttaatattaattacgtttatactgacgtttttaatggatcgatttcaacgttttatttcaagaaaattgaaagtaaaccggaaaattgttattgcatgtttatatataatattggtttcctttataggcacaacgttatataaatatttacctgtgctgacgatacaaatttcacaattaatttatcagtttaaactattttttcaaaatccacctgataatgaaatcgttaaatatgcactttcgacaattaatgggatggaagtatcaaaatatatagaacaaggtgtagatgtcatctatcaatcaatagcaaatatagggaaggtaagtttacaaatattattatctctaattttaagcttatttttcttattagaaaaagagcgtattattacatttacatctaagtttaaagatagtaagttaaaaatcttttatgaggaaattgcatattttggtgaaagatttgcaagatcgttcggaaaagtaattgaggctcagtttttaattgccgttgtaaattgtattcttactgtcattgcattaatcgttttaggatttccacagctacttgtattagctgttatgattttcttactagggttgattcctgttgcaggtgtgattatttctttgtttccactttgtatcattgcttacaacgtaggcggagttatgtacgtagtatacatactcgtattcataacagtaatccatgctcttgaaagttattttttaaatccgaagtttatgtctgcaaaaacaaatttaccaatattctacacatttatgattcttatcttctcagagcatttcctcggaatatgggggcttattatcgggataccaatctttatctttttattagatgtacttgatataaataatgaggatgcgactaaaaaataagaaatgatagaaaatcactaaaaagtcataggagataatgaaaataaaaagcaatccaaaataaattggattgctttttatcttaattaaagaaccggagccattgtttctttcaatacttgaacagagtggtcgaattttaattcttcatcttcacttaattcaacctctaaaatttcacgaacaccgccgcgatttaaaacagcaggtaccccgatataaacatctttttgaccgtattgaccttctaagtaagctgatacagttaatacactattttcgtcgtttaaaattgcttttgtaacacgtagaagtgacataccgataccataataagttgcgcctttacgctcaataatatggtaagctgcatcacggacgtttatgaaaattttgtctaaatcttcttgattatacgtgttgtctttttcaagcagtgtttgtagtttttggataccaacggaaacatggctccaaactggaagttcagtatcgccgtgttctccgataatataagcgtgaatgttgtgtggaccaatatcgaagtactcacctaacatatagcggaaacgagcagaatcaagcgttgtaccagaaccgattacacgttctttcggtaaaccagattctttccaagttacataagttaaaatatctacagggtttgttgcgattaagaagatgccatcaaatccgctatccataatactgcgaacgatttgtttaaagattttggcgtttttctcaactaaatctaaacgtgtttcgcctggcttttgtggtaatccagctgtaataactacaaggtcagcatctttacaatcttcgtagctgcctttccatactctagttggagctggggcgaatggaacagcatgacttaaatccattgcttccccttcagcttttgcttcatttacatcgactaaaacaaattcttcagctacggcttggttaatcatgcagtaagcataactacatccaactgctcctgttcctactaatacaacacggttaataccttttttcatttcaaaattcctcgcaatttcattggttttgttatgtaagataatacgtcttacttctatagagtcatatctagtttattacattttataaaagatattcaagtatttgaaaatgtatccgtgcaaatctgcgaacaaaacataggaattcagtgaaccgaatataattcagtaaaatcctttgtaaaaggggaaatggtatggggaacccattaacaatggaagaaatgcttcatattattcatgcagggcttgttaaaaagaataacccaaaacggattacgattgcaggtgcagggatttctggattagttgcaggttctttattaaaagaggctgggcacgaagtaacgattatagaagcaaataacagaataggtggcagagtgtatacgattcgggaaccatttagtgtgggtttatattttaatgcgggaccgatgagaatccctgacacccataagttaaccttagcgtatattcataaatttaaactacctttaaacctttttataaataaaacttttgcagatatcatttatacgaataacattcaaacgagattgaatgtgtttgaaaatgatccaagtgtacttgaatatccggttttggataaagaaagaggaaaaacggcagaagagctaatgattgaggtattagaaccaatactaaattatattaagaaggatcctgataaaaactggcttatcgttgaaaaaaagtataaaacgtattcgcttggttcatttttaatggagtattattcagatggtgcaatagatatgattggggtacttcttgatatggaagcttatatgggaatgtccttaattgaagtattacgtgaaatgattttctttacttcaacaacgaaatattatgaaataactggtggaatggataagttatcgaatgcattcttaccacaattaagggaacatat

SEQ ID NO: 1063 - DNA, 3410 bp, Bacillus thuringiensis
agtgaacacattcacataaatcaccttctctctagaaaggagaggatgtaagataagcttagtcggattactttttaaaattggatttataggatcgtttatatcaggaatggttggaattggcggtgcgattattaattatccgatgatcttatacattccggtattgctaggattttctggctatacatcacatgaagtgagcggtattacagcggtacaagtattctttgcaacttttgcaggcgcttgggcataccggaaaagtaatgacatgaataaaacgttagttatgtatatgggagctagtatattaataggaagcttcatagggagtttcggtgctaacatattagaggaacatacagtcaatgttgtttatgcagcattagctacaattgcagctattatgatgtttgtaccgaaacaaaataatagtggagatgtgaagtataataaatggttagcaagcttgttagcgttcgttgtagggggagcttcaggcattataggagctggaggttcgttccttttagttcccattatgctagttattttaaaattaccactgcgcatgacgatcgcaacatctatcgctattacgtttatttcctcaatagggattactacaggaaaaatggttactgggcaagtagttatcattccagctctaattattgcggttgccagtatatttgctgcgccacttggagcacgagtcgggaagaggctaaatcaaaaagtactgcaatatgtattgtccactttaattgtaggcactgctgttaaaatgtggatcgatatgatatcaaaataaaaggatggtgctgcttacagcccatccttttatttattgcccgtaaacctaacggattatagttttactttatgcccaaataactttcattaagtttttatattcgtcatttgctaatttatatagcattctcgtatgttcaaagacaagtgctggattaaagtttggttctgagaatgcaagagatgttgaaatatcaattgcattttgcttatttaatgtgaattttgcaaagcgataagatgtatttaattcattgatgacatgtaaaatatcatttgttgatgttgcatcaggcacgtgagcaacattgaagcagtatatatccaccgtaggatgttcgttttggaaagcagcgataagttgaatctttgcgccagcttcagtctctaatcctactgaaaaatgaacagagccatcattttcatctatattttcttccatgtatatatcgttagattttaagtagtctttaaaatctgagatgttatgttttactgcagctttcatatgtatgagccccctgataattggaatagattgctactatttattataatttaaaaatattaaaaaagatagttagaaagttctgatttttatatttggaagaataaaaagaagcggttctctacctccatagagaaccgcttctatattattcattgtcattagacgatgtttctgtatcttcactgctatttttgttcttatttttcacttcattgttatttgattcgcgttcacttgaattttcagacttagattcttttgtctttttcgaatcagagtttgagtcagactttgtatatgcaggtagcccaagatgagtacgaagttcatttgtaacattagctaattcttttttatctggattgtagtagtaagttcgaccaccaccagcagatttgctacaagtatcgtcaccttttgccatatagcaatcatcaccttggatttgtaatttctcaatttccgaatccgatccatatttatagaatgaaagcatatcatcaaatgttaagtttgtaacgaattgtccgttaatatcatcaatgatgttgccaacttttgttacagaaccaacacttgttagtttctttaaaatagcttcgataacgagttgttgacgttgtccacgcattgcatcactatcgatgtgtcttgttctagcaagagcaagagcttcttcgccatttaacttttgaacacctttttctaggtgaattgcctctgcattatcattgctatcttgctcagtaaattcaactggtacatcaacttcaacaccgcccaagtcatcgacgatttttataaatgatttaaagttgaattttacaaaataatcgacaggaacattcattaatttttcaactgcatcaatgcttgcttgtggtccaccattttttccgtttttagcagaaccgaatgcatgagcgtgtgtaattttatcttttttcttttctattggaatataagtatatgtgtcacgtgggatacttaatagtttaacagttttgctatctttattaaaagttgcaagtaaaagcgcatctgttcttatagcgtcaccatattcttttcctcggacatcgctttcatcaacacccattattaaaacagagacattgttcgtaataggtttaacagctttatcacgtaaatcagatttatcaccgcgtgctaaatcgtgtgcggcatttcgaacagcagaagatgctttatttactaaaaaccaagtataaccgccgcctattaataaaacgaatagtatagcgcttataataacttttatttttttcttattttttttcgggttactgcgtgtattttcttgcaaagatgggttttgctccatttcctgtactccttcatttggattgaaatacgacactcatatccacttattataatgaaatttagcgaaaaaaaacattacaaatcatttacatttcgtaaaaattcaatttatttataaaaagtcagattttctatatattatttgtcagatgtagaataagtataagggcttttagtagaaatgaaaatatatattatgagaaagtgatagggaagtaagatttgttgaaatatagccaagaagaaatgagtaagcttacttattttttctatataataaggaagaatttgacggataaaggagagagcataatgaatcatacattattccgagcaatcgttgtgaatgaaacggaaaatcatcagtttgtaagtaaagttgttgagagagaagtaagtagtttacctgagggagacgtaatcatacaagttcattattcttcattaaattataaagatgctctttcagctactggtaataaaggtgttacgagaacatatcctcatacgccgggaattgatgctgcaggagaagttgtgagtagtgaagataactcttttaaggtaggagatcaagttattgtaacgggatatgacttaggtatgaatacctctggtggtttcggagagatatattcgcgtgccatcatcttgggtcgtgcctttaccagaaggaatgtcattaaagcaaagtatgatgtatgggacagcaggtttaacaacggctttatct

SEQ ID NO: 1064 - DNA, 5367 bp, Bacillus thuringiensis
  unsure (1)...(5367): unsure at all n locations
atcaatcttttttattattgttgcttctcatatacatggtttttatacgtatacgggtttttttcatccgttaaacctttttctacaaaaatctctttccaatttgtcatatccatttctgggaagaatgtatctccttcaaatgcataatggatttttgttatatataacttgtctacataaggtaaaaagagatcgtaaatttgcgctccgccaaaaataaaaatctcttcttcatttttacatagttcaaatacttcttctacagaatgaacaacttcacacccttcaacatgatacccttcattacgagttacaataatattacgtcttccaggcagtggtctaccaatcgcttcatagttctttcttcccataataagcgggtggcccatcgttgttttcttcacgtattgtaattcactcggtaaacgccaaggtaaattattatctttaccaattactctattttcgtccatcgcgaccataaatgaaacaatcattttttcatctcctctacaattatactgcaaccggtgctttaattgctggatgcggatcgtatccttcaatcgttaaatcttccatttcaaaatcaaacacagatttcacatctggatttaatgtaagtttcgggaatggacgtggttcacgtgccaattgcttttctacttgttcaaaatgatttgtataaatgtgtgcatctccaattgtatgaacaaattctcctacttcaagaccacattcatgtgcaattaaatgtgttagtagtgaataacttgcgatgttaaatggaattccaaggaatatgtcaccacttctttgatatagctgacaagaaagttttccgtccgctacataaaattggaataatgtatgacaaggcggtaatgccatactcggtacgtcttcaggattccaagcagaaacgattaaacgacgtgagtctggtgtttttttaatcatttcaattacatcttttaattgatcaagtgtctcaccagctgtcgttttccaagcacgccattgtttaccgtaaacgtctcctaaataaccatatttatttgagaactcatcatcttctaaaacgttctttttaaacaattccatttgctcatcgtactgtactttaaattcttcatcttgttgtgagcgaagaccaaaatcagtcatgtcaggaccagtatactcatcactttctacccagctcttaaacgcccattcattccaaatgttattattatgctgcaataaatagcgaatatttgtatcacctttcataaaccaaagtagttcacttgctacaaggcgaaatggtactctttttgtcgttaataaaggaaatcctttgctcaaatcaaaacgcatttgatatccaaatacagatacagttcctgtccctgtacgatcttctttcttcgtaccatgttccattacatggcggcataaatttaagtattcattttcagcatgtttcatatgtaggaaaaccttctttcaatcgtatatggaatttatcataacatgaaaaatggtaaatttaataatcttaattaataaaatttcttgcgctaattcttacaaaattattaactttccatattttaaaaggttttcattttctattaccgaaagtatagtgcggtagatcaaaatttatatttggaggttagaaatatgtctaaaattgaaacacctgttatgacttctttacaaaccacggttgaaaaaatgatgaaggatttaaatgttcctggtgttgctgtcgctgttataaaagacggtgaagttattctttcagaaggtttcggctatcgtaatatggaaacaaaagaggctgttacaccgaatactcgattcgcaatcggttcctcaacgaaagcgtttggtacactttcattaagcttgttagcacagcaaaaaaagtttaattgggatgctcctgtcccgtcttatatacctaactttactttatctgaactacttgctagctcacaagttacaggacgggatttagcttctcatcgaactggagtgagtcgtcatgaggctctttggtacagttcttccttatctcgaaaagatctcgttgaaaaaataaaacatttaccacttgatgcaccgttccggactgcatttctatataacaacttaatgtatgcaacaattagctacattgttgaaaacattacaaatcaaacgtgggagcaatacactacagaacatattttagaacctttaaatatgagacatacaaacttctctgttaacgattcacaaactacagatgattacgctttaccttacattgaaaatgacggtgaaataaaagcagttccattccgtaacatcgatacagttggcgctgctgggtgtattaattccacaattgaagatatggcaaattgggtacttctccacttaaatgaaggaaaatttggagatcatgaattaatctcctctgaattattacaaccaatgtatacaccacacaattcaattccagaccaaccggttttatcactccctgaatctccattaaatagttacggtcttggttggtttattagcgcttatcgtggtaaaaaagtgattcatcatggcggtaatatcgatggattttcagcgcttgtttcattcataccaacagaaaacataggccttgttattttaacgaatgctggaggaacattacttcctacttatctcgctaatcaaatttatgacgaactacttgaattagaatccattgattggcataaacgtgctgtagaagatactaaaaaaatgaaggaaatgatgaaagaagcaactgaatccctccctgaacaaattaaagggactacaccttcgcacaagttagaggattatactggtacttttgaacatcctgcatacggaacattacaagtatacaaacgagatgattcgttatatgtacaatttatggaaatggatattcaattagggcatcatcattacgacatcttctccacaaaagttgacttattccaaatgaaaatgagcttattattcgcttatgaaatgaatgtaagtggtgaattcccatcccttcagttacatgtaccagctacattaagtactcagccgcttacatttaagaaaattaaataagtatcttgatgttaaaaaataaaggtaggtgcgaatcacacctaccttttctatttcatatcaatcttatctggttgaaaccaaattggcttcgataactcaaagttattatgatcctctaaaactatagtaagacgctctaacatatcatctaacatatgcggcgctgctcgtaatgtccagacaactgaggagaaaactgtcatgccaacgtacaccgtgtataatttccagaactcctctggtattttcctattaaagtatccttctatttgtccgattgaatacggaatactaatatcccttgcaaacagtgcaatttttacgaaatcatgaattgggtcgccccagtcatagccattaaaatcaacaacacctacatattttccatcccgtacaattatattttctaaatgaaaatcatcgtgttgaaatcgattcgggcggctctttaaatatatttcattttcttctataaactttatgattttatcatcattttttatttttattccgcatgttttgtatacctctacatatttactatgttttttcatagctctttcataccatggaagtatatccttaggagcttcaaatgtatgcatttttgctaaatcttttcctgcctctataccaatatcatattgttcttttggtgaatacgtaggcaatagcttcttcgcatcttccccttctaaatatgaaaaaatactatagcatacaccttcttcttccaatatacctatttcaattggcctttgtgcctgtacgttacgttttaccatttcatttaaaatttgaaactctattttctttctttcatactcttttatatcgcctgtccgaaataaatatttttcattatttgcattcgtaattacatatttcttatctggagagaaacctttagaaatttcttcaatattcgctgcatcttttactatttgtatattgctttgccgtgctgtaattatcttcatatctattccccttacatttctgcatttggtgtataggcaacttctacaataaatccattcggatcgtaaaaatcaatcgtatagtaaccttccgaataatgattcatttcaattggaccacgtattaccttcactttcgtactagaaagaaaatctgctacttcatcaactacttctctatgaatagcttgataacaaatatgtctaggccctaacgtccttacaatttcctcatctacttctttaaagtatatttcactttctcctgtgctatatgctatttcatttaactttctccacccaattatggaaaacaacttattataaaaagaaatggactcctctaaatttgctacccaaaattcaatatgatgaatgcctgctcgcagtgtattcatattaagaatacgctccttgtactacttgcacaatttccatcggcttatgaaccatgtaatctggtgcatcttttttcactgtttcaataacatcatatccccaagatacccaaattacgttcactccagcctttttacacgctgctacgtctcgctgttcatcaccgacatataacatatctttctctgttattttttttgatttcaaaaatctttttatcattttatctttaccgaacaaatttttagaacaatacacttcttgtatattttctatatcattcttttgtaaaaacgcccgaatatgctcttctgagttcgatgatatgactgcaattccgtagccttttttatgtagttcatctaatacttctttcatcccatggaacaaaacgagattttttatagccggctgatataatttataaaattccaacgctaatatcggtaatttatacagtggtacattaagttgtttacatctctctggcatcgttaatttacgtaaatgttcaatttcgtcttcctttactgctttatacccatgtttttcagcaagttgattataaatcggtacaaatatattttgtgagtctactaatgtgccatcaaagtcaaaaacaatatatttttgcattcccatactccctttgcttcttttttctaaacctatgttattcaacaacatagttgtctgtcccttctataaaaataaaaaagaacaagattttctcttgttctttttaagaaagccatttcggcggtacattcgtattcccaataatatttcctaactcatgatgtccagagtatccatcatcaaaacggtggntatggaaattaaaataata

SEQ ID NO: 1065 - DNA, 3308 bp, Bacillus thuringiensis
tgatcttctaacgttaaaaccgctggcggtaataacccttttttacctaactcttctctttcattttgtgtgaaagctacccctttatttaaaagtggtgttgataatacttctgctcctcttaatgttgtttctaatgcgccattagaagctactgtaaacttgctcataacatccctacctctattcatatatagcatttctatattgtaaacaaaaaagaggggattgtcccccctcttcttttaatttttctttaaaagagttgctcctgcaatccctgggtgtgtcatttcgaatggatctagaattaactctaagtcttcttgtgacaatacaccatttttcacacaaagttctcgaacggattggcctgttgcaattgcttctttcgcaacgcgagctgctgcttcataaccgatatgagggttcccggctgtaataattcctacacttttctcaacatactcttttaagcgatcttcattcgcttcaattccttttaagcaattatctgtaaaggcacggaaaccgttattcataatgctaatcgattgaagtaagttgaaaacaagtactggttccatcacgtttaattctaattgtcctgcttctgaagcaaggcaaattgtatggtcattaccaattacttggaacgcaatttgattaattacttctggcataacagggtttactttccctggcataatagatgaacctggttgacgagctggtaacataatttccgctaaaccaacacgcggacctgatgccattaagcgaaggtcattcgcaattttagacatattcatcatacatactttaagcgctgcagatacttcagtataagcatccgtattttgcgtcgcatctactaaatcttctgcaccaacaagcggtaattcactaattgcagctaaatgttttacaactgcttcaatatattctggatctgcatttaagcctgtaccaactgcagttgctcccatgttcacttcatataagtgttgacgtgattgctgaatgcgtttcatatcacgttcaagtacacgtgagtacgctttaaattcttgtccaaggcgaattggcacagcgtcttgtaaatgtgtacgtcccattttaatcacatgatcgaactgttcggcttttaattcaaatacatcatgcatataacccatcgtttgtaataagccttctaatgcatttaacgttgcgatatgaatcgccgttgggaatgcatcatttgttgattgggccatatttacatgactatttggactaatataatgatagtctcccttttccattcctaataattcaagagcacgattggcaatgacttcatttgcattcatgttcattgaagtacccgctccgccttggattggatctacgatgaaatgatcatgccattttccatcaagaatttcttgagcagcttctgcgatcgcaccgcccttgtttaattccaatcttcctacatctgtattcgcaagcgctgcagctttttttacaattgcgaacgctttaattaaaccttcatggattttgtatcctgtaattgggaagttttcaactgcacgcattgtttgtacgccgtagtatgcatagtttggtacttctttttcacctaaaaaatctttttcaattcgaacaccatttttaacttcagttaatgttgccatgattattcactccttaacgatttcttatgctgcttttgtttctttgactgtttctacatattgttttgctttctcattatcgaattcgccttcccacttcgacataacaatggccgctaatgcatttcctaatacattgacagatgagcgaatcatatctaaaatgcggtcaattcccgcaattaatgcgataccttctagtggtaaccccattgaacctaacgttgctaatacaacaacgaacgatgcacctggaactcccgccatacctttggatgttaacatgagaacgaataataacgttatttgctccgttagtgacatgtgcacaccgtacatttgtgcaacaaacaatgccgctaacgcttgataaatagccgatccagtcaagttaaatgtataacctgtcggaattacgaaagaggcaactgcctttggacaaccgaactcttccatttttctcattatattaggtaaaacagcttctgaacttgctgtcgtaaatgaaagaatcaattcttcttttaaaatttttattaatgtaaaaatgtttactccaaccattcgtgcattaatacctaatacaatcacaacgaatagtataacagttacgtatacagctagcactagttttcctagcggaagtagtgttgctacaccaaattttgcaaccgtaacggcaattaatgcgaatacaccaaatggtgcaaatttcataacttgatttgtaacccaaaacatggcttcgagtacgccttcaaaaaagttaaagacaggctttcctttttccccaattgccgcaactcctaagccgaataatactgagaagaatataatcggtaataggtcaccttgtgcaatcgattcaaatacgtttttcggtacaatgtgaacaattgtctcagcaaaacctttcttctctgttgcatctgcagtttgtttataagaagaaatatcactttgctgtaaattactcatatcaacaccagtacctggttggaatatattcgctgcaagtaatcccattaaaatagcaatcgtcgtaataatttcgaaataaagaattgtcttaccacccagtttcccaagcttcttcatatctcctacaccagctactgcaacaattaatgctgaaataacaattggtactacaatcatcttaattaagtgaataaatatatccccaattggtgtgatataagaaatcgccgttttattgccataaaagactgcccctactacaatccctaaaacaagcgcgacaaaaatttgtgttgccaatccgaattttttcatttatgttcatccccttcatgcgaacgctttcaatttgaatttataaaagctactcacacatcttataagcgaacctacaaaatcatacaaaaacctacaagttcgtcacaaaaaattcaaatatttttcttctttttttcattgacaccattttgttaaaaaacgataaaataaacttgataagtaatcagattgtttcgtataatcaaaaagatatatacttaaaacaaatcaaaatgaaaagacctgcggtagtatgtcaactgaaaaacaaaagatttttagttatcaaaggcctatttactaaaaaagacatacgaaactaac

SEQ ID NO: 1066 - DNA, 4474 bp, Bacillus thuringiensis
taaaagaggcagttgttgtaatggaacagtatgcacattacaatcattggtttacatttggaaaccaaactgattttggggggatttcagatttaagctatgtaggcttgcagtatccactggattcaatgagttcgcttgtagacaatatgccattatgggataaaggctattcaattccgcttcaggaattagaagagtttgatgttccagtattaaatatgggaccggtaggaaaagatgcacatcaatggacagaacgtctagatgtaaactacgcatttgaaacactattagatatgttaccgaaatgcattgaaaaattattagtttctaataaaattacacaatcatagtagggaataggtaagggataaaacagaacctttaaagaagagtcgaatcaaattattttaatataattaaaaagtagaacggccaagctcaattttatatgagtttggccgtttatcatgtagtgaatttttaattaaaattatgtgaattcatagctaacgtaatctcttttatagttttattttttagtttgaccagatagttcaacagacttttgcgtacaacgctgcatagctgaaataatcgctgttcgtaatcctttttcctctaatgttgctacagcttctattgtcgttccgccaggagaacaaaccatatctttcaattcacctggatgtattcctgtttctagtaccatttttgcagagcctaacacagcttgagcagcgaatttatatgcttgatttcttggcataccatctagtacagcagcatctgccatcgcttctataatcatatatacataagctggtgaagaaccacttacggatgtgacaacatccattaatttttcacttacgatctctgtttgaccaaaactattgaaaatgtttagtacatcttctaaatctttttctgtcaccatttcattagggcataatgcagacattccttctccaacaagagcaggagtattaggcattactcttacaacctttacttttttattaaaggcattttcagtactttcaatactttttccagcagcgatcgtaacgatgatagcatcgtttttgattacttcttttatttcattaattattgatgaatataggtctggtttgattgataaaattaaaatatcagcatttttagctactttattgttgtcggtagttgtagttagcccatatttttcactagcattttttaaattagcagtgtttaaatctgaacaaataatttgatttgaagatactatatttttgtttatcattccgccaatcatagccattcccatatttccgcaaccgatgaatccaatttgtttatccataataactcaatcttgctccttttataatcaattatatcgggttgatattattttcttagaataagaataacatccctgtgcaatataaagaaacattctaagagaatatattcctttttgcaacactaaaagacaaaaattaattatattcgacattatgtaaatatatacactataatgtaaggttttatgtttatgaatatgagttaaacttatatcattttgtattttcattcagtagggcgataatttcatacaaataacttgtggctctatttatttttaaaaatacctcttgacaccgaatcaaactatatcgcataatataaaaaaattagattgaaaatcgttgaagggaattagtacatatgtcttcttgcgaaagagagtggaattcaccggctgaaagattcctcgtatagaatatatcgaacctatccctgagtcttaaatgaaagtttaggcgttcgcctgcgttataggcaccaagtggatatctatgtatatcaattaaggtggtaccgcggaacaatgaccgtttcgtcctttttattttattaagggcgaagcggtcatttttattttgctcttaaatacttcagtgcagcattgatgagaatagatatagttacaaagtgaatgaagtgtaatttataaaaaaactttgattttagacttgggggataaaaaagtgaaaaaacaacgaattgttgtaaagattgggagtagttccttggcagatagtcatggaggcatctctacagaacagctttcagatcacgttgccgcattggctcggttgaaagaagatgggcacgaggttgtgttaattacatctggagccgtcgctgcaggtttttcagcgctaggatatcctagcagacctgtaacgattaaagggaaacaggctgcagcagctgtcggacaaagtttgttaatgcaggcgtacacggaggaattccgtaaatatggcatcgttactgcgcaacttttgctgacgagaagtgatttttctagaaaagaacaatatagtaatgcttacgctacgttaggagaattattaaaccgttccgctcttccaattattaatgaaaatgattccatctctttagaggagctaacgttcggtgataatgatatgctgtcagctttagtaagcgggcttgtttcggcggatatgcttatgatctttacggatgtgaacgggttatatgacaaaaatcctcagaaaaatgcggatgcaaaaaaatattattttcttcctgaagttacggaagaaatttcttctcttgcaggagatgcaggctcaaaacttgggactggcggtatgaaatcaaaaatcgatgctgcaaagacagcactctctcttggtgtgagtgtatttatcggaacaggacgtggacaggaaaagtttgtagatgttttgaagggtaagggtgatggaacgtatgttggtaatgctcctcaaaaagaaatgaagatgaacaagcaatggattgccttgcattcgcttgttagcggacaaattgaagtagatgctggggcagctactgccatcattcagcatgggaagagtttacttccagctggtgttacgaatgtatcaggatttttccaagtgggtgaagttgtagaggttgtaacgcaacaagggcgcgtaataggaaaaggacaatgcacatatagtgcagaggaactaagagatgtacaaggtatgcaaagccaagatattcaagtaagaggcgagagacatagttatgaagtcatccatagggatcattgggtttcacttcaaaaaggaggaaataaaaatgaatgaagtgttagcaaaggggataaaagcaaaagaggttgctagagaacttgtgcttaaaactacagatcaaaaaaatgaagcacttgctgcaattgctaatcagctgatagtagaaacagcttatattttagaagaaaacaaacgggatattgaagaaggtaaggagaaaggattttctcattcactccttgatcgccttttgctgaatgaacaacgaattgttgatatgacagagggtattaagcagttaattgaattacgtgatcctattggagaatgtgtaagtgcatgggaacgaccaaatggactatctattcaggagatgcgcgtaccacttggtgttgtcggaatgatttatgaggcaagaccgaatgtaactgttgatgctgctacaatttgtttaaaaacaggaaacgcagtaatactacgtggtagttcttctgctatacattctaacaaagctatcgttagcgttattcaccgggcgcttaagcaaactagcttgccttcagaaagtgtacagctcatagaagatacaacgagagatagtgcaaaacagttgtttacattgaacgagtacttggatgttcttataccaagaggcggtaaacaattaattgatacagtagtgagagaagcgtctgttccagtacttgaaacaggtgcgggaaattgtcatatattcattgatgaaacagcagataaacaaatggcgtttaatattattataaacgcaaaaacgcagcgtccatctgtatgtaatgcaattgagacgattgtacttcatgagaattgggcagagcaatatggtagcgagttgttttcttccttgaaggaaagaggagtggagctacgtggtgataataaagcagtggcgattgatccttctatcttacttgcgacagaagaagactgggaaactgagtttttatctctcacactagcagtgaaagtggtttccactgttgaagaagcgattcatcatataaatacgtatggatctatgcattctgaagcgattattactgaaaacgaggaaaacgtcagcaagttttttacttctgtagatgccgcggcactttatcataatgcatcgactcgttttacagatggatccgaatttggattcggagcggaaattggtatcagtacacaaaagttacacgtaagaggaccaatggggcttccagcattaacttctacaaaatatgtgattcgtggaaatgggcaaattcgaaaataataataaaagacactcaatataatctgtgctcctttgtaaaggacatttgatctcgcattct

SEQ ID NO: 1067 - DNA, 4232 bp, Bacillus thuringiensis
gcgataaatgtaactacaattagtgcgaatataatcgttaacgttaatgctaccatatttattcactctcctttttcacttgtaatatagtactatgcctctttataacaacgactttttctccagcatcaattgaagaatctgcaatagctgtccaagtatctccatccactttcacaataccattcgcttcatttgtaatcgtttgcataacaatcccttttttaccaacaagcatatctactgtatcagtaaaaccttttgcttctcgaaagttttttgaaattcttttcgtaaagaatgtcaaagttaaactaacaattgcaccaacagtaacttgtaacagtagtgcatcaggagcaaacaaagcaataagacctccgacaacagctccaattccaagccaaagcatgtaaaatgtaatcgacaacatttctgcgataaataaaataccagctattataaaccaaattacccaagcagccatatgcaaccctcactttctttctcattttctatatgtatatgaagaaaagaatggtttatccgccctttcttacacttgggcgtttgctacaagctattgtacatactcactgttacaatgatcattaatataatactatatcaatatatccttcattatacatgaaaatccctttcaaaaagtgacaaaaaattaaattctttaaaaattttaatttttaaattacaattattctaattactaaatactattttttatagaggtgataatcttattgagaaacctgtcactaatctactatttaggttccaaaatatgcattactctcgctgacatcgtatatgtaatgattattacaactcatatttatatagcaactaaatcagctactattactgctctttttccattattacaagttatcacaaatctaattgctaacatctctgcaccacttataataaatcgttttccatcttatacgctgttatatacgctccaatggctgaaaacagtctttttactattattaatgattttgttcccggtcttatccacaaacattatagctctattaacttttatttttgtcatttcattatgtagtgggtggagtgctccgttattatacggtattctcccgcgccttacaccgaaagaaaaattagtaaaagtaaatagtatcttttccttttcaacacaaattgtgcaagccgttgcttattcatttacgagtattgtcgttcttctcattggcgctacttctacactcatgattaataacattttaatgcttttcggatgcattgccttacatttttcattacgttccatacatactgaaagaatagcagattctccctcttccaaaagtactgttttattggaaggttggaaactcctatttcaaaatccttctctccgtaccgttacatatatggacttaatcgaaactttcgcagggacaatatggattggtgctattacgatggcatacgttacgactatccttcataaaggcgaagaatggtggggatatattaatacaagttattatgttggcacgttaatcggtggtctattagcatggaaaatgagttcctatattcaaaacaatttaatacgatctatgtcgattggctctcttatatttagcattcttacatttttatatggtatgacgagcagcggatttattgcgctttttctatgtgttctaatgggaccatgttatcaaattagagatatttcccaaacgactgttttacaatcaagtgtcgcccctgctttattatccaaaatgtatacagcacatggtgcacttctttcaacagcctctggactatctatgcttagcattggcattattactgatatgttcggtgttcgtacaatttatatcatcgcttctattcttattttatgttccgcttgtttatcttttagtttattaaaatatcataagacagagcagaacgatatttcaatttaatcactaaaacaaagaggacagggattcctgtcctctttgtttattctattcatgataagttgaggatttttctatgctttgtcgcttgttcaaaagcataagctaatttaattaatatcccttcactaaaggcagtgcttgcaatggtaattccaaaaggcctcccgctttccatataccctgctggtattgctatagacggataacccgcttttgcacatatagtagaacctatataggaaggaaacagtatcgcatcaagattatatttttccaatgcaaaatcaatgccttgttcttgagaaaaatatatatcttctaatctcgcatttaaatattctggatttcgtaaagtattaggaaaatcttttcttccctctaacttagtttgtccatattttaaagctctttctgctatgtttttattaaactccattaactccgaaatagaatgtaccgggatagtagaaggtaatttagaaagatagttatctaaactatgcttcagctcataaagcggaactccccagctccattctctatgaaaagaaggaatatcaatattttctactactgtcgctccttcattacgtaatacttgaatcgtttccttaaacaagatttcatcatactcaccattttcgtaataatcttttggtgcatcgttaaacacaccaatcttcgctccatttaaaccatttgcatcaaggtaagatgtataatcccgatatgccctattttcactttttcgagtaactacatctttctcatccactccagttaaactccctagcaaaatagcagcatctgttaccgttctagcaaatggtccagctgtatcttgtgaataagtaaatggaataattcctctacgactaattaaaccgacagtcggtttaatacctactacagaattttgaacagcggggctcaaaatagaagcatcggtttctgtcccaacagatactactgtaaagttagcagcaactgctatcgcagatcctgtactagatccgccaacaaacatatgatccttgcccgttccgtatggattgattgtttgaccaccttttgcactatatccagcccacatttcaaaagacattgcatttgctaattctgtcatattcgtttttccaattatcactgcccctgcttctcgcagttgagtaacgagaaatgcatcttcactgcttatattttgttctagagctattgtacctgcacttgtatgcatggagtcattcgtttcaatattatccttaagcaaaacaggtattccatgtaatggaccccttataccttttgtctttctttcataatctaacgcttctgcaataaaaattgcatctggattgatttctaaaattgaattgattttcggtccgtcttgatcatactttgcgattctataaagataatacatcactagctcttttgaagttaactttcctgattccatttcattttgaatatcttgaattgttaattccttttttaagattggattaaactgaatttccatttatattctcccttatatgaacttttttagcgtataccccttactttttcatttttttcacctcaacacatcctaaattaatattcctttaaagaaattcaatttccttatttaaacacctattaatttaccgaaaaataaaaatagtctgaaacggattaaccttcgcttcagactcttacattactgtgcgtatacttcatctaacaaatgtaaaaactcaccttgtttcccagctaattcagggcattttgcaatatcaacccattcgtagcaaaatactaatcctttatcttcctcaccagcacttacaatatgttcccaagtatcctttacatctgttagtaaagttacatgaaaaaagtggcatttttcatattcctgtttttctttcatatgtatgatgtaatctgctaaaaaacgttctatgcataaatgacgcaatccggattcttcctgtacttcacgcaatatagccgcttctaacgtttcaccttcattaaccgttcctcctggcacttgaataccagcttcatgtatatcacgatgtttaaaaacaagtaattgcataaccccctctttttctcttgtaatatatgcatgtacttttttcttatataacatcgtcattatacgtctctcccctcaatcatttactctgttacttcttcaagcgtcagttgattatcatacaaatatgtagcttgtggatttcccacataccttac

SEQ ID NO: 1068 - DNA, 4860 bp, Bacillus thuringiensis
atataaggtacataataataaaggtatattactgcaaataaagcttattcatctaaaacgtgatatttttacaattaatgaactagcaaccttgttctttctatatccttcacctgtaaatttttcactactatattattgacatacaataaatggttaaatgtttctaaaaggttttctaaacaaacaaaattctcagattgatacgaaaatgctatgaaaaataataaatatatctaatgcgctattagaattttttcatattatagtattgagaattgtataaggaggtggaaaaagaatggacgagcgtgtacaacctcaactttcaccgccatggatcacatattttaacgaactcagaaattcggtaggggctgatccaactgtaacagtaggtccgctaataccgactgatggaaattttattattttagtacaaactacggattttgaaaaagcgattgcattagctacacttcttaaacctacagtgcaatttggcaatgtaaatgtaactattgttgttagtgttattggggatggaattgtaaacccaattccttgtcctttagatgcttttgaaattgcacacctttttcaagtagctttagaaagcaacttgtattttgagcaagttgttgtgcagccgcagttcccaggtggagcgaatgttgtttttccggtttttgctgcaaaagtgattcagttttttaatgatgatatttctaatctatgccaaactttcacagaagtcgctgcaaaagtttttcgtgatgtaatgaatgatgctatatgtggtataccaattttatactcgacaagttgtagtacaagcactgaaaatgtataatttattgatgaaaaaacttttcacaaaaaagaaatacaactgaatttgttctattaatttaaaagagacatttctaatttaaggagatgtctcttttattacatatgaaaattacgaaacggatacttgtccaataagggtaaaattcatttataaaaagtaacagcttaggttaagagtgaaaaccctgtctatgattttacagacgaacttgctaacacatatgagaaatagatataaaataactttggtatccacatttaaaaatagaattaactaataaaaaacttaaaacaaaatactgataaaaaattttttaatatgtatagtaaaatgtatgtggacgaagtggttattattaaatattgaataggcggtatgggggaagaaaaatgaaaataatagaactaccaattgaattcgaatttaacgggcaaaaacaatgtatttatccaagtttaattatattacataatgaattaacgttagtcgatacaggatatccaagttttttacctttaattgaaaatgcaatattaaaacatggatatgagataaaaaacttaaagaatataattattactcattatgatgatgatcatatagggcctttatacgattttaaagtgaaatatcctcaaattaatgttattgctagtgaaattgaatctaactatattagtggtgatataaaatcagagaggttagttcaagctgaagaaatgttagaacgtatgccaaatgaagaaaaagaatttggtaaatggtttatacaacagttaaaaaatataaaacatatttccgtcgatgaaaaagtgcatgatggtcaaatgattttgaataatgaatgtcaaatagtagcgacgccaggacatacttcggggcatatttcattatattttccgaatttagattgtgtaattacgggagatgcggctgttcaagagaatcgtgggttagtaatagctaatccgaatttttgtttagatatagaaaaagcgaaacagtctttaaataggattaaaagttttaaagcaacacagtattattgctatcatggaggaaagcttactgtataaattaatgaaaatcggtctttcctaaatcgaaaagattggtttttagttcatatattttgcgatttcaaccaaatcagtaacattatatttcggtaaaattgaaatatatatgtaaagaagaatatatataatttgagcaagagtataggggggagaagatgggttcgttatttgatgtaatagcagatatcattttattttatcctcgaaatgacatgaaattgaaacatcatatcgcaaaattaagtgaattagagtggtttcgaaatctacatgaagatctgaagtatacaagtttaatttggagtaatagaaaaattaaaaggtatattttgacttctataaatatggaagcattaataaaatctgagaaaaagcaaaaagaatttgttcatctagtacaggatgaatataaaaaaagaagataagaatttttttatttttcatatttggcgaaacaaatggtacaatgaaagctaatgtgaaaaataaggaaaagaagtggtctatttgaaaaattttttagaattaggaattagtgaaacttttaatcatacattacgtgaaaatggaattacagaagcaacaccaattcaagagcaggcaattcctgttattatgtctggtaaagatattattgggcaggcaaaaacaggtacgggtaaaacgttagcattcgtgttaccgattttagaaaaaatcgattcagagtctagtgatgttcaggctttaattgttgcaccaacaagggaactagccctgcaaattacaactgaaattaaaaaaatgcttgttcaaagagaagatattaatgtactagcgatttatggtgggcaagatgtagcacaacaattgagaaaattaaaaggtaatacacatattgttgttgcaacaccaggacgattattagatcatatacgccgtgaaacaattgatttaagtaatctttcaacgattgtactagatgaagcggatcaaatgctttattttggtttcttatatgatattgaagatattttagatgagacaccaggtagtaaacaaacgatgttattctcagcaacgatgccaaaagatattaaaaaattggcgaagcgttatatggatgaaccgcaaatgattcaagtacaaagtgaagaagtaacggttgatacaattgagcagcgtgtcattgagacgacagaccgtgcaaagccagatgcacttcgttttgttatggatcgtgatcagccatttttagctgttattttctgccgtacaaaacttagagtaagtaaactgtatgataatttaaaaggactaggttataattgtgctgaacttcatggtgatatacctcaagcgaaacgtgaaagagttatgaagagtttccgcgaagctaaaattcagtacttaatcgcaacggatgtagcagctcgtggacttgatgtagatggtgtaacgcacgtatttaactttgacatccctgaagatgtagaaagttatattcaccgtattggccgaacaggacgtgcaggtggatcaggtcttgcaattacgttcgttgcagcgaaagatgaaaaacatttagaagaaattgaaaaaacgcttggtgcaccaatacaaagagaaataatcgaacaaccgaagataaaacgtgtagatgaaaatggaaaaccggtaccaaagctggctccgaagaaatcaggtcaaaatcgtcaaagagatagccgcgaaggttcaagaagtgaatcaagacgtgattcaagaaatagctcaagaagtgattcaagaaatagttcgagaaatagttctagaaatgaaaataaccgatcatttaataagccaagtaataaaaaaggtagtacaaagcaaggtcagcaaagacgtggccgttaaatggttataattgtaaaagagtcgcaaaatattgtggctctttttttgtttgtatacaacaaggatgatggcaagaaaaaaacaaaatttcattcaccgcatttgaaatttataaagggaattttatagtccaaaaccattagtgcaagggtattactatcattcagcagaacactttggttaaaagaaaaggtattgaagcgagcgagtattttcattatacattccgcaattattgaaatagaacaagagaagtttatgaaggattaaactcgtattggtgtacgatcgttggaaactggaaaactaatttgttagttttgatcgatgaggaactcgagaagcaccactgccatccttatggggaaattgcttacgacgacgatgaaggtaatttagtgataatatgcgaaataagaaaaaaggactagcagtcgtacctgccgtcctttaataggagaaaaagtaatcttgtttagaactacgcataaacagaaaatctgcttgtaattagttttaccctaaatatacgtgtctatacaaaaaagggataagtaaaagatacttatccccggaagggaaatcccaagcaccaaaatggctcgtattggtctgcaggttcaaaagtagtatatgtaaaacgaaaaatctcatacaaaaagcagacaacgattttggttgtctgccagtgagttcaatgagttagctaattgtgataatttgcatccccattgcgagaagagtgaagctgctagttcaaacagcttgttggtattattttcgatttctaaaaaaatatacatcaaaagaaagaggtattagccatggacacggcggcttgaaaatagtatgtatttttatttgaaaaatattcaaggggtgaagaaacatggaattgttaataaaagtggtttgttttatttaatccagttagttaataaaacaaaaatagttattttgggagaacagggaaaaattaaatatgagaatgaaattgaaagctgtttgaaaaaataacttggaagttgatgaaaagaatgctttttggaa

SEQ ID NO: 1069 - DNA, 1979 bp, Bacillus thuringiensis
atctttacattatactttcctataagagctttcgcaataacttacaaatgttctctattccatgatactcactcttttacttcttaattctttttactattttgatttccctttacaattatgtaaatttctccatttattccgtacaaaattatggatattctattttcagtatactcttttatcaatatatactctagattttattgtaaagaaagcaaaaagcctaatccaatatttggattagaccgcttgtaaaatatatttagcatgttctacatttttctcagtaggtggttctacatttgcgagtggatacttgtgtccaagcgcctcccatttatatacaccaagcttatgatatggtaacacttcaactttttgaacattagacagactttgaataaagctagatagtttttgtagatcctcttcattatccgtaacaccaggaactaatacgtgtcgtacccaaatcggtttattcttatccgataaataacgagcaaattgtaaaatatgttcatttggtttccctgttaatttacgatgctttttggaatcgatatgtttcagatccaataaaactaaatctgtataatccattaaaatatctagcttattttggaattctggttcctcagaataacaaccaccagaagagtcgattgttgtatggataccagcctctttacactttttaaacaactcaattaaaaagtctagctgtaataatggctctccaccgctaactgttataccgcctccggaagcttcaataaatggaaggtaacatgtcacatcctgcatcacttcttcaactgttatttctttacctttaccgatttcccacgtatcagcattatgacaatattgacaacgtaataaacacccttgtgtaaatatgacataacgaatccctgggccatcaacagtaccacaagactctacagaatgtattcttccttttaccatgttacttcctcctttattgaaacagcctcccttcgctatatattaagagcgaagggacacttttttcatttacatgctttcatgcattgtacggttaattacatcaatttgttgttcacgagttaatttaataaagtttacagcgtaaccagatacgcgaattgttaattgtggatatttctcaggatgttccattgcatccattaatgtttcacggttaaatacgttaatatttaagtggtggccttcttttactgcatagccatcaagcattgatactaagttacgtacttgtacatcatcttctttaccaagtgctttcggaataatagagaatgtattagaaataccatcttgtgcatcttcatatggtaatttagccacagataataatgaagctaatgcaccttttgtatcacgtccatgcattgggttcgcacctggtgcaaatggttctccagtacggcggccatctggagtattaccagttttcttaccgtatacaacgttagatgtgattgttaagattgacattgtatgaacagaatttctgtatgttttatgtttacgaagtttattcataaatgtttttacaagatttacagcaatctcatctacacgatcatcattgttaccgtatttagggaaatctccttcaatctcgaagtcaactgcaataccattttcatcacgaattggttttacttttgcgtatttaattgcacttaatgaatctgctactacagatagaccagcaatacctgttgccattgtacgaagaacgtttgtatcatgaagtgccatttcaatacgttcatagctatatttatcatgcatgtaatggataacatttaatgtgtttaaatatagacccgccaaccattccattgtcatatcaaacttatgcataacttcttcataatttaatacttcagaagtaattggtgcgtactcaggaccaacttgtgctttagatttttcatttttaccaccgttaatcgcat

SEQ ID NO: 1070 - DNA, 3484 bp, Bacillus thuringiensis
  unsure (1)...(3484): unsure at all n locations
caaattgtagacaagtaatgagggaataaggaattacatatgtcgagtgatcctggaattgccatgcttcgttttaatgaaaaaaataccgcgttagcaaataaaaaggtgcgtcaatctatttcattagcgttaaataaagatgattttgttgctcactttattaataacggagcaaaacctgcaagcgggcttgtaccagttggtcatgtaaatgaagtgaccggtaaagattttagaaaagaaaacggagatctttcttcatatgatttgcaaaatgcgcaaaagatttggaaagaagcgaaaaaagagcttgaagtagagcaagtaaacctcgagtttttaacgtttgaacaagataatgcaaaacggatggcagaatatataaaaggtgatttagaaaagaatttgcaaggaatcgcgatacaaattaaacaacagccatttaagcaaaaattacagttagaacaaacaggtgattacgatataactatggcaaattggggacctgactataaagacccaattagttatttagagttatttacgacagggaatccgaataataaaatgaattattctaatgttcattacgatgaattaataaagaaagcgaaaacggattttgtactagatacggaaaaccgatgggaagcgttgcgagaagccgagcaggtattattagaagatgctgcggtagcgccgctttatcatattggctcagcatatgtacaaaaggattatgtaaaaggaattgaaaagcatcaatttggtggtatttatacttataagaatgcttatattgctaatgaataaatacaaaaaaccttactttttaaaagtaaggttttttacacatgaattctattaaaccgatttcaataaagcgtaaaaattcgtatcatatgggacatcatcttgatacatataattttttagaacgccttctttttcaaagcctaattttaatagtacttgattggaagcttcattttcaagaaatacaattgctccaatccgctttaaatgaatcgtatggaaaccgtatgatataatctcagaaacagcttcagtcgcatatccttttccccagtgttcaggcaaaaaggcataacttatattggctcgtttatgctcagaagaccaatcgtgaaaaccaatggtaccaatgagttctttcgtgtcttttaattcgattccccattttataccgcttcttgcattgtaactcaacttaaaattatgaatgatttgcttcacttgatcaatatcttgtaacggtttttggccataatagcgcagtacattagtattagaaaagcattgtagtatacgcggtgcatcttctttggtaagttctcttaaaatgagtctttcagtttttaataaaggaaacatattttcgctccttttcacatgaaaatagaatgtatttgttattatataatttaatctgaaaataaagattattcaaggtgtaaggaagttattggctggaaatagattataaaatttattttaaaaagactttataggattaatacaaataatgaaaaaagggtattccaaattaaaattggaataccctttttcattatcctacaaatgtttgatacagtaagaagatatttaaaatgataacgagtgctgcaattatccaagcgataaatgttgttatacggtggttaacgagtgcacccataatctttttgttacttgtaaacataataagtggtactagcgcaaatgcaataccgaatgataagacgacttggctcatgactagagcgtaagttggatttacacctaaagcgataataactaatggtggaatcattgtaataaatcggcgtaagtataacggaatatgcatgcgaatgaaaccttgcataataatatcacccgacattgtaccgacagaagagctagatagtcctgctgataaaagtccaatcccaaataatgcagccgatacaggacctactaaattggtaaattgagtgtaagcaacatctaaatcttcaacgtgcaagccgtttttaaagaatagtgcagcagcaacaattaacatacttgcattaattgctccagcaataaccattgcaataataatatcgataaattcgaaacgaaaaatctttttcttttgttcgtcagttgttccgaccacgcggcgttgtgttaatgcagaatgcaagtatattgcatgtggcataactgttgcacctaaaatccctgctgcaagtaatatactgtctacaccttggaattttggaataaatagtcctgaaagaaggggacttaattctggttttgcataaaaaacttgaatcccaaaagcaattactacaatgaaaatcattcctgtaataatagcttctagtggacgaaatcctctacgttgaaactcaagaataataaatgatccggctgcagtaattaaagcggcaggtagcatcgggattccaaatagtaagtaaagccccaaagcagctccaataaattccgctaaatctgtagccataataactagttcaccttgtatccataagccgatagacacaggctttggaaagttttcacgagctatttcgggtaaattgtttcctgtagcaattcctaatttagctgataaagtttggattaatacagccattaagttagaagcgagtataacccataatagtaaatatccatattgtgaaccagctgcgatatttgtagcaaagttgccaggatcaatataagcaacggacgcgataaaagcgggtcctaaaaatggtaacagtcttttccagccttttgtttctccacttaaagctaagtgagctgattgtacagttgtactttcagaagggagatgttcatcttttgttatatctttattcatagtagttttcccctttaaaatgttaacttgatgaaattattgtatttattcttactcattatttcaatacatttaaatatattatatggtaatttcatttgaacacgaaagtttccttaatgcaaattatatgcctttatgcaatggatggtgtgataacgtaaaatgaattgggagtttatggtgtgatgacctggggaaacatagtgaattaaaaggctgtttttgaaatttatgtgaacataaagctgataatacaacatattaattgatggaaatgcatttgtatgatatataatatatggggattacaacataaccataangtttgggggggaatcttggtttttattttgtaacttgtggaattgttttaagaaaagaaaagggaatcattttcttataaatatgattgaaaagacctaacttttcctgttttaaaaatggatgggggggaaaaccttgtgaattcaagcctaatggtttgcttgtgtttggccccccttggtgacccatttccagaggattgtattgtctcattctaagaggtaaaataatgggtggggagaatttttttatttttatgtttnataa

SEQ ID NO: 1071 - DNA, 2647 bp, Bacillus thuringiensis
gaaaaacacaagattgtaccagctttagcgacctatgtgctaaagctgttttatttttctcttcccacccttcccatttttgtgtaaaattttaaatagtgatgaagtttcgaggtgaatagaaatgaaacgaatagatctcatttttaacgcaatacaaaaaggcaattatacagaaggtgtaaccgcatcagaactcgctacatttctgcaactagatcgcgccaatgtaagtagcgatttaaacaaacttgtaaaagataaacgtttattaaaaacaaatacgcgacctgttcgtttttacatagaaacgaacacttcgttggaaacgcattcaaaagacataacttcattagatacatttgcaattgaaaatacgagccttaaaattgcaattgaaaaagcgaaagcttctattctctatcctccaaacggtatgcatactttactactgggagaaacaggggtcggaaagtctatgtttgcttctttaatgcacgaatatgcaattgaagttgaacagcttccaaaagatgcaccatttatcgtatttaactgtgctgattatgcaaataatccacagttactactcgggcaattatttgggattaaaaaaggagcttatacaggagcaagtgatcaaaaagggttaattgaaaaagcacatgaaggaattcttttcttagatgaagtacatcgcctgcctccagagggacaagaaatgcttttcacctttattgaccgcggagtataccgccgccttggagaaacagagaacgaacgtaaagcacaagtattaatcattactgcaacaacagaagaaccaaattcatttttattaaaaacatttacaagacgtataccaatgactgttacgctgccaccacttcgtgagcgtacacataaagagcgctttgctttactacagcgatttttcacaaatgaagcaattcgtctgcgaaaagacattcacgttagcccaaatgcaatgcgtgctttcgtcttttacaattgtcccaataacattggtcaattaaaaacagatgttcaaattgcctgtgcgaaagcctattctgatttggtcacaaagaaacgtgattctgtctatgtttcaagttcagatttaccttggtatatgaaagaagggttgttcattgaaaggaagagccgtcacttataccaaataccaaatgaaacatttgtatttacaggtgaggaaggttggagtaatcataaaacagaagatgaaaaacgctcttctatttacgattatattgattataaatacgaagaacttcaagcacgtggtattgaagaggaagaattagaattactaatagaaaatgatgttcaaagctttttcgtacaatattttaaccaaatatcaaaaaaaacaagccatgaaaatgtttttaaaattgtggatcgtaatatcgtttccgtatgtgaaaaaatagcggaacttgctgaaaagcatttatctaagacgtttgatgaaaaagtatttctcgctttaagtttacatgtacagacaactctacaacgtttacaaagcggcaaacaaatacatcacccacaattaaatcaaattcgtacgaaatataaagaagctttttccgtagctatgcaatgcattcaactactggaggaagaattacaaataacaatgcctattgatgaagctggctttttaacaatgttcttcgttgttgatccaattcctgcctcacaaacagaagtaaaagtattaatattagcacacggtaatggcatcgcaactgaaatggcaaacgtcgcaaacgaacttctcggcattgaggaagtaaccggtattgatatgccgttacacgaatcaccgaaagatttcttggaacgtgtgaaagtgtatatgaaaacactacaaaatgtaaatgggcttctcttacttgtcgatatggggtcacttgcttatatcggtgacatattagaaacggagttcaaaatccctgtacgtgttctctcgatgacgagcacaccacacgcactagaagcagctcgaaaagctcagctcggttattcattagatgcgctgtatgaaacagtaaaaaatttaacaccattttacttaaacgtacaagaagaaaagaaaaaacctctctctccaatgaaatctgttattttaacagcttgcttaactggtgaaggaagtgctttagctattcaaaaaatgttagagaactatttacgatttgataaagacttaattgaaattattccaattagtatcgtccatgaaaaagatttaacgaaaatgattgagaacataaaaaaagagcgtaacatcatttgtattgtcacgaatttcgatgtgcaagtaccatgcttaacatatcatttccaagacatcgtaaactacacagcgattcagccaattcaagaattaattacgtatgaagaaacatatgcaaaaatggcggatattcttgaacaacaaatgcagcgtaacgatggagcattacttatcaaaacaattcgttacgcattaaatacaattcaggaattaatttccttacagctaactcctgatagcttaatgggtgttattctgcatatgagctgtatggttgaccgtcttaaaaaggagaaagccttcttcctcaccctgaat

SEQ ID NO: 1072 - DNA, 3570 bp, Bacillus thuringiensis
cgaatttatttaatgaaatatttggattaggctgtgtggggcactctaggatgtggcgtctttaaacatattcaagaagtacgtgctggacattctataacatttacacgtcataaaaaagtagttactaagtattggaatttagaaagtaagttccatacagactctatagaagatacatcttcgcatattttatctattttacaagatacagtaaaaagacaattaattgccgatgttcctctcgtttgtatgttatcaggcggattagactctagcggtattactgcacttgcgggtaaagaatttgctgctgaaaataaaacacttcatacgtattctgttgactttgtaaatagcgcaaaagatttcgaactgacatttgctcgcactggtttagacactccttgggtaaaacgcgtttctgaacatgtcgggacagcgcatcatgatattattgtgaatgctgaagaattagcaaatcacttattcgttccccttcatgcaaaagatttaccgagtgctggtgaaatggaaacttcactatatttactattttgcgaaatgaaaaaagatgcgaccgtagctttatccggcgaatcggctgatgaagtattcggtggatatccttggtttcatcaagaagaactactatatgtagataagtttccttggctaacaaattggaaaaatacatctcctcttctactaaatgaagtaagtaaccaatgtaatctagaagactatattgatacacgattccaagaagcgatacttgaagtacctactcttgaaggcgaaagtaaaaaatccgcgaaacaacgtcaaatgttttatttatttttaacaagattccttcctttcttacttgaccgtaaagatcgtatgagtatggctgttggatttgaagttcgtgtaccgttttgcgattatagattagttgaatatttatggaatgttcctttcaacataaaaagtattgataatattgaaaaaggcattttacgtagagcactacaaccagctttacctgacgatgtacgcaatagaagaaaaagcgcttatccaacttcacaagatccacactacttacaaacaatccgtaatttaacacttgatatgtgtaacaataaaaacaatcctattttctcacttattaaccattccatcttactttcaattgctgatcaaagtaataaagtgattaacaattttgaagcaagaagtgccatggagtatatgctacaagtaaatgaatggttgaaaacatatcacatccatattgcttaacaaaaaggagttcaaggataaaaaccttgaactccttttatattaattagcacattgtttattatcagtatcaatagaccatccaataatcgtggcacagtctctacctttccactgtagtacatttgttaatacgggctcaatctgcaagcgagttccgtcgtgtaatatttctactaaagattgatcatcatcaaaccttcgtttgtcacactctaaaataccgtccgttgccattacaatgtgattcattcctttttctaatcctcttacacctgacgtaaagcaaggtgtatttgctgcaaaaatatttttcctgccaatatattcgtaatttttccgtttatttaatcgtccttttccatttttcgttttctcagaatggaataaatacgcgaaacaatcaccaactgataaccaatataaaaattcgccttttcgtaaacaaattaagcaagcgagttcctcatcatcttgatcacactttttaataaataactcatctgtaaataacgctaataagtacatatgtgtatgatgaaaagctaaatgtattggataggaaaataactcttttaatttctcttttctttctgaaatcgcttctattatataatcaatattttttgttttgcggtgtgtatcaaaaatcataacaaattcaaattgtaattcagggtcccaccaagcaagtaccgcatctcctcgttcatatgcatcactttcttgatttcccccatatacgccgactgaaagaggaccacatttttcaacatgtatttcatctacatacatctgttcatgactcatccatttgaatgtattcacaactatcatcctctctcttgctaaatgtatacctttacacatagattaccttatatttcaataaaaataaactttttcaacattttttatccaaataaaaggattttatttctaaaacaacgaatatatcttactatacgatataaaaaaggggatttattattatgaacaacattaatcaacattgggagagcatttattatcacttacgatacgaatacgaggacaatctttcccaccaagcaattcgtattttacaaatcgtttctcgtgagaaagatataacaattggaaaagtcgctactgagcttagcctttctcataacacagcatctgaacatataaagcgccttattcaaaagggtttcatcgttaaagagagaaataaaaaagatgaaagagtggtaaaccttacattaacaattgaaggaattgaagtattagaaaaacatactttactagataaagaaaagataaaaatattagaatcacagttatcaaaagaagaactacaattaattgaaaaagcattttcgttattagcgaaggaggcaaaatatgcatttcctcgttaaagtaatcgtttcggcacttattatcggcgttatcactgaagtcgccaaacattatagtacgataggtggctttattgctgctcttcctctcgtaagtttacttagtctattttggatttcatttgaaggcgggaataaacaagaattgagtcaatttgctttaggggtattatatggattccccgcatcagcactactattatttattgtctatattggtttaaaaaattcatttacacttagtacatctgtcctactcggtataggtgtttggtgtatcgtttttgcttttcaaaaattatttcaagcttagggggaattaacattcataaatttgtagaaataatggggcaaaatatagaagtacatataaaagaccaactatgagaagtcaaggggagttttttatataaatagggggtgtttttctaaaaaagggcgtgccaaataaacctaaggattttcaaaaaaaatgaaaaggtcatgtttctgttgtgtgaggtggtacttcataaggcttattgcttttaagaatggcatagataatgtaacacagctttctagctaccgcccctatacaaacatagtagtgctttccttgctttcgtttcttttcataaaaagcttttaatacagggtcatgtttatgcgctgtaatagccgcttggaataaggctctacgcaaatgagaagaaccacgtttggatatagacgtacctgaggcttcaaattgtccagattgggacacagaggcatcaatgcctgcgtaagcgacaagtttagatggtttgtcaaagcggtgaatatccccaatttcacttagtatagtggctcctaaaatgggcccaacacaataaaagtcatgataggagtaata

SEQ ID NO: 1073 - DNA, 4389 bp, Bacillus thuringiensis
tcgattaatggcttcccgtaatctatcttctgcatgcaagagaccaacacggacatacccttccccatgcttaccaaatccaacaccaggagcaactgcgacatgtgctttttctagtaaaatatcagaaaattgctcagaggtatatccttttggaacgggaagccatgcaaagaatgatccttttggaatgtctacattccaaccaattgagtgacaggctgaaataagagcgtttcttcgagattcgtaactatttacaaggtctattacgcaagactgtgaacttaatagcgcttctcgagcagcatcttgaactgcaccgaatatactaacatacatatgatcttgtaataggttaattgtttcaatcacactttcattccctacagcaaaagcgatgcgccagccagccatattgaaagtttttgataatgtgtaaatttcaattcctatatctttcgcaccatctgcttgcaagaaactaacaggtttttgaccatcaaatccgatagcgccataagcaaaatcgtgaacaactaatatattatgtttattagcaaagtgaatggttgcatcaaaaaaatcttttgatgcagtagcaccggtaggattatttggatagtttaaaaacattaattttgcacgctctgcaatagagtcatcaatgtttgtataatctggtaaaaagttattttctgcaataagcggcattgtttcaaagtgtgcttttgctaaagcaaccccggataaataatctggataacctggatccggaacgagaatcgtatcaccaggatttgtaaaacaaatcggtaattctactagtccagccttcccgccaaacaaaatagcaacttcagtttttgggtttaattcgacgccgtattcacgtttatagaatgtagccacggcttcctttaagctttcatgtccgcgaaatggcggatatttatgatgaatggtcttttcggcagcatcttgtaaagcttttacgatatgctgcggtgttggttgatctggattaccttgacctagattaataacatcgtgaccagctgcaacgactttgttaacttttgcaacaagtgaagcgaaaaattgtgttggcaatgatgttactatctcagaaggttgaaataatttcatactttccacctcttttgaaagttgttacaattctagtgacaaatgatataatctttccagtattttgtaaagaaaaaaataagaatggggctgaaaaaatgaaagtcgcatgtattcaaatggatattgtttttggagatgtagaaaaaaatattgagaatgctaaaaataaaataagcgaagctatgaaggaaaggccagatgttatcgtcttaccagaactatggacaacaggatatgatttaacgagactttctgaaattgcagatagggatggagtggaaacgaaagaaaagttaatagaatgggcgaagcaatatgatatacatattgttggtggttctatagcaaagcaaacagagcaaggcgttacaaatacgatgtatgttgtaaataatgaaggacagctagtcaacgaatatagtaaagtacatttatttcagcttatggatgaacataaatatttaatagccggtaatggtacgggcgaatttaagctagatgatgtcgaatgcgctggaacaatttgttatgatattcgttttccagagtggatgcgtgtccatactgctaaaggggcaaaagtattatttgttgtagcagaatggccattagttcgtttagcacattggcgtttgctattgcaagcaagagcagttgaaaatcagtgttatgttgttgcgtgtaatagagcaggaaaggatccaaataatgtatttgcgggtcattctttaattgtggacccttggggtgaagttgtagtagaggcgaatgaagaggaatcaattttatttggagagcttgaattcgagaaaattaaagaagtacgtaaaggaattccggtttttgcggatcgccgtccagaattatacaaataaaatgttgacaagtgatttttattcttggtatagtcttcaacataaagttaaaaattcaaaaaattatacaactcttatcaagagcaggtggagggatttggcccgatgaagcccagcaaccgaccgtaataccattgtgaaatggggcgtttattacgccaaaaggcacggtgctaattccagcagaaagtaaaaccttctggcagataagaggggagaagataaacttcaaacctctttcttagtggaaagaggtttttctatgttagaaaaacctctgaatttaaaaagggggagaagacgatgggatattattcattaacagaaataacagctgtacaatatgcgaaagatcatggctattttgaagcgaaggcaaatgtcgtttgtcatgaaattggagacggaaacttaaattacgtgttcaaattagatgatggagagaaatcaattataataaaacaagcactgccttatgcgaaagtagttggtgaaagctggccattgtctataaaaagagcaacgattgaaagcaaggcattacaaatttttgcgcagtatgtaccggattatgttccagtagtgtacagtcatgatgaagagttagcgataacggtaatagaagacttatcaagactaacaattacaagaaaaggattaatagacggagaagaatatccgcttttatcccagcatatcggccgttttctagcacatgttttattttatacttcagattttggtttacagtcagaagagaagagggtactagaaggtacctttgtaaatccggacctttgtaaaattacagaggatttagtgtttacagatccgtttggacattatgatacaaatgattatgagccagatttacagctcgtggttgatgaactttggagtgataaaactttaaaactaaaagtagcacaatataaatataagttcttaacaagaaaagaaactcttattcatggtgatttacatactggtagtattttttcgtcaccttctgaaacgaaagtgattgatccagaatttgcgacatatggcccatttggatttgacataggtcaatttattgcaaatctattattaaatgctttatctagagaagaagaaaaaagaagtgtactatttttccatatagaaaagacgtggagttattttgtagaaacttttacaaagttatggattggagaaggtgtagaagcatatacgaaagaaaaacaatggttaccaattattttgcaaaatatctttactgatgcagttggatttgccggatgtgaactgattcgtagaacaattggtttagctcatgtagcagatttagatgaaatagaaaataaagaaacaagaattcaagctaagaaacaagcgctatccttaggtaaagaactaataaaatatgaatctaaaagtgctgatattcaactgtttcgaatattatttcaacagacagtttcagggggcgtaaaagcgtgagtacaattgttactgttccgagatctgtaagctggaaaggtgatgcaattgcggtattaaatcaaacgaaattgccgcatagcacagaatacaaaacattgacgactattgaagaggtttggaaaagcatcgtaatgttagaagtacgaggagcgcctgcaattggaattgtagctgcatttggcttggcgcttgcatcaaaaaaatataacactgtacatattgaagaatttcaaaagaagtttaatagagattgtaattatttaggaacgtcacgcccgacagcagtaaatttattttgggcaattgatcgtatgagagaatctattcgagagattactacaataaaagaagcacaaaaaacattagaagaagaagcgcttcgcattcagcaggaagatgaagaggtgtgccgaaatattggggaatatgcgttaacatgttttaaagatggcgataatattttaacaatctgtaacgctggaagtatcgcaactgccagatatggaactgcattagctcccttttatattggaaaagagaaaggtgtgcgtttacatgcatatgcgtgtgaaacgagaccagttttacaaggtggtcgcttaacgacctgggaattgaagcaagcaaatattgatgtgaccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttctttctcatatcgatgggatttccggccatttt

SEQ ID NO: 1074 - DNA, 4314 bp, Bacillus thuringiensis
cacattatcaggtagtacatgtttaaatttattttcaagcgcaatactttctatattaaatggttttgtcttgtatccatttagtgtaagaatcgaaaagtataacgcatacatttcatccacactaaaataaattggcgataacacactattttctataattttataacttccatttctacctagttcagaatatatgggtacacctatttcttccaatgattgaatatctcgtaaagctgtacttttagaaatatcatatctaaccattaaatcttttaaattaaaatttcttttattatttaagaaaataagcatatcatttattcgttccgtttttttcatatttacctcccgaaaggtgtcatgtattgaaacctttttagtctatattataattattaactaataaaggagttgtaaatttatgacattagaaatagctatttttctctcactgaatgggcaagcaaaggaggcaattaacttttatacacgtaatttagaagccaaaaaattaatggttgttacgtatgaagaactggcgaaaagagatcgttcttttaaaattacaagtgaaaataaagaacatatcgctcactctgttttacaaattgggaatacaaagctaatgatagcagaagatacaatgaatactaatgaacgttataacgttggaaataacatgtcactttgcattcaaagcgctaatttagaagaaatacaaagattttataataatttaatttccgataagcatgtgaaaataatctctccgctagaaaaaaatatatttagtgaagcatatggtattattgaagatccttatggcatacaaatccaattaatgtatgataaacgactaaactaaataattaatcatattcacatattcctaataaaaagacacgaatttcgtgtctttttattttatagaaatgactctacctttttcactgctttcaatcgctaattgaatcagtttaataacatctaaaccttcttttgctgttacaggtagtttctcaccatttaatatactatctcgtacacctttataataattgtcataacaaccgacttctgttggaatacgctctaagctttcttctgtttctaaagtagcaaaattctcttcatcgtctactccataaccgttatcacctggcttcattccattttttaattgctcttcctgcgaatccataccgtacttcacgatagaacctttctctccatgcactataaaatgcggtccagcttttttcacataactgctactacgtaaaatgacacgtttaactccgtaatgaagtactatgtggaaataatcatccacctctgcacctggtctttgttttattacatctgcacttatcgcatcgggtttcccgaatattgataacgcttggtcaattaaatgcgatcctaaatcgtataatataccggagcctggtagatttttttctctccatcgatcacgtacatgtggacggaaacgatcaaaattcgattcatatgcgtatacattccctactctgttttctcctaacaatttcttaattgttaagaaatcattatcaaaacgacgattatgatatacgcttaacattatattatgctgctctgctaatgaaataagcttttccccttcttcaattgagacaacaaatggtttttctacaacaacatgcttaccgtttaaaattgcttcttttacatatggaaaatgagttgagttacgtgatgtattcacatctttgtcaacagaagactggcagacgaattcatcaattgtactaacaacattagcatttggtaatgtttcttttactacctcttcttttgaggataatacagcacgaatatcatattcttctatcgtttgtaatagtgggatatgaaatgtcgtactagaaaaaccaaatcctacaatccctacacctattcttttcatgttgcccctccatttgtcccgctttaacaggcagtaagattcctaactcaaaattcagcgaaaactaaggaactaggtgaggaatcaactgctcgttaaagcccgattggtttaactaataatcagtgtggataaagaaaatccccattgattaaagtttcactttatgagaacgatttcattcagttattataacaagattattattatttatataataaattgcctagaaaaaagcatcttgctattattcatagcaagatgccctctttattctggtcttttcttcgtccacgtttctactacttcaccagtatcattaacatctagcactaggctaccattactataccggtctttatttcgatacgctttcggatcaatctcttctacaatgtttttctctgtcttcatgtaaactaattcatcgtcccgaacaatttcaataccgacaatgcggtacggattacgttttaattctttgaaaataacaagacctcgtttcgccctcgttgatttttcaatttctgatgcttttagacgttttacagcaccgcgctgtgttacgagaataagttgatctttgtcaccatttaacggtttaccagaagcgacatagtcatcttcttttaaattaattgctttcacgccagcagctcttacaccgactggacttacttcatcttcatggaaaataagtgcatatgcaccgtgtgtagcaagaacgatatcactcgttccatctgtcgcaaatatatcgacaacttcatcatcttttttcaagtttacagcaacgaatgcccttgaataacgctgaactttatattgatttaattctgttttctttatcataccatttcttgttacaaatacgataaatcgtttttcttcctcaaagttcggtacaaccgttgcccaaatgattgtttcatcccggtcgagtgaaacgatattagcaacgtgctgacctaaatctttccaacgaatatctggcatttcgtatactggcagatatatatagttgcctttattcgtaaataagaggactgtctctgtcgtattcgtatcgaatcgttcaagtaagatgtcaccctctttcataccgaagtctttgccatttgaggcattatgtgagcgccatccagtacgtttcacatatccttctttcgttacagtaacgatgacatcttcttgtgggatcatcacttctacatcgattttaatttcctcgatttgatcttcaataattgcgcgtcgatcatcactatatgttttcttaactctctttaaatctgttttaattacttgaagtaatcttttttcactttgtaaaattgcctgtagctcaataattttcttattaagctcatctgcttcttcttgtaacgccgtaatgtctgtattcgttaagcgatataattgcaaggaaacaattgcttctgcctgtgcttctgtaaagccaaattttgcacttaaattatctttcgcgttacgtttatcttttgaagctcgaattgtttcaattacttggtctaaaatcgataatgctttctttaaaccttctacaatatgttgacgattttctgcttttcttaattcatattgcgaacgtctcgtaataacctctttttgatgtccaatataagcatctaaaattttcggtaatgtcataagtgttggacgacgattattgatcgctaccatattaaagttatatggaatttgcaaatctgtatttttatataaataatttaaaataccttcggcgtttgcttctttctttaattcaacaacaattcgtaaaccagtacgatctgtctcatcacgcacttcagcaataccatctaactttttatctagacgtaattcatccattttctttacaagatttgccttattcacttcgtaaggaatttcagtgattacaatttgttgtttcccaccgcgcactgtttcaacttctgcttttccgcgaataataattttacctttacctgtttcatacgcctttttaataccatcaatcccctgaataataccgcctgttgggaaatctggtcctttcataactgttaataaatcatcaacagtactatttggcttatcaatacgcatcattgtagcatcaataacttctccaagatgatgcggaggaatttctgttgcataaccagcggaaatccctgtagatccgttcactaataaattcgggaacgctgctggtaatacaaccggttcttcactcgtatcatcaaagtttgacacgaattcaactgtttctttatcaagatcacgtaataattcagatgcgattggtgataaacgagcttccgtataacgcatcgctgccgctgggt

SEQ ID NO: 1075 - DNA, 4276 bp, Bacillus thuringiensis
agactctcatttgtaatagacataacactctctttttttccatttgcacttaaacgatacggttctactttgcacatttcttcaattaaacgctcgtttgcataacgcattttatcgtcataagtggcttcaattctctgtaacagtgctcttttttcactttctacgatagaagataggaaaccgttgccctccgttgctggatgtaacacaatatctgacaacatagaaagcgctttttcaaataacggtggtgcatcatgtaagtaaacttcatttgcaatgtctacataaatggagataatatggtcttccccttttttacttacatctaccgctaaagaagatccgtataattcttctaaatattgacgaagacgaattacagaaggtaatttttctgtcgcactttgcaatacgtatggcaataaggcacgctctgtcaccgtctcctcatttaaaggcgctttaaaacgaaatacaaaggtattcgttttatatttatcagtcggaataatatgtacgcgcaaaccatctaactcatgtagttgttgttccattagtttcatttatagccctcctttacgtatataggaatattcctcttcaatatacagttcttagaaataaaaaatcaacttttctcccttattatgcttacatatgattctttctaaaaactttaatatgtaaggaacatagtaaaattccgtattaaatatattctatgtaaaaaagcccacactaatgtgcgagcttttttatacttataaaatacttatcgttttcctttttcataaggagttcctaatgctttcggagcttcagaacgacctacaaaaccaacaagcgctaatattgtgaatacatatggtaatatcgttaataaaacacttggaatttgatctaatacaggaattgttccgcccgttacacttagagattgcgcaaaaccaaagaatagagctgcacctaatgcgcctagtggattccacttcccaaaaatcatagcagctaaagctaagaaaccttgtcctgtaatagttgcccctgagaagttattagaaattgacattgcaaaaatcgctccaccgattccagcaaacactcctgaaatacagactccaatataacgcattttatatacattaatccccatcgtatccgctgccattgggtgttcaccaacagcacgtagacgaagaccgaacggtgttttataaataacataccaaacaacgaatgctaaaataatggcaatatacgacgttattggtacgttcgagaaaaatattttccctaaaaccggaatatccgaaaggcctggaatatcaatcttttcaatacgatactgaataaagtcagtctgccctttatcaaaaatcttcttaattgcaaatactgttaaaccaagagataagaagttaatggctacaccacttacaacttgatctgctcggaatgtaatagaagctaccgcatgaagtaatgcaaataacccactaccaattgccgcaaataataacgcaatccatggagtcatcgttccccaagtatcacccattaataagtttgtaacaactccaataaatgcaccaaatagcattagtccttctaatccgatatttacaacacccgatcgttcactaaatacaccacctagtgctgtgaaaatgataggtgccgatgtatataacgtacccgtcacaagaatggctaatatatctaaaaagctcatttatttcccctccttgctcatgcgtgtaagcgcccatcttaacacataactacatgcaacaaagaagatgatacatgcaataattacattaataagctctgacggtacatctgcctcaaagttcatttgaggggaagcacttttcaaaccaccaaataataaagctgaaaggattataccaaacggattattccctccaagtaatgctacggcaatcccatcaaatcctactcctgtaaacgaagacatcgctgtcatactctggaatgtccctaatccttccatcgctccaccaatccccgcaaatgcaccagcaattgtcatagagaatactacattacgagaaactttcatacctgcatattgagaagcatgctgattaaatcctacagactttaattcgtaacctaaagttgttcgatctaataagaaccacattaaaatagcgattaaaattgctacaataattccccagtgtagacgtgaaccgtcagtaatagaagcaagccagtctgaagatagtgacgcactctctttaatatcatacgttttgtcattacccgcatgtaagaaacgcttaatgatgtcatacgttacatacaacgcaatatagttcatcataatagttacaataacttcattcacttgaaacttcccttttaaatatcccggaatgaagccccaaattccgcccaccaatgcggcaaataaaatcgataatggaatatgaaggaacgctggtagtgagactgcataaccgaaccaaaccgctgcaagccaaccaactaacaattgaccctctaccccgatattaaataaacctgtacgaaatgcaaacgcgaccgataagccagcaagaataagcggtatcattgtacggagcgtttcaccaatcgcacttgcgctgccgaacattcctgtccaaagtgcactataaccaacaattggatcatagccactaactagcattacaatcgctcctacaagtaagccgaaaataacggatagtactgggactaaaatatttatcgttcgttctgttaaaagttttttagccatttgtacccacctgctccttctttgttcctccagccattaacaatccaagctgttgttcattcgtttctttcgcatcaactattgctacaatttccccttcataaataacagcaattcgatcgctaacatttaagatttcatctaactctaatgataaaagtaatacaccttttcctttatccctttgctctattaatctcttatgaataaattcaattgctcctacatctaaaccacgtgttggctgtgccgcaattaataaatctggatttcggtctacttcacgtgcaataattgctttttgttgattccccccagatagagcgcgtgctaacgtttgctcactaggtgtacgtacatcaaactgttcaataagagcctttgctttttctgtaattttgctaaaatttaaaatccctttctttgaaaacggatttttatagtacgtttgaagaactatattatctctaacagaaaaatcaagaacgagtccgtgtttatgacgatcttctggaatatgaccaattccttcttctgttattcttctaacaggccaatttgttatttcttttcctttaattgcaatagaacctgactcaacttttcgtaaaccagtaatcgcttctattaattcactttgtccgtttccatcaatccctgcaatcccaacaatttcccccgcacgaacagttaagtcaaggccttttacagcaggtagttgacgtgcatcgtgaacaacaaggtttgcaattgaaagtacatcttcttttggcttcgcgtctattttttctgttttaaaattcacttgacgtccgaccattaattctgcaagtttattttcatccgtatttgcaacgtcaaccgttccaatcccttttcctttacgaataatcgtacaacgatcgcaaacttccataatttctttcaacttatgtgtaataagaacaatagattttccttcttgtacaagctttttcataatttgaattagctcatgaatttcttgtggtgttaacacagctgtcggttcatcaaatattaaaatttctgcaccgcggtaaagagttttcaaaatctccacacgctgttgcataccaactgaaatatcctgtattttcgcatatggatctacagccaaaccgtattgttcagacagtttttgaatttctttagcagcatcctcaacagcaattttcccttttttcttcggttcatttccgagaataatattctctgtaactgtaaaattatgaacaagcataaagtgttgatggaccattccaataccaaggtcatttgctatattcggatttgtaatttttacaggtttacctttaattttaatttcacccagctctggttggtacaaaccaaatagtacattcatcaatgtggatttccaagcaccattttctccaagtaaagcatgtataacaccaaagctttacttgatctgaattcgtgcctcaccatctctaa

SEQ ID NO: 1076 - DNA, 4214 bp, Bacillus thuringiensis
aaattaaagatttacgtagtgaaacacttactccttttggtacgtgtgcaacaatttttgctcctggttcgttcacagtaacccatcctaatccagagaatacaacatccgttttaggttcacgaatattaaattcgtatttcactagctcaggcatatttgctaattcttctggcgttggtgggcttaataaatccccggcatgatttttatataattcatctgctttctcaagctttgtacgatggattgttaagcgattcgagaagtgacaagtaaatgcacgacgaccaccacttacataatcaaaacgtgccaatccactaaagaataacgtttgttcttcatttaattggaataccatcggcttaatttcttttgttggtgtaataagctttaagctttgctttccaacataatgagccatttggtggtggttaataatacctggcgtatcatataaagaagactcttcgtccaatggaatatcaattaaatccagtgttgttcctgggaaatgagatgttgtaattacattttcagtctcatcactaaattctttaatcatacgattaataaatgtcgattttcctacattcgtacatccaacaacataaacatctttgccgccgcgataatactcaatagcatctgctagttcagcaattccttgtcccttcgctgcactaattaaaaagacatcttctggttttaatcctagctgctttgcactatagcgcatccaatgttttactttatcatgttttactgactttggaattaaatcagctttatttccaacaagtaatactttattattccctacgaaacgatgtaagccaggtaaccagctaccattaaaatcaaaaatatctacaattttgactactaatgcatctgattttccaattccatttaaaatgcgtaggaagtcatcatctgttaacgatacatcttgaatttcattgtaatgcttcaagcgaaaacaacgttgacaaatgacttgttctttctctaaagatgaggcaggagcataccccacttcatttttattttctgtttgaatttctacaccgcaaccaatacatttaattgtttcagtcaaactttattcctcccagttaattaaaccttttttcttcatatttttcataattcttcgttcaatttttcgattaaagcgcgttactaatccgtccgtttgtgctaccggtacaactaaaattgtatgaaggcctactcggtttccaccaagcacgtcagtcagtaactgatctccaattactacaacttcatctggctgcaaacgcatctcttgtatcgcacgcttaaatgcgcgaacaaatggtttacgtgcactatgaataaatggaatacctaatggatcagcaaaatctttcacacgttgctcattattatttgaaacgaccgttacttgaatgccttgctctttcatttccaagaaccatttttcaagttgcggcgttgcattgggacgatcccattcaattaaagtgttatctaagtcagtaataacgcctttaatcccacgtttttttaaatcttctggttgaacatgatatacatttttcacatattcatttggtaaaaatagtttcaatttctttcacctctttgaggatttttcataaaatttttcgacaacatttttcgatatataacctgtggataaaattgtacacattttccacattaattttgcagttaatttggaatttactaacaaactatacacactttatccacctaggtatgtggataaccactcgtttgtgactgtcatatttttttggtacattaaatgcatcaacgaatcaatccttatattattaggaggtgactcaccttgaaaacaaaacatatggaacagttatccactgagttactcactgagtcttattataaagcaaaagaactaaaattaaatcccgacttcattttacttataaaacaagaaatcattagacgctcattagaggacaagcttgtcaaatcatcttgattacatataaagtgaaagtttaatcagcccttaccaatcaaacagttaaaggataaattattagatgccctgtaaaaagagccatcctacgatggctctcgaataaacaagtactcccatctaggggatttcatcattaagtatctttgcccataactcttacttacggttataaaagcttttctttatttatgagctaagcgagtagctattttttcaccaagacgaagctcttgtccactctttaattcctgcactacttctatcatatctttttcaaacaataacacaactgttgaaccaaatgtaaagtatgccatttcttcacctttttgaacagtgtctctctcatgcaaaagctcaatactattaacaaacatagcacctacttttacaagagccatatgctcgccatcactgcttacttctgtaacagaacgataattttttgacagtggttctttcccgtattccataccagctgcatttaccggatatgattttctaccgagtacaaatctttcagtcacagaaccagaaagcggactatgaatgcgatgataatgacttggactcaaataaattaccatatatgtaccgcctgcatatcgcgttgcacgttcttcattacctagcatatccacgattgaatagcgctttcctttaatatcaaatgtttttgtatcctcaataggaccatgatctgcaaaaacaccatcaacaggactaacgatactcgatgcatctgtatcaatactacgctttccttcttttagcttacgcgtaaataattcatgcaatgttctatattccttcaaacccttttccatctcatcttgattaatttgaaaaactttcgcgtacgatggaataatgatagagctcaaacgagattgtgcaaatttacgtaatatataagaagtaaagcgaccatttgtaagttctatcataagtcgatataatgtacgtcgcaaattgcgaaaccccctaatcagtctataactttagttttcccttcttttctttctatatcatatgtaaaattggttcttattcccacatatcatataaagcagccttattatatatacagaaaactaagtatggtattattcttaaattatttagcaccttctaatattacagatagaatccgtcattttcaacagtgaacgtgtatttcttcttagcataacgcgttttcttttcttatttacaataaaaaaagcagcccattttaaatatggctgcttctaatacactttactctttcgcttttttctctttctctgcccttacaaactcgtggaacattttcattaaagcacgcttttcaatccgtgatacgtagcttctagaaataccaagcgccttagcgatttcccgctgtgttttctccttatctagcccaagtccaaaacgtttcacaatcacttctttttctctttcgtctaaaatatcgatatactctttaattttttctaactccatactaagctgaatcatatcaattacatcttcagactctgattttaatatatcaataagcgatatttcattaccctctttatcttgcccgatcggatcatgaagtgaaacatcttttttcgttttctttagtacacgtaaatgcatcaaaatttcattttcaatacagcgtgctgcatacgtcgcaagcttcgttccctttcctgcagaatagctctcgatcgctttaatgagcccgattgtaccaattgaaattaaatcttctgcatcttctcctgtgttctcaaattttttaacgatatgagctacaagccgtaaattatgttcaattaaaagatttctcgcttgagcatcaccttgctccattaactctaagtactttctctcatcatctgatgataacggctgcgggaacgcattgttcttcacataagaaacaaagacaaacacttctcgaaccatatatccaattgcggcgaatagactcaaacctttcacctccgccaaaatagtggtctttattatgtgtatgtgggcgtgaggttgtttgtgtctgtacagtttatttataaaactcaacacttctaacatttaaaatattttattgttatattataattaaataaaattgttatttatatatgaatatgctattaaaggggacactattcatgattacattagaacgattattaaatgtaac

SEQ ID NO: 1077 - DNA, 4090 bp, Bacillus thuringiensis
gaaatatctgttgtagcggatcaagttggctctcctacgtatgtggcggaatttaaatatggttattattaagctcattcatacttctttatacggtacataccacgtatcaaacagaggctcatgctcttggtttgaatttgcacaaaagatattttcgtacgccaatatgaaagtgaatgtattacctgtttcaacggaagaattcggggctgcggctgcgaggcccaaatattctatttttcaacataacatgctacgattaaatggtttttcacaaatgccgtcttgggaagaaggattagagcggttttttatagaaaccaaaagtcattaacaaatttctgttaatgacttttttgtttgcctttaagcggttttatggtactataattatagtatcaggtactaataacaagtataagtatttctgggaggatatatcatggaactattacaagggaaaacatttgttgttatgggcgttgcgaaccaaaaaagtattgcatggggaatagctcgctctttgcataatgcaggtgcaaaattaatattcacatatgcaggagaacgtttagaaagaaacgttcgtgaattagcggacacattagaaggacaagaatcacttgtattaccttgtgatgtaacgaatgatgaggaacttacagcttgctttgaaacaattaaacaagaagtaggtactattcacggtgtagcacattgtattgcttttgcaaatcgcgatgacttaaaaggtgaatttgtagatacttctcgcgatggatttttacttgcacaaaatattagcgcattctctttaacagctgtagcaagagaagcgaagaaagtaatgacagaaggcggaaatattttaacattaacataccttggcggcgagcgcgttgtgaaaaattataacgttatgggtgttgcgaaagcttcattagaagcgagcgtgaaatatttagcgaacgatttaggtcaacacggtattcgtgttaacgctatttctgcaggaccaattcgtacgttatctgcaaaaggtgtaggcgatttcaactcaatcttaagagaaattgaggagcgcgcaccacttcgtcgtacaacaacgcaagaagaagttggcgatacagcagtattcctattcagtgatttagcacgcggtgtaacaggagaaaacattcatgttgattcagggtatcatatcctaggataaatataatattaatttttaaaggacaatctctaaatgctgagattgtcctttttatttgttcttagaaagaacgatttttaacgaaagttcttaccacgtgatgaatataactataatagtacacgatttatttagctacgtatggaagtgggagggacgagtgtgaagaataaaaataaaagttcaacagttggaaaaccgttgttatatatcacgcaagtaagtttagaacttgctgcaccgaaaataaaaaggattatcctgacaaactttgaaaatgaagatcaaaaagagaaaagtaatagacaagaaaatattgtaagaagtgctgtggaagaggtaatagaacaagaacaacaagaagagcagcaagtggaagaaaaaatagaagaagaaaaagaagaacacatagaacaagaagagcaagaaccagaaccagtaagaactgtcccgtataataaatcatttaaggatatgaataatgatgaaaaaattcattttttactaaaccgccctcattacattccgaaagtaagatgcagaataaaaacagctacagtctcatatgttggatcgatcatatcgtatcgtcatggcattgtatctattatgccgcaaaatagtatgagagatattaggttgtctatagatgatatccaatcgattagtatggccggtttttaaatatgtaaaggtggtagaaagcttctaccaccccaatagttttttagtttactttacgatagaaacgtcgcgtaagcattgaatcgcacagaaacagcttaaatcaacagtaatgcaagtagttgtagatattaatcttgcatttggtacagctaaaaacgtacaaattggatcgtcaccaggtggtaccggagtaccgtcacctaatactacagttaatacacgtagcacagcacagctatcatcatctacactttccacacggaaaattggagatcggcagctagtaaggcttgaagatggtgcaaatgcttcaaaaggttctccagtttttgtgtataaaataaaagggcgtgtatttgctactgatgcagtattgtgtgcacctaaaaatgggatttcacaaccagatccacatgttgttgtagaacaatcttgtaattcattgatgaattttacaacgtcaactacacaatgagaagagccatggtgtttattttcgttacaactcattaatgtcactccttatcttcttgtttgtatttacattaataagatattggagtcgaggagatttggtcacaatctcaagacctttttttttaaataggcgaaagaggataagggtaggtggaattatgctgtttacaagctggcttttattttttatttttgcgttagctgcttttaggctcactcgtttaattgtttatgataaaattacagcctttttgcgaagaccatttattgatgaattagagattacggagccggatggaagtgtatcaacggttacaaaagtgaaaggtaatggattaagaaagtggattggcgaattattaagctgttattggtgtacaggtgtatgggttagtgcttttttattagtcttatataattggatccctatcgttgcggaaccgctacttgcattattagctattgcaggagcggcagcaatcattgaaacaattacaggatattttatgggagaataatatattttcataatacgagaaaaagcggagtttaaaagaatgagggaacggaaataaagagttgttcatatagtaaatagacagacttgacagtagaggagacgcttgctgtgagcaataatctaaggcagaattcatatgacctgcagcagtggtatcatatacagcaacaacaccaagcacaacaacaggcatatcaagaacaattacaacaacaaggatttgtgaagaaaaagggatgcaattgtgggaaaaagaagaacacaataaaacaatatgaagaatgaaacactcatgctactgtgagtgttttttattatatataaaaagcggtatttctgtataagaaataccgctttttactagctaatttgtgcaactgttaatgctgcagcacgaatgtctacagttccaattaactgaactggcacaatttgaattaagtcaccaggatttaagttaataagaataacaccgctggatacgtctacttcaccagtaccaataacgttagaacgaactgctgtacctgatccaggaataatgttagctggtgtatttaatgataagaagaaacgaccagcttctggtgcagtaggtacgttatcaagactaattgttaatgtataactaatttgataaataccagctcgtagaattcgaatgccatctccgacacttactgtatcatttattacaggaacagtaatatttgggtttggacttacgctaggtaataatagtggtgtaaatagtgaagcaaactgaggtgcagacgcgttgaaagcaaaaccaaaggcaggtagtgtactagctggcttcgcctcacaatcgattttagtaaattcgcaatcagaagagaacatgtttttcactcctttatctgtttctactttcagttaatgaaaaggacaggttctatgttctagacaagttcccaattttaagaaatttacataagaatactctttaagcatggatttatcgtcgctgtactagatatgattacatgcacatttgcggtgtctgatcgttccacacttactacaatcagtgcttttgctatagacacacattcagatcgttcaacatttatcgaaaacagcgactccattaacggcactccgggtccaaatgatcgtccagacactggtatgaatattgaatgtttatctgcaggatcaggtgcatc

SEQ ID NO: 1078 - DNA, 3895 bp, Bacillus thuringiensis
ctacccatacttcgagaggtcttctttataatttatgcgggttttacctttttcgttgttttactttttcttttcgttcctgtaaagcgcttgtgtaatatagatgctatcaagcgtgaaataacattgaatagtaataccataataattaatacagctgcagattttgtcgcaatcaacttcgcatctggaataactccttcagaatttaatttccaaatgtgaaccgctaatgtttcagctggtctaaacggatttaaaggatgcgcaggacttgataaatccgctgctgaatttaaaatcggggatgttaaacccgctgtgtaaattaatgctgccgcttccccaaatatacgacccgccgctaaaataatccctgtaataatttgtggtaatgacgatgggataataatacgagcgattgtttgccacttcgttgcacctaatccaagacttgcctcttttacattatgaggaacttctgaaatcgcattttcacaaacacgcgttaaacctggtaaatttaaaatagttaaagcaagagcaccacccattactgtgtatccccaacctgtcattgtaacgaacactaacaaaccaaataaaccaacaacaatagaaggtaaagacgccatcgtctctatacatagacgaacaaaatttaaaaaacgtccttgttttgcgtactctgctaaatatattccagcacctaatccaagaggaatagatataataagcgttataacaagcatgtagaaggaattgaataactgcggaccaatcccaccaccagctcttgtattgcttggttctccaaacaagaaattaggatcccaaaatccccatcccttttgtaaaatttcaaatactaagaacactagcaaagctacaactaaagctgcaaccgcataaaagatacctgtccaaactttatttaccgttcttgcattcattattatcgctcacctctttgcccaatcgctcgaattactaaaataaacaggaatgaaataacaagtaaaatcatcgctaaagtccatagcgcattgttccaagcagttccgttcaatgtattcgtcatgtccattgttaaaataccagttaacgtcgctgtcggactatatattccttctggtaatttaatcgtattcccgattaccatttgaaccgctagcgcttcaccaaaagcacgcgctaaacctaaaacaacacctgttaaaatccctttcttcgcagcaggaacaattactcggctaatcgcttgccatttcgttgatcctagaccataagaagcttctaaataatcaaatggaacagaacgtattgcatcagaagcgatactagcaatagtaggtaaaatcataatacttaatacaacaatacctgcaattaagctaaagcctactcccccaaacgaatcacgtaatagtggtactaaaatcgtaacacctaataatccgtatacaaccgaaggaataccaactaacaattctagaacaggcttcaatactttatttccaaactttggcgaaattaaattcatgaatatagcaagagctatagcaattggtgcactaataataaccgcacctaacgaaaccaccgttgaacctacaatgaaaattaaagccccgaaggatccttgatcagcatttggattccattttgtcgatgttaacatctcagtaaatgagataccactttgtgtaaaagattgaatacctttcccacaaataaacgcaataatagctaatgtaattaaaacaataaaaataccacaaaacgtaacaagtgatcttcctatatattcactttttacgtaattaatttgttttttccccttcatcacaggacagaccccacttcacagattgaaatgaacaggactggccttgcagccagccccataaaattttattacttatttaatttagacattggaatgtagcccatatcttctacttgcttttcaaaatctttaccttttacataatcgatgtaagctttcgtcgcttccttcgcttcaccttttgttaccatatattcgtaagaccagaatggatatttaccagacgcaatgttttcaactttcggttcagcaccatcaattttcactgtttgtagtgcgccttttttctcgccgaccatgtaagacattgctaaataactcaccgaaccaggagtagagttaatcgcttgctctactgcaccgttagaatcttgtgttgtaccagttccatcattaattttcgcgtctttcataatcgttttttcaaatgtagcacgtgtaccagatgaagccggacgattaattacattgattttttcatcttttccgcctacttctttccagtttgttacttttccagtgaagatatcttgtacttgttgcattgttaagttatcaacttttacatctttatttacgacaagagcgaatgcaatacccgctaccttgttatctactaattctttcgccttttcagcatcttttattttatctccggacggaacatccgaattaccaatttgcactgcaccagatgctacttggttaatcccagttccactaccgccaccttgaacttgaatagaaacttttgaatttttctccatgaatttctttccagcttcctccgcaagaggtagaagagctgtagaaccagccgctgcaatcgtacctgataattcttgttttgtattatcgcttcctttagcagtttctttactagttgtatcttctgctttcccacaaccaactaatgctcctgctaccactaaagctgctaaagaaaatttaataccttttttcataaccatgtcttgtacccccatttggattatcacttttcgaattcattttctttcgaacacaaattcattgtaggacaacaatattatgtgagtgttaagcaatttttaattttaagtaaatgacgataataatccttaaaagctagaaatcccaacatttatagttaaataacccaacaaaaaccacactaactacgctgcaatgtaaatatattcttaacaatgtaaattcaatgtaaatgtttttctatctttttcccttttcgttaaagttacatttacaattccgctgtattttgtaatttttacacacctaatttatgcacattaaaaataatttcagtaatattttttagtacaactaaataaattggaacaattctaaaaataaatgaatatttttaaagtactaattgacaacataatccaatgtagtctactatattactaacaaaaagtttaccttaggaaactttttaaactcaaactaaaaatatagagatgaggtaacttttatggtatcggctaatataaaaccactttccgaatttaaaataggagagtttgtacaaattgagaagatacaattagaaggaactatgaaacgacgcttattagatttgggatttatcccgggggcgacgattaaagtattgcaacgcagtccacttggagatccggtcgcttatcaagtgagcaacacaactattgcactgcgtaaagaagaaagctcccttattttcggggtattaataggagatgatttcagatgagcaaacatcgtatcgctttagctggtaacccgaatacagggaaaagtacattatttaatactttaacaggcttaaaacaacatactggaaactggacgggaaaaactgttttaaaagctgaaggagaatatgaacataacggaagtaattatacattaatagatttaccgggaacttactcactatactcaaattccgcagacgaagaagtagcgagggattatattatatttgaaaaaccagaagtaactgtagttgttatagacgcaactgctatggaaagaaatttaaatttagcactccaggtg

SEQ ID NO: 1079 - DNA, 3709 bp, Bacillus thuringiensis
tgtcttaggggcaagtcagcctcattctgctgggttcatgagcatatccgggggcttaaaatggaattagaacagcatttaattaaagaagaaatggaagattttccattaattttagaatttgaacaaaatccaactaatgaaaactatgctaagttacgtaaagtagtaaatgaactagaaaatgagcacaatcatgctggaaatattataaaagaacttcgtaaagtgacaaatgactttactcctccagaaggggcttgcggtacttatcgacttggttaccaacgcctcgaagcgctagagtctgatttatttgagcatattcatttagaggataatattttgtttccgagtgccatcacgaaagcataagtcgagtccgggacatgagtgtaaatacttatgtcctgctttttcgtttcgcgaaaaatattcacatccccttcacataaaaccgaattttaacaatttgtgaatcattataaagatgtgataaatatcacatctcccccttatttgattttctataataaaaatataatcctttgttcaatatttcacataaaaaggggaaacgaaaatgaaaaaacgtttagttatgatcggaaatggtatggctggcattcgctgtatggaagaaatcttaaaacatgatagtgattcatatgagattactatttttggagatgaaccgcatccaaactacaaccgcattatgctctctcatgttttacaaggcaaaacaaatatacaagatatcattatgaatgaatacagttggtatgaagaaaacgaaataactttgtatacgaatgaaagagttcaaagtattaaccgagaagaaaaaattattattacagaaaagaagcatactcttacatacgacaagctcattatcgcaacaggttctagtgcttttattttacctgttgaaggttccgcactttctggtgtaacagggtttcgaactattgaagatacacaatttatgatagataccgctaaagaaaagaaaaaggccgttgtcattggtggcgggttactcggtttagaagccgcaagaggtctaattgatttaggaatggacgtacatgttgttcatttaatgcctagcttaatggagcaacaactagatacgaaagcagctgctcttctgcgtgaagatttagaagcacaaggcatgaagtttttaatggaaaagaaaactgtaaaaattcttggtacagaccatgttgagggcattcaatttgaagacggtgaagttgtagattgtgatttaatcgtaatggctgtcggaatacggccaaatacgcaaatagcaaaagatgctggtctaattgtaaatcgcggtattgtagtcaatgactatatgctaacaaatgatgagtccatttatgcagttggagaatgtgcagagcatgacggtatcgcatatggacttgttgctcctctttatgaacaaggtgcgatattagcaaaacatataacaaatttacaaactgatggatattcgggcagtatcgtcggtacacacttaaaagttgctggttgtgatttattctctgctggccaaatttatgaagatgatcaaacgaaagcaatatccatctttaatgaatgtaaacgttcctataaaaaaatattaattcgtgataataaagtcgtcggtatcgttttatacggtgatacagctgacggtacccgcctctttagcatgttaaagaaagaagaagatatacaagaatatacaccagcttccattcttcacaaagctggtgaagaatgtgaacttgacgttgctactatgagtgcggatgacacaatttgcggatgtaatggtgttacgaaaggcacaatcgttcacgccattttagaacaggagttaaagacttttgaagaagttaaagcctgtacgaaagccgcagggtcttgtggtaaatgtcgtccgcttgtagaacaagttttatctcatacacttggagatgcttttgatgcttctgcacagtctaccggtatgtgcggatgtacacctttatcacgtgatgaagtcgtagcggccattcatgagaaaggtttaaaatctccaaaagaagtacgaaacgttcttggttttgtacatgaagatggatgttcgaaatgtcgtcctgctttaaactactatttacgtatggcgattccagaagaatatgaagatgataaatcatcccgtttcgtgaatgaaagaatgaatggtaacatccagcacgatggtaccttctctgttattccacgtatgtacggaggcgttacaacagcagatgatttaatgaaaattgctgaagttgcgaaaaagtacgatgttccacttgtgaaaattacaggtgcgagccgaattggcttatacggtgttaagaaacaagatttacctaacgtatgggctgaattaaatatggcttctggatatgcgtattcaaaatctcttcgtaatgtaaaatcatgtgttggctctcgtttctgccgtttcggtacgaaagattcattaggacttggtatgttgcttgaacaatcattagaaatggtagatacacctcataaaataaagatgggtgtaacgggctgtccgcgtaactgtgcggaagtactgacgaaagattttggcgttgtttgtgtcgaaaatggataccaactttatattggcggaaatggtggtacggaagtacgcgaagctgattttgtaatgattgtccctactgaagatgatgtccttcgcatcgctacagcttacatgcaatattatcgtgaaactggtatttatggagagcgtactgcctactggacagaacgattaggcttcgatcacataaaggaaatactgcaagatgcaaatatggtcactaagttaaatgaacgtttccaaaaagctcgtggcacatataaagaagcatggggacaagcactagaaacgaaatcattaaaagcgatgtatgaagtagaaactgtgaaataaggagctgtgatctatatgatacaaacgaaagaaaaaataaaagttatgcgtgcagaagaccttcctattcaaatcggtaaagaggtacaaatgaaaggtatgtctatcgccctattccgcctttcaaatggcgatattcgagctgtagaaaatcgttgttctcataaaaacgggccattagcggaaggtattgtatctggagaattcgtcttttgtccactacataattggaaaatttcactactaacaggtgaagttcaaaaacctgatgatggttgtattcaaacgtatgaagtagaagttattgacggggatatttatatatacatgtaatttacaaaaggaagcctcccctggcttccttttaaataaaaatagacgaggtgcgaatatgaacggatatgtatatttagttggtgcaggaccaggtgatgaagggcttattacaaaaaaagcgatggagtgcttaaatcgtgcagatatcgtcttatatgaccgcttattaaacccttcctttcttaattatacaaaagaaacatgtgaacttatttattgcggaaaaatgccaaagaatcatactatgcgtcaagaaatgattaatcgcacaccttttttaatttgtgattgaaggaaatatcgttatccgtttaaaatgctgatatccatctatttttggtccgagttgttgtagatactgaaacttttgtattagtaatttat

SEQ ID NO: 1080 - DNA, 3458 bp, Bacillus thuringiensis
atccaatttgtattacagtgtatcttccttgggttgttctcgacccttattagctttactattttgatgtagtttgcaaacactatcccatatgatataataatcagcaaaacattttgttataaaactttagttctttcatattaaaagagctcaagtaacaataaataaatttatatgtatgcgatgataaagaagagtacatattgaggcaatttcagagagcttgtggttggtgtgaacaagtaattgtacagtatggaatgggcttttgagcaccaaaccgaaccgaaagtagtaggctttggcgttatatcctaacgttattatggattagagagatttcacagtagtgaaataattagggtggtaccgcggtccattcgtccctatagtttttgggatgaatgggcttttttgtttgccttctctccccccccatcacgcattcaattttaggaggaattacttatgtcagttatcttttctggtattcagccaagtggaacgattacacttggaaactatttaggcgcaatgaagcagtttacagagcttcaaaatgaacacgactgttatttctgtattgtaaaccaacatgcgattacagtacctcaagatcccgtcggacttcgtaaaaacatccgcagtcttgctgcactttatgtagcatgcggcatcgatcctgaaaaagctactttatttgtacaatcagaagtaccagcacacgctcaattaggatggatcatgcaatctgttgcttacgttggagaattagaacgtatgacgcaatataaagataaagcttcgggtagagattcagttccagctggattacttacgtatccaccattaatggctgctgatattttactttacaacactgaaatcgtaccagttggtgatgaccaaaagcaacatatggaattaacacgcgacctagcagagcgtttcaacaaacgcttccgtgaagtgttcacaattcctgaaattcgtattccaaaagtaggcgctcgcgttatgtcattaacagaacctacgaagaaaatgagtaaatctgatccgaatccaaaatcaatgatcagtatgcttgatgaaccaaaaacaattgaaaagaaaattaagagtgctgttactgactctgaaggtattgtgaaatttgataaagaaaacaaacctggtatctctaacttattaacaatctactcttcattctctggaaaaacagttgaagaaattgaagcaatgtacgaaggaaaaggatacggcgacttcaaaggcgacctagcgcaagtagtcgtagaagcaattcgtccaatccaagacaaatataacgaactaatcaactcaccagaactagacgaaattctagacaaaggtgcagaaaaagcaaaccgcgttgcattcaaacaactacgcaaagtagaaaacgcaatgggactaagcagaaaacgtaggtaacatataaagtggaagcggctcgttcagctctgactggctaaggttctttcgcataaaaggagcttttttccttcttatgcggaaggttcttagacacgaagagcttgccgctggagctggattacatataaggtggaggcggctcgtttagaatgtgagggggatggagctcctgacgtagaggcgctttttgcctcgcaggaaggcgcgaagccaccgaacattcttgccgctggagctggattactacaaaattaaaaaaccgccaattggcggttttttaatttaccttttgctcattttccatttcccataacttttcaaaaaatggctgtccttttacgagacgctcgcataattgttcatgcttatcagaccagcctgttttcgcttcatcatacagcttaacccaaatatcttcaaattccatatgttgaaccattccatatgctgatggatcccactctgtgaaccaatagcgaatttctgctgtatttttcgttgtatgtaattgatctaacgccataaataataattgttttagctgtctttctttacgagtcaagccattcataatgaaaggcgatggtgataaaatgtgatgttctttttctgtttcttctacttggaactcatacttttctgcttgtacgttttctaccatctcatataccatctgctcttggcgtggtataagtctgcttttgcgaattggtacattgtaaccaattgtgtcaatcgcaataattccttttccatctgtaacaacaaagcaatactcttgctgcaaacgttcatgatttttacgaatataagccttatgatgtacgtcttccagcattttttgcggaagctctaacaattcgttctcgatgtaatgatataatgtggcatctacttttaataatggcacttgatctaatagctcaatcgtatcatctttccgccattcgtaaaaatgacaaacgttatacccattttcttcaccttcaaaccaatttacccatacatcatgtagatataacattcactacccctcacttcactactgtttgtaccaatcattatgttcatttttgcttaactttattccacttgaggaaatatattctaattattattttttcttctattaatactaaaaaaacaggaaatagaactcctgtttttttatatatgaaatgtacttgctttattcaatatttcttttgcatctatagataataaagaaagtgtatcttctccttccaaagttacacaatctttgacaatatgaaatccaagcgcatagccaagcatcttcggataagagtgaaagccatttaataagatgtcatgttcccttgttcctcgttttatacttattctttcatgtacaatatttttccaataataaatagcctcttcctttgaaagatacgccgtccacggtgcattgtttttttctgtatacctttctgttactgcttgttcagctagcccttccataatcatcgtatcaagtaatgtatattctgtttctttcgtctcaatttgatgtaacctgcatatgtgatgatattcatgcgctaataacacttttaattcttctaccgaattccgtccacatacgaataagaaaataacatgacgcatagataatccagccctaccgttatactcttcttgtacagttcgattataggaatctgataataaaataaagacagggacatctggaccttttaaccagtttttcagtttatcatactccaggctcaattctttccaaatttccttttcctctaattctttaatttccttttctccgcgcataatcgggcgatacatcccttttgaaattaaaaagcgatacaacctttcttttggcaacggaatatacttcgtaaatttctcacaaagtttttctggccgcccataatataaatgtagccatcaagctgtttcaacaatccccatctttatccctcctttttcttatgtatatgctacaggag

SEQ ID NO: 1081 - DNA, 5453 bp, Bacillus thuringiensis
agcatcctaaaacgagtagcacgccaaaaatcatacgaattctagcatttaaatacatagaaagaattccgcttaaacaataaatgaaataaaacagtaaaaatataacttcatgaaaatataacttttgaatatgaaagtctttaattgttaaacaaaaatatatgactaaaaaaatcatatatatcttcaatgaaaatccaatatataaattgtatttacttaacatgacaaataatattagaagaataatccatcccattgatactttcatattattttccataggctatatcccctggttcgtaatataatcctttttgcgtatttttcttataaaagaaagaagagtttttttagctcataatcatataggaatatggcagctactacaattagtatattaagaacaagcgcaattaaatgatatgtatgcaatatatattgcactccaataaaggttacaccaaaataaattgtatacggtattacaatttggaatacaatttttttcttcactacacttaccgctatatatcccactaaagcgactatttcaaataaaaccatagcgtatgccgctcctatcactccaccaagactactaaagctataaagcataaccccacctatcaccaatgctacacactgcacaacagtcctcttattttgacaaccactcgtcgttaaaccgtcagcaatggcaatatttaaactttgtagcacaataagaaatgataatatttggagtggttctactgcattcctccattcttcatgaaaaaatatagaaataaagtatggtgctaaatgatataaaccgatcgtcatacatattcctacaatcgccattgatttaatttgaagtaaatttaatttcgtatgctcttctatattattctggttataatgcttaaagagcaccggaaaaaatgcacctgcaattacccctggtacttgatataaagctgccggcatccggtacgccactgcaaaaacacctaccatacttaatggcaatgtatagttaagcaagataggcgctaattgtggcgtactcattattaaaaaaccgctaataataaagggagttaattgccaaaataacgctttatgaattacgactttcatattcattttcgtctttcttctcatgatatatatactgaataaaccaccaatcatatacccaaaagcatataagcgagctgttacatacaccggtaactctccgaaaatacaaaaacatgtaattataatgacaactgatgctgatacaacttttatgagcgctatatacttcatacgttccgtcagttgaaaataggcaatccctatgttttgccaagttaatcctattaacatgaaaaacattacgtttatcatcatataaattaaatttttatccgcatacatataatgaatagcaatataaccgatgatagaaataaaaataagtagaatcatccttatttttatatacgatgataaaatctgctctaaatctgctccatcctttgccccttctcgaagaaacgtattactaagtcctaagtctgtaaaaaataacataacaaacgtcactgctatggcaacactaaacatcccataatgttgtgcgttaaaaaagtttgctaaaacaattaaactgacggcctgaagaaggttagctaaaatcgtactataaaatagatggataatattgcttagaatagatctacccatacaagttctcctttgcaagtaacctacttacatatgttgtttgtttacatatatatttatcttgcaccattaccgttcaatacaattaaaacggttttacataaaatacggatgtccgtccgaaatgttttcatttcaatatactccatgtccagcctcaacttttcctttggatcaagattataccctccatttatttgtgcccatcctgttaatcctggttttactattaaacgttccttaaattctggaatatacgcatcaaactcattataaaaaaactctctctctggtctagggcctacaaaagacatatctcctcttaaaatgtttaagagctgtggtaattcatcaattctcgtttttcttataaacaatccaacttttgtaattctttgatcatgttcttttgcccattgtggtccgttcatttcagcatcctttaccatcgaccttaatttaaatacattaaacttcttcccgtttatacctaaacgttcttgaaagtatattggagcccctgatgtttctaaggtaatcataatacaaaagaacaacataattggtattgttaatagtaacaatatgattgaaaatataatatcaaacaagcgttttacacttcgattcaatatgctaggcttttcttgagccggaatcgtatacaacttggcttgatttgtttcacgaatcatggatcgttacccccacattcaagaatataaaattatacctattaattcacattctttcctatttatatccgctattactttttgcactgtacgtagtgaatcttttcgctttttaactgctaaaaccactccatcgcatttccctgcaataatgtgcgtagcaggaagctcaaatacttcagaagaataaacgaaaatgtaatcaaaatcttctttccacttagcaatcgcattatcaaattcatccatagcaactaaaggcgtccctgtatgtactgttttttttgcaggaatacaatataagtaattagacaaattactagaaaaagattcataattgcaggaggaagagcttattatatcgtttactgttatcatgtgatcactttgtaataatacatgtagtttaggatcagaaaaattcacatcaataagtaacaccttttttttcatttccgcaaacactagacccatatttactataagcgaggcaacaacacctctgtccttcgttgaactaactgtgaacagttgttttccggattttttcagctcgtgatacaccgtataaaactgctctttcatcagatcatcatgcaaattgaatggcagctgcttctttgtcctaaacatcgacatgttcacctcgatatatagatgattttttatcaacctctgtaggtttcttttttctatttggttccatatttatgtgaccaataacagagactgttgttattttctctaaatcctgttccgtgtatatacgttcatcaaaataatctcgaaatacagctaaacctatcccaacaaaaaaactaacaattaaagaaataggaatgatcagttgaaatttcggaaacaatttttcagcctgttcctgtaactcaggatcagttaatactttcaccccttgtacatttgtgtactgttgaaagcttttttgtgattgctctgccaatgtctttacaatgtctttcacgattttcggattggaaccttttactgtaacagttacaatttgtgagttgtccgtattcacaaccgagattttttgtgctaattcataacttgattgctctaatttcaaagtttttttgactgttgaaataattaatgggctttttaaaatatcaacatacgatgttactagttgcttattttcttgtgttttatttgttgaattttccttattaaactcatctaaattcccaacaagaatttgcgttgaatattgatatgacggctttaaaacatacatagagataagaactaaagaagcggttaaacaacacatcgttaaaataatcgttacgaatcttcttttcagtaattgttgaaaatcttttatactcatttcttgcttcaattatttcaccgcccttttctgaataacatcctgcaattcactctttacagataaccctttctctcttctatccacttgttttgttacatactttccgactccgaatgcaaatttttctacatatacatacgaaagcattgcaagtataaacgaaaaaacaagtgaaaaaattaaaataataggcaacggtaatatttcatggagcatgtatataagggaaaacaacgatataatatggtataaataaagactgtaagaaatcttccccaaatataacaaatatttattatgtagcaaggacgacaaagttgatattgacaaacttaatatgacaaataaacatgcacttatcgccactacgtagtctcgaaatataaaattattgagcactttaatttctcctataagcccttcatacataaaaagtaaaatcgcaaataaaaaccatgcaattttcgtgtttttagtacaattactataaaaaactattaaattatttttatacttcgcaactagtgctcctagtaaaaacagtactgtgtaatgcaatgttaatgcatagcttgttaatgttaagcccgagcgaaacaaaaataatattacgacagaacatatactaaaactaaacaataatagtaatgaacaccttaacgtttttcgtaagcaaatcatcaaaattaacgggaaaattattgatattcgcatttcatggacaagtgaccaaatcacaccgttatatgcatctgtattatatttcccaaccaataaaatatgttgtgcgattaagcttgaagaactttcaatcgtccatgagcgattaaaccattcacttaaataagaaataccatattcactaattgtaatctggcatacaatagctataattattgccacaatataaggaatatatattctgcatatacgttttaaaaggtatgacccatagctactatagtttttttgaatagattcatacaaaacaaatccgctcaaaacaaaaaagataataactgattcgttaccactactaaaaattagacgagcaggcgtttcttttaatagatacacaacaaatggtttattatcttcataactgtaattttgaaatgctgaaaaaatcattaaatgatgaccaatcattactactaatgaagaaatccctcttatagagtccaattcttcgtatcttttcatctttttacatcaactcctaatgaaatgataataatcatttcaaagcgacatctttattcatattcctctcctttcttttcattccaatttttcatattaaaatgattttatagtataaatttgagtgtattgtaacattttttgtaatattttgaatagaaaatctcaaaaattggtatataccaatttcaacctcgaaaaatgagtaatattgatagaaaaacgctataaaaatatcttgcatatttacaaaattaaagagctgaatagcgttttttcaatataaaataaaaaagatagcctacataggctatcttttttattttatttaattactggcaccactatatgctacatgtcgtttctcaattctctcttcaatttctttcatattttctttattatttaatagtgattgtttattttcaattaataattgtttaaaagattttctcacaaaatatctcatt

SEQ ID NO: 1082 - DNA, 2852 bp, Bacillus thuringiensis
ctcgtgctatgacctcatcatcctttccatatttagccaagcctgtactaactatgattgatggaaaaataatttacaaaaaaattaaaaaaaactagtttatttttttgactagataaagtattatacgattataaactgaatgaaaccataatcaatttgtgtcgtgattatcattttcaaattgatgaatggggaaggcaaatggtgcgccaccagcgttagaaactggttctagtgggttcgattcccaccccgaaattttttaaagattgatataaaaatttcgagggtggggtgttttttcgtcatgctaccctcgtgtgaggaggagttagtatgttgaaaaaacgcgacttacacgacagccacgttctatacgagttaatggtggatccagctgtcttcccttttgtgcgtcaaaaggcttattcttatgaagaatatttattcttaacgaaacaaacgattgaagctgaagagcgtggtgaattaatttcacgcacaattttagatgaatggggtaaccctatcggaacaattactttatttgatgtgcaagaaaaagctggatttctcgggacatggcttggcaaaccatatcatggaaaaggctataacaaattggcaaaagattcattttttagtgaacttttctatgaattagatattgaaacaattttcatgcgtattcgtaaaataaatattcgttctattaaagctgcagaaaaactgcaatatgtgaatctagcaaacgaaacaagaaaagccgtatatgatgaaattaacgcaaacgaagaagtgtataacttatatgaaattccaaaagatcaatacacacttgctacaatgcgagatacaaccttccaagatgctcatcaattaaaagaagcgtaatctaaattttctgaaatgataatcaatcgttaacattttccatatgcgtatatcccctcatgtctttggaaacgataaatagtaactttaagacacgaggtgatttgtaatggataaaaagaaacgtgataaagcaaaaaacacattatctagtacacaagaagttctctatcaacgcgaatttcaaaaagcagatcgtgcagcaggatatcgctcgaaaagcatttaaagtgaaaatgaataattagaagtttcccccctaattattcattttcattacataattttctcgactgatagaagtaagcaaaaaagccccttatacataagggacttttttgctgtggacaactttatccacaaaaccgatgaaattgttagtaattttcaaaaacatttaatatttttctatattaaagcatatatcagctgttttaattgtggatatttttctaaaaattgtggacaatgtggatatagttgttaatattccgactttactgtttaatgaaagcgcaatccttttgtggataactcactaaatttcctttaaaaataataaagaaccctctttacatatacaaagagggtttcatattaagtaaaagattgtgcaagagcaggtgatttaataggtatatgacgcggttctgcatgattttccgccaaaattgcatctacaatatggccagctggctctggaagatagatgcttttcattgcttctttcatttgaagaagcttcacatcatcttgtaataatgcctctgtttttgcaaaaacctcactatcatcgcgaatgacaactgctgctccctttctttcaaagtacatcgcattttcattttcttgtcctggaacaggcttatataaaatgacaggtacttgcaacgctgctgcttcacttaatgttattccgcctggcttcgtaatcatacaagaagtaacacggaataattcatcaatattttcaacatacccaaacacttttaatgcatcggaattttgcttctgtaaacttaataaatcctgttttaaagcttcatttttcccacaaacgacaactacttgtaaattaggcactgacataaatgattggcatagttcttttacatttcctaataccccatgagcacctgctacaattagtaaaatctttttattcttacataactgatatttattatatatgatttctggatttacctttaactcaaaactactccgaattggaattcctgtttcaacaatttgttccgcaggtacaccgatatcaaccatcaattctttcacatgatccgttgcaacaaaataacgatctacttctcgatgaatccatattttgtgcacgcaaaaatccgttaatacgttatagacaggaattgaaatacctgtttgtttctttaattctggtacagcgataattggaaatgtattaattacaatatctggtttctccacctgtaaaagtgttttcaaacgtttccttccaaagttcgcataccaagatgctattttcttatcataaattttttctaccccgtaataaaacaaacgatataattcttttcctattgtataactttttaaatatagatattttgtaatgtcagttataaatggatgtgattctccaaacaagtcgcatacaataacatcttcaattcctttttggcgaaatgtttgttctaatgtttttgctacttgcacatgaccattaccgtaatgtgcagttaatattaaaaccttggggttttttatcaaacaaatccactcctagctttttgtttctccatattgcatatacgacaataggaaaaacattttccttaaaaattacataaacagattctaataattccctttcagctatgtacctgtcgtggatatgcaaagcatataagattgaccccttaatccatcatctaattgtgcagctctgagctaggagctta

SEQ ID NO: 1083 - DNA, 3945 bp, Bacillus thuringiensis
tggttgcggcaaatccatcccttttagattatgtatatcgtcgtgtcgatgtagatacagttggaattgcaaaaggagagagtattgctgattttcggcctcaacctgatgcaaaagcattaaaaaattgggtgcgaattggttggtcgttacattataaaaagtttcttgaggattttgtgaaatttatgacgtagacataataggagcatacaagttaaaataatggagatggttatttaaatgaccatctccattattttgtttttaaatgataaatagagaagagttacacaataggagaggaattttacttgaaaaaaactatagtatgcgcagtaattgtgggtattttttgttttgctaatatcgggtaactttttagtgaaaaaagtgtgggagttcaaataatgatgatgcacagtatattgcatcttttattgaagaacataaagatgaaaaaaatagtgcgcttgtagtaaagagaaatgataaagttgtttattctgtaaacccaaatgttgtattgccagttgctagtacgatgaaattattgtggcgcttgaatatacgaaacaagttactgaagggaaaattgattcttctagtttcgtgtcgattaatgatgtgaatcgttattatgtgccgaatacagatggtggtgcacaagatagatggcaaaagtatttggagaagacgggcaagataactgaaggagcggtttctttagaagaagtggcaaaaggaatggttaagtttagttcgaatgcaaatgctgaatacttaatggaattgttaggattagataacatcaatcgaaatttacaaagtttatcacttcctgcacatcaaccactatttccaatcgtttcatctttgtatatcccgggatatttgcataaagaattacatgttccaaaatataaaatagagaaaaagttaaaagaaatgtctcaagagcaatatcgtgaatatgcgatgattattcatgaacgcttaaagaagaagggaccattattacagaaggaaattccgctttatttagaggaacgttacgacaaaatttggtcagatagattaccagcagcttctgcaaatgattatatggtattacttcaaaaggcaaaccataaaggtggcttgacagaggctgaagaaaaagtgtgggcaaatatcgttgaaacagacatgagtgccaagaaataccgtaaaacattcagacatgcggggcaaaagaatggttacacaccatggacggttacaaaagcagtttatgctatggataaacgtggaaactgtacagaaattgtgtttttggcgaataatttaaatgaagacgatagtgcagaaatacggaaacatttagcaaacttgcatttccaagtgttgcaaagtgataagtatgatgcgacttttattaaataaactcggtgcagagagcaccgagtttatttttatgtacaagcactttttttctatctctgggtatgatgggtagtaatacttaggtgagaggggaaaaggtgatgaaacaaagtaaagaagagtttataaagagtgaaggcgctgatttccctgggaaaacatatgtggattgtgtattacaacatgtatttgattttcaacgaaattacttattgaaagatatgtttcaagtgcataaagcacatattacgatgctgacggaagaaaatttaatgaaaaaggaagaagctaaagttatattacacgcattaaaaaaggtagagggaattccagaagagcaattgctctatacagagcagcatgaagatctcttttttttagtcgaacatttaatttctcaagaagcgaaatgcgattttgtaagtaatatgcatattggtagaagtagaaatgatatgggcgtaacgatgtatcgcatgagtttaaggcgatatgtattacgattaatagaacatcatttgttattgcaagaaagtgtactgcaacttgctgctgatcataaggaaacgatcatgccagcttatacacatacacaaccagcacagccaccaacatttggtcattatacgttagcaatttatgatacgatgcaaagagatttagaacgaatgaaaaaaacgtaccagcttttaaatcagtctccaatgggggcggctgcactctctacaacaagtttcccgattaaacgagaacgagttgctcatctacttggatttacaaatgtaattgagaactcatatgatgctgttgctggagcggattatttattagaagttagctcgctacttatggtaatgatgacgaatacgagtagatggattcatgactttttgttgttagcaacgaaagaatatgacggtattactgttgcaaagtcatatgtacaaatcagtagtattatgccgcaaaaacgaaacccggtttcaattgaacatgctcgtgcaattacgagtagtgctttaggagaagcatttacagtatttcaaatgattcataatacaccatttggtgatattgtcgatacggaagatgacttgcagccatatttatataaagggattgaaaaggcaattcgtgttttttgtatgatgaatgcagtgatccgaacgatgaaagtagaagaagaaacgttaaaaagtcgttcctataaacatgcaataacgataacggatttcgccgatgttttaacaaaaaactatgaaattccatttcggcatgctcatcatgcagcaagtgctattgcaaatatgtcattggagcagaaaaaagaactacatgaattacacttcaaagaggtaaatatgtacttgcaagaacattttaaaataaatttattagaaaaagagtggaaagaaattatatcgccagaagcttttattcaaaaaagaaatgtatacggtggaccgagtaaaaaagagatggagcgcatgatcaaaaatcgaaaagagtcatttcaaaaagaagaagatgtatttgaaaaggaaaaacagagaattttacaagctgaaaatgctttgaatacattagctttgaatattattgaatcgtaaaagagggatttgatgaattaatcgccaatacttaattaaactatgaatagagagaagagattgtcgatgattcaattacatgtatatgaagagatttttcattttaaagaagatgttacaccatttctagaaaagaatgagcaggaaaacaatctcatattaggtgtattacaaatggtccaagaaccgatatttatggggatagcgaaacaaggagaagaaattgcggttgtatttctgcaaacagaagagaagaaacaaatcattgttgcaacttctgaaattgcgggagtaactattgaggaacttgcaaaagaattaacgaaagtatatccggatattcctggattgatcggtaataagaaaattgtacagaaattagcggaagagattgccgtattagaaaataaaaaaacgaatgttgcaatggagcaaggtgtgtatgagctgaacagagtaaagaagaagtgtaatgcgaatggacttttccgagcggtaaataatgatgaattaccattaatagaacagtggatatatcaattttgtgaagacgtaaagcttcctactacgaaagaagaagcaaaacaaactgcgtatacattaataactacaaatcgactgtttggtttggaagtggatgggaaactcgtttctgtagctgcaaaaacgagaccaactaaaaataatataacagtcaatttcgtatatacgccgaaagaagcaaggaaaaaagggtatgcatctcattgtgtagcagcacttagtcaacgtatgttagatgaaggctaccagacgactacgttatatactgatctagcgaatccgacatctaataaaatttatcaagaaattggttatgaacaaattgcggaatctgtgctcatatttttagagaagtaaaacaaaaagg

SEQ ID NO: 1084 - DNA, 4605 bp, Bacillus thuringiensis
ttatatgatgcataccaaaatggaaagattcgttatagcggaacaccgttaaattctgtaaaagagcaatatcgtaatttgttagatcaaggttttccttatttaatggtttcaccaggttttctactacttatctttgttggcgtatttccaatcatcttcgtaattttaattggatttacaaactatgatttatatcattctcctccagctaaattagtagattgggtgggctttaaaaactttattgatattttcactttaccgatgtggagagagacatttgtaagtgtattctcttggactatcatttggacattcgttgcaacaacattacaagttgcacttggtattttcttagcgattatcgtaaatcagcctggtattaaaggaaaggcgattattcgaacaatcttcattttaccgtgggcggttccagcattcgtatctattcttgttttctctggtatgtttaatgaaacattcggagcgattaacaatcaagtattagctttattcggaattgaaaagattgcttggatgacagatccattttgggcgaagattgctttaattatgattcaaacgtggcttgggttcccgtttatctttgcgatgacaacaggtatactgcaatcgattccgggagaattatatgaagcggctacagtagatggagcgacagcttggcaacagtttcgtaaaattacattgccacttgtgttatatgcaacagcaccaatattaattacgcaatatacgtttaactttaataactttagtatcatctatctatttaatggtggaggtcctgctgtagctggacaagacgcaggtggaacggatattttaatttcatggatttataagttaacgatgacttcagcgcagtacggaaaagcagcagctcttacaatgatattatcgttaattgttattacagttgcgttatggcaatttaagagaacaaaatcattccaagaagaggatatgatgtaaatgaatattaaaagacagaagatgttacgtctctcattaagttatttagttattttcgtaatgtgtgccatcattttctatccgttattatggattatgggctcatcgtttaatccaggtgatagtttatctggatcaagtattattccacaaaatgcaacgttagatcattatcgtaagttattagatctagagaatagtaattacttactatggtataaaaacacattaaaagtaagtgttttaacgatgattttctcagtgttagcaattagttttaccgcttatgcattttcgagatatcgttttgttggaagaaaaaatggtttattaacatttttaattctgcaaatgattccaaactttgcagcgttaattgctttatacgtattagctcaattaacaggattaattgatacacaccttgcattaattttaatttatgtaggcggggctattccgatgaatacatggcttatgaaagggtattttgatacgattccgaaagaactggatgaatcagctcgaatggatggagcaggacattttcgtattttttggcaaatcattatgccacttgcaaagccaatcgtagcggttgtagcgttatttactttcattggtccatttacagatttcattttagcgagtattattttgcgaacaccagaaaattatactttagcagttggattatatgaaatggttgcgaagaaattcggtaatgaatttacaacgtttgcagcgggttctgtgttaattgcgatcccaatttcaattttattcctatcactacaaaaatactttatttctggtttaacagctggaggtacaaaaggatgaaaaatgggacattacgtcccatttttcttttcatctccctataaataagtttatagggagatgaaaagagatttgacatcacatgtgaaaagaagtgaaataaatagtatattatagtataggaaaaaatagctatatcccttacaatacatgaagagggagaataggattagttttgcaagatataagaaatgaaagtttatgacttgcaatgagtgcgagataaaatatatgaaaaatggcagagaaatgagaggagggggatttttatgacagttacaattaaagatgtggcgaagcaagcgaatgttgcaccatcaacagtttctcgtgtaattgctgataatccaagtataagtgaaaagacaaagcgccgtgttaggaaagtgatgagtgaattagggtatcatcccaatttaaatgcgagaaatcttgcgaaccaaacgacgaaaacacttggtcttgttatgccaagttctgcaagtaaagcttttcaaaatccatttttcccagaagttataagagggattagttcatttgcacacgtagaaggttatgcgctttacatgtcgacaggtgaaacggaagaagaaatttttaatggtgtcgtaaagatggtacaggcacgccaaattggtggcattattcttttatattcaagggagaatgatcggattattcaatatttacatgaacaaaatttcccgtttgttttaataggaaaaccatatgatcgaaaagatgaaattacatatgtagataatgacaattatacagctgcaagagaagtggcagaatatttaatttcattagggcataagcaaatcgcgttcattggtggtggatcagatttacttgtaacgagagatcgtttagccggtatgagtgatgccttgaaattagcagacattgtattaccaaaagaatatattttacattttgatttttcgagggaaagtggtcaacaagctgttgaggaattaatgggactgcagcaaccgccaacggcaattatggcaacggatgacttaattggacttggtgtgttaagtgctctttctaaaaaaggattcgttgtaccgaaagatgtttctattgtaagctttaataatgctttattatcagaaattgcgagccctccactttcgacagttgatgtgaatatttatcagctaggatatgaggcagcaaaagctttagttgataaagtagagaatgcagaatccactgcaaagtgtatcattattcctcataaattactaaaacgtcaaacttgtgatcattatgcataaaaaagctaagagtttaactcttagcttttttcattagaaaggcttctaatcggtcgcagccttcttttaaagtttcgatactatacgcataggacaagcgaaggtagccttcaccgtattcagagaatgctgttccaggaactacagctagtcccgcttctttgacaagatcaagtgcaaaatcaaatgatgaagatgtcaaatgaccaacatatgggaataagtaaaatgcacctgttggcttttcaactgttaatcccatttgagtgagtctattatatacgtaatcacggcgttttttatattggtggcgcatcatttttggtgcgtctttagctgctgttaatgcttcaattgcagcgtattgagcgattgaagtagcacacgttacattgtattgatgaacttttaatatgtgtcctgctaaataacttggtgcaaataaaagtccaacacgccagccagtcatagaatgtgatttagataaaccgttaatgacaattgttttttcacgcatttctgggaaatgagcgatagatgtatgcttttgttcatatacaagctcgctataaatttcatctgaaaggacgaaaatatttttatcttttaaaacatctacaatatcttttagctcttctgttgataaagttacaccggttgggttagaaggatacggtagtacgatacatcttgttttttctgtaatagcatttttaagcgcttcagctgttaaacgaaatccagtttcacgaacatctacaaaaataggcgttgcaccgcataatcgaataataggttcgtagcctggataaataggagcaggtaaaattacttctgttcctggctctaaaatcgttcggaatgcaacatcaattgcttcgctagcaccgattgtaacgatggtttcgttttcaggtgaataatgtaaatcgtagttatcttttacgaagttacaagctgccttacgtaattctagtaaaccagcgttatgtgtatagcttgtatagttttctgtaatagcccgtttagccgcttctttcacgagagaaggtgtagggaaatcgggttgtccaattgttaaagaaatcaaattatcatagttttgaatcatgttagagaactgacggattccagaaatttggatgtccttcactctagggttaatgaattgttccattgtatctccctttcttccgtttgaaaattaagttcattttatcatattttctatgattacgctttgtatatgttatttagaaagagagagaaaagagaaaaaaagccgctataagcgactttttaatatccgtattcccaatctatttcatcttcattccagagtacagaggataccttgccaaggtgaacgactgattcgtttacagcacatgtgcagtcctcatctcccgctttatgctgtaactcttctgattctgatttttcaacattttctagaacaaccaaattttct

SEQ ID NO: 1085 - DNA, 4209 bp, Bacillus thuringiensis
agcagtagttgttgtttccctgtaacagagagctggtggttggtgcaaaccagtacataaacaagagcgaattacagtcctggagcatctttttcgtagtaaagatagtattgtctttatgaagggaaagacggtcagatgatcgttaacaatgaagagaggtagacgaaagaagtctacaactagggtggtaccgcgataaatatcgtccctactgattgaatcagtagggcttttttgtacaaaaaagtgggtttttaactagtagttcatgtctttgtacgaattattagtttaaaataagaagaggtatcgattccactataaatttgtataattagtcagttcagaaaatagagaattttttattctcttactatacttttaaaacattagaggaggatttccaaatggcaaatcatgaattagatcaattacgtaaacaggtagatgaaattaacttacaactattacaccttttaaacaaacgtggtgaaattgttcaaaaaattggagagcaaaagcaagtacaaggcacgaaacgctttgatccagtacgtgagcgtgaagtacttgatatgattgcagagcataacgaaggaccattcgaaacatcaacagttcaacatattttcaaaacgattttcaaagcaagcttagagttacaagaagatgataaccgtaaagcgttactagtatcacgtaaaaagaaacaagaaaatacaattgttgatgtaaaaggtgaattgattggaaacggaacacaaacgttcatcatgggaccttgtgcagtagaaagtttagaacaagttcgtcaagtagggcaagcgatgaaagaccaaggcttaaaattaatgcgcggtggtgcattcaaaccgagaacttctccatatgatttccaaggtttaggagtagaaggacttcaaattttacgtcaagtagcagacgagtttgacttagcaattattagtgaaattttaaatccgaacgatgttgaaatggcattagactacgttgatgtaattcaagttggcgcacgtaacatgcaaaacttcgatttattacgagctgtaggtaaagttaacacaccagtattattaaaacgtggattagcagcaacaattgatgagttcattaacgcagcggaatacatcattgcgcaaggtaacgatcaaattattctttgtgagcgcggtatccgcacatacgaaagagcaacacgtaacacattagacatttctgcagtaccaattttaaagaaagaaacacatttaccagttatcgttgatgtaacacattcaactggacgcagagatttattattaccaacagcgaaagcggcacttgcaattggcgcagatgcagtaatggctgaagttcatccagatccagcagttgcattatcagattctgcacaacaaatggacattccagaattccatagattcatggatgagttaaaaggtttcaaaaataaattatcttaattccatatcatatatgcattgaagaggaaacagtagtgcttatctcactgttaaagagagctgatggtcggtgtgaatcagtacaaaggtaagcatgaattacagccttggagcatctttcccgacaacttttggagggtaagacggtcgaacgatcgttaaagaagaagagaggtagacgaaagaagtctacaactagggtggtaccgcgataaacatcgtccctactgagcgctcagtagggacttttttgtacaaaaaaatagtaaaggggcaagagaaatgagatacattacagctggagaatcacatggaccgcagttaacagttattttagaaggtgtaccagcaggtttgacacttacggcggaacatattaataaagaattattaagaagacaaaaaggtcatggacgcggaagacgtatgcaaattgaaacagatacagttgaaattgtaagtggtgttcgtcacgggatgacacttggatcaccgattacgttaattgtaaaaaatgatgatttcaaacattggacgaaagtaatgggtgcagagccaatttcggaaaaagaaagtaaagacatgaaacgtacaattacaaaaccacgtcccggacatgcagatttaaatggagcaattaaatatggtcatcgtgatataagaaacgtattagagcggtcatctgcaagagaaacgacagttcgtgtagctgctggtgcagttgcaaaacaaattttaagcgaattaggcgtgggaattgcaggacatgttcttgaaattggtggagtaaaagcaaaacatatttcaaacttatcaattgaagaaattcaaacaattactgaaaactcaccagttcgatgtttagataaagaagtagagcaagaaatgatgaatgcgattgacaacgcaaaaagtagtggagattcaatcggtggtattgtggaagtcattgcagaaggtatgccgattggcgttggtagttacgttcattacgatcgtaaattagatgcaaaacttgctggtgcaattatgagtataaatgcatttaaaggtgctgaaatcggcgtaggttttgaagcggcacgacaaccaggaagcaaagtgcatgatgaaattctgtgggatgaaaaaaaaggatacacgagaaaaacgaataatgccggcggtttagaaggcggtatgacaacaggtatgccaattatcgtaagaggcgtgatgaagccaattcctactttatacaaaccgttagcaagcgttgatattgatacgaaagaagcattccaagcgagtattgaaagatctgatagttgcgcagtaccagcagcgggtgtagtagctgaatctgttgtggcatgggaacttgcagatgcactagtcgaacaattcggaaaagatcgtatggaattattaaaacaaaacattatgcaacacaataactacgcaaaagaattttaataaaaaggtgggtttaacgtgcaagtaaaagatcaactatcatcattacaaccatataaaccaggtaaatcaccagaacaaatgaaagaagtgtacggagatcattcgtttgtgaaattagcatcgaatgaaaatccatttggttgttcaccgagagttttagaagagttgcaaaactcttggttggaacatgctttatatcctgacggaggtgctacaacgctccgtcaaacaatcgcagataagttgcatgtgcaaatggaacaagtactttgtggtagtggtttagatgaaatcattcaaataataagccgcgccgtattacgagcgggagataacattgtaacagcaggtgcaacattcccgcagtaccgccatcatgcgattattgaagggtgtgaagtgaaagaaattcctttaaataaaggtgtatacgatttagacgaaatttcgtcagcggtaaataataatacgaaaatcgtatggatttgtaatccaaacaacccgacgggcacatatgtgaatgagcaaaaattaactcgatttattgaaggcattagtgaaaatacgttaattgtcattgatgaagcgtactatgaatacgtaacagcaaaagatttccctgagacattaccgcttttagaaaaacataaaaacattcttgtacttagaacgttttctaaagcatacggattagcttctttccgcgttggatatgcgatcggacaggaagagctaattgagaaattaaatgtcgtacgtttaccatttaacgtatcttcattagcgcaaaaagcagcgacgattgcttttggtgatgacgagtttattaaagaaatagttcacatgaatacagaaggattacagcaatacgagagtttctgtaaggaaaacggtataccattttattcgtcacaaactaatttcatcttcttaccggtagataatgctggagagatttatgaagcttgtgcacatgcaggatttattattcgtccgttcccgaatggtgtccgtattacagttggaacaagggagcaaaatgaaggggtgatttcagtgttaaaacaacactttgaaaataaaaaaaataagtctcgagatgaggcaaatgcgtaaaaaggtagtattaattggaacaggtttaataggaggctctctcgcattagcaattaagaaagagcacgatgtaacgataacagggtacgatatatttaaagagcaagtagagcgtgcaaaagaattacacgtagtagatgaaatagga

SEQ ID NO: 1086 - DNA, 5162 bp, Bacillus thuringiensis
cggttttattgcatgatattccctctctctaagggtggctattgtaatgcacaggggatttccttcttttctttgttacactatagttgattacataggagaggggccgtcttcatgtcatttacctttgaaatgttagaagataaagcagagttttttgaagcgggagacttagcttctttagaacgaaaaactagtgaacaaattgataataataaagcacttatgcttgaagttcatcacatctcacatcaaatgggtatggatcctgaaagcaaaagaccgtattatagcgcggttgttcattttaaattaaagaaattgcgttaacaaaaaagagaagctcctaaggagcctctcttttttagtttagagtttgaacaagtactggtttccagccctcattgtctacccaatcaatatttacataatatcttttgctagtaagcttatcttgaacatcaccattagctttgatattgccagctctgacctcttccaacaaaatggaatactaattgctgtttatgtacttcaacacctgcagcaattgcactttgcatctcattccaatctgatgaaccctgtttaaacgtcatcgctggtgatgaaccttgttctgttcctacagctttccaagaaggttttgtatacgcctcttttgccttagatacagttttctcagctgatactttctcgttagctttcgcttcttcttcagcttttttctgttcttcttcagcctttagcttctcttcttcagcttttttcttagcttctgcttgctcttgttctttttcttttttcttagcagattctttatcttctgattttccagctttctcattctttgttgtttgttgagagactttcttatcagtagaagatgcttgctctttcgtactaggaacgaacaattgatatgctacaatagctactaatagtaatacaatagcgattgcaatatttaaaacaccgttttgacgacgtttttgttgtttctgttggaatcttgatcctcctgccattctccaaacctccatgcagtttttcctaattgctattgtaacattaaatctagaaaggttgaacatttacaatgatattttcatgaaatgaagacatttcactataaattgcaagattacttttcattctccaattgatagattgctcctaccatatctttaaaaataggtgtaactttattcactttgctatcagtctctagatcaacaacaactaaagcatatcttggattctcatacggaaaataacctgcaaaccagcgattcaccctcgtccctttccctgtttgcgctgtcccggattttccagcgacacttagtggcaacgaacggaatgccgttcctgttcctttctcccttgttacaacgcctcttaataactcttgtaatgttttcactgtttcatacgaaagctgttttccatttaacgtatggctctcaaatgtaaaaaaatccgctccatttttatatactattttttcaactgctttcacttccatcttttctccattcctcgcaatcgtcgccatcatatttgcaattgctagaggtgatatacgtacatctttctgtccaattgctgtttgttctaccgcttttttactatttttattttcttcattcccccaaatagtagtacccttttcttctggcatttgctcaaaatgaggtgtatgaaatacagaacctttccatccaaccttttcatttgctcctaaagctgctacgtatgtttctagcaccgtcttatccttttgtaatagctcgttacctaactcggaaaatgtcctgttacagctcctagcaaagctctctttaaagttaagtgtacccatcctaacttgcgggtcgttttcaccatataaatctttattacagttaaatgtccgattaaacaaatttactttttgatcaatgactgcagctgcaactactgttttaaaaacagagcctggaaaatgtggcgttaacatttgattttcaagtgtagttttatataaattctcatcccttacttgtaaagacggcttactagccatcgctaatatttcatttgtctttacatcaagtaatactagtccccccttctttatttcattcgcttcaatcacttcttctgctttttgctgcaactctttatgtaaagtagtttgaatcctaactggataaaatggatttcctggtgaagtgtatttcgcttgctttccgaaaattggttctccttgccgatctacttgatataatacttttgcctctccatcagtcaatagaaattcatcaaatgattgctgtaatcctgaaatacctatcggcgtttgttttgagattcttttcaattctccatatcgcttttgaaactccctttcgttctcccctacatcaccaattaaatgatttatctctccagtttgttttaatcgcacttcagctgctacaatacctaatacatgtaattcatttaccttctccatctgctctcgtgtcactcgaaatggagcagttctcttgagggaaatgcatcttaattatttttcatttgtcttctaatctcttgtctcgacacaccaatgatatgcgcgattttctctaacatgtcattttttatttgtaaaaatggaaaaataattaaaacaggatattgttcctcacctatttttttaccattacgatctataaactgcccacgtccatcgtctactgtaatggattgtgtgcgttgcgtaacacttttttcaattaaatttattttgcgatcagtaaatgattctgtatctataatttgaatttggattaaacgacaaagcaatacaaacataacgctcataaaacaaattaaaacaattgtaattctccgttttattttcataaaaaacacctcgtctattgtagtttagacgaggtactattttatttatacaatctccaaaacaaaaacagatattatataaggctattattgtttctttggcttctctaaaaatttcataagaagcgatctaaattcagtttcattcactccagtgtttttagcaacttcaattacagtggttgttacattagccgctatttttaaataatccttactaagattatccatttcatttcttttttcttttgcattctcaactgttacagaatcaatacaagtaatcatcttatctacaatatgtaaataattattttgtgcatctattattttttgaatatcatctttattacttactttcgattgttttaaatatgtatatgcttgattcacttcatcttttaaaattttatcattattcttcgcctgttcttgtaacatattcttcatatcatctattgttttttgatccatcgaatctcgcaataaataatctggattcccaattgcgtaatcatacttaatcgttacatcttgaaatattttcatgacaattgctaattgatacgctacatcaaaatcattaaattcctttttatcttgtggattttctaaggcttttgaactctcagttgctttaatatcctttttttcttcttgcttcactttttctccctttgatgatgtagtttcttcattcgttccgcatgcagcaagtcctaatatggagatactacaaaccaatcctgtaaagattttatgtttcataattagccccttttcccttttaaaacctatggtctctaattatgatatcaaagcttaaagtgtttttttgacattttttgtcgaatcactctaaggtttacacaatttttttcattcgacagaaaaaaagattctcccgataggagaatctttttttattttacagagacaatctctacttgcatttctccgcctggtgtttggattgttactttctcaccaatttgcttacctaataagctttttgcgattggagaatcgttagaaattcttccttcgaatggatcagcttccgcgctacctacgattgtatacgcttcttcatctccgtttggtaattctttaaatgttactgttttacctaatgtaacaacagtagatacttcgccagtatctttaatgataactgcgttacgaatcatattttctaattgtgtaatacgtccttctacgaacgcttgctcatctttcgctgcatcgtactcagagttctcagaaagatccccgaagctacgtgcgattttaatacgttctactacttctttacgtcttactgtttttaattgctcaagttcgttctctagtttttgcttaccctcttgcgtcatagggtatgttttttctgttgacatattttccactccttttatataccaatcccccgaaaaaaaagaggagttccatatgaaaactcctccgcttccattgttagcggaggtttctagtacccttgcactagcggagttgtcacatacaaccccgtatttccaattcttctttatataaagaagatatgtatggaaagttgatataaatatgccctcacctatatatagatgaggttgcatgtttcattgtattcgataagaagggaaaaaatcccttcctaccgtatatcttttactatgctattacaaatttactttttgttcaagaattgttgcaatttttgtcaccataatatcaattgcaacgtggttttgtccaccttcagggataataatatccgcaaatttcttagaaggctcaataaattgattgtgcattggacgtacaacatttacgtactgatcaataactgaatccatcgtacgaccgcgctctttaatatcacgttgcatgcggcgcagaatacgaaggtcagcatccgtatcaacgaataatttaatgtccattaactcgcaaagacgtgggtcttctaaaataagaattccttctaaaataattacatctttcggctcaaccggaataatttcttctgaacgcgtatgcaatgtatagtcatatacaggcttatcaatttgctcatatgcaagcaactgctgcacatgttcaattaacagatcattatcaaacgcaagcggatgatcataatttgtttttaacagctcttccaatggtcaatggctttaaaatacgcactaataatcttgctctaagattaaaattattagccctttaaaatggtcaatcatagctaatgtctaatcacgcacgcg

SEQ ID NO: 1087 - DNA, 4402 bp, Bacillus thuringiensis
tataaagctatagaatcatatttttctaatagcgttccaagagctttcttctaattcttttactaactctttcgagtattctaattgccctgttgcaattactttcgttaatttttctagcggttgatatacaataataattaaagcaactggaggcaatggacgaagaaaaccttttgcgattccatcttcaataatattcataaagaagcctataaaatcatcaaatattttcttactctgttcatcaagaaaataactatcacagtgagaatttgtaaataaaaaagcatctacattgtttctcgcaaattcaaataaacggttgtacgtatgactaaactgttcacgaatatttgcttcaacaggaaaatccgtttttattatttcagaaagctgtaacatactttttgaaaataatgagttaacaagtgcctctttattttcaaaatagcgataaatagtacccgcaccgacttttgccttttcagcgatcattggaattgtcgtaccatcgtaaccacgctctgcaaaaagttgcatcgcagcatcaaaaatatcctcttgtttgtttttagccattttttccacctctatttccaggaatgaaaattcattccgtttttaattataaattacatggattaaaagtcaagtgcgtgacaaagtatagttacgttttagtgaaaaaattatatcaacgattattagaatatatcagcgcaagtctaattatatcagcgattttcagaatatatcggcgcatctccaattatatcagcgattttcaggatatatcgacttaccgacaaccaaagagaaagctgtcccaaaaattgtttttgggcagcccaattttctattgaaaacttaaaagaaatcataaataaatgcttctcgtaccggaactattttctcaaacgcttgtatttcctcttcacttccgctaattaattctaattcattcagttgtaacggacgtttatagccgaacattattgtagataactcgtttatatccagtttgatgcctttatctattgttttttcttttattattgttatttcatgatttgcaagtctcactgttatgttattccacggagcaaatgcgtctgtaatgtttaggatcacttcttgctctacattgttccaattcaactcatattgttttaagaactgctctacatctacaattcttcccataaaatatggttttatttctgtcttcacgcgtggctcttgcaatgaatataataacggttcgctttcacttactgtcatttcaatttctttaatcatagaatcatgctgacaaataaagttccacagaccatttcgtgcttcattatgcagtggtacaaattcttctactgtcattttatagttttctattttgtataacatgtaacctgctgcttttttattttcatcatagtaaatcgctaatgttaaatcatcataaaccgcttgtaaccaccagttcttctctcgaactaacatacatgaaaaacgttctgcaaatgcttcatagagcttctcgacttcttctggatgattttctttattaaaacgtttcacagtaccatttacttgttttttcatcactaaatcgctcttacttatatgacatttgagtagattcgcacaaagttcccagccgtatttacggtaaaacgaaacagcaaatggatgtaacatagagactgtaaagccatcttttttcattgtttgaagtgaatgttgaagtagctcttttacatacccacttgttctgtactctggatacgtcgctactcctgcaacgccacccattttaaatttttctttacctatgtaaatatgaaacggaataaggtgtagttttgcaggtaagtcttccccttccataatgccgtatatttcatgactttccttcatttttgtaagttgctgctgtaatcgttcctcatctactttatattgaaaagcgtattctgataaacgtaatgcttctctaaacttatcttcttttaattgtatgacattcatataattctcctccattctctgtttgaattgtatcataattcttactattatagttcgataagtgaaattacaaggacgttttaacaaaaaaagcagatacatcacgtatctgctttccaccctttttatttagctaacttttgaagttcgtcaaagaatgtaggatatgatacacctactgcttctgcatcttcaataattgtttttccttctgccaaacagccagcaattgcaagcatcattccgatacggtgatcaccataactatttactgtattgccttttagagctgattttccgtaaatgatcataccgtcatcagttgcttctatgcgagctcctagtttcgttaactcagcaacgactgtatcaatacggtttgtttcttttacttttaattcgtgtgcatctttaattactgtaattccttctgcttgcgttgccgctaatgcgattacaggaatctcatcgattaatctagggataatatctccgccaatttcaattccttttaatgaagatgtttcgattgtaatatttgcagctggttctgatgcctcttcgttaattagatctacagtgaacgtagcacccattttttctaaaacatcaataatacctgtacgggttggattcattcctacattttgtaatactagtttactatttgggatgattgcacctgctactaagaaaaacgctgctgatgatacgtcacctggcacttgaatgtctgttgctgttaatttttgtccacctgacagcttcactgttttcccttcgcgagttactttaacaccaaatgcttcgagcattctttccgtatggtcgcgtgaaatatgtggttctgtaacagctgttacaccttctgcacgaagacctgcaagtaaaatagccgactttacttgtgcacttgcaacaggagaaatatattcaattgcttttaaatcgccgccacgtattgttaacggtgtaaatgttccttcttctcggccgtctatgtttgcgcccatttgttttaatgggtttgttacacgcttcatcggtctttttgcgatagattcatcaccttgtacgcaagagaaaaatggtgtgttagctaatatacctgacattaatcggattgttgtaccagaattaccaacatctaatacagctttcggttcttgtaaaccttctaatcctttaccaactacagtaacctcatcaccgttgtgcgtaatttctactcccatttctttaaaacatgaaatcgtacttaaacaggctgcaccgggcaagaaacctctaattattgttttcccttctgcaatagagccgaacataacagcacggtgtgaaatggatttatcacctgggattgtaatattgccattcaatccgttattaacaggttgtattgttctttctttcacgtttttcaccttctcatttaaattgtttcataagtttggtattcttcttatccaagcgctagctttgctttcatacgatcttcttccctttggaagctaatacgtaataccccaagcagtccttcacgcgcttctaatatttgcaagttcgtaatactaatttcctcgcgcgctaaaatactcgtaatatgagccaatgcccccaccttatctaatacatcgacgtataagtcgtgataggcaggaattgcccctctctttcttactggtaaagaatcacggtattctttcgcatctgcaaaatagttttgaatctcgcctgcatctccggtagaaactgttttatataaatcttccatttcagagatccactcttttaataataccattaaatgctctcgattttgctttacaatatcactccacatttttggactactagatgcgatacgtgtaatgtctttgaaacctccagcagctagttgatgaatgagcggattatctcctgcatgtttctcaacttgctttactaaacctgctgcgataaggtgcggaaaatgactaacgatccctgttacataatcatgttcttccgtatttaaaacaagaaaatgtgaccctgttccttttaaccatactttaaggtcttccacttgtttatttggcacgtgattcatcggtgttaaaatgtaaaatgcattttcaaataaatgtgcctttgcactttcaactcccgttttatgagaacccgccatcggatgtccaccaatgaaagaaacatcctttgaaaataaagcttccgcttcgttcataatagacccttttgtactaccaacatcagtcactataacatcttctcgtaaacggaatgacgcaagtttgtgtaatagcttcttcgtttcttcaactggagaagcaagaacaattgggtgtgcctcttcacaggcgcgctgtta

SEQ ID NO: 1088 - DNA, 4334 bp, Bacillus thuringiensis
taattattgtctttcatatctttactgtgaccaccagcaacatctgctgtttcctgatcccatgttaataatggtaatttatgacgacttcgaatgatatttgttaaatcaaaaatttgttgcatattcccattttctacttgttttattttttctggagtcaatggttgttctgctattaattcacctgaataaacgagctgatacggtctttggcgtaataaagtttcatcatccatataacgaacaccaacaagctcatgtgtaaattgatcaaaatacaattgcgcccatccatcttctacaggtattaacggttgttccatgacttcggtatcagatagctcaaattgataactatttttccctctttttaatgaaatttcatgcgaaagcggactttttttatatacttcttcatatttttcatttatataataaggtggaaccttaacttgttcaccagctgcgtatgccgttacaactttacgttcagaaactccaaattgaacatactgagttaaatcctggttgtatacccaccattcatatccgtatgcagatggctctattcgagagggttctccccacttcgctaataggttttcagagtcttcaccaatcatatttaaaacagtgtctgaggagtcttccttaatttgctttttctttttcacaattttattttcttgctttgattgagatggggttaatatatattgtgaaacgagtaatttcccgtataaatcaacagctaaaattaaaaatgtaatcattacgatacgcaataatttcttcaaacgatatacctcctgaacaaaacataaaattgagatatacacaaatccttttctttctttttgtgtgtaccgtactcttttcactatatcatatttttgtgaaaaaagtctggattatcccttttctctcaatatgaattgcactttcttattattcatactattataaaaataatggtgtaacattaaaaaaggaggtattatatgcaatttacaaatacgaaatttaatggagccgtcgttgaattaactcttttaactgaaatcatggaaaacaaccacttcgtacttgccggacagtgggattatgaacgagttacatacgattataaatttgaaatattaaaggatgtttattatttacgagtgcaaggagttgctgttgaaggtgacattggcagtagacacgctgaagtaaaactactcccccccttattaggaaaacattattatcctcacggcgttgaatatggtgatgatgagactttcccaacgaatgtacttcaaaaaagcgaacaactcctacaaaatgtcgaaaaagagttaaaagaatttcaaattattgattaacaaaaacaagcgcatcaatatgatgcgcttgttttatttcccttccctaagaatgaatcgttttttttactggatatccataaatagatccatcttttactttaatctcatcttcccaggggaccttatatttaccttcagctaaatcttttacaaacgtatatggattttctttcaccccaccaggagttgctacatatcctcttgaacctaaattatatatattattttccaatccccatcctaatctagcctgatctgctagttctggatatacttcagcagtaacaatctcccaaggatttcgatgaccctgtactaaagtagtcccatcaaaattacatacttgtccttcaccaaagtaataaaatacaccatcataacccgctaagtttaccgacaatgtatacattaaattttgccatgcatttgaacgattcgttagcatccattgttcactaacttgtgtactatatccagaaatacgaattaagacatttgcacctttataggccgcttcacgagctacttcagggaacatgccatcatgacaaatacaaacagctaatttacttcctccaggtccatcacaaacaggtaagcctaaatctccagctttccaaggctcgactggcacccaaggatttagcttacgatacttcaaaatcatttcaccttgtggatcaataataactgctgtattatatggctctccaccatcaggatttttctccattattgaaaaaacaccatatactttagattctttacatgcctcagcaaataagtctgtttctggcccaggcactgtgcataaaaattcttctgtagtccatttttttgtattgagcccttgtgtactatattcaggaaatactatcaattctaaaccagggtaacctgatttggtcgaatgaattgtttttatgatttgttgaatttgtttatcaatgtctgcacgcgattctactactggtactggatattgaattagtgctgtcaaaaaaccactaatcggctttaccatacttccactactacccatttaaactcccccttaaaatagttcgtgtttattaaagataacaatatatatttgtaactctctaaaaaacttgcactacatatggaattattacgcatgaaagctagtagtaaattttatctccacttttagtacacgcctacactaacttaacataaaaagttagaaaattcaatctttttaaggtagctaaaaaagaaaaagcgcatggaatcccatacacttttttacttaatctgtaaatacggcggcaattgttgcaactgctccttatccttttcacgttctctacgtgcccatctaaagaatacatagcctataattgtaccgtacactatttcctggacaattttcattatgataccaccagtttgctgatcttgtacgactggcatccagtgcaaaaattctggtcccgttatatttaaatctgataaagtgcccgctggtacacatagttccatcgctttcatccaagcagccggatccgtatacgttgcaaataacggggctgtcgcaaaaatgattaacgcacatgcaggcgttaataatatgccgttagcaaacatataaccaagtttctttatatcacttaacgtttgatattctggtaatggatttaacatcggccaccacatcatgattgctgtaaaaaacaatatagcgagacaaataggatgagctatttgactttgttttactgtatcaaaaacaactggtaaatgataaaaagaaaacaggccgttaaatacaaacaacgcaataagtggtttagcaaatgcctttaatataatttgaacgaacttaaaagaagtaatgtaacgatataaccaaattggtataccaagcaacagtaacggtggaactgcaatatacatgactgccatttcaaacatatgagcactaaatataatatggccaattaaatcaataggccctccctttacaaaatataaaagaacaataccagtcgtaaaataaaaaatttgcttcttactacccgtcgtcgcattttcaaatcgcattctatatggtccaataattaagacgtacccaataagaatcgaaagcataaataataaaaagattggactccataaagcctgaaaaccaaatatccacaagttactcattttcacacctgccttcgtaaggttatctcataatatgaagagggagctgtgacaacacaagctcccttatttttcacttttcaaatccacacaattgtcataaaagctaaaattgtaattaaccctattagcagaccagagtaaagaaagaaacttgctgcttcatgtcctttatgactcatatgcataaaataatacaattgaaaaattacttgtaccactgctaatagtaaaataaacggtacagagaaaatcggactaaaagtttttggatacgctactgctacaaatgcaactaatgttaaaaaaatcattaatgcaaacgtaataacttgatgcctcatttcctccgcactttttctcttccgataaacaagatcaactttaggattattcgtttgctttatcgccattgtttatcccaccattcccattaaatatactacagtgaaaataaacacccaaactacgtcaataaagtgccaataaatcgatgcaacataaaacttcggtgcattgtataaatttagacctctcttcgcatttctaaagattaatgttaaaatccaacataacccaaacaatacgtggagtccatgtgtaccaacaagagcataaaacgcagagccaaaggcactacttctcatagtatgcttaaattcatgtgtataatgataaaactcatatatctcaaatcctaaaaaccctaaacctagcaatactgttactagtaaccaaagctgcattttcttaaagttaaagtttttcatgtgatacatcgcatat

SEQ ID NO: 1089 - DNA, 3993 bp, Bacillus thuringiensis
cgatcgctccgagttcgtgtttcgccaacaacagtctgatataatggttaaattgtagtcgctttaacagaagataatgaagcaactgttaaacgtttctataaagaaaaagaccatttccgtttacaaccagaaaattcttcattagaacctatcattttaaaacaagtgtcagttatcgggaaagtaattggcgtatatcgtgatttacattaaaaaataataaaaagaagataattaccttatttatatacggtaattatcttcttttttgtattttgatagatttccatgcattctatttcttattaacgagttttaatcgtcacatctccagcagccgttttaccactaatctttttactaccatttccaattgttacgtttttattttcttcattaaaaatcgttacatctccggcagcactttgcccagtaattaccgcatcttgtggtttttccgataaagtaatatctatatctcccgcagttgaacttgcttctagattatacttagaatcatgatcttgaatatttatttccccacttgttgtttttgcggtcactttccctaataccttcttaaaattcacctcaccagcttttgtcgatccctccacattcttagccgttatttgtttcaactctacttctccagcaagtgttctaacacttacgctatcacttttcacatcactcatctcgatttgtccagcagatgaatttacttttacatcttggtaagagcgttcgggcacaaggagagtcaatttagacgtttgaaacctaaaatcgtaaaaagaaaaatcaaatgaagcacctttttctctttccccaataacttttaatgtgtcaccatcttctgcgatacgaatctcttgtttacgtacatctcctgattgcttgatataaaaagaagagtcaggagatttttggacaataatatccccggcatctaacttaacttctatattttttaatgtttcgtttttaattacattttctttatcgccttttttagcagtttgtactgctttttcatatgtttgggaaattcctattactccaataatgatacaagcaatagcgattaaaaatagttttttcatcatttactctccttttatcattttgaagttccatattacatatcgtacacacaatctcttaaaccactttgtactataaaaagcgataatacataacaataaacctactccaacaaacgttatactaacgaaaagatccaaccatataaaagtacccataaatacttttccaataacgaaaaatggtgttactacactagcaataccaccgatccaaaaagaaaatataaaagcaataattgcgactaacggtcctaacacaataataaaattaaacaaactaagtccaatcgctgccataacagctcttgtcacatttgaagtcgatggattttttttcatttcatcgaagcgatacatcgcaagtaattctttcgctattactttcggagaaccaaggccttgtattatttctgattcagttttcccctcttctagtccaaactgaaagtgctcttcataatccaataaaatatcttgcctctcttcctctggtaactttctaagataacttgataattctttaagaaacccttctttactcatcccattccaccccttcaataatttcttgtacccctttcgcaaaatcacaccattctgttactaacaaatgaaattgcgtctccccttgctctgttaattgataatatttacgaggtggcccttccgtagattcctttaaatacgtttgaaaatacccttctttcgtcaaacgacgtaataaagggtatactgacccttccgatattaaaaatttattagaaatttgctgaacaagttcataaccgtaactatttttacgttttacaagtgctaatacacaaagttcaagcacaccttttttaaactgaacgttcaagtgccatcctcctttcctatcttagtactgttcaatgcacagtacctatcttatccataatataccactcggtattgtttattgcaaggtactaagctatatttatttccaaaatttagaaaatgaactaacgaaatcctgaataagactatgttataactaagcagcattacgttaatatcattgagtaatgattcgattcacaagccacaaacttacagccttgcagatgaggacgtaaaaatcattggtcgcgttgtacaagcagtaaagaattattaagttatagcacaagtgatttaaaaaaagataaaatcaattcttttgaaaagattttcttagtaacatgattcaaaataaccaaaaataatccattgcctagtagttaatatatccaataacttcactaaaaaagccctgataccgtagtatcaaggctttttcatttcacaaattatataaaacttacgtttatctgataatgtttttctatgatatcactacttgttattaattcgtggcttttatgtggcttttttcattttgcaaccacataaaagtgtaataattgggaattaaaaaacccttgatacgagttgtatcaagggttcaagcctcttagtatagagacatatattgatcgcgttcccattggtgaacttgtgttctaaatatatcccactcaatctctttcgcttcgatgaagtgctcaagtaagtgttctcctagtgcaccgcatactacttcattagattgtaatgtaactaatgcttgcgctaatgttgctggtaagtcaacgatacctgcttcttcgcgctcttcttttgtcattacatagatgttacgatctactgctgctggtggagttaatttgtttttaattccatcaagacctgcagctaataatgtagccattactaaatatgggtttgcagctgggtcaacactacgtacttctacgcgtgtactaataccacgagatgcagggatacgtactaacggactacggttttgtgcagaccatgctacgtaacaaggcgcttcatatccaggcactagacgtttgtatgagtttacagttgggtttgctatcgctgtaaatgctggtgcatgttttaaaatacctgcgatgaagtgacgagcatcatcacttaattgtaagtcaccgtttgcatcaaagaatacgttctcaccatttttaaataatgataagttacagtgcatacctgaaccgttcacaccgtatagtggttttggcataaacgttgcgtgtaaaccatgtttacgagcaattgtttttacaacaagtttgaatgtttgaatgtcatcacatgagcgaattgcatttgcatatttaaagtcaatttcgtgctgccctggagcaacctcatggtgagatgcttcaatttcaaatcccatttcttcaagttcaagaacgatatcacgacgacagttttcccctagatccatcggcgcaaggtcgaagtatccaccgttatcgtttagttctaatgttggatttcctttttcatcaaccttaaataggaagaattctggctctggtccaagattgaagtctgaaaatcctaaagcttccatttcttttaacacacgttttaagttgttacgtgggtctccatcaaatggagtgccatctgcattgtaaatatcacagattagtcgagctactttacctttttcagctgtccaagggaaaattacccaagtgtctaaatcaggatataaatacatatcagattcttcaatacgtacgaaaccttcaatcgaagatccatcaaacatcattttgttatcaagagctttcgttaattgtctcactggaatctctacgtttttaattacccctaaaaggtccgtaaattgtaaacggatatactttacattctcttctttcgccaaacggaaaatatcttcttttgtgtatctagacattataaattcctccttagaccctctaatcgccctcagaatcaaccatcttcagtgagaaaatcttgaaat

SEQ ID NO: 1090 - DNA, 4057 bp, Bacillus thuringiensis
  unsure (1)...(4057): unsure at all n locations
tatctctgtgctttctatatacgacagactttctttttcaacataaaaaagaggatgccactttatcctctccttctcttctctattccacacaagtaaactgcgtccaagctcctacataatctagtaagaataactcctcttccgcaattgtaccgacgatatttttccgttcatctatcggcatttctttcagaatgatttgcagttcacctttatacttaccaaatgaattgtttccaattacaacttgccctctttcctgcagcacactttcacgcactgggaagtcataatctttgtactttttacgtacttctgtagaacgtatcatatactctgttatgtcgccgcgtcttacgtgtaattcttgcagcgtggctctcttttctacttcagtcacttcgcctacaaagtgcacttttagctgtaacatgtagcgatttaagtttcctagtttttctaactcttcctcactcgcataagcatttccgataatgacatcatcgattagccctgttgcccataaatgcttcgcttgtacttcaattggtaaattacgatgctcttctaacgtacataatccgtcgttaatatcccatggaccgatgtttgcagcatgtgatgtaataaaggctgccgtacgaataccgtgttttttaaagcgttcactacagcgaatgaaataatcatacggaagaccagtgaatttttgcggataaaaattatggcaaccaattaaagctgatttattcgcttgatgcgaaagaatattttctaagtacgcaatatcgttacttacatttaactcaatttttaaaccgtacggattattcgtcattttcgcttcagttaacccgtcgaagcctacatctaaacgaataccgtctgcgcctaactccgcgaagaatgataaatcgctataactaataccaagctgatcaaacacagccggagctacatctaaaataacttccatattgttatcttttgcgtgattgataatctctttaaattcagctacaatttcttctttcggacgattcacagataacaaacaagtaaatattcttgaaaaaccgtgtcgtgccgctgcggaaatataagccatatctttttctttcgttgaatgttctgggtaaagtgaaattcctaatttacgctccatgcttttgcatctccttcatacgttgtattaatgccatgctcgtaaatctatattttgcagataaacacgttgcacataaaattgtcggtacaataattacgtacggtgattgcaatcctaacattacatatgcacccattgaacaaccgataaataaaactgatactagtagtaacactaataaagatttactttgtacccatttcgaataatgggcaatacactgtccgaccacgaatgtaattaagatgataattgctccgagcattctgttttctcctctcctgctaattgttgtttctcatacattttgaagaatggatagtaaataacgaacgagataacaaagttaacaagtacaagtacaccagccataattgtccagtccgtactaatcaccgctgcaattggtgctaacatcgtaaatggcagtttcgccctcatgagtggaatcatacctgaaacaactgcgaaatatgatactgtcgttgtcactaacggtgtaataacgaacggaataattaagattgggttcattacaattggtgcaccgaaaataattggttcgttaatattgaataaacctggtacgaatgataatctacctaactcttttaggaacttagatttagagaacataaacataattactaaagctaacgttgagcctgatccgccaatccatacgaaccattgaatgaattgctctgtaaataagtttggtaactgatgtgcatttcctgtagccgtgaacacttccatattttcaagaattgctgaatcccacatcggacgaataattggtcctaaaatcgctggtccatgtataccgaatgaccagaaaaacacgattaagaatactgttaataaaccaccgaataaattatttcctactaatactgattttaatggtgcgattaaatatgtaattgttgtatttacatcgaatttcaaaccgtagcgaatgccccagaataaaagaataactgctaacgttggaattaatgctgcaaacgaatttgaaactgctggtggtacactatctggtaatttaatcgagatattatgcttaatcataaaatgataaatttctactgcaattaatgctgtaacaattgcgccgaataaagacgttgcacttaatgttcctactgaaatatatctccctgcatcaataacacctggtacagctttcgtaatttgaattggttcaactgatgctagtaaaaaggcgagtacagataataaccctgcacttaactgattgagctgataaaagttcgcgagcgaagcccctacaccaaacgctgcgtataatgccattagtcctactgtaaatcggaatggaatatctaaaatatggcgaaacggtgcaatccattccatatatgcatcaattggtaaatttaaaaagataacgaaaaatgatccgacgatcgttaacggtaatgtagaaataaccccgtttcgaattgctaataaatgtcgttgtcctgcaatcttttgcgttgttggcataatcttttgttccataaaactcataaacccattcatcaatagccctcctctttctctctactataaaagaatgaaataaactttataacattataatgtttatatttaaaaagatataattatgctaaaactaattgttctgcttgcttaagcactttcaaaccatcacacataccataatctcgttggtctataatcgcaactggtatattgtatgaatttgcaagaaactctacagctggaaataaatatttcacttgtggaccgattaaaacgacatctgcttcctttatttcaagtttcacaagttctgaatcaaccgccttaattttataattcttcccctgtttctttgcctcttcttgcatttttcttacgaccatactcgttgacatacctgctgcacaacataataaaatgtacatcttatacggtcactttctcttctactcgtttatgaagagcaataaattcttcagccagttctttcactgtaattgcattcattaaatgatcttgtgcgtgcactaacagtaaactaatttctgcatgatttcctcttgcctcttcttgaattaaatccgtttgaatacggtgtgctgctgaaatttcctcactagcaagtttcatcttttcaccggcattcccgaaatctccttgtcttgcaaaagcaattgcttcaagcgccgcgcttctcgcattgccaccatgtaaaattaacgcaaatggagtttgcatatcagccattttaaattcccccaagctatatgttttctatatttttatcttattatgaaaacgcatacaattaaacataaaaaacttccgttatgtaacggaagtttttatatactttttcaaaatgataataaaatttcttgaaaatcttcaattacctcggtctgagtaagtttctctatcgtagtttgactagacataatatcatataaaaaatcataaagcctttgcaaatcttcattattattgcgctttacactaaataaaataattacttgtacttttttatctccccaatcaacagccttttcaagtgtgcaaaacatcagaaaagtttcctcacttaataactgcatcggatgcgggattgcaactgaattcccaaccgctgtcggagacgtattttctctttccataacagaagcataaaagttttctggtacatagcgtttctcagcagctttctcacataaaaactgaataacatcctctttcgtagaagcattatgatttaaaaagattaaatcttccttaatataaggctgcacactagtattcacatgcgtaaacaaccgctgaccaatcgatttaatctctttttcatcaaatatngaattcacttttataactgga

SEQ ID NO: 1091 - DNA, 5943 bp, Bacillus thuringiensis
aattactccttcgctttcttgccttctaataatgcttgaataataattaatacaacaccaatacataatggtgaatcatttatattgaatactggatagttgcaccagaaaatatacacgtgaatgaaatccactacttcttgtctaaatacacgatcaataaagttaccaattgccccgcccaaaattaggcttaacgaaatacctagaagcttgtctgttttcgcatactttttcatataaaatacaataaacactacaaaaacaactgtaataatgtagaagaaccacattttattttctaaaataccccaagcagcgcctctatttcgatgtgatgttatgtataatacattgtcgataatcggaatactcgtacccaattccatgttctttacaattaaccacttcgatatttgatcgatagcaatgacgaataacgctattacataatatatcattttcatttcccccacaaagacagtgtacctcaaaattttagcatagctgctaccttttcacaatgaacctttatagaagaataaaataaattaaaaaaaggtaatataatatcgttgtgcgtattcatacatttaccttttcgtagaagaattcatgaatcgtacgggcagtcggcattgtcttcatttgctttgtggaaattaatctccccgtctcttcacaaataccatacatgtctatttccattttaaataatgcgcgttctacatcctttaaatcctcttttatatcatgtaatagcaattttttctttatctcttccttaatttcatatccaagctcttggctgaactcgacatcatatttgtgcattacttctttagctagtctctcttgcaactcttttctcatcaattgcaattcttcttttatttccatgtaaatttcattcacgtgtacattcctcctagctgtaatgtacagttagtgtgtccgaaatttatttgcttacctcacacacatttttccttcacaggaaagagtctgaaagtgatcttgatataccatcaacaaaaaaactgaccgcatcaatagcagtcagttttttattattttacatagttttctttaacaactgttgcacaacgctcacataatgtttcatgttcagcatctttaccaattgtttctgaaactacccaacaacgttcacatgtttcaccagttgcttgaacaacaacaaccgctgtatgttcatacttcggtgcatctgctggcgcttcatccatcataccaccaagtttatactcagaaacgatgaataattgctttaagtcttcgctaatagactctaacatagctttcatttctgcagttggatatagcgtaatgcttgcatttaatgacttaccgattactttttcattacgagctacttctagtgcttttaacacgtcatcacgtaatgtcataaatgcatcccattttgtttttaacgcttccgcgtcatctaattgtacagcttctggcatatcagttaattgtacactttcttctgttacgcctggaatatatggccatacttcatcagctgtgtgcggtaagattggtgttacaagtttcgttaacgcaacaagaacatcatataatacagtttgaattgcacgacgatcttcgtggtttgcaccttcaatgtataagatgtcttttgcaaagtctaagtagaatgaacttaaatcaattgtacagaagttatgaattgcatgatacacagcagcgaaatcgtatgtctcatatgcttctttaacttttgtaattaagtcatttaattttactaacatgtaacgatctacttcacgaagttcagctacagctactgcattttcacttggcttaaagtcgtctaagtttcctaataagaaacggaatgtgttacggattttacgatacacttctgctacttgttttaaaatatcatctgaaatacgtacgtcagattgatagtcaacagaagatacccataagcgtaaaatgtctccgcctaattgatccatgattttcttcggtacgacgatgtttccaatcgacttactcattttacgtccttcaccatctagtacgaaaccgtggcttagtacgcctttatatggagctttacctgttacagcaactgctgttgataatgaagagttaaaccaaccacgatactggtcagatccttctaaatataaatcagctggacgctgtaaatcttcgcgctcttctaataccgcttggtgagaagaacctgaatcgaaccatacatccatgatgtctgtttctttacggaattcaccatttggactacctggatgtgtaaatccttctggtaatagatctttcgcttcacgctcgaaccatacgttagaaccgtgttcacggaataaatctgctacatggttaattgtttcatccgtaataattggatcaccattctcagcatagaataccggaattggcacaccccatgcacgctgacgagaaatacaccagtcaccacggtcacgaaccatattatgaagacgagtttctccccatgctggtacccattttgtttctgctacagcttctattaattctttacggaatgcttcaatagatgcaaaccactgtgctgtcgcacggaaaataattggttttttcgttctccaatcatgtgggtatgaatgtgtaatgaatgttagtttcagtaacgcgcctacttcttctaatttttctgtaattggtttgttagctttatcatagaataagccttcaaatccaggtgcctcatttgttaatacacctttatcatcgactgggcaaagtacttctaatccatactttttaccaacaacgaagtcatcttccccgtgtcctggtgctgtatgaacacaacctgtacctgcatctgttgttacgtgatctcctagcataactaatgaatcacgatcgtagaatggatgttttgcaactgtatactcaagttcgctaccttttactgttttcacaacttcagcattttcccactctaacgtttttgcaactgtctcaaacagctcagaagcaatgatatatttctcatcatttacttttacaatgctatattcaagctctggatgaacagaaatacctaagtttgcaggtaatgtccaaggtgttgttgtccaaatgatgtacttttcatcaccttctaatacgttctttccatcttttacagggaatgctacgtaaatagatgctgattttttatcttgatattcaatttcagcttctgctaaagcagattcactcgttggagaccagtaaactggtttttgacctttatagatataaccttttttcgccatgtcaccaaacactttaatttgttgtgcttcataagctggctctaaagtaatatatggattatcccaatctgcacgtacacctagacgcttaaattgctcacgttgacgttctacttgttcatatgcatactctgcacataacttacggaactcagcaactgtcatttctttacgttttacacctttatttgttaaagcttgttcaattggtaaaccgtgcgtatcccatcccggaacatatggcgcactaaaaccagtcattgatttataacgaacaataaagtcttttaatactttatttaatgcatgtcccatatgaatgtcaccattcgcatatggaggtccatcatgcaatacaaataaaggacgaccttttgtatgttcttgtactttttcgtaaatattcatttcagcccatttttcttgcattgcaggctcacgttttggtaaattcccacgcattgggaactctgtttttggcatcagtaatgtatttttgtactccatgctcaattcctccttacatgtataaaagaaatacttaaaaaacggaataaaaaagagaccttctcatccccaaaagggacgagaaagtctcccgcggtaccaccctagtagattctatacatatgtatagaatcctctttatattcttaacgcgaatacacgcctacgcttactctatttgttcagcgcggaactccagggtgatattcccactatctccttatcctgagcttacaccatcctcagttcgctatataaggtttgaaaaggtacttatccctatcttcgtttttcttaataaatatgttgtttaaaattatatgtaataatgagaaaaacgtcaagcttacactgtttcttcttttttcaacagttcatctacttcgtcttctaattcaattagtttatcccaatcatcgttgtttaacatctcaagctgtgtttctaataacatacggaaacgagttcggaatactttcgcttgtttctttagctcttcaatatcaaaagcaacttttcttgattttactaatgcttcgttaataatacgatcagcattcttttcagcttcacgcacaattaatttcgcttctttttgcgcattacgttttacttcttccgctgcttcttgtgcaacaacgatagatttgtttaacgtatcttcaatattagagaaatgatctaacttcccttctaactgcgcaactttttcttctaaagcttttttctcacgaatgaccaattcataatctttgataatttgatcaagaaactcatttacttgatcttcatcatagccacggaatccgcgaccaaattctttgttatgaatatctaatggtgttaacggcacaacgccacctccaagtagttatctaaatttcctctttcaattatatcttttcttcgacaaaataggaggatttccttctaaaaaaccaatcattttagtatgccatacaaaattctccatttgtcgcgttttgttctaccttctacagaaaataatttacttcggccatatcctctaacagaaaaaaacatctcctggataacattcataagaagtttgctccactgttttccaattgacttttactaaaccattttttatgaaaggttgtactttctgtctagataaatgtaacatttcagctaacataacatctaaacgaagtgaagaaaccgttccagatttctctccccacgtttcatgtatctgtagaatttgttctccttgcactgacgctaaagagacttttactttccctattgattgtaagttcatctcaatatgcgatgcgatttctttcgcaactccaatttgggcacgattttcttgcagcaaaatatcaccacatttttctcttgttgaaccaagagacataaatgtgcctaatatttgcctatgttctagcgtataaaacttggaaggatagtcaatttctaatacttctacttgaaattcttcttcatttaattctagatagtctggataaataagtgctcttttacgctctgcattaggcgttgcaccaccaaattgcacagcaacatcaccttgtcctattaccatagaaacaatttgttgttgcctaggatcaagaaaatccgttaacttcacttgatggtactccgccgctcgcttccactctagcactttatccacaaagacctcctcatcaggcctaaaatgttcgtagatgctcatgtatttaccttcttactataagaaatagcttaataaactgaacaaaccagttttagcaagtttcaacgcaaagattgcaacgattggagaaatatcaatcattccaagcggcggaataaagcggcggaatggttctaaatacggttcacaaatacgtgccaggaactctccaaaagatgattcctttgcaccaggaaaccatgataggagaatgtaaataataagtgcccacgagtaaatctcgatagcataacttaacactataaaaactgttgtcatggcgtattaccacctctttatatttgtttcttcttcttcaccgaataactctgaaatcgcaccaacaatatctacattttcaggtgtacacataaatgttttcggccctattttttg

SEQ ID NO: 1092 - DNA, 3196 bp, Bacillus thuringiensis
  unsure (1)...(3196): unsure at all n locations
ctctaacactggctccggttaatcaacaccatcttgctttttcaatgtgatagaatacagcgtctgcatcgcttggtggtccttctctctaaacttcatctttcctttcggtgtatcaaattccattccttccattttcttaatcaaggtatctacatctgtatcaccttttgttttctttaaggcttctacaatagaaattgctgctgacattcctcccgctgtaaacaaatctggcactacaccattaaaacgttttttatgctcttcaactagccaatcattcactttattttttggaagtgtgtgataatatacagaaaaaccttgcatacctactaatgcatccattgtttttaatgctggtatatctggcgcacctgtagaaattttaataccttgcgcttccacattcatatctttcaactgtttccaaggtgaatttgcccctgcccaaacaataaataaataatctggttttgaactaatgatattttgaatattcgctgtaaaatctgttgaatttgtatccgcgtattgctcattcacaatgctcgcacctaattttttcgcacccgctttaaatgcagcaatcccttcacgaccaaaagcgttatctggggcaaatgtcgcaatctttacaccttttttcgcaattgccgctgctcctgcaatcgcatcttgtgaggaacttcttccagttctaaaaatatatttattccagttcttcccggtaatactatccgcaactgccggttctacaaccataatcttttcatattccccggccagtggtaaaaccgctaacgtatcacttgaactagacgatccaactaaaaaatcaactttctcttcttctaataacttcgtagcttttttaactgctacatcagctttcgtttctgtatcttctacaacaaacttaatctttttcccatctactttcccagttccaccagttgcatagtctaaccctaattcaaatccgttcactgtttgttttccatacgattctagcggtcctgttaaagaagcaagaactcctaccttaatcgttttttcatcctctgtacttgttttctttcctgaacaagctgccgttattaataacgaacctaaaacacaaccagtaaacattgtctttagccacttacgttttttcatcgacattgtgatcctccccatactttactttctgatagaatcaaacacgccaaaatcccctgtccgtaatcatgactaactaattcgatagataatggaaaactcttgtagtaccctctacattcggcacaaatatataatcaccttcctatgtaatggaaacggacatacaatcaatatatattctgtaatccaattgaaaatactgtttcatttcagtaatgatcatacaaaaagactaacttattttttaagttagtcttttcaccttaattagagttaagttctactttctctaacccttcagccaattgtttcttatctagtccttctcctattactactaagtttgtcgggaaaccgaagtcttgttctaataaagttggtactccgaacgaatattggaataggtgagggtatttatctccacggaatttcacaaaacctttcactcgataaatactatctggtaaattcgaaagccattcatataatttgtcttgatcaatcggtttcgtaaattgatatgtcatcgtttgtatatgtaaatgctgtttgacatgtagtgtctcatgttcctcatcatttggaaattctgcttcctctatatcttttaaagatatattgcaatactttgtctcatacattttcgcatgatcatttattgcctttacttcttcaaatactgtgttcttatcttcatctgttagtaaatctgctttattaacaagaatgtgactaccaaatttaagttgctcatgcaatagctgttgtacatttgcacttaatatacttcggtttaaccaccttactgcatctaaaacgactacaattgatttcacttccagaaaaggagctaaaattggcgagacacacgcgtctaacacttcaattggatgcgcaacacctgtcgtttctatataaattacatctggtctttcttgttggtataacgaatgtaattgtatttcaagctcttcttttaatgtacaacaaatacatcctttaagaagttctcttaaaacattctcttttccaataatatctgtatctaccgagtattcaccaatttcattcattaatactgcaacttttctattcttctttttctctgctaacaataaattttgtaataatgttgattttccactacctaaaaaaccacctaatatatgaatctccactttattcattcaaccgaccatccatttctttacttcaaatgtattcaaagcgtaataattacgatttatatttatcattntattaaaagaatgaacatttgtaaatataagagattcactgttcatttacttcatatgcaactctaactccagactcaattgccccttgcatccatccatgtgttaatgtcgtatgctctcctgcaaaatgtacttttccagatggtggtgtaatatacggaaataactcgagctcttggcctggttcgaaagctgtaaatgcaccgcaagaatacggatttttactccagctaaaagatgttccagtgacaaactcactatagacgatgtcaccgtatatttccgctaaattttttaatgcgtaacgaatacgatctctttgcgggagactatcccatgttaacgcctcatctgcccacgtataacttgctataacgatagctggtcctggagtatgaatgccataactcggatagtatgtaaaccgtatcggtaaatcagtaatagatttacctccacactgtcccgctttctcccaaaatctacttttaaactctattgcaattttagttgcagcaatataatttaattcacgaattgctctttttttaaaataagagaataaatagtatggctgaacttctacaaatcttaacgctgaaaatggaattgtaataatagcaaaatcacttgttattgtaaattgctctaacgtttgttcatgatttccttgtaacattactttattatcttcttgtataattttatcaaccttatactgcattaaaatatgttcccttcatatagtaagaatgatctaattgtcg

SEQ ID NO: 1093 - DNA, 4229 bp, Bacillus thuringiensis
tttttatgtaaattctcgttttatatttataaatctatcataaaagaatactattttaaagaaagttttctgcctaatctgaaaaaacaattaaaatcattgacaattatttctattctacataaaataaaaataaatattacgaacctcgaaatatacgggagtggaattaattgttgcaatatgaacattttttagacttactgctagataacgccaagaaacttttctatcctgaagaatgggtaagcctagatttaacactttctaaaacagaagtattttgtttactttggatggaacgaaatacagatattacaatgacgaaaattgctgatcttcttgatataccgatgagtacaacaacgggcgttgtaaatcgccttgtaaaaaagggatatattgaacgctaccgtgatgaaaatgaccgacgtattgtattaattcggttaacagaaaacggcgtaatgctcgttcaagaagtaaaacaaaatgcggcccattactttagcttagtaacagaagcattatcagaagaagaaaaagcattcttactacaaatcttccaaaaaatcatgaatcacatcgctacgtcacagcaaaaaacagaagaaaagatttctacacctaaaatgaaaaacattccgattgaataaaaccctatctgggtttttattcaaccatttacttcgacactcgtaatattcgacattcgaaacaaaggggatatgaatgatgagaattatcttgtatacaggtaaaggcggcgtaggaaaaactagcatttcagcagcaacagcaattcaaagtgcgaaacaaggattaaaaacattagtaatgagcacagatcctgctcatagtttaggagattcatttggtataaagctatcttctgaaccactagaaattcgtgaaaatttgtgggcacaagaaattaatacgatttatgaaatggaaaaaggctggggaaaattacagaaatatattacactactcttcacttctaaagcagctgatgatattacaacagaagaattaacgatgtttcccggtatggaagatttaattagcctacttcgcgtactcgattattataagcaagacacatatgatgttatcattattgattgtgcccctacaggagaaacattagcaatgctaagctttccagacatgctcggctggtggatggaaaaattatttcctattaaaagaaaagttttaaaagtcgttcgtcctgtagctcaaccactccttggtgtccctcttccaaccgacgatattatggacgaattaacaagtacacttgaacagctcggagaaatgagagatattttatcaaatcgagaagtaacaagtatccgcatcgttgtaaatcctgaaaaaatggtcattaaagaagcccagcgcagctttacttatttgaatttatacgattataacgtagatgccattatgattaaccgcgtcatccctaacactgtcaccgatccttattttcaggcatggaaagatacacagaagaaatataaaacattaattaaagatagttttcaaccccttcctatttacgaagctccaatgtttgaacaagaagttgttggtttgtctatgttagaacgtgtaggagattctttatttaaaactgatcattcccctacagaagtaaaatttaacgggcgcactcaatatgtaaaaaaggatggcgatgagtatattttcgttctgtccattcccttctcaaacaaaagtgaactttccttaaatcaaaaaggtgatgaacttattattcgagcgggttctgttaaacggaacatcacgttaccaaaaacattaacacacctttctattcaaggagcaaaatttgaagaagatgtactaaatattcggtttggaggtgtagtacatgcatgaggaattactacgaagggtaattcgtacaaaaagtaaaagtcgggatgcatatattagaagagctacctaatccaatccaacaatcagctaagcaaatattaaatattttacaagaggaactagctgcttatctgaaagaacgagagcatcatgaagttaatttaaaaaatatcataattgaataaccatctctgtatagagggcctttttttaggctttctatactttattggagtgatgtaaattgatgaaaaaacattccactactatattctggatcattcccttattatttttcattcataaccttgaagaagctttccaaatgccacaataccttgctaatcaattttcaatccgtcttataactagccaacaatttttcatcgccatttccgtattaacaatctttgtattacttatcgtctttctatatcaacttaacttcttgtcttctatatgctggattatttttatacaaggggccatcttcttcaactctgttcaacatattattttgtttttcatttatcgctcttataaccccggcgtaatatcagcatttttcattactctcttttctattttcttttttttatcaaaaaaacacttaattcatccaaagcaattcgtaattacactccttttcagcttattttcttatcccattataatttggatcaccttactgttcgctagctactttcattcataaaaaaagaccaggaaaattcctggtctatcactctacttaacaaacattggattctatgttatacaaaattggaaggtacagaattagggtttgtttgttaagtttatatgttgaacgaactaacagcggaggggttccttctgttagtccattaaacccaatgattattttacgattttttcaagctcatcaagtgaaagatctactgaaatggaaccatcatttgtttctttcttaattgcgtctgttacttcttttgaatgatatagttcaattacttttttcaatgttggatcatctttatctttcttacgagctgcaaaaatattaatatatggctttgcattttcattctttggatcttctaagaaaataggatccttcgctggatctaatccagcttgaccagcaacaccgttattaataactgatgccgctacatcttttaacacacgaggtgtttgctgtgcgataaccggtgtaatttttaatttcttcggattttcagcaataccacttggatctccaaatagaccaaagtcttttttaagctttaataatccagctgcatcaagaagttttaatgcccgtgcttggttcgttggatcgtttggaattgcaatttctgaaccatctgggatttcatttgctttcttatatttttcagagtataaacccattggcgcaatttgcgttgtaccaacagctgtaatatctaacttatgctcttttttaaattgctctaagaaagcaatatgctggaatgagtttaattcaatatctccatcagctaacgctttatttggcgttgtgtaatcagagaactcgaccagtttaatcttaatcccttctttttcagcttttttcttcaaaatttcccaagcgtctccatccgttccagttacaccgacgcgaactactttttctttcgctcctgcacccgtgtctccacttgagcagccgcttaatgctgagactcctacaatcgctgataatgcaaatgctaaaattttcttcattttcttttcctctcttcctttttatgatctgcgtaacaagactttcgcaaagtagtttcctaaattttgagctatctgtacgagaatgataagtaacacgaccgttacgaacataactgatgtatcaaaacgttgataaccatatgtcattgccaagtcaccaagaccgccaccaccgacaagcccagcaactgcagagaattcaattaaaccaactgtcataaatgtgacacctaagattaatggtgctaacgcttctggtacaaggatttcaaaaacaattctaattggtgaggcgcccattgcttgcgctgcttcaattactcctttcggaacggaaacaaggtttgtttcaaccattctagcaataccaattgatgcgactaacgtcatcgggaaaattgccgctgctgttccaatcgtcgttccgataacacttcttgttagtggacttaaggctactaaaaagataatgaatggtaccggacgaattgtattaattatgatgttaagaattgaaaagacccatttatttttaaaaagtttccttttctcgttacaataaaagtaaactagaggta

SEQ ID NO: 1094 - DNA, 4699 bp, Bacillus thuringiensis
agagcttccatctcgcgaaaatgacgttgttgcaatgacgttactacccattaaaaataacgatgcacaaaggccaacaccaattgcaaatcccgttgtctctggattgttaatatactctgtaataaactttaaatttccatcttgcacaaataaaataaagaacaacataattggcataacgaaagtttgtacaatgcaatttaagaaaaattgtggtgtacggaataacgttttaaattcttttttcacatacgcttttaaatgcgaactttgtactgttgatttctgtaaaccttccgccgaaataacttgtttctttgctgtactcgtcgaaagtccaataaccccttttaaatatgtacgctctgctatgtaataaaacaacacaaagaagacaaatgaaataactgcaaagattattacatataaaggtcccttccaatttgcattttctactaatgccactgctccaaaatatgtagttggaaaatagtttgtcatttgtactaaaagagaagactggttgtttgcaaggtaatccgcaattgcatcttcagaaaacgaacttttatttttccactgcaaaaatacgttaattcctacaataaatagtatacttacgattccaataaatatatttcctcggtctttatttttcgctatatttgtatacctcataataactgtcatcagtaacgaagctagtactaacggcacaattgggaagagtaagtaaatgaaaatcatatatatgtaatatgtaataaatgcgccactttttaaaccgtacgtaataaagatcggtaataaaataaatgaactcattacgtattgtgtaattaatactgttaaaaatttggctgaaataatttgcgctggttttaatggtaatggtaataacatttcaatgtcattgctgtagtaaaatacagttaaaatgttcgtaatactcattaaaaatacccatatactcgcaatcgcaagtcccattgcgataatcattcctggatcttgccctaaatgtatcattccctcatacattgcatgcgtgatagaaccaaacagtaaaaagccgacaaataaaatagctgcaaatgaaaatacatacgcccatcgcttcttcttatctgttataaaatctgcataatttaatttcaataataccttcgttaacgtccaaattttactcattgcccgtcatctccaagaacattttttcaagtgattcattggatttaaaatgatctctcatttcatctaaatttcctttaaactgtaaattccccttattaataatagcaacccggtcacatattttttccgctacttctaatacgtgtgtagagaaaaatacaatctttcctttatccgcatgctctctcatcatttcttttaaaatatatgcagatttcggatcaagcccagttaatggttcatctaaaatccatacatctggctcatgtacgagcacaccaataataacgattttttgtctcataccgtgcgaataactttgaatttgatcagataaagcattataaagatcaaacttcttcgctaaagactctattcgttcttgtcgtacttctttcggcacttcatacatatcggccataaagtttaaatattcaattccttttaatcgtaaaaacatatctggactatctggtacataaccaaacgtcttcttcgcttccatcggctcttccataatattttttccgttaatcgtaatagtccctttgtccaccccgtgaatgccagtaatcatcttaattgtcgttgatttacccgcaccattcggtcctaaaaatccaaagatttcgccgctaggtacagataaacttaagtcttttactgcataggtagacccattataactttttgacacattcgtaatttcaatcattccatccaatcctttccttaattaccaaataactatattgatattatagcatagttctattttaatatttttacatttttcagtttatttaacctttaaaataaatatacacccctaatccaacaactaaaacgacagctagtataatataaatcattgttaagcgtttaatattcccctttgtcgctttgctataatttgcatcaccattccgcccaattaacaccgtcgcaatgacagtaatcactacaagtaatacaacgatcatgatccaagttagcatttcttcctccccctccttacaaccattttacaatattatcctctttatttcgcagcatatttcctctttttactattattatgaagcaaactggaaaactattattaccattcctatccaattgcgatatatttataacataacgtgacttatttctaacaacataaggaggacctatcatgaaaacaacttggataaaatatttaggatttctcggtttcttcggatttttttatgaaaaaggattgtttactatgttctgtttcttctcctttttcacatcgtatagaacagttcaacacgatgaactgtttgaacaaattgtcaataaatcgtgtcgcaatgcatttatcgttacgttactaactaccacaatcattatgtttattgaaatgttatttccaaaccctacgctacaagagattgatatcgctcttattttcggcacactcattcttacattcggcttttctatgttctttttcgataaaccaattgatgaaatggaagatgcaccatggcgttcgtaacgagaataaaagaataccgtgccaaattgaacatgacacaagaagatttagcgaagagcgttggtgtgcgacgtgaaacaattagtcatctcgaaaaaggtaaatacaacccttccttacaacttgctcacgatatagcgaaggcattacatagtacgattgatgagatttttatttttgaggattgattaaagacgtccagtcacaagaatcacataaaaaaataccgtcattctttccaagaagaatgacggtatttctcattgattatccatataaaaccgcatgaaatacgcctaatagcaagtattgatcctgcatgtaatcttcatcatatacattcatctcaatgtaatacatatcttcctcaagacgaatattccaatctgcaattacatagccctttcgtaataactttcccattccaaatgaagttttatgaacaacatattcttctgccttatatgtaaaggtaaataagaaatttgcatccaataactttccgtcacatacaagtatttcatgctctgcatcatgattatctttgtacgttactaaaatccttctttggcgctgcctacttacatcctttgcaatgacgcgaatattgtccttactatcctttatttcataaataatattaccaccaatttttggaatgaaatccagcactctcatcagcgtatttttataatagccccttactacgcctacttgctcacttccattataaacctctatcggtgtcgtatctgctttgctatcacacggtcgtttgtaagagagctgcatcattcgctctcctcttaagtactgatcaaacgtcacaggatattctatcatgcgcagttctttatttagctcatacaaatagcgttgaacactctctattaatgttgtagtagctatacgctcttgaagttcaaattcttgccagctggaaaaaacattccattgattatgatcctcttcatagaagaaaccaagaattacctcttcacggtcagccgtttcatatttcataggcacgttctgcccatgttgaacttgttccatccactgacctaaataaatgcccagctctgcaaccttcatacatgatttttgaaaaaatacgctgtcactcgcgcaaatcgttacatctccttcgataaagccctttgaataagcatcataccgtggctcatccttctgcgggatactcttatctaactcaaataaaaacgttaacatcctttattcacctctagttgttacactaatcatacatgacatcgcatcactctgagagactatttatatacgcatatttaattcacgcattataacacgtgaatgatcttgtatagtagcgctattttttgttctatatcttagtatatgaatttatatgagcgatttttcaaatatatctatcacaacttacaatatatcaacgatttttcaaatatatcgatttttcgacaaatatcagcacaattaaaatgaaactaccttttcttcagccacttctacaatttctaaaatttgtagcagactctccacttcataagtcggattaacactcgtcttattctctttcaaactcggattataccaacacgtatcaatgccgaagtcttctccgcctttcatatcagaagttagcgaatctccgaccattagtacacttgatttatccgtaattccaaatttctcaaatgcataatcaaaaatctcacgcgctggtttttgatgaccaacttcttcagaaataataatgtgatcaaagaaattacataaaggcgaatttccgattcttgattgttgcaccttcgtatatccattcgtaataatacctaacttgcaatcttgaagattttcacataattgtactgcgccttctataagatgtacctcttttcctaagttttcaagatatacatcactaaattgctgtgcatctacttttatattatgaagggcaaataatgt

SEQ ID NO: 1095 - DNA, 5860 bp, Bacillus thuringiensis
ctattaaactaggacttggtaatacgttaggatttttagcaatagttttagcactaggaacgatgcttggaaaaatgatggccgaatctggtggtgctgaacgtatcgctaacacattaattaatcgttttgggaagaaacgagttcactgggcgatgatgttcgttgcatttttagtagggattccggtatttttccaagttggatttgtactattaattccgttagtatttacaattgcattagaaacaggggtatcacttattacaatcggtatcccgctagtagcaggactatccgttgtgcacggactagtgccgccgcatccagcggcaatggcggcagttggtatttttaaagcagatgtagggaagacaattttatatgcattaattgtcggacttccaactgcaattatttcaggtccactttacgggaaatggattggtgctcgtatacataaggaagtaccattagatatagcggagcaatttattgaaaaagataataaaaaagagcttccaagctttgggaatacattgtttacaattttacttccagtatttcttatgcttggtgcatcaatagcagaagttgcattaaataaaacgagtcaactagcacaagtattacactttattggagatccgattgtggctttattaattgcaaccatttactctttctttagtcttggatatgcaaaaggtttctcaaaagataaagtgttacaatttacaaatgattgccttggacctattgcaaacatattgttagtgattggtgcaggcggtgcatttaataaagtattattagattctggaattggaacgacaattgcagatatggcgaaagaatcacatatttcaccgatattattagggtggggaattgcggcacttattcgaattgcaactggatcggcaactgtttctatgatgacagcagctggtattgttgcgccgattgcagcaagcacaccaggtgtaaatgttgaattattagcacttgcaactggtgcagggtcattaattttatcacacgtgaatgattcaggattttggatgattaaagagtatttcggaatgactgtgaaagaaacattattaacatggactgcaatggagactatattatctgtagtagcacttgggctaatttcgatattaaatatatttgtatagaataggagattgattaatatgaaactaggtttaattggattaggaaaaatgggattcccattagctgaacacttatatgaagacaagcatgaagtagttgtatacgatgtaaataaagagcttgttgaaaaggcaggaaaactaggaattactgcacgtcatacattaaaagaaatgatcgctgaactagaagctcctcgtacaatttgggtaatggtgcctgcaggagaagttgtagagtcagtactaaaagatgtttatccgttattagatgaaggtgatatcgttattgaaggcggaaattcattctataaagatacgttacgccgtgctgaagaagcaaaaagcttcggattacattatgtagatatcggtacatcaggcggtgtagaaggagctagatacggtgcttgcttaatggttggtggagaaaaagaaatttacgaccaattagaacctttatttaaagatttagcagtagaaaatggctattcttatgctggccgtgttggtagtggtcatttcttaaaaatgggtcataacggtattgagtacggcatgatgcaagcaatcgctgaaggatttgaagtactagataagagtgactttgatttcaattatgaagatgttgcaaaagtatgggcgaatggatcagttatccgtggttggttaatggacttaactgaaaaagcatttgcagaagatccgaaactagatggcattaaaggtgtaatgaactcttcaggagaaggaaaatggactgttgaaactgcacttgaacttcaagctgcagcaccagtaatcgctatgtcattatttatgcgctatcgttctcaggaagatgatacattccatggaaaagtagtttcagcactacgtaatcagttcggtggacatgaagttgtgaaaaaataaggatgtttttgaaaagaaacttgtgcataagcgcaagtttcttttttatagtttaagaaattactaatttaaaaataccaatcaatcatcgtttttttgtcacaaatgacagcttcaacgttcattgaatgaacaatatattctatattttcttctttagctaataataaggttgtaaaggaatcgaatatactcataaacgcatactcattatcttcgccagtaataattaactcattattgctaatgtcccaaatatctaatggagtagtattatttacctctaataatccgtttgtatcaagaattggttcagagaaatataaattttttgcacctttagaaccgaggagtttaagtaatttatgtaataaaaatatagacgtataatcttctgttggataataaagatctttttttaagtttgaatatagcttttcggctaaatcctctcttttatattcttctgtataagcaccaatggaagtcaacagggccattgctaattctgcgtatgaatgtaatccactataagacatcatttccttccaagaaacggatttcccattatgaatgatttcttcagcgctaggatagatgtgctcatatggtctttttctcacagacttttcccatcctaaaggcatttggacaaaagggtgtagcaatatagctgcagatttaaaggtgcttggtagttgttctaaaattggtgatttgtcatctagccaaatgtaatccaacaaaatataacctcctcttagactttgaaatgtacggattcccgcattatgtttttttgtattgattgtatcaaatataaagcgctgcatgaaatatatctcaacataaaagtaagaataaataaaatgaagttttcataaatagtaaaagggtgcttatgtcatcagtatagctaagaaatgttgttacatatgagaagagcgtgttaataaaatatgaggtggttaaatgggaaatgagcaagtgaagtctgtaaagaaagaaaaaaagttatgtctttgtatgatcgtcaaaaatgagtctagaattatggaaagatgtttaaatgcaacaaaatcaattgtagactttgtttctatttgtgatactggatcgacggataatacgcctgaaattattgaaaattggtgtaaggaaaatgagatacctgggacggttcatcatgagccgtttaaaaactttggttataacagaagcttagctgtttcgttagcgcaaaaaacatacccagaagcagattatttattaatattagatgcggatatgattttagaggttgatccgaatttcgataaaacgagcttaacggaagatcattatcttacattacaatatgatgttcatattaaatattggcttacacgtcttttgaaagcttctttaccatggaaatctgtcggtgttactcatgagtattgggatatagatcgttcaaaagttggagcgaattacaatacgagggtagctcggttagagactcttgtcgtgaatgatcccggagatggcgggagcaaagctgataaatttgaaagagatgagaggttgttgttacaaggaataaacgacccagaaacaacgccagatttgcatataagatatttattttatttagctcagacttattttcatttaagtcaatttgagaattcaattaaatggtataaaaaacgagtggaagcaggaggatgggttgaagaggtattctattcgttattgcgaataggattttgttatgagcagttagcaaatcgttcagcaaataaacaaaatgaagtgacagatgctgatgaaaaagaaactgttaaagggcaagaagagcaatatttagcattagctgttttttattttcaaaaagcttgggaatatagaccaacccgggctgaaccattataccaacttgcaaggttgtatcgattacgatctcaaaacaatattgctttgatgtatgctctgcaagggaaggaaattccttttccaaaggatgatctactatttgtagattatcatgtgtatgattacttatttgactatgaaatttctattagtgctttctatatacctcataaaaaacatttaggggcggtgtcgcaaaagtatttggaatcgataaaagaaaagattccatttcatatagcaaatatagtagagaataatgcgaaattttattaaatacattttcggttaaaggagtagtggagtaatcatggaattaatgagatgggcgattgaactaggagaatcggtgcatggaaatacgtatgaagaattgatgccactactagactattattatgatcgtgatcatttaaaagcgtattgtatcgcaaatcttcttttaaatatggatgtattagatgaggaccgggaaagaatcgaattaagaagatgcatcgctgcttattatgctggattatataaagtagcaagaaaacatgcaaatgagttggtacttaaacatccagatgtagatttatataaaaataatttaagattaatggaagtttatttgaataaagaatatgattattgtctttttatatgcccaaagacatacggtagtttcatagatgttgcgcgagctttaaagtggcggttggagcaggagggaaatacagtaattatatcagaaacaatactggaaaatgcaaagaatacagttgtttttggagcacatacatacgcatataacccgaatcttcttccgaaagatgcaattatttataatttagaacagctatacgaaggaagtccatatgcgcatcccctttatttaatattattaaaagatagagtgatttgggattatagtaaacaaaatatagaatggcttcaacaaaaaggggtaggaaaagaaataaaacatgtagaaatgaactatgctccaactttggaaataaaaaaagatgcgtttgaagatgagattattgaagatattgatattctgtttataggtgctcttaatccgaggcgacaagctatttttgatcatctaaaagcgattgccccgaatttaaatatagtttttaaaaataatgcgtggggaattgttagaaatgaattgattgctagagctaaaattatattaaatattcatttttacttatcaggaattcttgaaacacctcgcgtgtcttatgcagttgcgaataagaaaattattatttccgaaaatagtaatccagaagatgaggtagagtggccaggaattgtatttactccgtacgaaaaaataattgaaaacgtaatgaaatatatagaattaccagaagaacggaaaagattagcggaaaaagcatataatcattttgaagcaaatgaaagtttaggtacattgagcatgagagatgaatcaaagtaattgtacgaaactcatacgaaagtatgagttcttttttgtttatcatactattttatgaaacaagttaactctttatattgtgttttgtatagaaatttctgataatatataagtagaacttgaaaacaaaggggagaaataatcatgaaactagtcgttattaacggtacaccaagaaaatttggtagaactcgcgtggtggcaaaatatattgcggatcaatttgaaggggaattatatgatttagcaattgaggagttacctttatacaatggagaagagtcgcaacgtgatttagaggcagtaaaaaaattaaaaacgttagtgaaagctgcggatggggttgtattatgtacaccagaatatcattatgcgatga

SEQ ID NO: 1096 - DNA, 3343 bp, Bacillus thuringiensis
tttaggggataattcagaagtagtgattaatggttggatgaaggaattgagaaagaaagaaaaacaatttttagaaaatcacacagacataaatgaaataaattctgtgttaaggaataaatagaagacataagcaattttacattggaagaaggtacgagcatgcaacaatcaaaagaagaaagagtacatgacgtatttgaaaagatttctgataaatacgatgtgatgaattctgtaattagttttcaaagacataaagcgtggcgtaaagaaacgatgcgaattatggatgtacaaccaggcagtcaagcgcttgatgtatgctgtggaaccgcagattggacaattgcgctagctggagccgtaggtgaacaaggaaaggttgttggcttagacttcagtgaaaatatgttatctgtcggtaagcaaaaggtagaggcgttacaattaaaacaagtagaacttctacatgggaatgcaatggaacttccgtttgaagataatacgtttgattatgtgacgattgggtttggtttacgtaacgtaccggattatatgcacgtattaaaagaaatgacgcgtgtagtaaaaccaggtggaaaagtaatctgtttagaaacatctcaaccaacaatgattggttttcgacaagggtatattttatactttaaatatatcatgccgttatttggaaagatgtttgcgaaaagttataaagagtattcatggcttcaagaatctgctagtacgttcccagggatgaaagaattggctcaaatgtttgagcaagctggacttgaacgtgtgcaagtgaaaccatttacttttggggtagcagcgatgcatttaggtattaaaccagaatcaaaatagaaaaaagaagtttttaggttaaggtgaacaatatgaagttacaacttatgtactcttttttacgatcggatattaatgtgatagaaaaagaattaaaaaagacagtcgcttctgaacagccattagcagaagaggcagcattacagcttattgaagctggtgggaaacgaattcgccctgtatttgtgttgcttgcagggaaatttggagattataagttagatgcgattaaacatgttgctgtggcgttagaacttattcatatggcttgtcttgttcacgatgatgttattgatgctgcatttttacgacgcggcagtgcgactgtgaatgcgaaatggggagatcgtattgcgatgtatacaggggactatctgttcgctaagtctcttgaatgtataacaaatatcgaaattccagaggcgcatcaagcgttatcacatactattttagaagtctgtaaaggtgaaattgaacaaattaaagataaatacaattataaccaaaatttaagaacgtatttaagaagaataaagcgaaaaacagcattattaattgccgcgagttgtcaattgggagcgattgctgctggtgctaatcgtgatacggtaaatcgtctattttggtatgggtattttgtaggaatgtcttatcaaattattgatgacattttagacttcgtttctacagaagagaaacttggaaaacctgctggcggagatttactacaagggaatattacacttcctgctctatatgcgatggaagatcccgtacttcgtcagaaaatcacatctgtacatgaaaattcaacagcaagtgaaatacaagaaattattgatgctgtaaaaaatagtacagcaattgatcaagcatttgcatttagtgaacgttatttacataaagctttagaaataataaaaccactcccacgtggaaaagcaaagtacgcattacaaaatgttgcaaagtatattggaaaacgaaaattttaatgtttattctaaaaaataaaataatctctctatttcaaaactattgcacaattgtgataagggtgataatatgtgtgtggggatatacaattacatacataattcagaagtggagagattttttatggaaaaaacatttctaatggtaaaaccagacggtgtacaacgtgccttcattggggaaattgtagctcgttttgagaaaaaaggctttcaattagttggtgcaaaattaatgcaagtcactccggaaattgctggacaacactacgctgagcataaggaaaaacctttctttggtgagttagtagactttattacatctggacctgtgttcgcaatggtatggcaaggtgaaggtgtagtagatacagcgcgtaacatgatggggaaaacaagaccacatgaagcagctcctggaacaattcgtggagatttcggtgtaactgttgcgaaaaacattatccatggttctgattctttagaaagcgcagagcgcgagattgctattttctttaaagaagaagaattagttgactactcaaaattaatgaatgaatggatttactaattattttgaaataatttgtaaacgctttaatcactgtgataatagtaaaaagtgcaaggagaataggggtattcttcttgcacttttttattttcagttagttacgaagtttgagctgttatgatatgttgatatttaaattaggcctatcggaaatatagaataagaaaatggtcgatttatgatataatttctttaatatttttagaatgataaaagttaatatagtgagataaatacatatacgaaaagaggaataacgtatgcgatatattacagctggtgaatctcatggtccacaacttacaacgattatagaaggtgttccggcaggattgtctttagtagcagatgatataaacgaagagttagctagaaggcaaaagggatatgggcgcggtagacgcatgcaaatagaaacggatcaagtgcaaattttaagtggtgttagacatggagaaacattaggttcccctattgcacttgttgttgaaaatcgtgattttgcacactggacaaaaattatgggggcggagcctttaactgagcaagaagaaaaagagatgaaaaggaaagtgacaaaaccaaggcctgggcatgctgatttaaatggtgcgattaaatatggtcatagagatatgaggaatgtactggaacgttcgtcagcgcgcgaaacgacggtgcgtgttgctgctggtgcggttgctaaaaaggtgttagcagaacttggtattaaagtggcgggccatgtaattgaaattggcggtgtacaagctaaggagattacgtatagttcaattgaagaattaaagagtattacagaagcatatcctgtacgttgcttagatgaagaagctggtaaccaaatgatgaaagcgattgatgatgcgaaagcaaatgg

SEQ ID NO: 1097 - DNA, 3517 bp, Bacillus thuringiensis
aatacagcttcatcagaaaatgtgctagaacataaaggagaagaattagcatttgtcttagatgggaaaatcacattatatttaaacgaggaagaatacgtattagaatctggcgtcagtgtaaagatacctgcttatttaaagcataaatgggtgaatcattttgagaaaaatgcgatagtcggattttctgtaactcagccgatattttaatatatgtaataaaaaatagccatgtacggggaatatccgttaatggctattttttattttttcggcaccaacaaaatccctaaactaataatacaaaagctcattatttgctgtgctgatagaccaaactgtaccgaattttgttcactaacaagcgaaataatgatttgagcaaacccctcaacaattagaaaaatacttatattctttccatttccgatcctttcatttttcatccataacaagcccattatacaaaggttgaggataatctcatatacaaaaataggatgatacaaaaatttagattcgtatatattcattccccatggtagtgtcgtttgtacacctacttcatgatgtaatagaaaataaaagataatacttacacacagaccaaaaggcaatgcatcaagtaaaatacgaagcgaaaattgttcctttttacttttccaaacaatgtatacactagcaattacgcatcctactacaatatgttgcatacttcctatagctaataatgcttgcaatggcgatttaaaagcccatacaggatttaaaattgctggtgcaaacttccatacaaatacgatgataataaacgcatttgttacggcatccatcattttttcatatgatgcattttgatgcctcatctttcgttcatcaacataaatccaaatagacttccaattataagagatacgggttgtaatctcacgatccactccatcatcacgaaatccccttttagctctcaatcaatttttaaatttcttttctaattgatctggtggtaatacacctcgtacatgatctactataattccatccttattaacaaaaaatgtcgtcggtaaagagaatactttataatctagtccagctactccgtccatatctagtagaaccggaaactcaaatccatagcgattagcaaatgcgcttgcttcttgtactgggtcactaacagttgcattcaccgcaaaaatttcaacatcctttttatatttatcatacatatgaactaagtcaggtgcctccatttcacacggcccacaccatgatgcccaaaaattaataatatatggttttcccttggcatcatttaacgactgcaactttccgtctaatccttttaatgtgatgccaggtgctttaaaacctacttgtggtaatacttctttctcttgtaactctgcttgctttgcttttctttccttttcttctttctttgaattataaaagttaacccccgcccaagcgagagcacctactagtataatagcaattagtttcttcacttttcttcctcctcatttttaaaaacctgtaaatccaccgaatagacgaataaagaatgctgtaattttcgtcatttgatttgtatacaataaaatacctgtaatatatgataaataagatatatatagcgataaaaagtataatgatataaatgacaacactctatccacactacatagagtagtgtttaccctaaaaaaaagaggctatatgcactctccgacaataagtacaatcgacacccagaataaccctactgttacatataccgagttcgtatgtaacggaatagtaagcttagcaaccttttcatttaacacttgctcgattcgtaaatttattgctgtttttgcaaatgaagctgtaacacatcgattttccattgtctttattttaattaattttaataacgcgctacctaactcaaatgaagattccattttttgcatcgcatatttatctgctgctaactcttgatacgtatgatatcgttgtaacaattcttttaatatcgggatgtacatcattccttctgctaataacgtaaaacaaaataattttagcggatcccaattattttgatgatattcttcatggaaaataatcgcatcaatctcttcatctgaaaacgtctgaagcaaaccttccgacatgacaactttcggacggaataatccaattgtaaacgctgcaacttccgcagtcggcagtatatatatttgtttcccttttctaataaatgggataagtactttttgtacttttttactatagaaaaattgccgccaaattcttttacacacaatcaatacagtaattaataataaccccgctattataatacgaaccattgatagttctttcatatgtttttctaactgaaacaagcaaaactttgaaaggaagaatgccttattttgaaagagaaatggatatgtaacataatacaataacaagctgaaaaagagggtactaacaatgagcgctaacaatacgattttacgcatttgccatttcatttcatcgatcctctttttttaactgattcaatttgtcttctaatttttttattaaattcggatcagcctgctctaactcatctatcatatgtgttataactaaatctccaaattcccccactaattcctgtgtcattttcttcgtttgattggataagaattcttctttcgtttgtatagcacgatatatgccacttcttttcacagtctgtttttctaagtgtaatttctctactaacctgttcataactgtcataacagtattaaaattcacaggcgattcttcacttaatttctgctggacttctttaatagtaataccttcagtagaccaaataatctccataatcttcgcttcaagcggtccaaagaaatgatttaatccttgctcatttaacctatagttttgcgtaaacatcgtatgactcctttcacactacgaattgtagtacaaattaaatgagaggtcaaacgcaagtaatacaaactaaaattcactacctataaatacgtacatcattctattcattataagcctaacttatctccaaatgtatcaaagagatactgctctaatatttgtacactaaacttttcattacgtccaagtgcaaataattcccgatctttcgctacgatagtatctaacggaataactacattatccactatttttgtaatttcaattatattactttttacatttacttctgttttaaattcaacgttttctaacactatatgtgaacgtcttcctgatgcaaaaaaagtaaaattaggatttttaacaacgccaatttcagtctctaacgcatataaatagtgaaaaattacatctctatgtccatcttttattattttttcatccttctcatcgtctaagtattctttcagcttcgttgtaaattcaaatcgaaaatccacttttttcacgctccttctttgtatttcatattaaacaaatatattgaaataatttt

SEQ ID NO: 1098 - DNA, 4545 bp, Bacillus thuringiensis
aatgagttgtcttttttctcaataaccgaaactatttaacatggtaaaataataattggactggcatccaataccatattacaatggagcaaatcgcaagaaggcaccttagagtgtcttttttgtacataaaaaaatcttaccatcttatagaaacgataagcccttttaaaacaataattgcaactatattaactttacattacattaaggttagagaatgttcttatattaataaagtgctaaatagtaggtgaaaaaatggaatttaacgatttgggtattaccattaaagaacttagaattaaaaaaaatatatcacaatccgacttatgtcacggaatatgttcacaaagtcaaattagtaagatcgaaaaaggtatgatttatccatctagcatattgttatatcaattatcagaaagactcggtgttgatccaaatagtatatttgcactaactcaaaacaagaaattaaaatatacagaaaacgtaaaatacgtaatgagggattgcataaggcaacatcaatataaagagctttatgaaatagtaacaagagaaaaatacacaaataattttcaaacaaaagaagataaacaatttctaatatggcatgaagcaattgctatatattgtgtgaataactcaacaaaagtggctttaactcttttaaataatgcactaaaactaactgtaaccaatattgattttttatcagagagagaaatagatattctacatacaatggctatacttcatgcagaaaataaagaatacaaaaaaagtattactatccttaaaagatgtttaaataattttaacaaattagattttcctagagataaagaaattaaattgaaaatcatttataatttagcaaaaaatttaagttacacatatcaatacgaagaagcaataaaatacattgataagggtatccaattagctattaatctaaatactttttacttattgggtgaactatactatggaaaaggttcaaatttattaaagcttaaacaatataatgaagaagatgttgctaataacatgagaaaatcattatttatatttgaattaacaaaaaacgaaaaaaaattacaaataattaaagaagaatatttcgaaaacaaaaataaccactcataatttcttaaaaactacttataaaactcacaggaaaaatcccaatagtttttaaacttagaaccatattattgttttaattcagaggaaggcaccttagggtgtctttttttattttcaaaaggacctgctcaattaattcttaaaaacatactaagaaacattgttttatttatcccattttcattcatgctatataaaattcgttaataaatccacctcaaacatatttatatgcattggagtatgtttgaggtggaactccttcaaatactagttccttttataagccgtttttttgatgtagatgacattattctcaatacaatagaatgaattatgggaacatacttagcaatatatatcaaaaaacaatattaagaaaacccctccaccttaaggtagaagggatcttctaatttctatttcaaactacctaaaatttccgtaaagataacccaaagcgtatgtgcacctgcatctggatatcctaaacttttttcaccaactaccgctcctctgccgaatgatctttcaccgatagattgtatgccgtgaagtgctacttgtaacatttcaattcagatatacgacaggaaagaatacatcatcacagtgtcagcaagcaaaagtgtattctgcatttctgaaaacagtagatggcagattgtgacctactgaatctgctaagaaagaatatacaagaacatccttaacatcctctttatttccactaatgatgacatcaaggaaatcttctacttgaaattctggagtaaacaacacaatcttagttgttctgtttggttctaaagaaacaaaagtacgagagatttcaactaattcattttgagttgggaaaaaggtgtttcgacttctcttaacagttaccgttacattactagtatggcagcgtgaatcattgtttaacataatgttgagagcagttggaataatcccattttcagaaactggaactcgaaacactccagtagatttatgagccatataatcagatccttccaaaataaaatatatttacaatatattagatgcaaaaaacgttcattttgatatggacaaattatatgattaatatatctataataaccctcggtattactaagccaatgttttaaaagattaacaaataattacctctgcaaatttagaaaatatctacactttttacaaacattattacaattagataaactaaagcaatatctcattaacaaagggactccataattggagtccctttgttaatgagatattaaaaatgatcagcatgtgaatattgtataatttcttccttttttagagcatgttgtgtatcacctgtattgttactaaatgataatactatcactaatcctaacgtcgctaatataagcttcttcattattttaacgcccctttgcttagtagtttttgtttcgcttcgtaacatacatcgaaataatcactaactttttcatgcttattcaatttgctgcgacaacatcatttgataaaaatcattaagttgttgcataactgcttcatacattaaaatatttgtgctcatatcactacgtcctcctcaactacttctatttacctaaaaattatcataattctgtaaattatataatagttcaacctctaattgtaaatcgataaaaaacaacagaatattccgaatcaagagaagggattggctaacaaatggttactgtataaaaataaaaaacttgtgatattgcttttatcatatttgctcttatatatggttctgttacaaagtttgctaagttaatataaactctagaaaaaatgaataaagatcaccacagctgagctatctttaatccgtataataatataaacattctattaattcatattattaataaggaaatacttaaatattcgatttttttctaaaagtgtattatactgtaaattgctgagggatacattttagtattttctggtaaatattcagtttgttaggttgttattagtattatggtaacgaaaaacttatattttcccttgaagataaagcattagcagcaattacatccagatatcataataataattattttcttaacaatatcacggaattttaattcagaaaattcgaacccttaagtaatataaagtgctaaataaaatatttagacaattgaagtccaacaacgattagaagatatatatattagaaaaggaattttgggagagcttatcctatataactaatacatatagcgttgtatctttaaatcaataaatttttcgataagctagttaatagattattgaatttaatcttttaatagagttaaaaaaatcaactttacattctaatttagaaattattaggtggtgtcggtagtgtttgagtatcttttagttaaagctttatttactattttcttaattagcctaatcgtgttaatcagtttaatatggactaaaatagaaaaaattctggacgagactgtatttaaaaacgtttctgaaaaatccagatatgtagtaactatggtaattgttatggtaggagaatttgttctcatagtcattacttcattaaattggagagcttcaattattgacacactcttttttggtagtattattttattctgctgtatatggctaataccttattttgttaatcaacaacaaaacgtcgctaaagttatggataagcattttagtggaggggtagatttaggtgaaattcaagttcatcgtgcgaaactttctgcatttaatttagaaagtattgtattttctatagtgggcattattatacctatttgttattattttaaatactttttatatctgtttattggttctgttggaaattttttaaagatatagtaataggtgagattacagatatttatgtacaaacaacttagatgtataagacaatccatgtgagcgaaaacagtaaaataccctataaggtctcttttacttgtattaattaaaaaatgatactaattataaatgctaacttaaatatgtacattaacgcttgaataaatatgtacattttcaattggattctccatactgactctgaggtggttagtatgtatattaagctagatattcaaacagaatttgaggttaaaagtctttcagacttaccaaattttaaaaaactaatggggaacttaaaaatgaagataaataaaagtcaattagccagagaattgaatgtggatcggcgtaccatagataagtatttgaatggttttacaccaaaagggacaaaaaataaaacatcgaaaatcgatacatattatgaagtgattgcagctcttttatctagtgattctaacaaatcttctactacaacgagtgttatgcagtatttacagacat

SEQ ID NO: 1099 - DNA, 3367 bp, Bacillus thuringiensis
aaaacatcttctttataaaacttaaattgttttcctgttatttcttttactcgatttatagattctaccgagctattcgaaagattatccactactataacttcgtaaccgctatttagtaattctacacatgtatgactaccaatatatcctgctccacctgttacaagtattgccataattatagtcctccatatttcattcattataaacttctcaaagtatatcacatatttcttatcctatgtttaacatgcgaacacagaaacttacattttatcccataataattttataacatatacgattctaatcaggtaataaaaaaatgccacataataaaaattatgtgacgtttttttattaaattacgtaacaatatacacttagaaaatgcgcaagactacctaataatacaaaaacatgaaaaatttcatgatgccccatatatttaaactctaaccattttggctttgttccataaataaatccaccaattgtataaaaaatgcccccaagtactaagaaaataatgcctcctgtacttaaattctcagctaacggtgcaaagaataaaacaattaaccaacccatcgtaatataaattgctgtcgataaccaccttggacaactaaaccaaaacatcttaaatacaatgccacaaatcgcagttgcatagactaaacaaaataatagcaaaccacttgctgaatttaatgtaattaagcaaaagggtgcatatgtacctgcaattaatataaaaatcatagaatgatctagcttcctaaagaagtatataacacgttcatttgccacaacactatgatatacagctgacgccgtataaaggaccatcattccaataccaaacaaaataacagctgtaattgcagcaaatgatggcatcttgatagaaactttcacaagcatagctaataacgcaataaatgataatatcgctccacctaagtgagtaaatgcattaactggttcccttacataagtattcataataacacccctcatataattacatgtagttttgataactacatgtaattatatacacatttctttttaaggtcaacatttacaattcatttgtttcgtaataccatatttaaagatatattaaacattaagttccactaagttataaaagtgagggattctacgtggaaaatataaatgaattacttaagacattacatttagaaaaaaacattaaacttgaggatattccaaatgttgacttatatgtagaccaagttgtccaactatttgagaatacttatgcagatacaacgagaactgatgatgaaaaagtattaacaaaaacgatgattaataattacgcaaaagggaaactattcatccctatcaaaaataaaaagtattcaaaagagcatatgattttaattagcctaatttatcaattaaagggagctctctccattaacgacataaaaagttcattagaaactataaatgactccttattaaatgatgattcattcgaattaaatacgttatacaaaaattatcttgctcttactgaaagcaatgtcgaaagctttaaacaagacgtaaataaccgtgttacagaagtaaatgagatttcttccttagaagatacaaagctagaaaaatttctactactaacatccttcgtgactatgagtaatatgtatagacgtttagcggagcaactagtggatgatttaaaagaatcataaataaaaaactatccacctattaaagtggatagttttttatttacttaattgcttcatgaacttttagttgtttccctttaatcgttgtagtcttcatgactttcaagataagtggtccttttccatttaatatttcaacgtaagaaacattatcttgtatcgtaataatacctatatcttctgctgtaacacctttaattttagcaattgtaccgacgaaatctaccgccctaattttctttttcttcccgccattaaagtacagcttcataatgcctttgttgatatctgcatttttatctttctttataattggtttagcatgtatcttttcttcaaatgcagctttctctttcataacttcttcttttgaaggtccaattgcctttggaatttcaaatccaatatactcctcaatctcttctaaaaatctattttcatatggtgttataaatgtaatagcttttccactatttccagctcgtcccgttcttccagtacgatgtacatagctttctttttcaagtggaatatcataattaataacatgtgtaatattatcaatatcaattcctctcgcagctacatctgtggctactaaataacggaattttccttttctaaaatcatccatgacttcaaaacgatcttcttgtaccataccaccatgtattttatcacaaggatagttagctcgttttaattgtctatatacatgatctacattttcttgtgtacgacagaaaataatacagctatcaggattctcaatcgttgttacatctttaagtagtgaaagcttctcgtcttctatcacctcaaaaagagtatgttcaattttatccgtcgtaatcccagctgctttaatttcaatatgaattggtgaattcatatatgtacgagacaatttctcaacatcttctggaagtgttgctgaaaataacatcgtcattctttttgtaggtaattcatcaataattgcctctacttgatcgataaagcccatatttagcatctcatctgcttcatcaataactaaatacttcaaacactctaaagaaagggtacccttctcaatatgatccaacacacgaccaggagtaccaactacaatatgtgtcttttgctttaattctaatttttgacgtgcaaatggagatttcccataaactgccgcagcctcatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttatattcgcttagttctcttttgtgcttttgcaacagaagttggcgcatcctaaacatcgtggaagacatataaaaatggcaatgagttttccatacacatggcattcta

SEQ ID NO: 1100 - DNA, 5551 bp, Bacillus thuringiensis
atatcttttatgtttaatttgttattttctgataaaggggatataagtatctttataatgagtaacctagaacaacaatgtattattgtatttttttactaactaattcagctttaagcgataaaaacaatggctacatgctaactgtaaaatattatccatataaaattattgcactttaatatttctgaaaatataaaaatattaattttataaatatacacgttataatgagggcgtcgagagaaattttattatctctggagaaaatataaaaaatgcgattactagtaagaaaggtgtgtgattagaggcgaaatgtatgtaatgtgcttcagtggcttgtgtaagcagtatcatcagtgctaccgaagttatgaaggtaatgtatagaattgagaaagaaatgcctcgcaaatgaagagaggccggtttatctaaaattactgttaaaagtaaaaaagagaaaccattaaagtaatacactgttattagaaatgttgcaacgtatttatgaagtctattctatattgttctcttaagaggtctttatataaagagcggatattacgagtaaacttttttgtgaacgctaacaattatattaggacgctaactagcgaatgtttcaatttggattcattatgatgaaggacatacaaagtggggcaacttgtaaggaattcattttccgaaaagggaatatttgttaggtgtaaagagagatgcaggaatagatacaagggggagttattatatgaacgggaatactgcaaagaaaatagaagttcaagctgaaaataccgcacgaaaaaatgagcaatatgcagatccgaaaaagtggcataagcaggatactacatgggcactcagtctatttggaactgcaattggagcaggggtgctctttttaccgattaatgcaggttcaggtggtttattatctttactactaattacattacttgcatatccagttatgtattactcacatagggcgcttgctaaaatgatatacgcttctaattctgctgatgaggggatcacaggtacaattagagagtatttcggaaataaagcgagtatcatttttaacatcgtatatttcggttcaatttatacaatcgtactaatgtattcggttgcgcttacaaacactgcaagtagttttatcgtgcatcaattgcacatgccagaacctccaagagctattttatcacttgtattagttcttggtcttatcgctatactgaattttggtcaagatattactgtaaaggtaatgagtatgttagtgtatcctttcatagtttctttactttttatcgcaatatctttaattccacagtggaatacgtcaatgcttagtttttcagctgtttcaactgcttcaacaggaacaggctattttggaacgatattgatgattctaccaatcatcgtattctcatttaatcattcacctatgatttcatcatttgttgtgaaacagagagctacgtatggaatcgaagccactgatgctaaatgtgcgcaaatacaaaaggtttgttatatcatgacattcgctgttgttatgttcttcgtttggagtagcgcattgagcttgactccagatgatataaaaatggcaaaagaacaaaacttatcaattctttcatatcttgctaatgagcttaattcgcctgtaatcactattgcagctccaattattgcttttgtggctattacaaagtctttccttggccattatatcggagcatttgaagtaatgcgtgacatgattattaagttcggtaaatcacgtggaaaagatattgaagaaaaaacaattaagacagtaatccttacttttgttgtattatcatgctggtttgttgcttatacaaatccaagtattcttggacttattgattctctaagcggtccattagttgctgctatcttatgtctattaccgatgtatgcgattcaaaaagttccagtactagctaaatacaaagggaaaatgagtaacgtatttgttattattgtaggtgtacttactgtcttagcaagtattaagtcattattctaattcacgattgttagttctagtgcaaaataaaataaagcgattttgggacaggcttctccatttggagagtttgtccctttttaaatgagtgacaaaaggtcatcttttccatagtctcttttcgtacataaggttgctttattgagtgtaattttttgatgattatgaacaagcattcctttggttaaatgaatatcccatatgaaacttttagcgaaccggttgctcaatcaactgttttttatgtttgtaagtagtattcggaagaaaacttctatacgaaatgtttagcactagaggacatacatttttaatgagttaaatataattcataatagcaccaagaagaaatgaatacgctttacggtattagttatatggaaagaccgcacgataggattgcataattttaaaagtagcaatctggcataaagtgagtaagggggacaaagatatgagtacttcaaatttgaatgaaataagtaaacaaattttaaaagaggaggaaacacttcaattttcctcttttacaaatgaagatgccttgcaactaggtttatttatcgttgaaacagcaaagcaagaggggaaattgattgctgttgatataacgaaaaatggtgtgcaattatttcatttcaagatgacagggacaaatgaggaaaatacgaaatggattgagcgtaaaaaacgagtcgtttccctgcatgatcgtagctcgtattatatgcagatacaaagtgaaataactggggtctcctataatgaaaaatatcttttagatacttcagaatacgctgcgtttggtggatgttttcctatcagaataaaaaacgtaggggttattggaatgataacagtttcaggattaccaccagaagaagatcacgaattggtaataagggcagttaaaaatcatttgaagcaatagtaaaaataaatgtgatggttaagtaaaagccaagaatgaacatattattgttcgtttttggctttttattattttttcttatagtcggctaagagggttcttttacaggtagcacttaattttgcaatgttctttaaattgcatcgttttgttcgagtgagcgaaattgctgtaattgaagatgctctaaattaatgtgaaatttggtgattaaagtagctacatttcatatttgtgtaaatatgaaacaagcaggatacatgaatagagaatgggtaaaatagtaccgaatgatgattagattttatgaatgatgttataaggctttttttaggaaaactgaaggaagcagtgtgtttagatttagaatgactggcaatgggtgctaggaagttcaatgattcaaaaatgaactcatttaaacgcatactatcttcgagatgtatcattttgaagaatattaaaacttaggaggaacggaattatgacaaaagatttctatactgcactgaaagaaagacgtacttactatgggattaataaagaggtacaagtatcggatgaaaaaattaaagaaatcgtggagtttgctgtgaaatatactccatccgctttcaattctcaaactgcacgattagttgtattatttggtgaagctcatgataaattatgggatattaccactgaaacattaagaaaagtagttggagatggagacttttcaggaacgcaacaaaaaatggattcttttaaagctggttatggaacagtattattctttgaagatgaggctatcgttaaatcgcttcaagaaaagtttgctgcatatgctgaaaacttcccaatttggtcacaccaagcatcaggtatgcaccaattagtcgtgtggacaggtttagaagcagagggattaggggcatcattacaacattataatccattaattgacgatgaggtaaaacaagaatggaaagtccctgctaattggaaactaattgcacaaatgccatttggtaatccaacagctgcaccaggtgaaaaagaattccaaccacttgaagagcgtgtgaaatttcataagtaatattcgaatgtaataaaatagaaatttaatcagtggtggtcttactgtccgcaaatagcaggggaagctaactgtattgtaaaaataaaactgtttattaataaaaaagcttattcgttttttttattaatcgagtatgtatgaataaaagattttaaaacactattttaatctgtaagggaacaaggtgatcgttttgatcaccttgctttatttcttacattttatttattaaaaaacgctagcatttcataaatgcttgaaaaattagcgttttaataataggtatctgtaatttgattacttaaaactatatacgaaaaagcttttatgttattcctcaagttctatccattcctgtgaccattcttctattccgcgaataatagcttctaaagcaaatcctttttgagttaaagaatattctatacgaactggtgtctcaggaaagactttacgttcgacaattccttctagttctaattctttcaatctttctgaaagtaatcttccgctaacaggaagagaagattcaagtgtacaaaagcgctgagatccagaaaaaagttggtaaataattagtgctgtccatcgttgactaaaaaatttcattcctttttcaaagcgagggcataatgtagaatcattcattttccttcacctcctaaaataaattatataacatcttactattagtaacaaatgtttttataattaattacttgacgtaaattgattacgaatgtatactcacttacataaagtaactaagttgttttatgtaactaaaactctttctttaaatggccaaagttgtaatgatacatattgcatataagctgagagaaaaaagaatagcatctgtaaaaacacttacgttgtgtaagttaaacaataaaaaatataacaatggaagagaattttagagattctctatactaggaggtacctaatggttacaacagatacaattcatatgttagaagataaaattcaatttatacatcaagatggaaaggatatttatttagtaggtcctatcaaattgccaattaatttatatggggagactaaagtttttcaatggtattcttggttacaatgtagtgaggttacaaatagtgtagaaggaattatcgaaaaactctcatctattaatttagctgatatgcagcaatctagtgtacttgtatatggtgattttgagaattctgaagatgccctaattcgtatgcatagtatttgtcacaccggtgatatctttggtagtaaacgttgtgactgtggattccaattaaagcagtctttacaaatgattacagaacatggttcaggtgctttattttacttagcgaatcatgaaggaagaggaattggcttgtttagtaaagctatgacgtacctcttgcaagaaaatgggttagaaaaagtagaagctaatctgaacctaggttttaag

SEQ ID NO: 1101 - DNA, 5074 bp, Bacillus thuringiensis
acgtcagcatacgtcatacgctctgtcgttttaatcacactttggaaaatctcgtgtttaacaacatcacctaagttgttgatttccatttcacaagataacgtcagacggtctactttcggatttaatgaacaaataccgttagatagacgatgcggaatcatcgggattacacggtcaacaagatatacactcgtcgctctttccgctgcttcaacatcaattggagagccttcttgaacgtaatgacttacatccgcaatgtgaacgcctagcttgtagttaccgttctcaagcttcgttactgtaacagcatcatctaagtctttcgcatctgcaccatcaatcgttacgatcatttgatcgcgcaggtcgcggcgatcttttaaatcttcttctgaaatcgtttctggtacactgtttgcatgctccatcacttcctcagggaatgctaaaggtaaatgatgtttatgaatgacagataaaatatctactcctggatcatttttatgacctagaatttgaataacttcaccttctgcacttaaacgattctctggatagctcgtaattttcacaactactttatgaccttctacagcacccatcgatgcgcttttcaagataaagatatcactcgtccagcgcttattgtcaggtataacgaatccaaagtttttcgattctgtatatgtaccaactagttctttcgttccacgctctaaaatgcgtacaattgaaccttcttaacgcgaaccgctcgattgagaactaaggcgtgctaatactgtatcgccatgaagtgcaccgtttaattctgtaggcgggatgaaaagatcatcgtctcccgttttcttctcgtctggtacaacgaatgcaaaaccacgtgcatgtccaattaacttacctcttactaaattcatcttttcaggaagaccgtaacggttgctacgagtacgaataacaagtcccttttcttccatcgttacaagtgcctttacgaaatctttaaagccctcagaaccttcaatcccaaatgcctcttctaactcttgtatcgttagcggtttatacgcttcttctctcataaataataacaacttatcaatatgttcttgtatgatttcttccaagcaaaaatacctcctttaaaaccttatattatttagtgtatccgaaagataggggatgtataaactgaaactgcatatctccccttatgatttttacagttttcacaaaaaattccttatgaaaaaaagaggcaactagatcttaccaatctagttgctccaagaagttatatacatcctcatgtagctcgtcacgttgtttatcaagtgtaatgacatgcgtagagtcttcataccatttaatgtcttttaacgtagattctacaccgttataaataatgttagcactatctgtattaatcatttcgtcatgacgtgcttgtacaacaaatgttggcgcataaatcatatccacattgttacgtacgtcagcaattaattgttgtaatgcttttaatgtattcatcggtgtcttttggaattccaacatttcttgttcaatttgttcaggtgatttttgctcacgttttttatattcgcgggcatatgccaatataccttggtacatcgtttcttcgctcttaatatacatcggtgcacacattggtactacacctaaaaccggtactgtataacctaattttaaagaaaatacgccgccaagtgacaatccaacaacagcaattttctcaaaacctttatcttttaaaagctgatatgcctccgttacatcttgccaccaatcttcaggccctgtatgaacaagctcttctggtggtacaccgtgccctttataaattggcgcatgacaagtatagcctttcttttctaagaaacgccctaacatacgtacatcagctgagttccctgtgaatccatgtagtaataaaacagcgcggtctccaccctcaaatgtaaatggtttcggagatgctaatttcatcatgtatttctcctctttctcttctgtaatctagtcgtattctttctatatctagtgtaccatatttgtatttctataatctaattagaaacatctttcaaatagcaaaacaaaaaaagaagaaccattagtaccattcactaacgcttcttctttcaattctataaattgaagtacgtaacaccaattgttaatacaaagaacaatacagctaaaacaattgtaatacggtttaataccgcttcaattccacgtgccttttgcttaccaaataattgctccgcaccgcctgaaattgcacctgaaaggcctgagctattactagattgcataagtaccataacaatcattaaaatcgatacaataataagtaaaactgataataacgtatgcacttggcgtacctcctacaaagattcagttattgtaactgtagcataaattctatagaaaagcgagagctatagaggcgctctcgcttttcttctattacataaacatcatcgcaaataacggtccaagtaaacatgtcaaaattgctgttaatgtcattgttaccgatccaataacaccttcatgttcgttatttttcatcgctctcataacacccataatatgagaagcacatccaaatccgatacctttaccaactgagtttgtaacacggctccattttaataaaagaggtcctgtaatcgttccagtaatacctgcgataacaacgaaagctgctgttaaggaaggtacaccaccgacttgctcagaaacactcatcgcaactggcattgtcaccgattttggtaatgacgataagattaagcttttatccgttcccataagtgaagcaatcgcaaaatcactagcgattgcaactgttgtacctactaataccccgccagcaatcggtacaacatatttttgcagaacatgacgttgtttataaagaggaattgcaaatgctacaacaccgggtccaagtagctttgcaatccagccaccaccactttccatataatgttgatatggtatatcaagcacgataaataggaaagccattaatccagttgctacaagcattggaatggtgaatggtgttggaaataatttatagatttttttagataattgatataatagcaccgtaaaaagaacccaaccgattccgattaatatttggctcatcgcgactctctttccttcctattcgcaagatattgtcctgtatgtcctgcgacaataataattaaaaatgtactcgctacaactgtaatgaaaagagaaattcctttactcataaaaaaagcaccgtaattcattaggccaagcgttggcggaattaataaaaacggcataatagcaacgagtgtttctgctcctaaatcgaaccatttcactggaagaacttttaggctaagtaaaacaagtaagaggaacattccaatcaaacttcctggaatcggaatatttaacatttcttgcacccaagttccaaccatataaaacacgtaaagagcagcaatttggacaagaatctttgtaaatttcatgttcatcatccctcatgtttatacgatcttctgttaatatctttatcatagtataaattgtaaaaagctgcaatttatcaacttgacagcaaaaacagcctatgttatacgcttacaaccttgatatgactgcatttctaaacgaaaattacgtcaaaaaccttgacctaatataaaaagtttttattttctgaatttaaaagactattatttcaataaaataatctttttatccttaaacttacatatatataaagtgaaactttaatcattgaggttttcctcatccccattaattattagccctcaccaagcggatttgtaccggataaacaagataggtggtgaacatatgcccaaaaaagttctcattttttgtgatcctgggattgatgatacgatggctctcctcttagcattctttatcgatgaaatagaaatcgtcggtatcgttgctgattacggcaatgttccaaaaaaaacggccgtagaaaatgctcatttttttaataacgaaacaaagaatagaaatatcaagatattcggtggttcagaacgtccccttactggtgcctcacctgcgttttttacggatgtacatgggaaacaggggctcggtccaattattccaaaggtgaatgtgactaacggagaaatggagaatttttttgaagtcattcctcttattgaacagtataaagatgaattaatcattgtgagtttaggaagacttacctccctagcaattttgtttatcatgtgcaaacagttaatgaaacaaattaaatcttactacgtaatgggcggtgcctttttacatcctggtaatgttacccctatttccgaagcaaacttttatggcgatcctactgctgctaatatagtccttcaatccgcagttaacatgtacatatacccattaaacgtcactcaatactccatcattacaccagaaatggcagaatacattgaggcaaaaggaaaagctccacttgtcaaaccgttatttgatcattattactacggatattataaagacgccctaccacatttaaaggggagccccttccatgacacaatgccaatactcgctttatttgataactctatgttcacgtatcataaatcacctattgttgtcatgacagaatcctctgcacaaggagcaagcataggggaatttcgttctctagtgaaccagaagccatttattgattggccggttcatcaaatcgcaattgattttgactataaccgcttcttcaaacatttcatgtcacttatgacgggtgaacaattttagcataaaaaaacagaccgtgatttctcacggtctgtcgtttatttcctacaattatcgtttgatgttatagaaagatttgataccatcgtaaacagcgatttcgcctaattcgttgttcatgcttaatagttggtggaacttagcaatacggttagtacggctcatataaccagatttgatttggccagagctagttgcaactgcgatg

SEQ ID NO: 1102 - DNA, 3795 bp, Bacillus thuringiensis
aactttatctaattcgcttgttgcaaatttcagcgtcttttaatgcacgacgagttggctctaatgttctttcaacaagacctgctgaaagctcttcgaatttcgctcttgttaacgttaattctaagtgtaatggaccagcagctccagcactaatgaatggtaatgaaatttgagtttgtgttacaccagaaagatcttttttcgctttttcagctgcatctttcaagcgttgaagcgccattttatcttggcttaaatcaatgttattttcttttttgaactcagctactaagtgatcgatgataacttggtcaaagtcatcgccaccaagacggttgtcaccagcagttgaaataacttcgaatgtgccgtctgctaactcaaggatagatacgtcaaatgtaccgccacctaagtcatatactaagattttttgttcttcgtcttgtttttctaaaccgtaagcaagtgctgctgctgttggctcgttaatgatacgctcaacttctaaaccagcaatacgaccagcatctttcgttgcttgacgctctgcatcgttgaagtatgcaggtactgtaataacagctttcgttactgtttcacctaagtatgcttcagcagaagcttttaagttttgtaaaatgattgcagaaatttcttgaggtgtataatctttaccttcaacttctactttgtagtctgtacccatatgacgtttaacagacatgattgtatttgggtttgtaattgcttggcgctttgcaacttccccaacttgacgttcttcatttttgaaagctacaacagaaggtgttgtacggcttccttctggatttgggataacctttggttctccaccttccataacagctacacaagagtttgttgtacctaagtcaataccgataattttactcatggcgaatcctcctagttttatgtaaattattgatttacttttaccattgatgggcgaatcacacggtcttttagtttataacctttttggaattcttccacaaccgcgtttgattcaaattcactatcttccacttgcataatagcttggtgttcattaggatcaaactgtttaccaacagcttcaatcacttccacaccttctttagtcagcgcttctaacaattgacgatgcaccatttccataccttgtaacaaggatttcgtttgctcatcagtcgcttccacttgcattgctctttcaaaattatcaagagctggcaagatgtctgaaactagactttgtgctctatatttttcagcagcctgtttatccatttggacacggcgcttataattttcaaaatcagcttgtagacgtaatgtgcgaccttccgtttccgttagtttcgcttgtagctcatctactttttcttgtaaaagagcagcctcacttttttcttctacagtttcttcactgttttctggtgtgacagcttcttcaacttgcgcttcttttacttcttctaccacttgttcgttacgctcttccacaatattcacctccttaaaaggtattaggtatcatgcatagcatgattacctaagcattatatattacacacagcaatgaaaatttcatcacttgagcgaatgtattactctcatttactttttaagtccatcagtaaattgtctcgtaaataactgtaacaaactaattacacgagaatattgcattctcgtaggacctaaaatagcaattgttccaagttgctcttcgccgatcgaatatgttgcagaaattaaactacaatcctccatagccgtcgaagagttttccctaccaattttcacttgaatcccgacttgtttatgacgcaaaatgtcataaaattcggcttcattatcaatcatggtaagtaaagatctaaccttttgaatgtcatggaactctggctgcgaaagcatatttgcttttcctccaaagtatatcttttccgataacggaacttgaaatgtaccatccaacatttttattgcactatcgtaattatgaacatacccacgtaaaactgtaacaatctccttaaagattttattatgaagttcttccatcggtacgccagatagcttttcatttaaaatattaaccattttttctaaatctgataaatcaacagattccggaacggtaatcgttttactttgtacatgccctgtatcggttacaataatagcgacagcagtttgacgatcaagcggcacaatttgtacatttttaagtttatttgtacttaacttcggtccaagaacaatggccgtataattcgtaagttctgataaaatttgagcagattgttgtgcaattttttccgcttcaaaaattctttcagcaaataaatctttaatttgtacaatttcagcgttcggtaagttttgcggtgctaaaagatggtctacataaaatcggtagcctttctcagaaggaacacgtccagaagaactgtgcgttttttcaataaaacctaattcttctaagtccgccatttcatttcgaatagtagctgaactaaatgtaatttcatcttttttagccaacgttctagacccaacgggctgcgctgatccaataaagtcatcaataattgtttgtaaaattaagagctgacgttccgtaagcatctcatcatcacctctgttagcactctttgtctttgagtgctaaatctattaataacttaccaaaattgacattcaattgtcaacggaaacgtcacgaaataatgaaactttttcacgcctatggaacatttaattagtcaatcaaaaatgattggaatacttcattccctaataattttccttttcgcgttaaacgcacatgtccatcttcctcttcaagcaatccctgctcttggttgctttgtaactgcttcgcgaaaacttgatccatctctatattaaatttattgcggaacgccgttttagaaacaccttttgtttttcgaagccctaagaacagctcttcttccattctttctttctccgtcactttgtgaacatctaaatacggaaatcctgtttcatcaattttattaaaatattgcttcagcggacctacattttgaatacgttccccgttcacataactatgagctccagctccaaatccataatactcttcattattccagtatgtgagattatgtctacttttattgtcaccttttgagaaattactaatttcatactggttataaccgtgtttctccatttcatccattactatttcatacattttcgcttcatggtcttcacccggaagacgcaatttccctttgttcattaagttataaaacactgttttaggttctacaattaatgaatatgcagagaaatgttgtacaccaagcgtaaaagcaatatctaatgtttcttttacatcttctatcgtctgtcctggcaaagcataaataatatctacattaatatttttaaatcctacttcctgcgcttctcgaatcgcgaggaatgcatcttccctcgtatgcttgcgcccgattttctcaagcagttcatcacggaacgtttgcacaccaaaactaattcgattcactccaccttctagcagtacattcaacttctctttcggcagatctcctggattcgcttcaaatgttaattcacaatttggggcgaacggacgcaaatgacgattaataatctcgagtaatttttttgtctgttccatatttaacgctgtcggagttcccccgcccacaaaaataaatttaatactatcaaacggaattttttgaaccgtatttatta

SEQ ID NO: 1103 - DNA, 4267 bp, Bacillus thuringiensis
cgcaccagtctgggcgattcaccgcagaaaacacttggttatccctcactggaaattattacttgcggaattacttagtggaagctgcctactgaataagaaggcacgtatctgattatcaagaatattacgtaaaaaaatataatgaagtaccaaaacatcaacacaaacgtgcactcgttctaaccgcaagaaaacttgtgcgattggtggatgcgctactacgtagtcaccaactctttacgccagaaaggtgcgtgaaagtgtgacataaaacttgtcatcgctacctttcaattaatttccagtaaattacatacgttactggtttagtttcgtgatgtctttttttagtaaataggcctttgataactaaaaattcttttgtttttcagttgacatactaccgcaggtcttattacctatttatgtatggagtgttcttatcattcatatagcaagtgaagcaaacaaaaaatagccgacttttatataaaagtcggctgctttcttataattcgagctctcccatacgaagaagctccacaactgcttgtgaacgtcctttaacccctagcttttgcattgcgtttgagatatggttgcgaactgtcttttcacttataaaaagttcacctgcaatttccttcgttgttttatcttgaaccagcaattcaaatacttctctctctctctttgtgagtaaaggtttagattgatacgctttttccttcaactggtataaccctccttgcttaagccagagctgtgtatgtgtaagttgggtgtttatttagtcaagatattgtatgaacgaaatgtgcaggtggtgaatgaaaatgggctttatttcctatgttattttagacttttatacagtgcgtacactctttttatccacttactttccaacgcgccatatttgttctagcaatatacttacaaccgtacctacaaataaaccattaccgaatatatattgcataacagacggcaaggattggagtgctccagacggtaaaaacataacgccgctgccaaataatactgcaacgcctaagatcgttacattcctttcactcatcggcacttgttttatattattaaatccaattccaattaactgtacgaacgaagccattaaaacagccgatgcgacagctgatggtaaagatgctaagtaacgaataatacttggaaaaagagacattacgactagtaacgcacatgccattaagaacgatcgtatatacttttgttttgttaaacgtatgaatcctgccgttgctggtaacggaacgacacctacagttgaaaatacagaagagatgagatgcgaaatccccccaacccatgttccatctttcaactgtttttgttcaatagtcgctttatgaatagttgcttgattaattgctataatagctgccaccgtattcgaaactaaaatacataccataacgaaacttgatacagccatacctgtattccattttggaagtccccaagcaaatatatgtggaagttgcacaaaatgagttacttgagatgggattgtcacttttcctgcaatgagaaaaataatccacccactaattaatcctattaaaactgcataacttttgacaaagccttttccaaaattagatagtataataacgaacagaaatatactaaacgcgatcattgctgtaaatccgtcgatttgagaaatagtagctgtaattcctaacattccttttaaaaatacaccacttaattgtaaacataataaaagtaaaaacgtccctgtcacaagcggcgtaaataaaaataaaatacgtcctataaaaccagttactcctaatcctattaaaataacaccggagattatcattcctaattctaaaatttgcagtgtactatgtaattgatcctgtccggccgttgcataagcaagtacggtaaatacaccaacccaagatccagccagcccatccgcaattggcagtctatgcccaagccacccttgtaaaaaagaagatataccaactacaaaaaacgtacgctgcattaaataaaatatttcttccgtcgtaagatgaaataatccgccaacgacaattggtagtgctattgaatttgctaataaaaatataaaccattgcaaagttcccataatatgattttggttatgttgattgtccaattttttcatcccttctagctttcctataaaaatatattgtaagaataaaaaagaagagttctatactcaccattagaaccctcctcaaaatatttaaacgattcttctacacaagattatttaattccacctcatttaaacttccaacaacaatatttcctttatacacgactaaacgtttttctgtttgacgcgctactgcttcagcagcgcatgtcgcattcgtcaaaacaaagctcgcttcatcccctacattcggccatactcgcttcccttcattatttaacgtttcttttccccctgtaataaagcggagtgcttttcctaaagacctttcgtcactccacccaaaacgctctgctaatcgattcgccttttgaagcatatcacctgttccaaacggtgaccaatgatctgtaatgctatcattgcctaatgcaaccttaacaccttttttatctaataacggaattgggattacttgtttaccaattggcactgttgaagtaatatcaatatttacatttgcgagtctttctgccacttcttcagcctctttaccagtaacaccaccaagtccaagtgcatgactaatcgttacacggccttgccatcctgcttcttctgttaaacttgccaatctcttcatcgtaaacgttccaagattattcgcatcgtgcaaatgaatatcaacatccgcattaaattctactgcgatatccataattgtatgtaatgacttttcaatgtcattatctactgtagctggatctactcctccgactagatgagcacccatacgcatcgcatctttcacgagttgcacagaatcactgcgcaataatccatgttgcggaaacgcaacaattctactagacactcgatttttatatgtttctaatgccgctaacgtcgcctccagattaccaagcccaataatcggatcgacattacaatgcgttctaatattcgttgcaccattttgcagtagtaactctagcatattttccgctctatttcgggcagtcgctaattgctttggtaaaattttttcttcttcattaaaacgtgtaaaaatactttctgctggcatacaagctttccatgggccactataatatgttttatcaatgtgaatgtgcatctctttgaaagctggcaacattaataagttcttagcatcaaaagttactatatcttcctcttgaacaatcccttttataatttttttgatgcgaccatcttcaataagtaacctgcataattctgtttctgtttttgaaattctctcttcttcatatgtatatcctgattcaagcattacgttagccaaccaatatactgtcatctctatttccccaccctttattaaaaatcacctcataactacaattttaatatccactgaaaattaagacaattaatacgatcacttctcacaaaaaaatgtaatacaaccccatagtcttctcataaatttccatatagaataaaagtatgcagtttgatataaaaaggagttgattggaatatgtcaaaaaagttatgtaaatccgaaactgataaaatgctatttggtatatgtggtggtttaggagaatattttgatattagctctactcttattcgtatcatttgggttattgctgttttatgttttgggacaggatttttagtttatttcatttgtttattacttatgccacgttcgtactaacggcattatttcacatacttaagaagagcaaatcacctatagaatcctataggtgattttttcatgaagaatatttcatcgttaaatgtaataccgctacttcttcttcttcatttttataaatatgcttcttattcgcttcaaattgaatggaatcaaactcatttaattcgtatacatcattctccacttgaatagacactttccctttcattaccgttacaagctcaatcgcaccttcatgatgagcttctggctcatatatactatttgatcgtaaacaagcacggtgcatttccatccctgtttctttcgtataacggaacatcgtttctaaatgccacgcttgtccttcatctact

SEQ ID NO: 1104 - DNA, 5561 bp, Bacillus thuringiensis
ctgtattcgccgccggtattatcgttgttattggtcaaatcgaaagatttgatgatgaaaccaaggtagcaaaatatgccggattatattggcgtacgcaccagtctggtcgattcaccgcagaaaacacttcgttatcccgtaatggaaatcattacttgcggtattacttagttgaagccgccaactcagtaagaaggcacgtatctgattatcaagaatattacgtaaaaaaatataatgaagtaccaaaacatcaacacaaacgtgcactcgttctaaccgcaagaaaacttgtgcgattggtggatgcgctactacgtagtcaccaactctttacgccagaaaggtgcgtgaaagtgtgacataaaacttgtcatcgctacctttcaattaatttccagtaaattacatacgttactggtttagtttcgtgatgtctttttttagtaaataggcctttgataactaaaaattcttttgtttttcagttgacatactaccgcaggtctttattctaggaatacctaaaataattactagtaatgttaatatttattatataccacttttttcattccgacaacgttatatcatttttaattctttcagagcgtatagagtgatttatagagatatttttatagaaatagttacatttcgtatatgttatatttaatactgaacgatttgaatacgaatttttatgaaaggagaaaaaagaatgaattataaacagttattaatagataacttcacatataaaatgtcatatattgcgcgtcatgtacatgaaatgaatgtaaaagaaacgaaggactacattgctgtagattgtggtttacctgcagatacatttaatatcattactttactaaacaatgatgtaacggaagacattgagaaattatataaagtgataaacaactataataaaaagaagtttccaatgtgtgtttggttttgggataatagctatgaacaggctataaaaaacgaattaataaaacttggcttaaaagaagcagaacaaaatattgcgatggtagcagacttaaagacaattcaaccaacaataaaaatgccagaaggttttacgatacaaagagcatcttcgttaggacaaattaaaaagtttggggaaacgttagctaatctatttggtacatcagaggaaggtatacatgtgcaaacattttataatgaaactgcttctttcgatttatggaatagtgaaaatatgaaactatatttagggatttttaaagatgaagtcgtatctgttggttcattagtatgtacaaaagatagtattggtatttatgatatagcaactaaagaaaaaatgcgagggcaaggatttggctccactatgtttaattacttgctgcaagaagcaaaacaattgaaagtttctcaatgcgtattacaagcttcacctgatgggattaatatttataaaaaggctggttttcaatctgttggacaaatgactgtatttgaaaatcgacatttaattgaataaattattcgatccaaattgctttcatgtaggagttaatacatcattatgaaaaagatatatatcattacaatcatttgcaccattatattactaggtactttcgttttacataaagtagatgaacgtaagtacacgaaagctattaatcaagcaaatcatataaaaaacattgcacatagaggcgcttctgcgtatgcgccggaacatacaatagcagcgtataaattaggacaacaattaaaaggagattatatagaaattgatcttcaaatgacaaaagacggacatttagtagctatgcatgatgaaacagtaaaccgcactacaaatggtacgggtctagttaaggaacatacattagaagaaataaagaaacttaatgcaggttcttttttcaatgaaaagcatccaagtttagcaaagaaagactttgaagatgctaaagtcccaacactagaagaaattattgaaacgttcgggaatggtgcaaactattatattgaaacaaaatcaccagatgaatacgctggtatggaagagaagctattagaaattatacagcactacgaaataagtgataacgttattattcaatcatttagtgaagaaagtctgcaaaaaattcatagtttagatgttactttaccgctagtacaattactaccttacaaaaagtcagttcaattaactgaattagagataaaaaagtataaaacatactgcatcggtcttgggatgaactataaatatattgattccgcttatgtaaagagaataaagaagcacggattagaagttcatccatttactgtagataatgaaaaagatatgaaaaagttacttttatggggcgttgatgggatgtttacgaattacccggatcgtttacattcgttattacaatcttaaactataatggtgtaattatcactgaaccaataaaacaagtacccacaagtatacaaagatggtttttggtccaaatggtaacatcattgaatgcataaagccgatattgaaatgaaatttgaaaaagaatccaatactgttattggattcttcttatttagcgctaagtgactaacttaaagcaatacgatcttgaatttataaaaaaaatattacattgagtatgatttttcataataatcatcagaaagtaacgaaaatgtaatgaagtttaactacgctttttatatttttttgatacactggctacgagaggaataccgattaatgtaggtaaaaaccaaaaccatataggcggaagtaaattaattaagggaatatgaataccgacatttactaaaagtgcagtaacagcaccgatataagagcctaacatacctctaatatggtggtgaagccaattcttccaacgtttttttcgtgcgaggtatccataaatcgcaaatgaataagagaaaattgctacataaaataaatatgcgattttatcccagtttataacggataatataatggcagtaacggtgatcacaacataggatgcatgatatatttcaccccattccgtatgttttcctttcttcttttgagcaaccatcgctacaataccggtgattaaacatatcgttccaaataatatgtggatggctaaaagaacgttgaaaatgctcataataattcctcctttttttatttttatagtattgcagtataggagaaaagttgaaacatattgtttattcgccttaatatattgaaataaaggtacttctagaacaagtttaaacggacaaatttttcttgagtttagtgagacacgtattacgtgaaatgaaggagagacttccatgtttacatctattacatatttacaatcagggaatgacaagcaacaaaaggtatatgatgttttgaacaaactaaatattatggaggatttagctttatataatcccgttctttgcgggacaatcccgataagaattgatactcctcaatctgacttagatattgtaatggaagtatataactttgatgtttttgagcaagaaatgagatctttatatggttcttatagagggttcaacataaaaaagaaaaaaatgaaaggtactgaatcgataaaggtgaattttgaattcgaaggttttgaatttgaattatttgctcaacctaagccagtgcgtaatcaaaatgcatatagacatatgatagtggagcacatgttattaatgcagcatcctcatataagggaagaagttattcacttaaaggaacaaggtttaaaaacagaacctgcttttgctcaagtattaaatattgacggagatccttatgaagaacttattttattagggcaggaaatgaaattgtggtaaataaaatacgtgaaaaaatcctccaaaacaaaagaggatttttttatgccgttaacttccgaattaattcactgagcaatttaattccgttagtcatttgttctggagaagcatatccatatgataaacgaatgtactgatctgattcttcttcataaatacgtcccgggtttaaaagaattccttttgatagtgcctctgaaaatagttttttcatcggaatgttatgtacaacctttagccatataaaaactccaccactaggaatatcccacgatgcaatatctgcacaatatttatttaaagctcgtatcattatttgtcttcgttttttcaggtgcattcttacgtttgctacatgttcttcataaaaaccttcatttatccattcagcagctactctttgagataaagagcttgatccatagtctgtttgcatttttatatctgacaatctatcaataacaggttctggtccaattatccatccaattctaagtccagggctaagtgttttagagagactaccaatatataatacatgtccatgtttatctattgactttaaaggagctggaggtgattcatcaatccataactctcggtaaatatcatcctcgatgataggcaactgctcttttttacatatttttaatatttcttttcttcgctctttggacatcaatatccccgttggattttgaaaacaagggattgaatataaaatattattcttttgactatatttaattcgttttaacaagtcgttaggtaaaataccgtgatgatccattgatataccggataagtttatatttgctgattgaaaaacatgaagtgaatataagtaagaaggttgttcaagtaaaacagttgattttctatgtaaaagaccaattgatattaattgtaatgcttggagtgcacccgagactattaatatagaacccggtgatgcatgtattccaaatgattttacgtatttgcttattgcttcacgtaacggataaaaacctttttgttcttcgtatccgaaataatctaattcctcactgacgttttttattatagattgcatagtttcgagcggaaaaagatgaggtgcaagttcacctttactaagatggataagcgttttatttgcttctgcttcatttatttctcgcaccattaacttacttggtttatgaataccggcctttacatattcactccaatcaggcgggggattagttgctaataatgaccatgtattatttgttacaattgttcctgctccgatttgtccttgaattaaaccatctgccataagttcatctagcgcagttattacagtacttcgatttacatgaaataattttgctaactgccgctgactagggattttacttccaattggccattctccgttttcaattttttctttcatatagtctattatctgccgatatttgggcacttttttatcggttgtcatataaaaaactccttcgttaatttaaaagattcaaagtggttggtttttccgataaataactggttgaagacattgtatcaactattaaatatgatgaaaagaaataattggtaatttaaaaatggttggtttattaaggagggagagaaaacatgcataataccaaatggcatttacgcattatatgtgctcatgattttacaattcttat

SEQ ID NO: 1105 - DNA, 5766 bp, Bacillus thuringiensis
  unsure (1)...(5766): unsure at all n locations
ttcgtcactttttttggtaatgtttccatagttcgcgttttgatgtcgtaattgctgtcgcaccagcgtttaaagctctttccacatcttctacagtacgaataaaaccacctgctaaaatcggtacaccagtacgctctttcacttcagcgataacgtccgttaatgctccaggaagtacctcaatataatccggtttcgtcttatctaaaagattgcagctcttctccatcgcactcgaatcgattaaaaagatgcgttgtattgccacaacacctttttgcttcgccttcataataacgctcgcctttgttgaaagtaacccgtacggtctaaactcctgacataaatattccgtcgcatgcccatcactctgcaaaccatgaattaaatccacatgtaaaaacacctttttacaatattgcttcgcaagcgatataacactcttcaattggccgacatgaatatctaaaataacaatatattcatacgaactatgtaatagcttttccaaatctttaatttgcctcactgccggcaaaatcttctgttcatgaaattccattctctatatccccttctttatgtcatcctatcctttatagtacacaatttaagtgaaaagaacagccagtgtaggggatttctttcaaatctttcctctatctatatattttcttcaacttatccgatcccataccacctataatcatgaatgcaaggggtaaaagattcattacatatggtgcatctgctacaattgtaatacttgctccagcaaacttatttagcatccatacaacgatttttgcaataaacaaaaatactcctatcataaatagactatcaaaaaacaccttccattttggatacgccaattgcttactatcttcaattactttctgcgtcaattcttcatcaccccttagcagttcatcaattgtaataccgaacagatcacttaaatgaataataatttcaatgctcagatagttctttcccgtctcccatttcgaaacagattgcctgctcacatgaattttttcagccaaatcattttgcgaccaatttcttttttccctttcttcttttaaacgctcactaaaaatcatactgtgtttatcacctctctatgcccattatgttcaaataaatgatgaagagtaaagctagttatcgttgcatttcctgcgcaacttatgcgttacagcttataatggcgctcttttatatgtatcttccctatactatgctccaataataatttcccgaacaataatacaaggaacggatactaataaagtgaaactttaatcaaccctcaccaatcgggcttttacggacagcccgcccccccacctaacttctttgcttccgctgaattttgaggtggggtcttactgcccggcaaatagcgggataaagactagattaggcataaaaaatacgccatcccttcttatcagtctccagaaagaataacgcaaattttcatttttactcatcatttttcggactatatgaaaaccccggatatttcacaacaggcctcttctccttacgcagggaatccattacttgcgggccaacatgtatattactctccactattcctttaggagtcagtgccatccattgatttaacgatacatcttcaaaacgattacttctgaacatctctaaaaaccataatgtttcggtacctgtattttgaatataatgccccgtcgcaaacggtacatatccgacatcgccagctctataatcaaatgtacgagcggtaccatttccaagaaacacagtcattctcgcttcccctgtcaaataatattgccattcatcattattcgggtgccaatgaagttctctcattccgccaggctcaacctcaacgagcgctgctgcgattgttttggaaatagggaaatttgtagaatctacaattcgaacgctaccaccaggcgtcttaatcggattttgttttaacaattcatgtttaaatgttaaaggaacttctcctttcggtgattgaatttcctgactttcaagcgaacctggcacctctccttgataaatataaacttgatctgaagggatagaacgaaaagcactctcaggtactccgaaattagccgacaacacttcttttggcgtatgcgcaaaccaatcagaaatagctaaagtagataaatcagaaaaatgcccatcatcgaaaacgagtagaaattcacaatgttccaatccttgaatggaatgtggaataccaggcggaaaataccaaagatcacctggtccaacatcagcaataaaattccgtccattttgatcaacagccgttatgcgtgcccgtcctaaaagcatatacgcccattccgcttctttatgccaatgtagttctcgtactccaccggccgttaaactcatatttactcccgcaatcgtcgtcgaaaccggtagttctcgaacagtaatctcccgagaccacccgccttgtttcaaaatcatagaagtgtccgagaatgaaaacttcaagttaggaactaatcctgcatccgttataggcggaacaagcatattcggattttgaatatcccgcataacattacgaggtccagaatcaatcgtacctgctccgtcgctgcggattggttgtggcacattccctcccgcttcattaacagtacgtttcttcatgattacactcctttttcatccaattagtaagtaaaaagcctccatcatagtgtatgaattgggctttggatggttacagttactatggagttacatcatctgcctatcattatcgttttgttcatttctcaacttatactagtatgcttagcgcttaggaagacaaaaaaataaactagaactaacaaaaaaccctgtaaaatttattacagagtttttcaccaattatttattgttttacatatcgaatacgaacattatcgtccatttgataaatttgtaatgtgtttccataactaattcctaactcttcacttacaccaactgcacttacaaatacccctttaaatactttatttttagttggttttactaccgatactcttcgctgcctcttcaaacagtttcgaaccttcttgtgctttacttactgattgatgcattttactttcgtcttcctgatctaatgcatcaaagagaagttgaaaacaatccgcatatagttccatcgactgctttatcttcgcctgttctccctgtaactctggaggcgcttgtagattcttcagctttgtagcagttgcctttgctccacctaaactcagttgtacttcacttttcttttgtttgtatgattttacgtctgaatctgctattccttcaattaatttcattgtattttcaatttgagtagcactatttatgatatctgccttgtacctttcaacatctgaaccagttaccttaccagttgaagaactagaagaagttgaattatttgaagaagaacttggttgactacttgatgaactactgtttgtaccttcacctttcgctacagataagctatcctctttcttgccatcagttgacttactctctttttcagaagtcttattctctttctctaccttttgcgtttcttctttctttggttcagctttcttaccatcagtttcaattgtaatacaaccactcaataacataactggtaacgctaaacttactaatttctttgctttcatgattactaatacccctttatttgtaaaatgtagtgcaaacaagttaatatacttaactaataaattccccccgaataatttattaaaatctactatccatagatttcctgtatattcataatctttccatatataagattttacaaagaattacatatttggtcaaagggatttatgtagtttttaaaaggaaatttactaaacgaaaagaaaattttaatcacaaagaaaagaagctaacaataaattgttaacttctcagcttaaggaaaaaatagtatctttccttatcttctactatctagattgtggatgaaccatataccgctccctcaaaagaaaaaagctaccacctaggcaataatttctactaagtggtaacctttcaaaatttctattaaagcaataccgaatctttatcactatcctgattacgtttctcacgctcttcttctaaacgcttcatatatacttcgccttctttttcgataaactcattatccatatcttgctcttttttcgaagtatataaaaccatgtagccacttaatacaatcccaacaattacaagataaacccaccatggtaaagtttccactctacttcattcctttccttagacaagccttattagtttcactctatgaggaaagaagtggatttatgcttaaaatttttattgtggatgcttcgcgaaaaatgcttgtacatattccataaactcaattggttcctgacgaaacggtgcgtggtatcctttttcaataatatgaaacgtactatttgcaaatagcccatgatacagttcaccatttttccacgaagcactcttatcatgtcgtccccatataattaaagtcggtgccttaattttatcagcttacgaaaatgcggcgctctcgcattttcgtaagctgatcataatgctctttatcatcacgactattttttacttcatttttattatacttcgtaatctcagttacagtttgtaagtccgtcgatagcggtggtacttcataactttctttttgctggaaagactctatccctttagcatccgccaagatgagatgcgtcactgcatccggatataaatacgctaaattgagagacatctctccgcccatcgaatgaccaagtactgcgaattgatcatacccgagcttcttcattaacttataatataaattaacttgcgcaggaaacgaatactgaaaatcaactggcttagaagaacgtccaaaccctaaaatatcaaccgctataatcgtgtgatctcgtacaagttccggataaatatcactaaacccatcagaagaaccaccaaacccatgcaacatgagtaacggaggtttcccctcaccaatttgcttaaaataaatcgtctgcccatcaatttgcgccatactctctttcgtattcagcttcatcataacagtatctttcacttcttcaaccttcgcaatcggcttatcaacgaagttacatacgataagcaaaacaagcacaataccgctaatcaaataaaacttaaaccgtttcaaagttcccgtctcctttcttgagttgctatttaaagtttttacattttttggttattttatgttctctttttaattgtaactaaaacagttacaattatactaaaaaaatataactcacttctattactaatggttattctgtaactattatagttacatatttaaagtaagtcaattcttttctctacatggcctgaaaatagaaaaagggacttcatgttgaagtccctttctttgttattatagttggcttactccgccgccgcctttattatctgctggtgctccgcctgtgtcaccaatgttaacgtagtctggtcttgctggtgctccgccaccatctcctttattaagtgcaactgaattaaaatcatgaaatcctagagataaagtaaatgcgaaccctattaccgttaatacaattcttctcattattttaacgctccttttatcatgngttcctttcttgcttctttactcatatgataatattcgctaga

SEQ ID NO: 1106 - DNA, 5294 bp, Bacillus thuringiensis
gcatattgatatggctatgaaagtggggaaatcagctttacgggtgatggaattattagatgaggcacatacgaatcattttggtgtgccagagcctgtacaaattacacaaaatcgtgtagaaggtaaagcaattgtagttacaggtcataatttatttgcactagaagaactattaaagcaaacagaaggaaaagacattaatatttatacacattctgaaatgctaccagcacacggatacccgcagctgaaaaaatataaacatttaaaaggaaacatcggtaaggcatggtatgatcaaagacgcctttttgaaaaatttactggtgccatattagctacaacgaactgtgttatgccaattaaaggatcgtactctgatcgattcttttcatatgacattgcaggtttagaaggtgtacaaaaaattgaaaatgatgattttacaccattaattcaaaaagcactagaacttccagaagtacatatggagtcggatgaacagttagtgacagggtttcatcataatacagtattatcattagctccagaaattattgatgcagtaaaagaggggaaaataaagcgtttctttgttatcgccggttgtgatgcaccgggaaaaggcggagaatattatcgtgaattagcaacgtcacttccgccagaaacggttattttaacaacttcttgcgggaaattccgctttaatgatgtggattacggtgttgtacctggtacggaaattccgcgttacattgatttaggacagtgcaataattcaatttctacagtgaaaatagcggctgctttagctgatgctttccaatgtgaagtgaatgaattgccagtaagtattgtgctatcatggtttgaacaaaaagcggttgccattttactcgggctatttagtcttgggattcaagatattcgcatcggtccaaaggctcctgaatttatttcacctggcgtgcttgatgtattacaagaaacatttggtttaaaactaattacaaatgtagcagaagacatggctatgatgttatcgtaacggaaaagatgttttcacttaattgtagctttataaatcatttgtatgtatgtgagtaaacgtacatacaaatgattattaataaagaaaatctgctatatctataaattttataattttataaagcttttaaagtgtaacaccacatgcccatcaccttaagattttaagtatccccaaaacgaaatttctacatgaatatctataattttacctctttttcatttgatttgaaaataagctttctatttttaaaaaccaacgataccacctcaaattatatgaataaaatccattcatttattaggaaaatggattgaaaataataaggtagactaaaaagtaaaatattatttatgataatcatttttttataaaatttaaattggaaatagccctactcattttgattgcgcattttcaaaatggaggggcttttcttactgtaaaatcaataactgcagcttattttgttgaaaaaattctcattcttattttgaaagtgatatgggtacatttacatgcacatcaatcttttatgatgaagtggcccttgaatatattattttttattgacagacataaaaatgatttatttgctatattgataatttatagacgttataataaaatgtttacgtatatgtaaacttaatttattattgtttggttttattgtgaggttaggcagtgttaataacaataaaataatgaatatatcacctgcaaaaagaatgcaaccaatacggagaagatgatttcgttaaaaattcgaaaaataagcgttattagctcttgaagaaaaatgactagaaaaattataagcatatggaaaatagggttatacaaaaagtcctaaagggggacggaattatggagaaaagaaagtattcagtaacaccacaagatcgaatgaattatgtattaggtctttattctgcagatcaacaaattaatgcagttctttattttcctgtaggtatatccaaggaaatacttgaagaatcagtaaggataacgttgcaattgcaaccagttttgaacagccggtttgtagaaaatgatattccttactgggaggaacattcatctgacactaattcatctatttgcttttttgcagaaggaaataatcaagaacttgaaataatggcaatagattttattaaggaacctggtgatcgtattcaggggcctatggttcaaacgaaattattacggggcactacaacagatatgttagttgtgaaattgtctcatctatgttcagatggtgcaggagtcaaggaatatattaaattgcttggaacgatatatactcacctttcattgggacggtctaagaagcaaattataaaggaatttgatgagggaaatgagagttgtcgagatcaattacatgtattcaaatacgctggaatatcggacataaaaagtgcgtatcgtcctaaccaagaacaacaggcatcgttatggtcttttccatctcaacctaacaaaaataaatttccccaaatgtccgtacggcgattgagccatgagcaaactctacgtttaacccaatggacaaaagctcaacaggctaccttgaatgatgtaatcatgactgcatacttccgagctttatcacatttcactgtgtatgcagaaccgcgcactgcagaaaaaatgattggcttgacaattgatttacgtcgatatctgcctaataatacaactggtgctatttgcaatttatccggtatggaaatgccagtgattaaaatggaagacgatgaaacatttaagcagactcttgttcgagttaaacaatcaatggataaaataaagtctcaaaatccaggtctttcttcagcagcaggaatggagttactggcagaaatgaagctatctacagtgaaggaaatgtttaatcagcaatatgaacaggctgtacagatgggaatggcattgccgttactgacaaatttgggagtaatcgctgatgaatctattcagtttggtgaaattcaagctgaggacgggtatatgacatcacctattatgtatgcaccattcttttcaatgggagcaagctcttataatggaaggcttacatttacgatcggttatcatgcgccggatatatcaaaagaaaaggtagaaaaatttttagatagtgttgctaatcaactatcagaaataaatacaagagaatatagagaacagatttctaacagaattgtattttaggggctcgtatcatgtacggataatctctggaaattttctctgatcgcacttgcctttatgctttatatgcaatgggaatggtagtgagaaacaatttgtatcgcgaaaaaacaagatatatcggtataaaaacaataaaacagagctgatttaaattacactttgaatcagctctgttttactaggttgatggcccttacaacaaaaaaggatgctgtatccggttagggtaaagcggatttttaattcttctgaaaataaagttgacatccacagctacttagtcatacaatgtagttgtaataagtaatactgaatagtgtggttttactcaaaagctattcagtaaaaaattcgccttagtactctgtgatactgaatataagtcagacagaatagggggtaaaggaggatcaggacatggaaaatttaactgaaatgctaaaaggttcactggaagggtgtgtactggaaatcatcagtcgccgtgaaacgtatggctatgagattacccgccatctgaatgatcttgggtttaccgaagttgtggaaggtacggtgtataccatccttgtacgattagagaagaaaaagcttgtgaatattgaaaagaaaccatcagatatgggaccgcctcgtaagttttattcattaaatgaagagggccgccaagagcttgaattgttttggaaaaaatgggattttgtatcgtcaaaaattaacgtcttgaagtcaaaataggttcataagataaaatgttccggccgatactttgggaatttcttgttcggttttataaaaaagcaccaaaataagatgttagaaatgtttaaaaagttaattggtgataaaaaagagtacaaaatgatgatggcacgagttgaggctctgccacaggactaccaatttgtatttaagaaaattcaaaactacatgtggaatttctcagcgggtaacgggatggatatgttacacatacagtatgaattaatcgatttgtttgaagctggtgcagcagaaggaagacaagtgcttgacattactggggatgacgtggcttcctttgctgacgaactagtggcaaatgctaaaacttacgtctccaagtatcgtgaagatttgaatgaaagtattatgaagaaattgagaaaaaaataaatggaataagtaataccgactgattagctggttacacatatgaattgccaccatagctattcagttatatttttagctcggtactaagtgatacagaatatcagtggtactaaatagatagaggtaaataaattatctccgcaaaacatttttatagggaggaaaaaagtatgagtcatgcagcgatttctataaaaggcttgaaaaaatcctttaaagacaaggaagttttaaaaggagtagattttgaggtgcagcgtggagaaattttcgcgctgctaggctcaaatggagcgggaaagacgacaacggtcaacatcctttcgacactcatgaagcaagatagtggtgaagtaagtatttgcggatttgatgtacagcgtcaaccaaatcatgttcgtcaaagtatcagtttgacagggcagttcgcagctttagacggtatgctgactgggagggaaaacttgataatgattgctaggctacgtggtgtttccagtcccgctcaagttgctgacaatctacttgcaagatttagcctgactgatgcggcaaaccaaagggcagatcagtattcaggcgggatgaagcgccggcttgatatcgcgatgagtttcccggggcgccagcagttatttttcttgaaaaaccaacgactggactcgatcctgaagcgcggattgaagtgtgggatacagtcaaggaactagctgatagtggtacagctattttgcgtacgagtcagtacttgaagcaagcagaacaactggctgatcgtatcgcaattatgcatggtgcaataattattacggcaggtactcttactgaaaaaaaagagatgttcccaccg

SEQ ID NO: 1107 - DNA, 5251 bp, Bacillus thuringiensis
ccctttcctttttgtcaaaaaaaatcattatatctctcatcaaaattcattaaagtgaaacaagaataagcggggattacccgcccccgcttattcttcatctataatattaaaatcttaattttcagatatttaatccaagaattttttctttccatatataattattgttgatcacatacttttgtatcattcactactgaagttccttcaacggttaccgtatgaaaacagtcatttactcgaactgttacaacattatcttgccggtcaatgatatgatattcattaaaatttttattcagagcactgcgaatttgttctccttcataaattgggatgccatgcgatagaacccaaataagtccagcgatagcaagaatagttttcatacgatctacctccttgggaatatagtgaacttttaatccatactttttcagctctacaaatcatgatcggaataaaccgagcctttttggaaataagttcatttcgtctattttatgtttatgctaattgtgaccgttttgtgacaactttttgtctctttagacgaaaagttgaaacaaaactttcaaaaaggacaattctacatatcaaaaaaggttatggaatgtttcatccataaccttttttcctatatgtaactaataaatctcaaccctttacttaaagacgtcggcacaacagatgcatgattctccccttcagcttcataaaacttaaatttaagtttatcgtggtttacttggagaaggcgctctgataattcatttgcacctacaaccatatgctctcgttctagtgacccaactgtaaggaacactcctgtttcaaacttagcattgtttaattcatttataaggttctcttctttttcaagtacggatttattattccaccatatagatggactactaataaaataattttgaaaagcatttaagtttgtaaatagtatatggagagcaaataatccacctaaagaatgcccaaataacgtttgcttacctttatcaatctcaaaattcttttcaatttgtggtttcagttcttcttcaataaaagtaaagaaattatgtgctcctcctgttttaggccacggtttaccgtctggttttaaaggggcatcttttgaaattacgctaggcgtaaaatcataacatctttcttcccctgaaaatgcgccttcaattggataacccactcctactataacagctggtgaaacaccagttttttccgctcttactgattgtattttaactgcttcatgaaatgtttgaaaaaaggcattgccatctaatacgtaaatgacaggatatcctgaatccggtgctggttgcctcggctttgaaatatgaatttgatattccttaccttctaattttgaatacattttccactgttctgtattagatattataatctgctgtttttcaactgtagtattcaccctatccccccctttttaacttgttacatatatttcgattttttcttcttgagatacaacgctatcataaccgaaacaaacaggagccccgttatacggatcaatcatgacacgtgcatcaatatgaaatacttcttttaatacttcatttgtaatgatttcttctgggctaccagttgtaacaatttctccttccttcattgcaataatttcatctgaaaatcttgctgcatggttgatatcatgtaataccataacaaccgtacaattatgttctttatttaacttctccacaatttgtaatacatctaattgatgagacatatcaaggtatgtagttggctcatctaatagcaacacttctgtctcttgtgctaatgccatcgctagccataccttttgtctttgaccacctgataaatttgcaatttgtctcgttcgaaattcagaagttttcgttatatttaatgcccaatcaatcatttctttatcttttgtcgttaacttatttacgttatttcgatgtggatagcgtccataagaaattaattcttccactttaagttcacctggtgcaattggagtttgcgggagtaaagctaactgcttcgcaatttctttcgttgaaattgtatgtaaatcttgcccttgcaaatatacttttccgcttttttgttttaaaattcttcccattgtttttaacaatgtcgatttaccgcaaccgtttggacctataattgtcgttacttttccttcttgtatttccacatttaaatcgcgaaacactgtaagcttttcataacttgtttctaaattttttgcacttaaaatactcacttttattcctcctcttacgctttcgccttataaagtaaatataagaaatacggtacaccgacaatagaaataacgattccaactggtaactctacaggtgtgaaaactgtttttgcaataaagtctgaggcaattacaagaaacattccgattacgccgcacgtaggaattatatacttatgttgaataccgacaagtcttttcgctatatgcggtgccattaagccaataaaaccgatactccctgaaacagcaacacatgcactcacaagcccgatactgcttaataataaaatcgatttctctctttctactgaaacacctaaacttgtaatactcgtttcttccaattggaataaatctaataaataagctttcttttgtataagtggaattaagataataagccatggtaacatagccacaatatacttccagttcgcactatatatgcttccagacacccacactgcagccatctcgaaatcagttgacttcattttgagtgataagtacatagaaaaagctccaaatcccgatccaattgcaatccctgttaataaaagtcgctgcgaatctaatttaccgtttttccaagaaaacagataaatgatgatagctgcacctaatccacctactaaaccaaacattggcatcatcataatagaaacccagtctgtgctttttaattgtccttgaaagaaaaacataaaaatgacaatcgctgttcccgctccggcatttactcctaaaatacctgggtccgccaatccatttctcgtaatcccttgaataacagcacctgcaacaccaaggcctaatcctactaatccagcaattacgatacgcggaagacgaaactcaaaaataactaaatcatgttctggtactggatcaattctaaaaagtgttttaaatacatctgtaatcgtaatgtcgaacgtaccatttgttaaactaatatagatagcacatagtattaaaaatataataatccccatcgtcattccgaaacgttgacttgaacttttaagcatgtctctctcctcctctagtacggattaaataaaggaagaaaggaattccaattaaggaggtaacgactccaataggtgtttcaaatggatagtttacaaatctactcaaaacgtcacataacgctaagaaaacgccaccaataacacctgcacatggcaaaatccacttataatctaccccaattataaagcgggtaatgtgtggaataattaaacctacaaaaccaactttccccactaaagcaactgctgttcctgttaaaaaaattaccgataaaattgccatcgctttaactagttttgtacgctgtcctaaattaatagaaacctcttcgcctaatgaaagaatggtaatagattttgatattaacaatgctaaaattattccaattatcccaaacggtatcgcgattttaattatattaggatctacttgatctaactttgcattaaaccaaaaactaacattttgagaaattcggaaatacgaagccattgcagccgatacactgcttaaaaatgttccaataactgttcctataatcgctaacctaactggtgataagccattttgaaggagcgaaccaaaaccaaacacgataccggctccgagtgcagaaccaatcattgaacatataaccataccaattgatgacattcctggaagaaaaattatacaaagtgtaataacaaaggcagcaccatccgtcacacccataatagaaggggatgcaagatagtttcttgtcatcccctgcataagtgctcctgatatggctagaaatgctccgactaaaagagctgcaactacccttggtaaacgtgaagtaataataatattatgatttacatcacttgaatcaaaatgaaataatgcgttccacactgtttcagcatcaatacttttcgccccatacaaaatcgaaagtataactgtaaataagatgagtatgggtgctatacataatatagttactggtactgcatttgttttctgcatatcattcaacgcaccttacttattgtattatttagataaatttttcactgcttcttttaagaaggcagttttactccaagcagtaccaccttgcgccattggatctacaacgtttacaaatactttcttttccttcgcagcattcatactttgccaaattggattactttcaatttcttctaacacttttggatttttattttcacttgcctcatattgtaagaaaatataatctgggttaagttcagcaagtttttcaaatgaaattttctcttgtgcttttacagttttcaattgttctggagcagttagtccaagatctttataaattacagggttgaagtatactccttctggatataggaataattcgtttgctcttagtctaatgacaagtacttttttatcttttaacttatctcctagttttgcttttgctttttcagcgtctgaattgtagtctttaataattttttctgctttatcttttttaccagttaattctcccattaactttaagttatcttcccaatttgttgaaacgtgtgataccgggaatgtaggagctactttcgtaaacttttcagctgtttctgctgggaatttcgtacttgatgtaatcacatctggttttaattgtagtaatgtttcgaaattgggttgcattttctcaccaacagatttcgcaccttctaactctttttccaggtattttggtagtttaccacctacagtaatggcaccaactggtttaattccaagtactgccgcatcttccattgactctaaactagctgtcgcaattttatctacttttgctggcactgtatattctttacctaaatatgtaatttttcgcccttcatcttttttcgtttccgtagctttagaagaattatttttgctcgcctgaagtta

SEQ ID NO: 1108 - DNA, 2667 bp, Bacillus thuringiensis
tttctaaatcgctcaataattcagatatttttgattctatgtctgtatattcttcctggctaatgatcatctcttcaggatcagtcaccttcgcttcagaaataacatccaataacgttcgatcagattcctcatcgtaaatcggcttatctaaagacacatacgaatttaaaggaatatgtttttgtcttgttgccgttttaatagcggtaataatttgtcgagtgatacatagttcagcaaatgctttgaatgaagacagcttgtcctctttataatcacgaattgctttaaacaaccctatcataccttcttgaacaatgtcttctcgatcggcacccactaaaaagtaagatcttgatttcgcacgaacaaagttcttatacttgtgaattaaatattctagagcgtcagtattaccttttcgaactaactcaacgattgcctcatcctctaaatcacgaaatgtaacgtcgcctatacttacgaagcctgcttccaccttgatccctccgaccgctatttatttagcaatattatacagtaaaaagataaagagcgtcaatgcttcaacgctctcctcttcttaatttttctaatttttctgtaatatccttactaaatatctttcgcatggcgggctgctgttctttcgtgtcttttgtacgccttcttacttgttgttccatcgcttgtacttccaactctaattcacgcgcagattttcgaagggcaccttgcccaaatataacccattgttctgtataatcagaagtcgcaacatatatttgtgtatttatatttctaagctctatcgcaagttgctctatcttttcgtctgcagtttgattctttcgtgtgaatattacttctacacgagattgtttcatctttttttcaataccatggactgtataggcatcaaagactatcatcacttttgtgcctgtataaccttgataatccgccatcttatcaataagcgcatctcttgatgattgtaaatctacatcccgcagtttcttcaaatctccccaagctccgataatgttgtagccgtcaacgattaaaatatcgttcattttttatttaccaatttcgtgacgtttacgatatacctcatacattaacaaacttgcggctactgaagcatttaaggatgtaactttaccaaccatcggtagagtgattaagaaatcacacttttcaccaataatacgactcataccttttccttcactaccaattactaatccaatcggcattgtaccatctaaattacggtaatccgttttccctttggcatctgtaccagcaatccaaagtccacgctcttttaattcatcaattgtacgagataagtttgttacgcgcgcaacaggaatgtattcaatcgctcctgttgatgctttcgcaactgatgcggtaagtcccacagctcttctcttcggaataataattccatgagctcctgttgcatcagcagtacgcataatagaacctagattatgcggatcttcaatctcatctaaaatcaagaagaacggatcttcattacgtttttctgccactttgaataaatcttctaactctgcatactgatatgcagctacttgagcaattacaccttgatgattaccctcaactaattgatctaactttttctttggtgcatgttgtaaaataatcttattttctttcgctaacgctagtacaatttgtacttgtcctttggcagcaccttctgcgatccaaattttattaatatctctccctgatcttaacgcttcaattacagggttacgtccgataatatattcactagtcatgatgatgtgcccccttccttttcttctaaaactgcaattgccttatatacaatttcgtctaatctttcacgattatttaataaatgatgataaccaattagtgcttcaaaggctgtactatgtcgatatgtttgtacatccgtatttttcggaactgtacctgaatttgcattacgccctcttcttaataccgcctcttcttcctctgtcaaaaatgccgtctctaataaatgataaacaactttcgcctgtgcttttgctgaaacaaagctcgtccctaagcgatgtaattgattagggcgaacttttcctttttgaaggaggtgatagcggatatattgttcatataccgcatcacccatatacgctaacgccaagctgtttaattgctttgcatcaatcatccttatcctcttttccatcttgtaccttgagcggtatcttctaaaataatattacgttcttttaaatcgtcacgaatttgatcagacaatgcgaaatcgcgatttttacgagcttcaatgcgcttttggataagctcttcaatttctttatccagtaattcttcttttgataattctaatcctaaaatatcaaataacgtttccagttgttttacgtatgcttcaatcacaactttagatgtatgctcttcaagtaaatattgatttgcatgatttgctacgttgtataattcggtaattgcatttgcagtgttaaagtcatcattcattgcctcttcaaatgcagtctggaatttctctatttcagctaaccatttctcattatggtccgttaaatccgtactactctacatacgatgctttaagtttccata

SEQ ID NO: 1109 - DNA, 3888 bp, Bacillus thuringiensis
gcattttctccaaggtctacaattttcgctgctggtaatacatttaataatgccaagttaattaatacgtaagcagccgttacgattaaaatccctactgtcattgctttcggtaataactttgttggattcttcatttctccaccaatcgaagcaagtaaaatccagccgtcataagcaaataacgttgctaaaattgccataccgatactttgattttccgatatcggcacaactacgttaaaaatatcgctattccctttccagaaacctagcacaacaattaacacaatcggaatcatctttcccaaattgtcgtgattgtttgaacgatacctccgtattttgttcccatactatttacaacgccaaggaacacaaccgttccaattgcgattggtaaattccacactttatctaaatagaaaaaattaatcactaaagaactaaagtataaacctaatgttccgataatagcaggtccataaacaattgtttgcatccaacctgataaatatccccaaaaacttccgtaaatctcctctaaatacgtatacaacccaccatttttcgggatttgcgctccaatttcagctactgttaaaccacttgctagcgtcaacagaccaccaattacccaagcaagaatggccatattagaactccccgagtaatctaatacgctccctggtttcataaacacaccagatccaataatcgttcctactacgatagaaagtgctactgttaaaccaattttgttcttctcatcatgatgcatgctgcgtatcctccttccaatcctagtgtgatgcaaaaatgaaataaaaaaacactcctccctaaaaaagggacgagtgttgtattcgtggttccacccttgtttcaattcgtaaagtaacacacttcaccaatttctcaagtctaaataacggtttttgccggcaagcaattactagatgctcgttcactgctgcagttcagaggtggtaatctatttttccgtattaggaagctcacagccaaaggcttccctctctgagaatcgtaaaaaattgatcgtgtcctcatcatcacttcttgatgtcgaattttgtagttattgttcattatattgaattgttagaaaaaatcaatatattttttatataacataggaaatatttatcttcttatattataacagaagctgtaatatttctctaattccctcgtatctttggagcagtgtagctgtaaaaattatatcagcgatttttcaaatatatcgatttaccaacaaaaaacgccaacaataaaaggaggtctttcaaaagaaagcccccacacgaaagatacgacttcattcaattatttctcatcttttttcataaaaaacttatggtgcggtaaatcaacattcaatgcctctaattgtttcttttcattgtctaaaatcgcttttgcttttgtttttgttgcttcatctaatcctgcaaagatgtcttcatgcttctctttctctggaagtttcacacctaattttgttaattcttcttttgcttgctcatgcgttaattttccagatttcttttgctctaaaattgactttgcttttgcttttgcctgttcatctaagttagcaaacatgtctccatgtttacctttctccggcattttcacgcctagctttgttaattcctcttttgcttgctcatgcgttaattttccagatttcttttgctctaaaatcgacttcgctttctctttcgcctgctcatctaagttagcaaacatgtctccacgcttacctttctccggcatttttacgcctaactttgttaattcctcttttgcttgttcacgtgttagttttccggatttctcttgctctaaaattgacttcgctttttctttcgcctgttcatctaatcctgcaaacatgtctttacgcttctctttctccggaagctttacacctagttcctgtaactgtttctttgtatcgtccataatcgtttttactttttgttttgtagcgtcatctaaatcttttttcactgtttttgtcgcttgctcagctgttggagtatttgttgccgcgaatgccggaacaccgactcctccaatgattccgaatgataaagcacctgcaatcgctaaataaccaactgttttcttcttcataggaaatttcctccttcatatttctaaagcatgtacactttcgtatacaacgccaatagtaatattggtttcttaaaatttccttaacgattcaaataaaaaacaccgctcgtaatgagcggtgtttctctatgctttttgtaattgtaactcttcacgttccattatttttcttaatacaattgtttgtgtcattgtaaataagttacctgttatccagtacaacacaagtcctgatggcgccgcaaaccccataaatagaatcattgctggcatcataatttgctgcatctttagcatctgtacttgttctccaggtgtaatattcgattggaaaactttcatctgaataaatgtcgttaacgctgcaataatcggtaatatatgatatggatctgcatgtcctaggttcacccataaaaacgaagatgtgcgaatctcttccgttctgctaatcgcataatacaaagcagagaaaatcggcatttgtataaaaattggccagcaaccagcaagtggattccaaccgcctgatttcattagttctgacatttctttttgatactgcttttgtttttcaaggtctttgcttacatcaccgtattttttctttagcttctgcaattcaggttgcattttcttcattttcgcttggctgcgatattgcgaaacagctaatggaatcatggctgaacgaataacgagcgtcataataatgatagcaaccccgaagctagctcccggtatatgatgagcaacaaattgaatcatatacgagattggatatacgaaataatggttccatattcccgtactatgtgaatcaattgtgcctgcattactgcagccggataaaacaaaaacaagtactactgataaactaatgagcgcagctcggtatgattttaacatgttcattcctccaatgtttcgtaattatttagcgaaacattggtgtatacggaccaacctcatcattctcttcacttgattcttgtctgcgtacggaacgaatcattccatatttataaaaaattgaaaatagcggtacatttcccgcactatcttcacatgtatcaactaacgcaaaagctctttgtctaccgcttgatgcttgttgacgcacaaagcgagaaacattagcaaggaagaaaacttctaataagcaaagtgctgtcgttacaaacgatatatatagaattgcatcctgcaataaaaattccatcgcttcacatccttaataaggtcattttagcacatcgggcaaatattctctatttccttttattttcaaaaaaagtattttgcatattttctcaagaaaacaataattaagaaacgttgtattcgctttctttagcatattcacacacatcaatgaataggcttgatttattagaaatttataaaatttttgcattataataaaactattgccagtttttgaaaaaacctttattctcttcttgtaatcaaaaatgaatatggagatgaaacatactatgggtcaactaggagacgccgattacgttcccgacaccgcctttttatccttcccagcagctaaaacatttcacttagaatttatgatacagttggttgttatttttatagcttctattttgtatgcaatttctatgaatatgttttttatcccgcataatatgattagcggtggattcgctggtgtagggatgattatcagatatttaatgcactaca

SEQ ID NO: 1110 - DNA, 3524 bp, Bacillus thuringiensis
agcttcgtttgttattctgtttagttttcctttatcaattttttctccgttttggctttgactaacatttactgttgagccttcaatgcttaattctgcattaacaggattttttaatgtttcattatatttatcttttataaaggtttcataagctgttgcatttaattgtggtgttaatttatagtcacgttttaattcaccgttttcagcttgcttgcgcattttgtaacgattcattacgtttccttcttgttctttgaagattttgtcaataatatctttctctttataatttacccctaaatctttccatgtgtaagtttgtttatcgttttggaatatgtaggtaagggatttttgatctaattcagttaccctttgattaataatggcttgaatatctttcttattttttccatcgagagaaataccttcaaatgtagtatttggtaatgcagtactatctaattgattatttaatttggatacatattgatatcccccaacaccgcctacacaaagtaatatgcccccagcaattgcagaaccaatcagtattttacttagcttcatttatttccccccagaaatttatgtataaatatatgtattacattttttgtataaaaatgatgaaaataacattatgtacgtactagtatactattattttcactgtgtgtgtaattttttcataaaaaatgttacatcgctgtaataattgtcacttcttgtcacaatgtgtatgaaaaatatgttgaaaaatataataaaaaggctgtctagaatgatctagcagcctttttattataattttttatgttcatttttattcgtaacaccgagatgtttttgaagggtagttgaaatagtatcgacgcttttttcatttggcacgtaataataaataccacctatatatttatctgtaccttctacttgcattttttccatctttaaatttgaatccattgaattttttgtaattgtcatcatatcatcaaaagttaaattggtttttaagtctttatcgacagcgtctagtaggccaccgattttattaatggaattaagagatagtgccttttcagcaatggcctctaatacaagctgttgtcgttggccacgcatataatcactatcgatgtgacgagttctagctagtgccagtgcctcttctccatttaaatgttgacgtcctttttttagatgaattgcatctgcttcatctttactattttgctctgtgaattcaactggaacgtccacagtaatgccaccaagagaatcaacaattttaataaaggatttaaaattgaattttacataataatcaactggaacatctaaaaagttctctaccgtatcaattgtgctgtctacaccaccgaatacgtgcgcatgtgtgattttatcgtatttatcacgtgatttaatgtagacgcgtgagtcacgtggaatgcttacaagtttaacggatttatcgtttttattaattgttgcaagtaataacgcatctgttcgagttgcttttccataatctttttccctaatatcactttcatcaacacccataattagtacggaaatgttgtcggtcataggtttaacagctttttcacgtttactggacttttctcctcgacctagttcagcataagcattatttaagacggactttgctttactgtatatatggaaggagtagcctcctgctccaagtgctacaattagtaatggaataagaaggaaccaaagtaggcgttttttctttgagcgtccttttttggctcgcgtatcgttgttcgtgtcggatttcatcattttttctcctttaaaactatcaaagtgtatacatttagaagtgtattcaaacacataaaaaatattttacgctaaataaaagcgattgtacatgtataaaaaatagatgtcttgattatttatccggtattaacgagcagtaaaacgcccacctcaaagtccagtgaatacaatgaagttaggtgggagataactgcccgtaaatacccgattgatgaaggctaataatcagagtggggatagccccactctgattaaagtttcactttataagacacctattcgttattgtatacaaaagatagggataagaaaatgataaaattttacctaattacaacataatgcttacgataattgcagataaaatactaacgagagtagctccatatagtaatttaaggccaaacctcgcaacaacgtttccttgttcttcgtttagtccttttaccgcacctgaaataataccaatggaagagaaattggcaaaagatacaaggaaaacagaaataataccaactgtacggggagaaaggctattagaaattttactaaggtccatcattgcgacaaattcattcgttacaagcttcgttgccataatgctaccagctgctacaatttcagagcttggtacaccgataaggaatgcgataggtgcaaatacgtagccaattaattgttggaacgtaataccgaatataatgaggaacaagtcattaatacaactaattaatgcgacaaatccgatgagcatagcgccgacaacaatggctacacgaaaaccatcaagaatatattctccaagcatttcaaaaaagctttgtttttcacctttgatttctaaaatatcttcgtcatctttaacgtcgtaagggttaatgatgagtacgataataaaaccgctaaataaattgagaacgagtgcagttactacatatttaggttcaatcattgtcatataggcacctacgatagacatagatacggttgacatagcggaggcacaaagtgtataaagacggtgttttggaatttgagctaattgttttttcactgtaataaaaacttctgattggccgacaatggcagaggcgatagcgttgtaagattctaatttcccaagaccatttattttactaagaaagtacccgatccaatgaataaaaaatggtagtattttgaaatgttgtaatataccaattaaaacagaaataaagacgattggtaataatacagtaaggaaaaatggcatttcacctttatttgcaagaccaccaaatacaaaatttactccatcagcagcatactcgagtagctttgtaaacaaactggaaatgattctaataagtatgaggccgatttctgtatttaatagtaaataggttaaaattaactgtataataagcatgataaaaattggtttaaatttaatatgcttcttattattgctagcaatataagcgagcaagaaaacaataattaatccgacgaaaaaagtaatgaatttcatggtaagcccccatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcaaatggaagaact

SEQ ID NO: 1111 - DNA, 3410 bp, Bacillus thuringiensis
tatatacggtgaggaaaaatgtaatctgtttgttttgtatagaattaatccaggaaatatagttaccatgtaacgcatcgtgaataagggttacatattggagggatgaatctttgcaaaaaaacgatcgcagccatataaaagcttatgctttaatgtcaggtattcttgctcaattagtcggttctattcttgttggaatctttggtgggcagtggattgataataaggttggaacgtttccgttgtttcttattatagggttattactcggactaggaacaggggtatacgcaatgattcgactcattcgacattactattcgggagagcaatgatgatagacgtacatggacttgtccaaagacaaaagaaatatatgtactacttgcttgcgcttctagtgctaggatggggatttacctcttacaaggatgtatttcttggactgattatcgggacgattttcagttttcttagtttgcgcatcattgcacgtagaacagacaagctgctagatcgcgtaacaaatggagaaaacgtgaagttcaaggcaacagcggtaagtacatattcaagattcgccacgattgggttattaattttatttgcagccaaatatcaagagttaatcgcgatgtggggcctaggtgtaggattgctgacaggataccttgtcatgatcatagattttctttatttagagtataagagcagggaagagaggtgaattactagtggaacacggtaaattagttgaatttctaggtttaacgttcgatttgtcatcagttatgatggttactgtagcagcagttattgttttcttaatcgctgttatcggaactcgcagcttagctcttcgcccaaccgggatgcaaaacttcatggaatgggtgtttgacttcgtgaaagggattatcaatagtacgatggactggaaaacaggtggacgtttcttaacgcttggcgttacgcttatcatgtttatcatcgtatcgaacttccttggtttaccattcatgtattcagcaactgaagctggcgaacatattgcatggtggagatcaccaacgtctgatccagcagttacattaacattagccgtgatggtagttaccctcacccattattatggaattaagatgaagggtacgaaagagtacgtaaaaggttatttccaacctatgaaattcttattcccattaaaggttattgaggagtttgctaacacattaacgttaggtcttcgtttatttggtaacatttatgcaggtgagatcttattaggattacttgctaagttgggcggagcatcagtccttggggcattaggtgcgcttgtaccaatgttagcatggatgggattcagtgtattcgttggttcaatccaggcatttattttcgttatgttaacgatggtttatatggctcataaagtaagccatgaccattaatataatttaagtaagaaaaaatttatttttttataatacaaaggaggacaaattaaatgagtttaggtgtaatcgcagctgcaattgcaattggtttatcagcattaggtgcaggtattggtaacggtcttatcgtatcacgtacaatcgaaggtgttgctcgtcaaccagaattaaaaggcgcacttcaaacaattatgttcatcggggttgctttagttgaggcacttccaatcatcggtgtagttattgcattcatcgtaatgaacaaataagggagactccccttacatagatggcgaagagtgtttttccgaactttcttcgccattgctttatgaatgaaacgtatgtctttttttttcatatgatcaatttagatattttgaagggagtgaatccttgtgccaactttattattaggtgctgccattccatttggaacgattgcttatacattgttcattttcttacttctattagtaatgctacgcaaatttgcgtggggtcctttaatgggaattatgaaagaacgtgaagagcatgttactaatgaaatcgacgctgcagaaagaagtaatgctgaggcgaagaagttagtagaagaacaacgtgaaatgttaaaacaatcacgtgttgaagcacaagagttaatcgaaagagcgaaaaagcaagctgtagatcaaaaagatgttattgttgctgctgcgaaagaagaagcagaatcaattaaagcatctgctgtacaagaaattcaacgcgaaaaagagcaagcaattgctgctttacaagaacaagttgcttctttatctgttcaaattgcttctaaagtaattgaaaaagaattaaaagaagaagatcaagtgaagttaattcgcgattatattaaagaagtaggagaagcgcgatgagcaatgggattgtagcaaaacgttatgctgtcgctctttttaaaattgctaaagaaaaacacgtattagaaatgtttgaagaggaattacgccttgtacaaaacgtttatgtaaagaacggagaactacatagctttttaacgcaaccgaacatttcaaaggaacaaaagaaaacgtttcttgcaaacgtattcggatctgtttctgaatctattttaaatacgttatatattttaattgataacaaacgcattgatatcttacctgaaattgcagatgaatatgttgttcttgctaatgaagaacgtaacgtagcggatgcaactgtatattctactcgtcttctatcagaagaagagaagcttaacattgctgaagcatttgcaaagagaacgggaaaagatgcaattcgcgtgaaaaatgttgtagatgaagatttactaggcggaattaaagtacgtattggaaatcgcatttatgacggaagtttacaaggaaaattagcacgtattcagcgtgaattaatgaagaatagataggggtgaagcacatgagcatcagagctgaagaaattagcgcactgataaagcaacaaatcgagaactatcagtctgaaatcgaagttagtgatgttggtacagttatccaagttggtgacggtatcgcgcgtgctcatggtcttgataacgtaatggctggtgaacttgtagagttctctaacggcgttatgggactagcacaaaacttagaggaaaacaacgtaggtattatcattttaggaccttacacagaaattcgtgaaggtgacgaagttcgtcgtactggtcgcatcatgcaagtaccggtaggaaaagaactaattggtcgtgttgtaaacccattaggtcaaccagttgatggtttaggcccaatcaatacaacaaacactcgtccaatcgaaagtccagcaccaggtgtaatggatcgtaaatctgttcatgagccacttcaaacaggtattaaagcgatcgatgctcttgtaccaattggccgtggtcaacgt

SEQ ID NO: 1112 - DNA, 3647 bp, Bacillus thuringiensis
  unsure (1)...(3647): unsure at all n locations
caaatatttcttttttttattggtgcaatttatgcaatggggcagacaaaaagaacgaaagataatatgccgttacctttagcaattcgtcttattcttagtgtttctttaacaggtagtgcaatttgcatatggttacaagatccatctgtagagtatagtacgtgggttgcacttggtatgactttatcgactgtgggagatttgtttatggctgggctgattccaattggtcatcgattaattggagggatggttactttcgctcttgctcattgtttttatgtaaaagcatttttgcaaacaggaatttcatggaatggtttttggattggcttactcgtatatgggctctttctaattgtaggatggttcttctttatccgaaatgataaacaggataagttgtttacgataggagctctaatttacggattgtgggttggaggaatggcttgctttgcattcgccttatcttatgaaaatacagggatatggtggataccagcgtttggtggcttactgtttgtaatttctgatttcattattggcgtgacagatatcggagggcgtaaattgaagtatgagccactttggatttggcttacatatgtagctgctcaaatgtgtattgtatatgtgggattataaaaagatactctcaaaaatagtggatagactattttgagagtatcttttttgcttgttaatttgatcagtatttttattgtgaaatttctaatattataattttacaattcagaattttgtagaaaatcaccggtcgcattatttataataaaagtaaaaagatgatgagttggtgaaatgatgcaaaagaaaaaacgtgggcgtgaattctttggaactattgcaattgcatgtttattggtgtttttggcgaaaatttttgtgttttttccgacgactgtaaaaggagcatctatgaggccaacgctgcaagatggagatagggtgattgttaataagttagcaaaacaatttgaaattttatgggagagaagatattattgttgtgaaaacagataatttttatgtcaaaagagtgattggattgcctggagatataattgagatgagaaatgatcaattatatgtaaattctgaaatgaaagatgaagagtatttggatagtaataaaaaacaagcagaaaaaaaacttatgaatttaacagaggactttggaccgattacagttcctaaaaataagatttttgttatgggagataatcgcttaataagtaaagatagtagaaatggtttaggttttattgatagnagaagatgtgagggaaagttagcaggcatttattatccgtttgaacatatgaaaataataaagtaaaaaaaccaagcaaattttagtttgcttggtttttttgttaaacagtaggagattcgtttgatacaaagatatcttcatgtttctttgtagtacttaaaacaaatttatgttgtagtaattgtagtttaaataacgccaaaggatcatgatatgtttctggattgcttcttagcgtcgctaatgtttgctcgtcttcctgtatctcaagttgagctgcatctacattttgtttcaatatattaagtggatctttgaagaacatcatgatatcacgttctaatgcaccttcaaatacttcaaattgaaggaagaattgtttggaaattgtgtgagcaatttctgtatagtcttctgtttcaatatattgtttatatttgttggcgagcatagattggtttttttgcatattaccaaataattttccggcactttttaagaaaaactgtgtcggtgtaaagcgtaataaaatattgatgttcgttactgtaattcgatttgtcattcgtgcaacatctcgattccaatcatctaataatttgaaatcgcaaggaagtttcatacgttcttctttatataatttattaaacgtttcactcatttcatctaaataagcttgagcttgaataaattcattatgtgctgtttcaatccattcttgaatagacccagtaaatttaggaagaagtacctgttgtacatgcttttgaacacgttcattcattgcagcatttaattcttcatgaactagtttgaaatcactatcttcttgaacaagatcagagcaactctgtaataattcaggaatttgagaatgtatatctcgtgtaatttcttctttcgttaaaagataggattcggtaatagagcgaattttatctttttcaagagcagtaaggttattaataaatccagtaagtttcactgagatgtgtttattccagcgtacggattttactaatgtattttctaattccacacgttcatttatgagataagcaattgtcttttgtgtaaaccatattagcttttctatacgttctttttctatatcgcgttttgcaagattagagagaatagattctgttacatctccaagttgctggctactctcttgcgaaggagagtatgggaagaattgtgcatctggaaaatgtactttaagtttactaattagtttttcattagtagtcgtattatttgtgtgtaatacgaagtgaatttgtaagtttggtacttgttcacgtaaataaattaatgtatcaatttctttactatgcaatggtgaagaagaatttaatacgtaaacaagactatctgctgcttgtaagtattcaaagtatgcattgtttttatccaattgctcttgaatggatggtgtaagaagaaatgtaaacttattttttcttaaaaacctacttggtagcttaatttctatacattttttctcaagttctgactgagcagatgtagccgttatttgatggaattcatcaaggttagggatatttcgtatatctaactcggtaaattctgttatttcagtttgactagcgtctttaaatagaataggagttgttaaagtttcagttaagatgttctctcccaatattgaattaacaaatgatgttttatcatggtcactagttccagctattagtagtggtgtgacatttaaatcacatagttcatggactagtagcgtaaattgatgacttaaatctacatcatttttctcagcccatacagcgattgtttcgaataaatgagaaactgtttccatatttacatctgcttcagctgatgtattagaaagtaaggatccagcactttttacgagtaatgattctaaagttgtaggtgagacttcattccatgctaacactgctgcagagacaactagagaatcttttgctttcgttaaactaaaccaatttgttaataaatttggtacaagtccgtttaattcatgcataaaatgatttccggtaattaatgcaaagtatgtttcttgatagcgagtagaaatttcattccaatcgtcattattgtctgtttcaatatgcaagaataaatgattaatactttgaatccaaggaaggtataaggattcatgttgatagctattccaaagagcaataacaagctctttaaattgagcttgatcaacagcatatagagcttttaaagactcatagaaatattcaggcttaatattttttgtaaatcctttgtaaatgtaatttattaacgtatcaaaccagtgtaaagattgtgttgaaat

SEQ ID NO: 1113 - DNA, 4029 bp, Bacillus thuringiensis
attgcaaaatcggccgtttcgaagctatgaagttaaaatcacagttcgttaagaaggcgtaagtaaatagaagaggaggcgaatagccccctctttttattatgtcactttttgtcggtaaatcgatatttcgtacaaaatcgttgatatattctgagttatgatagatatatttgcaaaatcgttgatatattgcaagttatgatagatatattgaaaaaatcgttaatataatttcactcaccgagaacgatgcatcatttactgagcgaaagttacgatttacctcgcatcatagtcaacctctttcaactgacatcgcttattaaagaacgttttatatccaagctgtaaaaagataatgacagcaaaggcagtacttccagaaataccgagtatgatggcgatttgatattgaatggctgtgaatggtgatacaccggataatatttgaccagtcatcatgcctggtaagcttataattcccattccgaccatagaattaattgttggtaaaatagcagagtcaaaagcgtctcgaatgagcggagcagctgcttctttcggtgttgcgccgagcataagtgcaccttcaatttgacctctttgcgatttcatattgtttaagaacgtatttgcaccaagagaaacaccagtcatggcattcccaactaacattcctgtaatagggacgatatattgcggagcataccaagggtcatgaccgataataacaaagataaatagtagaagtggtccaattgatccggcgatcatggaaagggcggctactcgttttaattctttagacattgggatgttaacccgtttataaatattaaaaattgcaaaggtagtaatagaagtgatgagagcgattgtataaaatggattactgttttcaaatacgtatgtaaggacatatgcaacaagtacgagctgaatcgtcatacggaatgttgcgagcgcgatttgtttttcgcgaggtattccttttaattttacaagtccaattaaaataagaatgaaaatataggcagctgcaagttgccaaatttggagttcaataacgcccttcaactgagagcacttcctttctagttgcaccctttgttttgctaatttcaataatatcgtctgcaatttcttctggaagttgttgcgagtgtgtgatgaagataactgtttttttcttttttcgtgctagttcagtaaattgtttcataacgcggcgttctgtatcactgtctaatgctgaagtgggttcatctaataaatagacaggcggatccataagtacgatacgtgcaaaggcaagtctttgtttttcaccgccggataatgaggaggtgctatcttctaattgcttgtctaagctaacggtttgtaatgcactccgcagggcatcatcatttggaaatggtttttcagaaagacgaagtcccattaataggttgtctttaacggttccatcaaaaataggtggagtttgcccaagcataactacgtcacgacgtaattgaatagggtaataatcagaaattaactttccgttatattcaattgtaccggatgttggggattgtaaatcatttaacatgcgaagtaatgtgctttttccgcttccgctttcaccgataatacaagtaatcttttctttttgaatctgtaaataaggaatgtgtagtatatctttatatataacgtcttttaatataaacataaatcgctcctttctgattctagttatatcgtatcaaaaaaagaggggaaaatggttataacgaacaacgttttttcttcgtcttgagttttattaataagttaagtaaacgatctaattcttggctgaaagaaatcactttatcatgagtgaatccgtatcgttcaacgagatagattagctctttctttttcgcttctattcgattgtttagtttcgataagttcataagtggaatgtaatgcctcctacaaaagtatttatcacatgaaaaataagaccgaatgaactcggtcttaaaggaagtaataaaacaacttacaaatagcatacaatgtttatcaatattttttaatataaaaatgaaaaataaatcattataaatattgagaaagatgtgtctgataatttttaaaaactgatgcaaagaggctgcctacatagtagacagcctgtaaagtattaacctttatgatatttgtacatccaaagaagaccagattttaataatctcggtacacgtcccattaatggttggtttgctagtaaaccaaagccgtgcttcttaccaagagatcctagaacaccttttaatttaataacaggtagttcatccgggagtggttcattattccaacgttttaataatatttggacaatttgttctccttgaccttcagccagttgggcagatggtgcatgtggaagtgctgcgcaatctcctacaacgtaaacatgatcgttatttggaatattatgatatttagttaagacaacccgtccgctaccatcttgttcaactggaaggtttcgaacaacttcatttgcttgaataccagctgtccagacgattgcatcacattcaagtggttcatcgtggttgtacacaatatttggttctacttttgtaatgttagagtttcgtataatgttaactttatgctttacaaaccattcttctacgtatctacttaatttctctggatatgggaataaaattctatcttttcgatcaaataaatagatttttaaatcagaacggctttcacgaagttcacttgctacttcaacgccacttaagccagcaccaacgacagctactgttgcatttggttctagactatttaattgttcatatgtcttacgtgtttgttcaattgattgtagactatgtgtatattctctagctccaggaacgttatgatatttatcttcacagccaagtccgataattaaatcatcatattggatcgcttcgccgccatcaagatgaacagctttttcttcgaggtcaatatttgttactgtgccgtattgaatattgaggcgtgggtgttcaggaaacggtatacgaatatgcgtttctgaaatagtacccgcaactaatgcataatattcagttttgaagcaatgatatggtactttgtcgattaatgtcacttgtacatcatctggaagttggttgcttggaagtagcctttgcagaattctcattccaccgtagcccccacctagtattacgaggtgtttcatgatggattaccccttttctgttgaaatatcccctaatcataaaattttatattaataaaatattttgactttactcaatcaaattatatcgaatttgtgaacaaataacaatgcatgaatgaatactctgttgtacaataagaagaaaagtaaactgtttttctttttaagttactctttcattgtaagtagcatgttatatagaagaaatcatctactttgaagtgaagtaatgaagtaactaaatagtttagactgtgtaacgaaaacaacaagaaacagcttagttttcttcttatagataaagtgaaaaggtaatttgttttgtagtacaggggggagaattttgattaaaccattaattgaattttgtgtaggtaaccttgcaagtggttcacaagcagctgtagaaaaattagaaaaagatccgaatttagatgtaatggagtatggttgtttaggatattgtggcatttgttttgaaggaccatttgcacttgtaaatggtgaagttgtacaaggtgcaacagtagaagagcttgttaataatgtatatgagtatttggatgaaaatccaatgttttaaggtgttgcgaattagcagcacctttttcattagataaaactttatttcgtggggaagactaatactgagtattagtcttccccaatcgaaaatagtaggataaataaaaaaaggccctttttagaagggcttttttcttacacaaattgtgtaagagtggctcatcgccaaacgttgtcaaatatga

SEQ ID NO: 1114 - DNA, 4040 bp, Bacillus thuringiensis
aaaacgtatgcgccgtggtgcaattgactttgactttaaagaagcgaaagtattagtggatgaagaaggaaaaccgactgatgttgttatgcgtgatcgttctgtttcagagaagttaattgaagaatttatgcttgttgcgaatgaaacagtagcagagcacttccactggatgaacgtaccgtttatgtaccgtgtccatgaagatccgaaagaagataagcttgagcgtttcttcgagtttgtaacgaacttcggatatgcggtaaaaggacgtgcgaatgaagtgcaccctcgtgcgctgcaacaaattcttgaaatggttcaaggacagccagaagaagtagttatttcaacagttatgcttcgttctatgaagcaagctcgttacgatgcggatagtttaggacatttcggtttatcaactgagttctacacacacttcacatcaccaattcgtcgttacccagatacaatcgttcatagattaattcgtgaatacattattaatggtaaagtcgacaatgaaacgcaagcaaaatggcgtgaaaaattacctgagattgcagagcactcttctaatatggaacgccgtgctgttgaagcagagcgtgaaacagatgagatgaaaaaagcagagtatatggttgataagatcggtgaagagtatgacggtatgattagttctgtaacaaacttcggtttattcgtagagcttccaaatacaattgaaggtcttgtacacgttagctacttaacggatgattactaccgttatgacgagcaacatttcgctatgatcggagaacgtacaggaaacgtattccgcatcggtgatgaaattacaattcgcgttattaacgtaaacaaagacgagcgtgcaatcgactttgaaatcgttggcatgaaaggcacacctcgccgtaagttcaaagatcgtccagtcgttatcgaacagccaagaacaggcagaaagaaacgcggtggacgtagcgagcgcagtagcgagcgcagtaatgagcgcggcggtgaacgtggcacaggtagaaaatttgaccgtggtggcaaaggaaaaggaagaggatctgcatctgcatccgcttctgctagccagccaggaaaaaaagatggtaacggtaagaagaaaaaagcattcttcgaaaacgtaccaggattcaagaagaaaaagaaaaagcgtaagtaagaaaagagtggcttcgctttgatgaaaagcggggccgttttcttttttcttcgtggcttgagagcgagccactttcgctttttattaacatttgttacaatagtaaaaatagaggagggacgttatatgccaaagggtacaggtaaggttattgcacagaataaaaaagcatttcatgattatttcatcgaagaaacatacgaagcagggcttgtccttcaaggaacggaaattaagtcaattcgcgctggacgcgtaaacttgaaagatgcgtttgcacgtgtacataatggtgaagtatgggttcataatatgcacattaatacgtacgaacaagggaatcgtttcaaccatgatccacttcgtacgagaaaattacttctgcataaaaaagaaattgataagctagcgggcgctgcgaaagaaacaggttacgcattagttccacttagaatttatttgaaaaatggatttgcaaagatggcacttggtttagcaaaaggtaaaaagcaatacgataaacgtcacgatttaaaagagaaagaagctaaacgtgaaattgcacgcgcgttccgtgatcgccaaaagatgtaatacagatatttacatttgtaaaatggagcgcgtatgttataataacttatgtaagattgttgcacattgaaaaacagctcttagtagctatcacgatattttcttcgtatgctccatttttatcatggggacgttacggattcgacagggatagttcgagcttaggttgcgagtcgaggggatcggcctcgttaaaacgtcaaagcctataattggcaaacaaaacaatctttctttagctgcttaattgcactaaaggttcctccctccatcgtccatgtggtagggtaagggactcaaactaagtggactacgccggagttcgccgtctgaggacaaaggaagagaacaaccagactagcaacttggaagcctgtcgataggccgaagagttcgcgaaatgctaatatatcgactacactcgtagaagcttaagtgccgatatttttggacgtgggttcgactcccaccgtctccaccaatacatatttggtggtttttttattttttataacaggaagcataagatggccgttttggtcaacttatgcttcttttagtttacggccaacttatgcttccaggatttgaagaatatttttaatgtcgcctttaaataaagtcgcgacttttagggatagcatcacatcatcatcaatctaagaatagcaaataccccaaaacgaaaaaaatgtacatttttttcgttttggggcgttataaaatccttaagttgatgggcatatggcgactcatttctagaattgttttcatgtgtcaatgatagaaatatatttttaattatggctacttttcaactagtacgatatcatcaagataggcatcaccgatgttaacatatccattaatttgtaagatgaccttatatggattattagtatttagagtagtaaattcaaccgatttttgttcatactgtgtggaagtaaacgtcataacaaatgtgttttctcccccaggagactgtgctcctacaaataaggttttttcaggacccgatacttttccagatgcggacatgatgtatgtagtattaggcttcaaagttacgtctcccttaagatgaccagctcctgaactaaaatgaagtcctttagaattatttactcctgcatgctcttcaatattgtaaattaaagagccatatgctggtttaaaaggttctaaacttgaattgtggtcaaaatcaatatttaaaatataagggttctccttctcatttaattgtacattatcaaacttaaccctcccatttgctgtagaagcaagtttgacagcaaagtttgacacatcttcccctgttttaaacttcatctcatgatgttccggcttaaatcctgaatattgcttttttgttaatggaatgatttcttgatgggcattcagattacctactgttacttctgatggagaacctatacttcccgctatatcaaatgttaatgtatattctgtattcggctttacagtaacaggctgataggctgtgtcggcatgtattaatttgagataatgattgcctggttcagaagtgccgatattctcggtagaagaattaggattagataaaatccagttatttagcccatcctcaaaatctccattcttaacttgttcatttgcagatgaactatctgctgatacaatacctgaaaaacctatactggcacttaatacaattgctgtagaaaagactcctataccgactttttttaacaatctcttcatctcctttggtcagattaaaatttactttttcatatttctatatatgtttggataaacctgacaaagaaccattttaacaataaataaattatgtatccgagatttaggttattttcatttgaaggagtagagggagcaaccgtgctgtgaagtgcaaagtagctccatctatccctaaatggtcctcttccacccaaaaacaaggagaacttttttattgctcaagtattaggggtcaccatacatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacaaaagttttcaggaaatgaagtagcgtccatagtgtatctgggg

SEQ ID NO: 1115 - DNA, 4368 bp, Bacillus thuringiensis
tttagaatatattgattcattatcgttacgtcaaaatgttcaaaaatcactaaatcgtggagaaagctatcataaattacgtcgatcagtatcctatgcaaactttgggaaacttcgtttcaagactgaaacaagatcagcacatctggaatgaatgtagtaggctgctcagcaactgtgttgtttattacaatgcgagtatattatcgaatttattaataaaatccaaagatacagggtttgagatgaaaatgttacagtatatttcaccaattgcatggcaacatattaatttttatggtcgttatgaatttagtaaatccccaacagtagtaaatatagaggaaattcttgagagtatcaataaagatgatattctcaccagcttaacacgagaagactccttggaagaataaagtattgttgtccttattcccccttttcggggggatgggcaaaaacaccctactcctaaattccaatcacttacaaaaatcctggataataaaaaatggacaaagctacgaaagttagcacaagagaaagaggtaacgccttccgctctactttgtacaatatatggtgatgtgttggcatattggagtaatcaacgtcgattagcaattaacttgactgtatttaaccgttatcctgttcatgatgaagtagaacagattgttggagatttcacatcacttattttattggatgttgatgtaaaaccagagcaaactttctttactagagtaaaagaaacgcaagctactttattagatggccttgaacatcgtcattacgatggagttaactttattcgagattttactcgatatcatcagatgacgccaaaagcagttatgccaatcgttttcacctcgatgttagcaggtgcaggtgctttctcttgggaacaacttggttctcttcgctatattcatgctcggactccacaagtgtatttggataatgtagtaattgaaaaaaatggagagttattaattagctggaactatgttgaagagttgtttgatgttgatgtaatagaagcaatgttttcccaatttgttgacttattggaacaattggtgaaacaaagcgatataacatctttgcatatgaaagaatcggatcaaactctaattaagcaatacaatgaaacaacagaaaaaataccttcaactactctgtatcaattatttacagaccaagtaaaacgtacgccggatgaagtagcagtggtatttgaacaagaatggttaacatactcggaacttcataaacgttctaatcaaattgcccacttcttaaaagagcaaggtattggtctaggtgacaaagtgggtcttttagcaaaaaggcgagttgacacaattgttaatatgttaggtattttaaaatcaggtgccgcttatgttccgattgatcccgatcatcctttagatcgccaaacatatattttaaaaaatagctcatgcaagcttttattagaacctagtctttatgaagaaaatcatttgtcattttatacaacagaagatatgcccgctattgctggtccagaagatattgcctatattatatacacttcaggaagtacaggaaaaccaaaaggagtaattattacttaccaagcggttacaaatactattcaagacataaatcaaaaatatgaggtgaatgaagatgatcgtattattggtatctcttccatgtgtttggacctatctgtatacgatattttcggagctttaagcacaggtgcaatgttagtaatgattcgtgcatccagagacatgcatgaattaatccgcactgtcgaacgtagagggattacattttggaatacagtgcctgcaatcatggatttggcattggagcaagtaggttctcattttgaatatccttctttacgtttagttttacatagtggagattggattccgctttctttaccagaaaaaataaaacgacattttccgattgcagaagtagtctcactaggaggggcaacagaagcatcgatttggtcaatttattatccgatcaaacaggtggcatcacattggaatagtattccatacgggatgcccttggcaaaccaaacgtattatgtgttgaactatgaaaagaaaatgtgccctgttggtgtaattggagatttatatatcgggggagtgggccttgctaaaggatatgtaaatgataaaaagaaaacaaatgaagcgtttgtgtcacatcctgattttggtcttatatataaaacaggagattgtggaaaaatgcattctgagggatatattgaatttttaggccgccaagattaccaagtgaaaattcagggatatcgagtagagttagaagaaatctctcattgtcttctaacttataaacaagtcgaacatgctgtcgtaattgatcaaacagatgagaacggaataaaatttttagttgcatatgtggtaactgagcaaaatattagtacaacagaactacgaaagcatttgcgagatcacttgccagattatatgattccttcttattttgtttatttggaccaattacccctgactccaaacgggaaattagatagaaaagcgctccctactccggagaaacaaaaaaataaagtatttattgccccaaaaactgaaatggaaaaaatattaactagtatttggcaagaagtactcaaaatagatcaagttggagtaaatgatcatttcttcgccttaggtggagattcgataaaagcgattcaagtgtccgtcagactgtatcgacaaggattcgagcttgaaccaaaaaatatattttcatttcctatattaagggacatggttcaatttgttaaaaagctagaccagttttcaagttcacaaacaaatgatgtaaacataatgaacgataataaagctacattactaaatgttaaagataaacaacttaatcaacatacacttaacaaaatacaagaaaaaatgccggatataaaaatagaacgtatttacccgttagcacctttccaggaagttatttatgagcatgctacgaatgaacctgatacaaatgcatattttgaacaaacaatttgggcacttgagggggagctggatattaaactctttattcagtgtttccaacaattagttgatcgtcatgattctttaagaacaataattgtgcaagatgaacaagcaaaaccttggcaagctgttctatatgatgttcaaataaattcagaaataaaaaacttgattgagatgacgaaacaagaacagcaagaattcctaaaacagtggatgaatgaaaatttaagtcgaggatttaaaaatgatgaacttatgacacgtctctgtatattccaactaggtaataacgagcataaagtaatttggagttcccatcatctattatgtgatggttggagcgtcagcattttgatagacgaattattccagctctacgaaactacaaatgccggaactacggcggggttacccatggtaaaaccttttgaaacatttatagattggactttggcacaagatcatgagaaagcacgtcatttttggcgagattatttatcaggatacaatcagaaaattagtattcctaaaaagaaagtcccatctaaaagtgaagggttaaacttcacttttatggatttaacattagacaaggatttgactgatcagttacagacatttgtaactaaaaataatataactatgaatacggcattactagctgtatggggaatattgcttggcaaattcaacggaacgagagaagtagtattgcctaatctagtatcagtcagacctcccgaagtagaaggaattgaaaatatgttcggtctgttcacaaatgttttgcctatccgattagcatggacagaaacgcaatcttttgtggacttcctgcaaaaggtacaactagagacattgaaatgtaatgagtatgcatactattcatttgttgatatacaaaagcaaagtgaattaaaaactgagttgactgaccatctttgggtttttgaaaactatccaactaatccagcaatcttttcttcaaatgaaaacagacattttgctatcacggattacgaagttgttgatgagccacatgtaaagtatggaattatgtgcttccctgaagaaagacttacaataaagtttggatatgatcaaacggtatatgaagcagagaaaatacaggaaatattaaatcacatccatgggttaatcaacacgattcttcaaaatccaatacaaacaatttgtgattacaaattataaaaaatgaaaaggcgagcaagaactcgcctttttaaatagaataggagtaaatcaaatgacaaaaaattac

SEQ ID NO: 1116 - DNA, 5677 bp, Bacillus thuringiensis
gaaccaaaaaccaagatgcaaatgtatgcaccttgttaagatttttatttagctttcaatcgaataggtaagtattttaatgtttgttcattttccaatatacatttttctaaacagaaagatggagatagctctattttttcaaaagcatttataaaggtagttaatgcaatctcagcctctaaacgtgcaagtggtgctcctaagcaaaagtgaggacctttcccaaaggttaaatgcttttcatttcctgttcgatgtacattaaattgagaggcttgtgaaaattttttctcgtctaaattcgctgcactaacccacgcaacaatcatctgatcctttttcattaaagaaccaaatatatttgtatcctctgtaatcctccgggctaatgtaacaggaaagcgatagcgtaatacttcctcaatcgcttttgaaattaagttaggttcttttcttaactcttcataaattccaggtgaatctactaaaaagcaataaaagctattaataattaaatttgtagtggtttcattcccagctgctagtaaacctaatgaaaaggttacaatttcttcatcggttaatctttcgtcttcatattcagctcgaattaaatcagaaatgatatcatcggttaaatgatatctcttttcctgaacaatcggtagaaggtatgctttgaattcatttaatgctatccctttctcagcatccagatcattaaacttttctttactatacggcataaataaaatatcagaccattctttaatttttttacgatctgttgttgggactcctaataaatcagaaataacggtaacaggtaaaggtgcagcaaactgttcaacgatattaacttcactacatttttcgatatgttgtacaagttcatctgcgatagcctgtattcgaggtttccactgttctaaacttcttggagtaaatgccttagaaacaatggaacgtacattgcgatgttctggtggatctgtagagtttatatttattctagtttctaaaggagggattgagaattgtctgcgctcccttctacttgaaaataagcgataatctgataaaacacgatttacatcatcatataaaaaaacattccatacatcctgctcttcatcataatgaactgggtgattatccctcatcaaacgataccattcatatggattccataattcttcttttgttttcagctttgaaatttcatgaactaaaataacattttcaggtgaagccatagttctttcctcccttttcttttacaataaaagtgataggtcggcagttcaaagttgtataaactatcatatgttattttaacatatactaaaggggatttttcattagagaacttgagaaatatataagggggatttttatgtacgttgatattttactactagcagaattaacgaccggaccaaaacatggatatgaaatcaaaaaaaatgttcaaaatcgtttaggtgagaattttgaattaaatcacaacatgctttaccctgcccttcggcgctttgaaaatatgggtgctataacgaaaaaaatacataaacaagttggaaaaccaaaccgaaatatgtacgatataacagaaacaggagaagaaattttttctgaaatgttacgagagtttcccgaaaaacttgcgacaaataatgcagaatttcttgttcgtatcgcgctatttgaaaaacttgaatatgaagctagaaaagagattttgactgtacgtcaaaacgtactacatagtcaacttaccgctattcagtctctagaggttacctcagcctttattactgaagtcattgaatttagtaaatcacgaattgaacatgaattgagttggattacatcacttatgaagaaaatatgaaaaaataacaaaaaaagctaaaattaatgaatgaaaatgatatttattatcaatactatcattaataaaagggcaaccacgatttggctacccttaaagaatttacacttctggatcaaatgttttgcaatctgtttcttccgttgtagatgcatgtttacctttatgacttactacgtaaattgcctctgcactacatttattaccgttcgcccaaaatttacagttgtttacttcacataaaacgtcttgtgccatagtatcacacctccttgttctattatcattaacaaaattcggaggtatgatactatttgtcatccatttttcattccctttttagctttcttaatggttcaatatctccgcgtacaatagcatcaatatttccagttattttttcaatatcaaaatgccaccattgaatttgcaataattcttgaattatttcatttgaaaatctctcttttattttatttgcagggtttccaccaacaattgtatatggtgcgacgtctctagtcacaacagatttagctgcaatgattgcaccatcccctatttttattccgggcataattgttgtatccataccaatccaaacgtcatttcctataactgtatcacctttataaggtaaatcagacaaactaggtgtatacttctcccacccatttccaaatatattaaatggatatgccgaaaatccatccatccgatgattggctccgttcataataaagttaactccagatgcaatacaacaaaactttccaatagtaaggcgatctccaagaaattcataatgatgtaatactcgatcttcaaatgtttctccatctttcgcatcataataagaatagtcaccaacaagtatattaggttttgttattatattttttataaattgaacgttttgattgccttcaatagggtatttaacatttggattaggattcattttgtatagcacttcctttaccacttatttcactttctaccgctattactggctttaaattgtatataggtaaaataaacaataatccaattataaaaagtaaagccgtcccttcatacatcatacttaatgaaaacatctcttttaatgagccagctatactcatcgttactaccattgaaccggtaaaaagcggacttaaaataccatttacacgacctataaaatcggtatcgctattttgaataataagcgtattaataccaatttggatacaaggaagagctaaaccactaaaaagctgcgctgtaagtgtcacccataaatttgtagaatatcctataatgccaataccaattgcttgaccaagcataccgataattaacatcttttgcggagcaacgtttttcgcaaataccattgctaatgctccgccaacaatcattcccgcaccatttactgttagtagccactgtaaactctcttttgataatcctaactgctcagtcacaataaatatacctaatggctgaattaatcctatacctagtcctgcagccataaaacaaagccctagcaaagttaatgcttttttctttttgacatacttaataccatccttcatctcctgcaacagagtgatatccttcttttctacgtcgttttcaagatctttcggaaggaataacaatacaactgccgcaagtaaaaacgaaatacctgttatgatgattgaaatataaattccaaaactatgaaagataaatgtccctagtattggtcctaataccataaatattgcaaatatcgtttgatatatagacattgctaattgaatttgttccgttgataaatgttgtttaaacaacttcattccagatggttgtgaaaactgtgaaaggattgcagagatgagtgtcacaaaaaacacaattttccacgttccaaacataagcgtaattaatacagcgaatactgaaatggaacttaacgtttcacaccatatcattgtcttctttggcttccacctatcagcaaaagtaccgccaataaatgaaaaaataaaaattggagcgaattcagcaactgaaatcatcgaaatagcaaaagcatcaccttttgtcatttccattacatatagtaataccgcaaagtttcgaacccatattcctatttgtaaaaataatgctgatgctaaaatcccttgaacaaaccgattttttaatacttgtgatacaccattgctttgtttcgttactcatttgtcgacataaaaaagcatcctatatcatgttctgaacagaaggcagcacaaatcatataaaaagactatatattcgcagagcgaaatacatcccttttctataaatgtacagactaaccctattcagaagaatatttcgttttttaacgaagatctcttacaaatagaattagttgatcattgggatgttttcacccttccgtttcgaatttaaataacacatacatactctatgtaaatcattttcgatgtatgcatgtctccttttaactattctagaaagttaaaggcaattcctctaaagaacgcattaaatagttaccttgccatttaatttcttcacgattcccttttatttgtagttcaggcattcgattaaacaaagtagtaatagcaatctttgcttctaacctcgcaagtggagcgcctaaacagaaatggctaccatgaccaaaggcaatatgacgattattttcccgagtaatatcgaatacttctgggttttcaaatacagtttcatcacgatttgcagaagctaaggcaatgacaaccatatctcctttttcgattgttcggtcgtgaatttgaaaaggttccgctgcccatcttgcagttgtaacctcaactggagaataataacgcaatccttcctcaatagccgaatcaattagttttggattatcttttaataactgtaattgatttggattttcaagaagtgctaataccgtatttgtaattaaattcactgtcgtctcgtgtcctgctacaattaatagcattatcattgaatatagttcccgagcgctaagtttatgcccttcactctctgcaagtattaaagcactcactaagtcttcttttggctcttttcgtttaatatcaactaaatattgaagatatgtaataaactcagatagttgtttttcggtctcttttatttcttcaggtgtttctggtgatgcaataacagcatgagaccaaattctaaatttcgcttgatcttcttttggaataccgagcatctcacttattacaataatcggtaatggaaatgaataatcatccacaagatttaatgtaccttttcgctctatatcacttatcaaatcatctgctattttctcaattcttttgtctaattgtgcaatcatcttcggtgtaaaagctttttgaactaaagatcgtaaacgactgtggttaggtggatctgaatttagcatatgtgttgttaagtggtcactattatcaacggaaagatacatgttctttatatcttgagaaaacacatttgtccaatctttttttaaacgattatcttttaaaagtggcagagcatcttcatatctagtaatgagccattctttaccgatttcaacttggtttacaaataatataggttgtttttttcgcgattctttataaatttcatacgcatcttctttaaactgagctgaagctaaattaatgccatcctctatgcttaacccaactttgcttttcattgacattgtattccctcaaaaacatttgtttttgaaaatcaacccaacat

SEQ ID NO: 1117 - DNA, 3163 bp, Bacillus thuringiensis
gtgtttgtaaatgaacaacgtgtctctgctgaagaagagtacgatgagtttgaagaaatttcaacacacgttgttatatatgacaatgatgttccagttggtgctggacgttttcgcatccttgatggtataggaaaaatggaacgcatttgcgtgctaaattcccatcgcaaaaaagggattggaaaaattgttatggattctcttgaagcgtatgcaaaagaaaattcgctaccgaaattgaaacttcacgctcaaacacatgccgaagatttctataaaaaacttggatatgtaacaagttctgatgtatttatggaagcgaatatcccgcacgtcgtaatgataaaagaattgtaatttgaaagcaggaggtgatccctcctgtttttttacattgctattttctttttcttccgctaaagttaaatgttgatgctatagttttgaaggtgaacatatgacacaagaaaaattttcacaaaaatcgttaacacacgctgatattccgcgtgcgacatatcatattccgaaaacatctacccatttaattatggaagaagatgtagatgcggcttatttccgcgctcttgaacaacaaaatgtttttttaaacgaaaaacaattagaagccgtgcgcacaacagaaggtcctgttcttacactagctggtgccggaagcgggaaaacatctgttttaacaactcgcgttggttatttagtaaatgtaaaacaagttcatccacgaaatattttattacttacatttacacaaaaagcagctgaagaaatacgaagtcgtgttgcgaagttaccaggtatgaatcatgcagcaagtagctacgtagttgctggtacattccactctgttttcttaaaattacttcgtagtcaaggttataatcagcaaattttagcaaatgaaaaacataaacaaattatgataaagaaaatcttaaaagaattgcgtttaaaagacgattatgatgctgaaacgatgctcgcgatgatttcacttgagaaaaacaaattaaatcgtccgaaagatgtaaaagcgaaaacaccagtcgaacaagaatttaaagaagtatacgaacgttttgaagaggtaaaacaaagatacaattatattgatttcgatgacatcttattggaaacatattatatgttagaaaataatgctcctttactaactcaattacaacaacgttttcactatattgaagtagatgagtttcaagatacatcgtatgcacaatatgaaatcgtaaaattgttagccacgccaagaaataatttatttatcgcaggtgatgacgaccaggcgatatacggctggcgaggagcaagtcaccaaattattttatcttttccaaaagaatttgataacacaacaatcattgcactaaatacgaattatcgatccaatccctttatcgtcgggcttggaaatgaagttataaaattaaatcaagaacgttttgataaagagctatactctgttcgtgaggaaggtgtacaacctttttatgcaagacctgctacgactcttgatgaagcaaatcaaattttgcagcttattcaagaaaaagtagagagtggtgaacgtaactttaaagatttttgtttactgtatcgcacacattctgtaagtcgttcgttacttgatcagcttaccattcataaaatcccgtttattaaacacggagcgagccaatcattttatgaacattctttaattaagcctgtattagatcatttaagactcgtgattgagccgtttcgactagaatcactttcaaacatattgccgacgatgtatatcggacgtgatgattgtatttcatttattgaacgtgaacaatggaaatatggtgaggggcgcttcccttctcttcttcatttcttactattaaatccaagcttaaaaccttttcaagtgaaaaaggtaaatgagcgcatcgattttattaagtttattaaagaattagaaccgaaaaaagcattaaaagaaatcattcatggtaaaggaaaatatttagagtacttacaaaataacgatcgttcttcctttacaatgcataaagacatacaagaagaaatgttggaagaattaatggagtctgcaactcgtttcaccgatattccagcttatttacaatttatcgacgaggcgattcaaggtcaaaaagaaatggaagcattaaaaacaatgccgcaaaaagatgccgtttcacttatgtcaattcataacgcaaaaggccttgaatttccatgtgtctttttacttggagcgagtgatggaatcctgcctcatacttcttctttaaaagatgcaaatgatcgtgttacggaaacttctgaagcgttagaagaagaacgccgattactttatgttgccattacacgtgcgaaagaagaactttacatttcttctccgcaatttttcagaggaaagaaattagatatatctcgttttttatatactgtgcgaaaagatttacctgaaaagacatccactaaataaggatgtctttttttatatcacgttatgtacatccctcctatataaattccttgtttttatcgtgagaattaacgtaatatcagccatatcccactcatattgtaatagtgtatgtcagaactcacgagaaggagtgaacataatgagctgcaattgtaatgaagatcatcaacatgagtgtgatttcaactgtgtatcgaatgttgttcgttttatacatgaactacaagaatgtgcaacgacaacatgtggatctggttgcgaagttccatttttaggtgcacataacaatgcatcagtagcgaatacacgtccttttattttatacacaaaaactggagaaccttttgaagcatttgcaccatcttcaagccttactagctgccgatctcctattttccgcgtagaaagtatagatgatgatgactgtgctgtattgcgtgtattaactgtagttttaggtgatggtaccgctgtaccacctggtgacgacccaatctgtacgtttttagctgtaccaaatgcaagactaatatcaacctccacttgcattactgttgatttaagttgcttctgcgctattcaatgcttacgtgatgtttctatttaaaactaaataatgagttaagcatggat

SEQ ID NO: 1118 - DNA, 3122 bp, Bacillus thuringiensis
caattcgtgattaaataacacacttattaattcaagtgaactacatgatttatttctcactaataaaaaactgtctccttatataccaaaatttgaaattgcgacgatacaaaacattttcaaactgttgttaaaaactaaagatattattatacgccccactaatatacattctaaagataacttatatcgagtcgcttacaaaaataaaacgtttcagatcgatacagtaaatgaaaaataccatacttctatttcaatcaaacgcacagacgaatttatatcttggtgtaaatctaacatacgttcatcacgttacatagcgcacactatgctacaaccaccaaatcaattaacatatccactgcacattcgaaccattttgcaaaaaaacaaagaacaaacttggaatgttatcggtcaatttatacaaaaaagctcatttcctaatcagcttttaccctcagcaacggacgatgattcattgcattcattttcaaaaattaaatacgtactatctagtacaggtgtgcaactattgcacgacgctttacacgacattataaatgaagtattccaaacactagatcagtcttattcttcgttatttgaactagaactttccacaattatggatcaaaaaggtgcaatctggcttatgtatgtcaacacgatccctccttacgaacaatacattcgtcatagtgattcattagctgaaaagatatttcacggaccacttaaattcagtcgctttacaccataatgaaaggaggtaaacctattttgaaagaacatatatatacattaaatatttcagatgaacatccaaatagcattactttaccttacgttttttctattacaccacctattacatccctctccttcggcatacgtcatatagcaagtgaagaagtaaaaattcattattcctttactcgcgaaattattatcggaaagcatattgccgaaaaacttttactgcctcaatcaactactattcatgcattcacacaaaaccaaacaattattttcggaccattaatcggcatttttacaactggctttaacgatgattcttctacccctttaggaaatcgttcaattgctctcagtgagttgttaacaccaccattctcattacgaccgttcgtattcgtctttggcgttcaacatataaactgggaagaagaaacaattaacggatatttctttcgagagaaacaatggataaagaaaaaggttcctttaccaaacgtcatttacgatcgactaccgaatcgacaagcggaaaattacaaaccaattgtcagagcaaaaagaaagttagaacaagactactccattccatggtttaacccagggtttttcaataaatgggaagttcatcaacttcttatgaaagacgaatcaattaaacccttattaccaaatacagaagcatttcagcatttcgaacaagtagaacggtttcttggcacatataaatcagtgtacatgaaaccaatacacgggagctttggtagaaatattcatcaaatattttattctcaaacagaaaattgctactactgtcgttatcgcgaaaatgaagaaaataaactaagaaagtatcaatcattagaaactcttctaaaccacgtattaaaaggacatgatttaaaaaagtttatcgtacagcaaggtatttcgttacttcgctttgatggtcaacctgttgatttccgcattcatacaaataaaaatcatttcggtaattggatagttagtgcaatcgtcgccaaaatcgccggcaaaggcagtttaacaactcatgtaaatagcggcggtgatacaaagttgctacaagagctttttccagattcaacgaagcaagttcaaattgaaaataaattaaaacaaacagctctgcaaataagttatgcactcgacgagcaagtaactggaaacatcggtgagattggtttcgatatcggtttagacacaaaggaaaatccgtggttatttgaagccaactctaaacctgggcgaactgtattccaagatgccaaattaaaagaacaaagtgaactgacacgccaattattttacgaatatgccatctacttaactgaacattccttacgtgatgcaaaggaaaaaatgtcccagataaaatccgggacttcatcaaacaccgaacatatcccttctcctatgattcactcacaaatacaaaaacaaaaacttccacctagataataaggtggaagttttctatttacacaagttttactacaacctcagtttccacgttacatactccgcaataaaaaatatgattgcaatattcatttgaattattatgcgttaaaccatctactgcacttaataattcttgatccatataggcactataatcgtctatataatctacagacttcccataatcttggagtatactttggcaattttgacaagaatatgtttgtgattctaatgcattgcaaagcgggcaaatccccatcatgattcctccatacgttatcgtttaaagcctctcttttttagagtgaagagagcaacctatccaaacataggagcgcccactccatccctacttaaaaatagaactataaagttgctaccgatttcatttttatttcaataaatcataaataagaagctaataattagcctacaagtagcaggctacaatgagaaaattatatttaatatcctccttagtttggcctgttttcttaaaaatacaacgattactcttatttcataatttacgaaatcaataagtttttttgacaaaatttacaaattattattttgtatatctttctaggtaacatccatactatgagtacaaacttaattaccgatggattagcgccaatcggggcgataatctggttcaactccagctagtccaaccaaaaaaacttttataactctaaggaggatatattcctatggcaaaccaaaattcttcaaatcaattagtagtaccaggtgcaacagctgcaatcgatcaaatgaagtacgaaatcgctcaagaatttggtgtacaattaggagcagattctacggctcgcgctaacggttcagttggtggagaaatcacaaaa

SEQ ID NO: 1119 - DNA, 5150 bp, Bacillus thuringiensis
tttttggaatacaccatttttatatttatttttaacagcgtaagcatatactcctccagaaacagaaggtgctggttgatctaaaacaagcttagaccatgccgcatgacatgtattactgtaacgtaaatacactgttcctacttttttactaccttcataaactgctgtagactttgcattaaatccatctgcatcacatgttgtacttcccccgtatactttcgttgttgctggattttttccgtcataatagctactcagatcagtagctgcaaatgtactttcttgaaaactaaataatacccctacactcgctacacttaacacacatactttcattaactttttaaacatttttaattccccctcaaaatgattatgtatactaaacacaacctatactgctgtgtcagccctccttccatgcttcctagaggcatcttacaaaaacgaattaacgttgtaaattcccttatgattattggaatatacgaagaactttacttatccttgtaagaaaaaaagttgagaaatacacattttatagcatcctttatttaaaacataaaagaaccgatacttgttatattcaagcatcagttctttatacaaaattgccattttttcttttatataaaataaatatttctccacttaatttgttgtaaaaaactccctcgttacatcaataaattgctgcagtggtgctgtcatccatttatctttatgccaagcaatttgtgtataaattggaggtattgtttcgtttaacattaactcctttaacgtcccttcccgtatatctttttctactactatcgctggtaaaacggctatacctaaatctgcaataacacattgtttaattgcttccacactaacaaactcaattttatttgctggatatagatcttccccgcgaaatagctcttcaaataaagttctatatgagcagcctaattctgttaataaaagtgtttcactctctaaatcttttatagaaacagtagtctgttcaagtaaaatatgccctggagcagctactacttttaattcttctttcataagtggttccacatgtaaaacatcttctgttttacattcgtccaaaataaatgcaagatctacttttccctccatcaattgttccttcgcatctttattggaatgtgctggtttaaatataagctttattttggggaattgtattttaaacctctttaatatagaaggcaatctgtatgtacattgactttcttgtgcaccaattattaacgtacctgctatttcctcatcatctttcacggccgtctttgcttcgttactaagtgcgattatcttgtctgcatatagttgaaactttcttcctgcttcagttaagaaaagacgtttccctaatctctcaaatagtggtgtaccgagctcagcctctaacgttttaatttgtgctgtaacgctcgattgagcaaagtttaatttcttcgcagtttgtgtaaagttcaaagtatctgctgctactttaaatgtaattaattgttttatctccatttatcatccctctttttcaatcgatatttccgattgatttcatcgaaataatcctctttgtctattgatatttatattgtatgataaagagcatcgacaaacaataaaatggaggtattccatatgaaagcactttgtttcgaaacattcggagatgctgatgtacttcaatataaagaaatccctgatccaatcattaatccaaatgaaattcttatcctcacgaaagcaatcggtctaaatttcgcagatatttatagacgccgtggtgattatcacctcgctggtaaccctccttatatattaggttatgaaggcgctggtatcgttgaagaagtaggtgctaacgttactactatcaatcctggagaccgtattgcatttgctgacgttccattcgcaaatgcagaattagttgccgttccagcagaaaaagcaatcccgcttccagattcaatttcttttgaaacagccgcttctatcttattgcaaggtctaacggcacattatttaacgaaagatagctatcaaataaaacaaggtgatacagctttagtccatgctgcggctggtggcgttggtcaacttcttattcaaatgattaaactactaggcggaaaagtaatcggtcttacgtcatcaaccgaaaaaaccaaagtagccacgttagttggggctgatcacgtatttttatatactgaaaaatggcattcaaaagtacttgaaataacaaatggtactggagtaaatgttgtatatgaatcagtaggctctacactagagaaaagttttaacgctactaaaatcggtggtactgtcgtattttacggaatggccggtggtaatcctgcgcccattgatccacgtatgcttatggatacttcgaaaactttaactggcggagacctttggaacgtacttactacttttgaagaacgtaagcagcgctctactcaattatttgattggatcgctactggaaaattgaacattgcaagtcctactacattctctttacaagacggtgcccgtgcacatgaattattagagagcagaaaaagtactgggaagattttattgatcccataattcataaaatgaaaagaaagctagattaaaattttgtgaagacctatagtgaaaaaaattgataaatgaaaggacataacatattttatataactaatatgttatgtccttacttcttcaaataacgatcccatgtatcactcgaataatttttgagctcttttctcaattaaaactccctttaattgcatatgttcttttatttgtatattgctagaaaattatcatttttatttatgaataaggctacgtaccgatttaagctaaaaactagattttgatcctataacaacagtggcatctaattcctcatctctagtcactttcgtggtaagcccagcaccagcaaagatttcaaaagtctgagttgcctgcatttcactcgtctctattaaaagatgccctcccgatgcgagccagagaaatgcttcttttgctactcttcgctgaatgtcgagtccatcctctcctccgtctagcgccattttcggttcatgtagacgggcctcctgtggaagcagctttattgtctcggtaggaacataaggtacgtttgcaactagggtattcacatggcctttaagtgcgtgaggcaaagctttatacaagtcaccttcaaaaacatggccaccgaaatttgttacgttgcggctagcacatcgtactgcgacaggatcaatgtcaacagaatacaattcaattcgtcctaaagctgccgccagagctacacccacagcacctgaaccgcaacatagatcaacgacgatatcaccaaagcataacagagcttctgcttggcgaacaagaaactcggtacgttgacgaggtacgaaaacacctcggtccacttctatccgcaacccacaaaattctgcgtatccaacaacatattcaagtggcaaaccattggctcgcatttccaccattctcttgagctcctctggagttcgggctgctgaaataagtaaccgggtctcttcttctgcgaaaacacaacccgcgctctgaagtctgttaattatacatttttccgttttattgtccaaaaaggaattacattcttttcctatttatctcaccactttttcttatttataaccctgtattcgctaaaaattggatgtatcctttttaacaaagtggtcctattcaaaaaaatacgcccttattcaattaaatgacccgattgttgaacaaagaaacgttctacacaatagaaagtttcattataatatcccaatataaccttataaatgatgcactaaaaaataaaaaggaagctagattttactaacttccttttcttatatctatttaagatagtattatatttccacactttctttcccttttgcaacataactcatatctccaaccgactccactgtgtatgttccatcttgatatacaatcttcgtcacgctagcattttccactccaagttttgttttgctactgtctaacatttctattaaggtagtaatcaaaagcccatgaacgacaactaagacgttaccgccaccattttcagcagcttcttcactaattttatctatctctgtttttatacgagtagaaaacaattcccaatcttccgcctgttttgtcggatctgctactctaataagattaatcacttcttgaatagaaagcttcaagagttcttctggtgatgcaacgcctgcagcttttccaaccacatcccacatattctcaagtttttcaccttcaaaaataccgaaatttaattctcgcaaatcttttctttgctcaagttttaattttgattgctcactatattttaatactaaattagcagtttcaattgcgcggccgctatcactactatacgcattcataaaatgaatatcttttaatcctgttcctaaatttgtggcaacttcaacacctctttctactaaaggagaatctgcccaaccttgcgcgcgatgattcgtatttaatattgttttaccgtgtcttgtaacatataacgtcactacattctcattgctatgtgtttctcgcttattcatttcattctctccctttacgtttctatatcaattttaccacctcaattattcattgagcaaaatatacgtcagtagatccgcttaataaaaaaagctatctttctgtatatccatacaaaaagatagcatcttttatgattacatttcttaaccggtactcctattcagcaaaagcactcgaatattgtacaattccttctacacctcgaagagaattttctgttaattccattatcataaatacctcttcaggcacttcaaacggtgcttttacattccactcacttgctttcttaaaaccaaatttcgggtagtactctggatgtcctaatactacaactgatccgtatccaagttgtttcgctttttctaaagcagccgtaatcagttttccaccaattcctttcttctgatggcccctagcaactgaaactggtgcaagtgctaacgattctacagaagttccatcttgtt

SEQ ID NO: 1120 - DNA, 7731 bp, Bacillus thuringiensis
ttacataatggtttttaacaacttttggttctgtaacaatagtgttcttttgttccaattttggcctagcactagaaggtggtatgaattttatattgtcttggtaattaggatctaaggtgtcagcttgtacactgtgtgacgaaacaaaggtgcttagactacttcccgcgattaaagttgcaaatactaactttgagaattttgttaatctactcattctataatctcctttttattattttgtaaggtatctccttacacctcacagtctatatccactacaaaagggtgtacatacatattgatagacaaaattctacaaaataccgcatgtttttgggatttatgtataataatccaatgtctaataatctatcaaaagtaaaaaggtaggtcttatataaaagaaaatgaataatttatgcaggtaatgtatatggaattattgtttaaatattctaaaatgagttgataaagatgttggtaggttttttggaaaacaaataattccctaggtgaaatttggaaggaagattctctgttagagtttttataagggaattcattttcgtagattcaaaatgtaaaaataactaaaagagcaagtgtttcaatgggtaaaaagctatgttgagtcttttttctctgtcggtggtcgtctaatcaatgaaatgacggatgcttatgatagtttgtgtctagcaacattcgtgtataaacgaatgaattaagaaaagggtgaaatattggataactcgaaatggatgcctttaagtaatgttgatgatgatgaggaaatttgggtaggagcaagagttagggtgtacaatgttggtatgaatagagaagataaagaaaataatttctatgaatatattatttcttatatctacgacaacactaactacttacaactaactaatttaacaacaggaaaagcaggttatattatttgtgtcattgaaaaagaattaccaaataattatgctttgggcagaacattaaagcaaagaataggtttagaaaatacctattttagatttgaataatcaacaaataagggaagcaccaactctaaggtgtcttcccttatttaatactttttatcaataatcaatattaacagagcctaaataaaaaagtgagaaaaatgataaacactcttctcactttcatcaattagggtggcatatacataaatatgcgtttgggtggattttggatgaaaaatccacatgcatagtataacaaaaaaattatggcttttcgcatgtaatattgcatatgaaaaatagtaaagttttaaattttaatattaacaacttatatatatgtgttacaatgtaattctctaatttattttattctcctatttagaatttatagtttagtgattcaataatacaaaagtggttgtaataaatagataaaacgatgaaataatacagttagaatggttaaaaggcagttaaatataagtattaaaagaaataaatttacttatttatgtttagtgaatgtattatggtaagaatttcatccgattggattagcgctaaactagatttttatccaatcaaatccaataattattttttaaatgaagtatatgttgcatcaagtttatttggaataattcgtagtctaataattgctgaatctagaaaaataacatattcgaaaggagggcagataaaactctgtctgtgaaaattaaatctctaaattataaagtacggataataggatgtaattgtggtttcatttcgaatggtaccataaatgaatgtggaaaagtaaaggagaaaaatttaaataaactatataagtagtaaaaatgaaaaggagaagtagctagtgtttaatataaaagaaagattggggaaaataaagcttaaaacgaagttgtctatggcatttatagcaatattaattataccaagccttatcgtaggagtatcatcttataataaagcaaaaacagatcttaatgaaacaattctacaatcagcaaaagataatataagtattttagataagattgttgatgatgaattagaaaataagcatacagatatcactcattttgcaaaggtactcacacaaggggattataatcctgaacaatcgcaaaatgtacagaataaatttgatcaatatatacagttacatccagagatagaaacgatttatacggcatccagtaacaatcaatttattcatgcacctgttggaaaaataccagaagggtttaatccgctagaaagcagttggtataaggatgcagtaaaagcagatggagagattattgtttcatctccatataaatcaaagtctacaggaaatatggtaattgcaattgcaaagcagaatgcagataaaagtggtgtcattggcgtagatttgaatattaaagatatcgtaaaaacatccaaaatgataaaaattgggaagcaaggatttgtatctatagttagtcaagataaaactatagttgttcatccatcactaaaacctggagagaaattagataaaactttagtggatgaattgtacaagacagaagatggagtaattacttatagcctcaatggtgaagatcgaaacataagctttaagacaaataaaaaaacaggttggaaaatagctggcgtaatgcctacgaaagaaattgaagaagctaccaatcctattttttataaaacgctcactataataggtgcttcattattgttaggtggaattgtaattctattcatactcaaatctataattactccactaagacaattagtcatttcagctcaaagaattagtcaaggagatttaaccgagaaaatagatattcgttcaaaggatgaacttggtcaattaggtggtagtttcaatacaatggcagagtcgttacgtaatattatttctcaaattaacacatctgcaggacatgtagctgcgtcttctgaggaactaactgctagtgtagagcaagcaagtgttgcgacagaacaaattacaaaagagatggaagaaatctcgaacagtgcagaggttcaaaataatgaagttgagtctggagctgaattaattggtgaggtaacacgaaatattcaatacgtagctgagaatgcttctgaagtatcggcttcatccatatacactaaacaaaaagccaatgaaggtgaacaattagtagaacaaactgtaacacaaatgcagtctatccatcactctgtttctcaatccgataatgtcataaaattattagataagaaatcacagcaaattggcagtatattagaagcgattcaaaatattgcggaacaaacaaatttattagcattaaatgcagcgattgaagcagctagagctggggaacaggggagaggatttgcaattgttgccgatgaagttagaaagttggcggagcaatcatccgaatcttcaatggaaattggaagtttaattaaggaaatacaagcagacgtatatgagactgtaaaagctatgaatgaagtaggcgtagaagtacagtcgggaattaaagttgctaacgatacaaaacaaagtttttatgagatttcaaaatctgcaaatgatattgtgtcaaaagtgcatggtatggtggaactatctaatacaatgactactgatgcaatgaaagtcgatacatcgattgatcaaatagctatggctgtaaaagaaaattcttcaagtatgcaaacgatagctggttcatctgaggaacaacatgcttctatggaagagataaattcttcagcaatacaattagcacagatggcggaagaacttcaagagttaattggtggatttaagatttaagttgagattctaggagagaatgctagaatcttgttacagagtggaaatgaaaaatcttataacatagtaaataagtataatatgtactctctatgcgtattgaacaggcagataagccatttaaaaaccctccatttggagggtttttaaatacatttacattaaatttgtggtggtgcaccaccataatcgccaacactatatgaaggagcaggataatgcccatgagtagcaagctgatctgttttagaaaactgaaaaattcccaccgttaataccccaataaaagcaatgcttgataataataagctaatttttttcattattttaacactccttttgcgattgatttttgtcttgcttgataacaaatatggaaatagtcacttactttttggtggttctctaattgtctacattttgtggcaaataattcggcgtattcgacaacatattcccataattcttcttcctcaaagtataagattccttcttgaatgattttttctaattcttccaatggaatattttcgtttaatttttttaaaatagagaagtggtgtgtatattcttcgttatgaatctctctgcaaatctgtagtcccttatcaatgagttggctggccgttgattgttctcctaacttataatgttccttagcttgtaggaagatggccttgaagtgtgtagggattttctctgttacttctgaaaggtgacgaatagctaaagtagacatactttgatcagaatacagccaccccatagtattttttacgtataacaaggaatcttcttccctatttttttgtagtaaatcaattgcacaatgtagatattcttctgcttgttcgtactgttttaaatagatgcagcaaccacctagcaaactattacaaaaggctgtttttacttcataaccttcgtactttgaaaagattgctctcgatttatttgcgtattcgatagaagcgagattgttataggtatggtgatagaaagtagcaattctatagtaaaattcggcgtgttcaatttcatctggtatagctaccaatattttttctgctagtttataatgttcctctgcctcagtataatttgatataaaagtggaatgaatggatttgaaaaaatgataatagaattgtagaaattgatctgtaggcatatcataatcgctaatagtatcaaaactattttgttgaataccaaggctatctgttaagaccttgtaacgaaattcgagtagtgaatagtatagtaacaaattttgatcctgatgctcttgattcggttcaatgcttaacttattaattttttcatcaattttcttttttagattagtagcttttataacttgctgagatagcatagatcgataccagtcgttcaatagagaggttaattgctcatttccttttactgagacactcataatatacgcccccattttctaaaaaaatcctaatccaatttaattataaacatcataacaaaatagaagaaaaaatggagtgatattacaatatttttcaagaaaattcataaaaaacaatcaatttgtgtcgaatatacgtagaataaaacatccaaaaataatcaaaagatgatatgagtctttatacgttctattaggtgaactaagaactgtgattgaagatttatgaaatttctttttcttaaaacgatcaattatgtattaatttttagattattttatcggataaatatagtatgtatcaccaccaaatgtataaatcttgcgtatgtaaataagaagagaataaaggaaataaaaaagaacttgtaagaattcctacaagttcttttttagataatgtaaaaggtgaaacagactatgtcattatttgtaatagtaaaattatcttacgtatggttttattttatagaagatgtactatattgaagatttgttcttattgttgattaaagggaaatttaagactggtaaggggaaagtgcataaaagagaaagtctcctttatttattctgaaaagataattcaaaaagctatttgtgtatagaataagctatgcataaattcatcaacattggtgataataaataagagaatcaatatataagcataaacttgttaaagctcagtgtaattctataaatagtagatataattatctgaaaaataacattatttacttttcgagtaggataagtaaaaaaaaaaaggaagtttttctttgaagaaagctcttttgacaggaatagattttttcataactagaacaaataaattaataatcacatatactgtattgtcgttaaagcaagacattattttctcagaacaagggaatcactagaaaaatacgtgattcctttattcttcaatataatgtcaatagttgatttgaaataaccgaagaaataaaatttttgttaatggacaatcacataattttaggtatagtaggtttataatttagactataaaaattaatgtatcttttattattttaaccaagaagactccctccataaggaactcacagcaagtatgggtaagtgggagtagttcaaagcatgcaatattgtttgatttggctaatacatagatttctcatctcagaactggtgtaagaattataatgtttataccattctattgtattttctaaagtctgttgtagggaccattttggctgccaattaagattgaattttgctttgctaatgtcaaggtttagtaaatttgcttcatgaaaatttattggacctatattttctgctgtccaatccccgcagccccaaatatctagtaaacttgtcactaatttttctactgaaacaatattgcttagggatggcccgaagttccatgctcctgaaaaaaggataccattatttataattttttctgtaaggagtaaataaccgcttaaaggttctagtacatgttgccagggtctaatagcagtaggatttctaataataatctttttgtttgattctaatgctcgtatacaatcgggaataattctatctattgaccaatcaccaccaccaattacattaccagctcgaacacttgcaattattttcttatgttgagaaaatttttcttctgaaaagtaagaattacgataggaagaaattaaaagttcgcagcatcctttgcttgagctatatatgtcatggccgcccatagggtcaatttcacgataaccccaaggccattctttattttcatagcacttgtcacttgtcaccataattcctattttagctgattcatgtaatcgaattgcctctagtacattcatagttcctacaacgtttacctcgtatgtttctctaggatattcatatgaatacttaactagaggttgggcagctaaatggaatacaatttcaggtttataatctgtaaaaacgttatttaatttattaaaatctctaatgtctccacgaatatcaattatattattttgaaggttagtaatgttaaagttatcatttttatttttagaatctaatgaatatccgattacagtagcacctaattcattcaaccatagggataaccaagaacctttaaaaccagtatgtccagtaattaaaattctttttccgtaaaaagcattattaaagttttggtttaacaattagtccacctcctttagtaccctatttttagggggttaggtataaatgtttattatttttataccaattaacagtttttataattccttcttcaatattaattctaggttcccagaaaagagagttttttattttttgcacatccgcttcaggaacccatctttcatttgttctagaggaaattgcaccgtaatttggtctggaattgggttgcgaagtgtttgaataataattctaca

SEQ ID NO: 1121 - DNA, 4501 bp, Bacillus thuringiensis
gatatacctgacttaccacggttttagaaaaaaactaatactacttattagagggaagagtaactatggaaaaataccgtatagatataagaaaaggaattgagtttggattatattcaattggtgatcatgttttaaatccacataatggggagaaaattacgccagagaaaagaattcacgaactaattgaaacagctaagttagcagatgaggcagggcttgatgtgtttgctgtcggtgaaagtcatcaaacgcattttacaacacaagctcatacagttattttaggagctattgcacaagctacgaaaaatataaaaattgcaagttcagcaacgatattaagtacatctgacccagttcgagtatatgaggatttcgctacaattgacttgatttctaatggacgtgcagaaattgtggctggtcgtggatctcgtattgggggatatagtttacttggttataacgtgaatgattatgaagaattattcgaagagaagatggatcttttattaaaaattaataacgaggaacatgtcacatggaatggacagttcagagcaccgctcgcacatgcatcggttattccgagagcgaaaaataataacttaccaatttggcgtgcggttggaggtccaccagctagtgcaattaaagcaggacgcgcgggtgtaccaatgatgataacaacacttggtggtccagcaattaactttaaagtgtcagtagatgcttaccgcgaggcggctgtacaaagtggatttgattcagctagtttaccagttgcgacaacgagtttattttatacggcaaaaaattcacaagatgcacttagtgaatattaccctcacattaatgctggtatgcttacactgcgcggtggtgggtatccgaaacagcaatttacaaatgcaatagattaccgtgatgctttaatggttggtagcccacaacaaatcattgagaaaatgctgtaccaatatgaattatttggccaacaacgctttatggcacaaattgattttggcggtgtaccatttgataaaattgagaaaaatattgaattaattgctactgaaattttaccagccgttagaaaacatacagcaaaataaataaaaaaactgagagtctaatcgactttcagttttttttatttgttctggaaaaatgacaaaaaaatgaacttttagtcgaggaagagggaagttattttctatttttgaataacattatttcgagtttgaattttaaaaatacatttttctcttgacaaaaaacaagcgtttatcgagggtagttccgaggacattttttcgggtgaaagtcaagtgtatgaagagaaaaacgattgttttatagatataaaagtaagaagtatattgaaaaaacacattttgctaatgagaaaaatctgattcaaaaaaatgacaaaagacatatttcagacaaaatgatgtcaataatacgtcaaaaataacctgaatttactatgcaggtatattatacaattcgattaacgaataaaacactacagaaatagtgaaaaggtaaaaaatagcattacaatagtttgaaaaactgaaacttcatatttttcgacaatacatacaaaatgtttttgtcttttcgtatttcttaataattgagtttgataagattgctcaattaacttttattataaaaactatgaaggaagtgattttagtatggaaacgctcgaattggcacgaatacagttcgcatcaacaacgattttccattacttttttgttccgctgtcaattggtttagcttttattattgcgatcatgcaaacgttgtatgtggtaaaagggcaagaagtatataagaagatggcaaagttttggacgcaattattccttattaactttgcagtaggtgtagtaacaggtattttacaagaatttcagtttggtatgaactggtcaacgtattcacgttttgtaggtgatgtatttggtccatcacttgcgattgaaggattactggcatttttcattgagtctacattcctgggtttatgggtattcggtgaggataaattaccgaagcgaattcacttaatgtgtatttggctcctttcaattggaacgatgttatcagcattctggattttaactgcaagtgcatttatgcagtcacctgtcgggtatgaaatggcagctgatggtcgtgcgcaaatgaatgatttcttagccattattcaaaacccacaactatgggtacaattcccgcatacaattacagcggcaattgcaacaggtgcattctttattgctggtgtaagtgcatggaaaattacaaaaggacaagaaactgtagtatttaaaaaatctttccgaatttctatcattgttggaacaattacaacggcgcttgtattattcttcggtcatgcacaagcgcaacaattaattaagacacatccaatgaagatggcggcagctgaagcgctatggaatacaagtgaggatccagcaccatttacagtattttcgaaaattgatacagagaagaaagaaaattcgtttgaaattcaaatcccttatatgctaagtctattatcgtatgataagtttagcggtcaagttgaagggatgaatcaaattcaaaaacaatatgaggaaaaatatggacctggagattatattcctccagtgcatacaatgttttggagttttagagcgatggtaatgagtggaacattcatgcttcttctaggagcttacggatggttcttatcaagaaaagatcgtttagcggaaaaaacgtggtatttaaaattaatggtgtatgcaatttctcttccattcatcggtaatacagtagggtggattatgactgaaatgggtcgtcaaccttgggttgtatttggtgtaatgaaaacagaagatgctgtatcaccaaatgtaacattcggtgaagtattattctcacttatttcattcacatcaatgtatttaattatgggtggaatttgtgtgtacttatttgttcgtaccattaagggccacaagaataagaaaacgaaaaaggattatcaaagccatgatccatttgataaggaggaagagtatgttatctcttaatgagttatggtttttagttattgcaatcttgtttgttggattcttcgtactggaaggtttcgactttggggtaggaatggtttcgaggtttttaggaaagaatgattttgaaaaacgagtttacttaaatacaataggaccgttctggcacgcgaatgaagtatggcttgtttgtgctggtggagccatgtttgcggcatttccgcactggtatgcaactttatttagtggtttttatattccatttgtatttatgcttcttgctttaattttaagaggtgtttcctttaaatttcgtgcgaaaatagataatcataaatggaagagtgcatgggattgggggatgtttattggaagtatgttacctcctatcctttggggagttgcgattgcaaactttatggtaggtgtacctattgatgagagtaaaaatgttgtaggtggattcttgcaattacttcatccatttgcgttacttggaggagtaatgtttctcctactatgtattgttcacggattacaatttcttacgatacgtacaactggtaaattgagagaacgtgcacgaattgctgcaataaaaattgcaccaatttcattaattacacttcttgtttttgctggtgtggggttatggaaaaccgacattttcactgctcatggaacagaatggattatggtgccaatcggagcttttgtagcactattagtgtccactttattaaataaaagaagaagagatggttgggctttctttatgacgagtttaacaatcattttactaagtgcgagtgtatttatcggtatgttcccacgtgttatgattagctctttaggagcaatgaatgatttgacaatttacaacgcagcatcaggagcttatgcattaaaacttatgacttactttgcgattgctattttgcctttcgttatcggaagtcaaatatggagttattatgtatttagacaacctgttaagtcagacaacgatttggagtactaatgaaaagaaaaagaggacttccgtcttatcccggtagccgtattttatatgtagcgttaacgattattagtattttagaagcttttagtattattgcgcaaacaatctttttagcacgagctattacgtttttatttcatggagagacagtacaaacaatattaagtgaaattgtttattttggtatcgcgtttgcagcgcgtcacatagtagttcgaacatcacaaatattagtggaacgttttgctgaaaaaacagggtcgttactaagaaaacaactaatagaggcatatttcacattaggtccaaggtatgttcaaactgttggaactggtcatctggttaccttatcaatgaagggattgagatatttaaaaca

SEQ ID NO: 1122 - DNA, 4396 bp, Bacillus thuringiensis
tattgcgagtttccccatttctcttccaacatcaccattatattttttatatgcgcatgaataacttctctttttgcttgatcactaaattgttctaacgctaatgaaggaaaccaaaataaatctccctgtaactcttgcatatcctctttccatgaaaaatcacttgtaacataagcaatatgcttaaaaccttcacttcgtaaatgatttgtccattcttgcaaacgacctttttcattcttttgactttctaccaaatacgtaaacgcaggcagtaaaagcactcttcctttatactctctttccaattccgtgctcaacaattcgataaattcaccttgttctacaaccattttcatttcttttgctgccgaaattgataacagcggtattactcctgtatcaacatactctcttgcttgctcaaactgttctacatcttttacaatccacttcaaatcccttccctccttcacttgcaaatgacagaactttcactttatatatattaaaccacactaaaagaggtaaaaaaagaaaaactacccaatataggtagtttttctttataaaagtctgaaatttgtaaaaattaattaatccaaataaattctataaagtctttaactctgccgttaatctatgaaacgcttccttatcttgcttatctaacgcttcatcaatttgtttcaaaaggcgttctctcctaaacgaaaatacactttcttccaaaaacctttctgcaagtaaacgatctttttcatttacttcaatatgctttggtagatatgggttttcttctaatacagctacataattcgcattttgaaacgatgatttaaagttgagttgaatataaatatcctcatctcgatttaaacgaatatcatgaaacgatttttcagcatctgttgtcataacattttgtttaaaaaagtgaaacggtgtgtctttcacacaattcgctgacatcactaagccacgcggacaatattttgcatgctctacgaagtggactttatgcatcaattggtcgtgactcattaaataattcagaatccatacacattcacgctgtttcagttggtaattattcaaaaaccattttacaaaatccttcttctcgtttacagaaacaggggtattcatagcaattaagtccctcctctgtctttctcttttctttttagattcaagaagcggcattcagtttccttccaacttatgaaaaatcctctaaattatataacaattcttcaatatgaatttgtgtcgggtctagttgtaataactgggtaaatacttctttcgcctcttttcgttttccttcttccaataagaaataaccgtactcttctaagaagtctggatgattcttaaaagaagtatatgcactttcatagtgttttaatgcatccgaatacatttctaattgtttttttgcatacgcaagatcccaaagtagttgtgtatctggttctccactatcaatagcacgctctacaattgcaattaactcttcgtacttttcttgtccttttaagatatatgcatattttaatgttgcacctaaatgccctggatctaactcaagcgctttttgaagaacttcctctgcttctactattttccctaatttcgccgcaatgttcgctaactctacataaaatggaactgaaagctcatctactttaattccttcatgaagcgtttcatagctttcttgaagcattccttctttttcatagcttttcgctaaatacatgtacagtgatgcgtactcagggtctaattcttttagttcttgccaagcaccaattgctctctgatattcttcaccttggtataatgtaaaggcatatccaaataatgagtgaatatctttttgttcctctaggcctgcttcataataagaaatcgcttcttcccagtttccgatcgcgcttaacgtttctgcgaggcgaagtgcgatcacaacaccacccattactttatgttccgctaatagcgattcataataagtaattgccttttgttcttcacctttactactatataattctgctaacccaaacgtaataacaggttcatcaggcatcatttctttcgcctttaatagtttttgctctgctacatcatcaaaaccttgcatttggaataaatctgcaacaagtaataacgattgaacatataaatcgtcattttctggaatatcatgaagcacttcaatcgcttcatcttctttatctagatcaatatataattctgctaaaaatacagtgaattcactttcttctggatacagtaaacgtaagtcttcagtaattgctaatgcctcatctgtaaatccaagcgtatgatagtaacgagcgatatcatacttctcttcatcattcgcaatttttaattgttcttttaataattgtaatcctttttccgcttcaccattttcaatatatgaaacagcttgttcaaacttttgcataaacgtctcctttaattctaaaaaatattctcttctgttcatttatcataagcaactcactgttagaacgcaacctttagaatgagcatacttcttcttatacttcttcttacagagtagttaattgttcaaaaggttcggatatgacaccgataccttaccatcatcttctattgtaccgctttcttttatgaccgtgcaaataacttctctcactaattatcgagccatacaaaccgtggtttacagaataacttaattagcagtcttcaacctttattttgaatgcgataaaaaaggctcctatactaggagccttcacaatctcttaagaatatgtttcttctttctgtacttgctcatttacaagctctttcagcaactctataatttcatcattttcttccttcaaaccgacagtaatacgaataccatcatcgataccaaatgcagcaccagaacgaacgatatatccttttttcattaatcgttcgaaagcttcattacccggtataccaagttttaagaaaatgaaatttgtttgggatggataatagaatacgttatattctttacaaaatgcataatactgatttaaaccttcagcattcttttgcacacaatcttgtaaaaaggcttgatcttctaatgcagcgagtgctacagattgggctacagttgatgtattgaatggtaacctagctacttctagctgtccgtttaacttcgcatccccaatcgcatatccgatacgaaaagcagctaaaccatatgcttttgaaaacgtgcgtaaaaccataagattttcatacttttcaagaagtggtaatgtttgcggatagtcttctgcttccgcgtattcataatatgcttcgtccataataacgagagccgacttaggaactgattctaaaaatgaaagtaatttttgtttctcaacatatgtacctgttggattattcggattacaaatccagacaattttcgttttctcatctacttgctctagcattgcatctaaatcgtgaataccatctttaagtgatacttcacgaacttctgctccttcaataacagcatggtgatgatattgtgaaaacgtaggattcgccattacaacgtttgttccttcatgtagtaacgctcggctaatcatttgaatgacttcatctaatccactaccaaatagtagttgttctgcttttacacctaaatgttccgctacttttgtccgaagttcaaaggcatatccatctggataaagggcatattggctcgctaaagaagttaatgcttctgtcacacgtgctgaacaaccgaatggattttcgttggatgctaatttcacaatttttgataaaccatattctctttttacttcttcaatgtttttcccaggcacatacgctctcaaagttaacaattgctctttcactctcatttttcttcccccagtcatttcattcaatttgattacaatacggttatagccccatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgagtccagaaggactcaataaacgctttgataaaaaagcggttgaatttttgaaatatattttttctgcattatggaaaaataaactttgtaaa

SEQ ID NO: 1123 - DNA, 2396 bp, Bacillus thuringiensis
tcaactaagttttttatttcgtttgtcgcttgttacgttattgtcatcggcgacttgttctatattacacctctaaagtataatcgtcaatacgttttttaaaaaactttatattttatagatttcacttatgtatttcttctatagttatatacaagcaccccacagaactatctatggggtactactctattataaaaactattgctctttcgacggcgccgaacaacttccatcagtacaaaaaagatcgcttccaccctctgaagaaagttcttgtaacttaggtgcaggattctcttcttcccacacttgctgaagtgcaccaacaaaagtttcaagtggttgtgcacctgaaatagcatacttttgattaataataaaataaggtactcccgaaatttgatattgctgagcaatcgcttcatcaattctaacatcatttgcatacgcatttttatcattaataacatttaaagcctcttgcttatctaaacctgaaacttcagcgatagtagcaagtgtatccacatcacttaaatttctcgattcagtgaagtatgcgaaaagtagattttccgtaatctctttttcttttccttgatcctttgcaaacttcgcaagacgatgcgcatcaaacgtgttcgtcggcttcatctcatcaaaattaaaacttaaacccatactagctgcatgatttcctagctgtacgttattacgcttagcttcttcaatactaattccatactttgatgcaagtacttcattaatacttgtcccagaatagattggagcattttgatctaattcaaaagttttaaactcaacttcaacatccttcttatgcggaaattgctctaaagccatctctaatctacgtttcccaatatagcaaaatgggcatacaaaatctgaccaaacttcaattttcatagaaacacctcattaacttttagttttcaatcattgtagcactgagattaaggaattcaaaagtttttgctctacctccttcatatagtacatacaaaaatacacttatagcagaatacctaattaacaaaaaaacgataatcaaaaggattaaccattatccctccgattatcgtctatataaatgcaacaactttaattatgccggaatatacttccctacgaacttccatacagtattccaatatttattcgaatctactttctccgcttccccatgtccagcacctggaacaattaatttctctttttctacttttgcagcattatatacttcatctaacatttcaaaaggaacgaatgtatcagcatccccatgaatgaacagcataggtgttttacttttcgctacttgttttacagctgaggcctcttctaaatcatacccagctcttaatttagtaaccgtatttgccgcattcataacaggaaactttggtaagtggaataaatcttttagttgataagtaaattcatcaataacagttgaatatccacaatcttcaataataactttaacattagaaggtaaatcttctcctgaagtcatcattacagttgccccgcccattgaaacaccaaatagagctatttcagcattagggtctttctttaagatttgttgaatccaaattaaaacatctttacgatcatgccaacccataccaacataatccccttcactatttccgtgtccacgaaggtctggtgctatgacattatagccttgttcataaaagttacgaatatatttcgtcatttccgatgctctaccactatatccatgaactacaattgcccatttatgactagatggttcattcatatattcataaccttttaaatttaatttatcgaaagaacgtatagttaatgtgttaggtttatacttcgatacgaagttcgcattcttttcttcatttgcagccaatacatctcccgacgcatttaccgtttctactaaatgaggattatcttgcaaaaattccttttcttgtttcgcattcaacgcgtagttataaaaataattcccaactaacatatacacgattactagcaggactaagactactatagtaattatacttatctttttcatattatctccttttctaacttaaatcttcttatattaaagtacatcaaaaacaactgtactattttaacacactgatgaatcctatctttaagaaataaaatagaaaatcttaaattagatataaaaaatcacgaaagaaattgaataaaacttatatagctacgtacccaaaggccttttaaaaaatgagcagcacttcaaaatatttagctttgaaaagaagttataaaacacaaaaaagacgagtcattctgactcgtcttaaagttgcttgggcgacgtcctactctcacagggacaaggt

SEQ ID NO: 1124 - DNA, 6864 bp, Bacillus thuringiensis
ctatatttcagataactgaataaaattacacggcattacctaaaaggcgatttgaagataatcgcctttttatatttaatttctacaggaatcatactaatctctctttctatcatataactactttgtttaatttgttaaaatataaccgcttgtccgtttcactttgctctatcattacattgactattagtaatacgatttttagaggtgataaataatggacgaggggttatcttttgctgcacttaatcccggttctattggacctacacttccaactgttcaaccttttcaattccctaccggtcccaccggttctacaggagctactggattaaccggatcaactggaccgactgggccaaccggatcaaccggatcaaccggaccaactggatcaactggatcaactggatcaactggatcaactggaccaaccggatcaactggatcaactggaccaactggaccaactggatttaatcttcctgctggacctgcatctattaccttgacttctaacgaaaccacagcatgtgtatccactcaaggaaataatactttatttttttcgggtcaagtattagtaaacggtattcctactccaggggtagtggtcagtttttcgtttagtaacccatctcttgctttcatggttcctcttgctgtcattaccaatgcctcaggtaactttaccgctgtatttctagccgctaatgggcctggaacagtaaccgttactgcttcacttcttgattctcctggaacaatggctagcgtcattattaccattgtgaattgtccgtaatgattttatttttaagaactaagcaatttctaataaaaagagcactgattttatagtgctctttttttatcatttggatgtgcctttcaaattaaatttcgtaacagcctattaaaataacgcttttattgaatttcatccttaacaaaatttaattactccaatgaataaacatgccacagtatcgtattttaataaaaactataaaacagacatacttaacactaatagtagaatttttcttcttcatcaaattcacttcttttctttttataaacataaaaaaggatctctatttatacagagatcctttctaactttataatttactagactgtaacccctgaataaacggaactacttcaggatttacaagcgatgataaatcacctaactcttttcctaagtaagctgctttaataacacggcgcattactttagagttacgtgttttcggtaaatcttctacaacgtggatatctttaggacacaacgcttttccaatatgagagtttactaaactcattaattctttctttaattctcctgtgaatgttacatgatctcttaatactacaaaacaatgacaaacttcaccttttacttcgtcaggtacaccaattgcagcagcttcaattacatcgttatgtttcacaagaatagattcatattcagcaggtccaatacgtttacctgcaatatttaacgtatcgtctgaacgccctgtgatgatatattgttcaccatcgtaaatgacccagtcaccgtggacccatttattttcaaaacgtgaccaatatgtgttcacgtaacgttcatcatcttcccagaagcttttcgtcatacctacccaaggtttctctaagcataattctccgacttcatctcgaattggtttaccttgatcatccagtacgacagctgccattcctggtaaagatgcgttaaaactaatcggtgcgattggcttaataagaacattaccgaaaatcccaccagagatttcagttccacctgagtagttacagattggaacatttccttttccaactgtttcaaacagccacatccatggatcaggattccaaggttctcctgttgatgcgaatacttccaaactctttaaagaatgtttattgacatactcatcaccttttgccattaatgctcggattaacgttggcgaaatacctagatgagtaatttcatatttatcaactgtctcccataaccggtctgcttctgggaagtctggaacaccttcgtacataaccatcgttgctccattaatgagtgaaccgaataatagaaatggccccatcatccagcccatatcagttacccataatacacgatcaccttgtttaatattcattccaaatcctgcatcaaaggctgctttcaaaggaaatcctgcatgcgtgtgtactgttcctttcggcttaccagtcgttcctgatgtataaatgagcattaatggatcatcgctttgcatttcttcggcatgtatgaatggtttttctttttctagcgtactccacgaaaagtcatagttatgtggtgtaaaatcatttcctgcatgacgaacgattaccactttttcaacagttgggcaatgttcacaagctttatctacttcatcttttaaagaaacaattttacctcggcgtgaaaatccatctgcggtaataatcatttttgaacctgccgcttgcacacgtgtcataactgcatcagacgcaaagcctgagaatattggtgaaataattgctccaattttcattacagctagcatcgcaacaactgtttctggaatcattggcatataaattgttacacggtcacctttttcaatacccgcgtgtttcaaaccattggcaacacggcttacccagttatcaagctcttcatatgtaaatgattttgaagttccattttccccttcatactgaagtgctggctgtattctcgtctcttcatccgcaagccagcgggataaagctgattctacaacgttacatgttccaccattataccactgtgcaaacggtgtaccattttctaaatctaatacttctgtataaggtttcatccattgatagccaactgctttttctgcctctccccaaaaccaagctgtttcctcaatagatttattataaaaagtttcataatcttcatatcccaatgatttcatccaaccatataaacgtgttttttccttgtactcttctgttggaaaccaaactgcttgtttcaatgttttcccctccttaactttttgagcaagaaagccctaaatagggcttttaaactggatatacaggatgtttacgatccgtgaatacttgatatttactcatatacatttcgaaacgtccttttaactcttcacgtaaattgtttggatgaacaataccatcaatcaccatctctgatgctaaatgataaatatcaatatctttcttatactcttcacgtttttcagcaatgaagctagcacgctcttcttctggtaaagctgcaattttatttgcatatacagcattaaccgcagcttctggacccattaccgcaatagaggctgtcggtaatgccagacagcaatctggttcaaatgccggacctgccatcgcatataaaccagcgccatatgctttacgaacaacgatagaaatcttcggtacagttgcttcactcattgcagaaatcatttttgcaccgtggcgaataataccggcacgctctacttttgtaccgatcataaatcctggtacatccgcaaggaataataatggaatatgatatgcatcgcataaattaataaacttagcagctttatcagctgaatcgtggaataatacgccacccttcatacgcggctgatttgcaataataccaactggcttaccatcaatacgtgctaagcctgtaattagctcttgagcaaataatttttttacttcatagaatgaaccctcatcaataactctattaatgagatctttcatattgaaaggagcattttgattttctggaatgatttgttctaacgttttatcgaattgtttcggttcttgaggtgtaaccaatggagacttttctgagaggttgtttggaaaatatgaaatgtattgtcttgcttgtgtaatcgcatcttcttctgtcttacataaaacatctccgcatcctgatacagagcaatgcatacgagctccgcccatctcttctaaagttaccttctcaccgataaccatctcagccatacgaggagatcctaaatacatagatgcatttccctctaccatcattacaacgtcacaaaaggctggaatatacgcaccaccagctgcagaaggtccaaataacaagcatacttgaggaactttacctgataacttcacttgattatagaagattcttcctgcaccgcggcgccctgggaacatttctacttgatctgtaatacgcgctccagcagagtcgactaaataaaataacggaacacgtagtttttcagctgtttcttgaatacgtaaaatcttttcaactgtgcgtgatccccatgatccagcttttacagtagaatcattggccattacacacgcagtacgaccatgtattttacccgttgccgttacaacgccatccgcaggtaagcctgtttggtcacagttagcaaataatgcatcttctacatattcgccattatcaaatagaagcgctaaacggtctcgaacgaataattttccttttgctttattttgctcatgatatttcggtgccccgccttgtttaattgtttcaactcgttcttcaaatgaattagattgttgtttttggtctaacatatttactcccccttatacatcggtttgcgtttttctttgaatgcctgtaatccttctattcgatctttcgtatggattacaccttcatacgcttgtttttccatttgtaatccggtatgtaaatcaacttgaataccatttgaaattgcctcttttgctaatcgaacagcaataggtccattactagcaattttctctgctatttcaatcgctttctcttcaagtaaattagctggtacaacaaattctactaaaccgtattcttttgcttcttgcgctgaaatacgtctacctgtataaattaattctttcgctctaccaacaccaattaatctcggtaagcgctgtgtaccacctgctcctggtataattgcaagtgtcgtttcagtaagaccaagacttgcagattcagcagcaattctaaaatcacaagctaaacttaattccgtaccaccaccaagtgcaattccatttatagcagcaataactggctgtggtaattgttcaaccatctccatagtagtgcgaatcatactaacagcatggcgaacttgttcttcattcataccggcacgctcttttaaatctgcaccagcacaaaatgctttttcaccagcaccagtcaaaataactacacgtacgtttgaatcttcacttatttgagttaatatcgtttgtagttcatctaataatgccaaagataatgagtttgcttgtcttgcacgatttaacgaaatctttactacgtgaggtgttacataatcaactgaaatgttttgtaattgtagcatcttctcacctacttatcgttttatgttgaagcgctctatacacatgactcggtaattggatattcaacttactttgaataaattgactagctctcaataacttttcttcgtctatattcgtttggactcctaatttatggagcatatgtactaggtcatcagtggcaacattacctgatgctcctggtgcataagggcagcccccgagtccaccacaagaactatcaaacgttgtaataccgtattctaatgatttaactacattcgctagagccattccatacgtattatgaaaatgcatggcaaactgcgaagcatcatacttctttaatagatgttctaatacttgttctacttgtaatggattcgctacaccgattgtatccccaagagaaacttcataaatgccgtatgaaaatagttgattacataattcgtcaactgctgcgacacttatatccccttcataaggacatccaaatacagtagaaacatagcctcttacctttttcccttcgaataatgcctgttttgttatatcttcaattacaactaatgcttctttaatcgatttattaatattacttttattatgagattcacttgctgataaaaaaacattcacctcatctacattttgcaaaaaagctcgttccaaaccattttgattcggaacaagcgcagcatatgtaacatttggatccctttttagctcagaaaatacatcatttgcatccgctaatgcagggacccattttgggtgaacgaatgaggaaacttcaacatacgacaatcctgcttctgtaagtagttgaatccattttactttatcttttgtgccaacaatctttttttcattttgtaagccatcacgtggcccgacttctttaatgacagcaaaattaggtagtttcaattcgcttccccctatatctccctattcaatttctaataatacatctccttcatttacaaaatcgccttcttgcacattaattttcataactgtgccagcttcttctgaaatgattggaatttccattttcatagattccaaaatgacgacatcctgctcttcctctactgtatctcctactcctacaacaatcttccaaacgtttcctgccatcgatgcgtatactttcgtcatcattttttcccccttaatattgttaaatcttattttttaacgagttgtttcgttacaaagcctgttgtataaataccctctttgaacacttcgtcttccaaaacttgcagtagcattggcgtgttcgttttaataccttctacttttaattcttctagagcatcatgtaatttcgaaattgcttcttcacgagtctccccatgtgcaatgactttcgcaatcattggatcctagaaaggggtaatcggtacatggattttc

SEQ ID NO: 1125 - DNA, 5628 bp, Bacillus thuringiensis
taaatttgaggtagctggcgaaaaagatgtacctcttgaaatgttagaaaaataataaaaaacgcatttctgaagaaatgcgcttttttatatttttacatttaaatgcataagtttttcagggttaaccatcatataaatatttgaaattttctcatcctcaaatacaaacgaaagaacataagttactttattatttattgtaactataactcctggtataccattgaccattttgaaatcaacagtgtactcttctgtcaatcgttgtgcaatcccaaagaacaaacgtataattcgatccgcagaataaatcgggttaatcgcagtcgtaactttaccaccaccatcagctttgagtatagcatctgtttttaatacttctaacataccttccgcatccccacactgtaatgatgatacaaacttttcaacataagaagccattttctccgtgcttaattttgattgcttcggtttctccaacatgctttttcgagcacgttgaaagatcttcctgcagtttacactactcttatcaacaattgaagctatttcttcgtattcataactgaaaacttctcttaatatgaaaacaatcctttctacctcagataattgttgtaaaagtaataaatatgcggtggaaagggattctttcattataaatgactttgatggctcatcactctcttctacaattggctctggcaaccacatccctacatacacgttacgtttatgcgctgccgatcgtaatttatcaattgaacgatttgtcgccatcttacataaatatgctttcatattttctatagattgaggatcttctatattatttagcaagataaatacatcctgaacgatatcctcagcatccataacactcccaaggattctgtatgctaacgaaaataataatggttgatacgcttcatataactgctccgtttccatgatgaactgcctcactttcatattgctttaaaatgtataacgctgcacgcttcccgcttgctaccgcagcatcagctaatacttcatcatgccctacccaatctcctgcaacataaacacctggcatttcaggtatattagggcccgctttttcaacacggtcaatatgaggaaaatcatgtactactgttattttcggtaaatattgctgtgcaacaacttctcttttccaatttggatgtaacaactccatcgtactttccaactgttctttatcatcacgaatatgattcatctcgagtacaggattatagtacttaattagactcactacaattgatccatcttcacttaatttagctgctctcgattgatttgtgaaaaatataggttgatctaatcctaatacaaattgatgtgtaggattgggtaattgtctcaagccaatatctaatgcagcaacagtaaccggtacagattgttcactccatctatgcaaacttgttccttctgcaccttttattattttacaagcttctttcggcggagtcgtcacgatgactgtgcctacttcaaaaacctcatcatcaacacaatgtattctttgtttaccttcggaatgctcaatttccacaacatgctttttagccaaaaactgcaccccgatatcattcgctatagctcttaattttgatattatcgtctcccaaccaccatctacataaagcactccctcttttatagaaagctgtatttgctttagtacagatgatgctaattgtattgtaggagcaaacgtatatgttgttgttcggcatagcgcataaaatatattgcgaaccattggatcttttatttcattttctgcccatgtagttagactcattttcggaacttctcctacatctaaatttcctaaacgaatcataagacgtgagaattgtacttttgcagaccaagaaagtagtggtgttgataaaattgagtaaaaatctgttgggatagtgaatatatcccctttccatattccatgtgcttttgtagatggtattccacctggaagagtcataccaagctcattaaaagttataaacgctgccccgcctctatataaagcatgtgcaccaagattcatgcagatttcatttttatttgtagtcatccctcggccaccgaattgactggacttttctaatacaatcactttccttccagctttcgctaaatatatagatgctgttaatccagcaagcccaccgccaacaattgctatatcaaatgtattcataataaaatccctccttaatcgttctacatacaagacgaacgattaaggagggatgtgacataaaaataaatttttattatcctactttatttcattactttttaattcgatcatattgcatacgaaataactcaattgcaaatggaatatcctcttcactctttaaataataactaatccatcctgattcaggtaatacgtgatgtggttttaccaagccttgcttcactaattcatctcgctttaactttggaaatggtaaatcagctaatttatcaccatgaagatggccaagttctttcttgccataatttatttcaataccaccaaatcgatgcggtttttcagaaacacccgcccagctgagtacttcatttctaatcatttcactaaatgacatgaacattcactccttataaatgattgatgtaattttaaattaacattttcattacttttttccatcaatccaaagtatgaatgggaatacgaatatagtttggtcttaacaccttattctttatggaataagtgaatttattaagctaccgacaacagcacaaaacaaagactagacacatatcctaattttgtaacctaacttacctatagaaaggcgggtaatacaattgactgccaacatcgactatacctccccctcaaccaattttacttatgatgtaaataaaagtaatttttttcggaaagatgcccaaaattatataaatgtacttggtattaaacaattaaatactttagaaaatacttctttattagatatttatttaagtacaggaaatgttgtagaaccacatattcatcaaaatgcagctgaacttgtttattgtatttcagggtctgctgttgtttctttacttaatccatttacgaatcaaatattaaacttaccgataaaacccgggcaagttgccaacattccacaagcgtggtggcattatgaaattgctacagcaaataatactcatttattagctattttcaatgctccagcgccagaagttattttcggttctgacattttaagattaactcctgctcatatgatggcacatacttactgcctcaatgaacaacaatggaaacaagcggtttcccctattcaatcaactactgtaattggtcctccgtcaaactgcaatcaaaaccgtgaaatgaaaaattatccaacccagcccctcgctcaacaacataatccgcatcaccaagattcttattacttccctctttactggggctattaatttgtaaattttcaaaagaatcatcatttatctcctaggaaaataccaaggagatttttttattgtatcttctcttcctattaaaaatagtaacaattgatagtggacatacatataatatttatatattaaattggaggtgatagtactatgagtaattataactatcgaaaaaactactcttataataaaaatagtagttcttcagcatcctctcaatcttccaattcccaatcgcaaagagacttagcggagcaaggctatgtaaagaaaaaaggatgtaactgtaataaaaataaatagtttatcttatggatgaattcttttttaaaagaattcatctttttttactgatcggaaatttttaaagttacataacttattacttaaatgagaaagggtaaattatacttttttatacgaacttaacaaagagtaattgttcaattaatttattacttattttcctaaaaaatatagtccttcctaaatttattaggaaggactatatacaaacccctgtttaatttcctactaaacattgtaacaaattaaacgatattaatacctgcacttacaaatccagcaactgcagctattggacttgctgctgttaatgaaacatataacagtattttatccccagctgctactggaatagcttcaggtatgattcctgatgctgtagaaccaatcgctattgcggcaaatgctggcgttaataatagaggtgcaccttgtactgtaaacgtattgcttgctgcaggtgcagttaatatttgtatttgcacttgaacaggtgataatggagataatgcagctgttgcactaaagaaacctgctaatgacgtaatagttcctgcgcgtggtgctacaaatgcataatcacctacacctaatgctaatgtgatacttgttccacccgttaacgctataccaggctgactaaatccaaatccgagaagagttcctgtattagctactaacgcattaactaatgctgctggtgttgtacctgaagcaaacggaataatagctccgccaccagttgcacctgttgctcctgttaagcctgttgcaccagttaaacctgttgcccccgttggacctgttgctcctgttggacctgttgctcctgttgggcctgttgctcctgttaaacctgttgctcctgttaaacctgttgctcctgttgggcctgttgctcctgctcctgttgctcctgttgctcctgttggacctgttgctcctgttgctcctgttgctcctgttgctcctgctcctgttggacctgttgctcctgttgctcctgtcgctcctgttgctcctgttgctcctgttaaacctgttgctccgcctcctggacctgttggacctgttgggcctgttgggcctcctcctggagtagcaccaattaattgagttaataaatttaataaaagttgtaaacttgcagggtcaataattaaagagaaaaagaatggtgcaagagcactgtagaattgttgtaataaagaaagtaattgacttagatttgggttaggagattgtagtaaattaataatactttgaattaattgttttaagaaattcccttctggagaaggtgctaattcatttagtaagttcaatagttgagtaaacaaattgagtaaagctaatctgttgcatcacttggatttgcaaaaaacgctgcaatagccgaaattaaagagtttagtaaagtaattaatctacctaattgctcactagtaatcggaactgtttgtggattgttacaacactctggagtgaaaacaatcggattattgcagtggttatgaccgaaacaattattacttgtcatttatgtcctccttacttgttttatatttgagtttttcctattataaggatcataaagttgtaaaagagtatgtgttatatattgacttaaaataggaaacatgaaatataattaaacttgcaaacgctatttaattatgttcatgactcacatattaattatatgtttttaataattgactgcttagattaaatacctaaacttaagagtttattttatttttccacgtttatctcttaggtctcaaagacacattttaatttgaatacaaaaac

SEQ ID NO: 1126 - DNA, 4359 bp, Bacillus thuringiensis
  unsure (1)...(4359): unsure at all n locations
tttacgatagagaaaggttctccgaagatgaaaatctctgtaagaacgattccaccagctccgattcctgtaaagactgcgtatacagtgccgacaggtaaatctttataagctctaaataataagacgaaactaattgtaattaatagagcaacaccagcccattcaagtggtgcctctgctttttttagtccaatcacccaaaagatttcaataataccagcgatgattacataaatccatgccatatgtcatttctccttcctaccagtcgttaggtaaagggcttaaaaacgacgcattgcaaagggcaatccgtcagtttgaaagtccgcgccaaaatactttccaagaagcgtctaaacgtgtctcaaaacgatttaaacctgcgtataatagttcaaccataagaccgtcgagtaagcatagaaaagcctctaaggcgtcttttacttcaatgttatgcagctcatcttgttcgcttgctcttttaaatacagggaataaaagttttccgacgttttcaatgtgtacatttgctttattaataatttgttcgcgaaatgcatcaggcggaaaataagaagttcgtaaccaaaacattgattcttcactttcaccaaatcgttttgcatacccttttaataattttaaaagcaattcttcagtggacgaattggaaaagctttcgatatcgcctgtgaagctctgcaaatctttttgaagagcagattctaagcatatgaaatatagctcttcttttcctttaaagtgtgcgtaaatcgatggttttttaatcccaacttcttgagcaatatttgccaatgaagttccttcatagccgtagcgtgcgaaatgagaaagtgctacagctttaatgcggtttgctgtcattttcatcccctacctaccgttcgttaggttaattatatgagatgaaaaatataatgtcaataggtgaagagttgaaaaagagcgttataggtaacgctctttttagacagtctctcgctcaattaaatggaatgaaagtttttttgactgccgacaatttactcgctttggatctgcttatggaataaagaaaaagcatgtgagcccattgcgagaccgggatgttcaattgtggaaatttctaatgcctttgaaatttcatgattatcaaatccaaggatagcaaggtcttcaggtactcgaataccatgttttcgagcctctgttaataaaccagctgcaacttgatcgttcgctgtgaaaatagcagttggacgatttttcatatttaaaatatgatggagtatttgtgctccgtcctgcattgtatagcattggtggaaaatccattcaggatgcaacgttttcccttcgttacgaagtgtatcggcgaacgctttttcgcgctccatggaatttacacttgtttttcttgctaaacaaattccgattttttcatggcctctacttagtaaataggcagtaccgagacggaaaccttcataatgatctacgtagatggatgaaatgaggggatgcttcattttttcacatgaaataataggggcaaattttgcaaaaggttcgatttgttcccaagagctcgttcgggagcaaataatcatcccatcaaattgtttcattttcatcatttcaagaacacgaatttcttcaatgctatcgtaattcgtttgacataaattaatgtgatatccggcagctaacgcttcgtttccgattccttcaataatcgtactgaagtaggggaggttaatgaaaggaagcataacgccaattgtatatgttttccctcttattaaatggacagcatttatattttttgcgtagtttaattcttcaacagcatctagaacacgcttacgcttttcttcttttacgtaagggtgattattcaggacacgagaaacagttgatatcgatacaccagcagttttagcaatttgttttatattggccatatgtatcacctctttcccttattataaagggaaaataataagaaagaaaaaatcttgacctgaaaagcttttcacaaactatggtattaataagacttctttttattcgcgtaaccttttcacttgggcgtaagaatgataggggtcttttttgtttgcaaaaagtgttgtcaaaatgtgtgagaataacgtggaaagttttcaaaggtggagtttggtgacaaagcgaatatgaagagaatatcaacgcttcgttcgttaagagagcggtatgaaagggcggaaacaaattgaaaaaaagaatcatttgtttcgtgttttctagtttcatgcttagttcgtgttcgtttcagcaaacgatgcaagaagaaaaacactttgtgggaacaacaggaggagctatggatcgtgttacggatcctattccgctaaaggaacttccaaaatattttccggtgaagtttcaagttccaacgtttttaccgtaggacattacaagtgatgtgaagggggaagtaagaacgcttgggaaaaagaacattgtcttaacgattaaatataaacagaaggagtcaggtagaaatgagtatattgagttaaatgtcgcgaactttccttatagttttccggatcttgtggaagagaagcgatttcaagaacaaatgaaactgaataatggaacgtctgcttattttaaaaataaagatgattatgaacgtggtgacgaatttgctacgcttatatggaaagagaaaggaattgaatatcaactgctgtatcggaatgtagaagagaacgatgaaaaggtaatcaagcagaatttattatacattgcgaataagatgaaatgaaaaaactagctgatttattcagctagttttttgtatgttattatttctttttaattttgcctgtccaagatttaaatccaccttgtaattggtagaaatctttgtagccttgtttttttaagtattgcgctgcacgacctgtacggaatccgctttggcaatataagtaaacaggttgatcttgacgaagttctttatggcgaaggcgaatttgtgataacggaatgttacgtgcacctaaaatatgccctgcgttatattcgtctgcttcacgaatatcgataagctgtgctttacggtaaccagcgcgaaattcttcttctgtaagagttttaattaattttttctgatagaagtacatccatacagtgtagccgataaatgctacgattacggctaataaaataatccaagttgttgacacgattctatcgctcccttttttcttatcctactttcaatattataatgcccttatgtatttatgcaacagattcatttgcatataagaagaaatttcgtattctttcacaaattttgtcgaatttggtagactagagaatgtgaaaaataattggttatatgaggtgcaggatgggaaaagaaaaatggtgttatattaactctggtcaatgttcaccggcatttaatatggcgttagatgaatgtttattaaattggcaaagtgaaaagaaaatgccaccaacaattcgtttttatgaatgggaagtaccaacattaacagttgggtattttcaacgtgttgaaaaagatattaatatggatgtagttaacgaaaagaaatatggattcgttcgtcgtcaaacaggcggcaggggtgtactacatgacaaagagttaacgtatagtgttattgtgtctgaagatcatccgaatatgccgaaaacagttacagaagcgtatcgtgttatttcgcaaggtttattagatggttttaaggcattagggttagaagcatattatgcagttccaaaaacagaagcagatcgtgaaaatttaaaaaatccacgttcaggcgtatgttttgatgcaccatcttggtatgaaattgtagtggaaggacgaaaaattgctggtagtgctcaaacacgtcaaaaaggtgttattttacagcatggatcgattccattagaaattgatttagatgaactatatgatctatttttattcccaaatgaacgtgttaaggaacgtatgaagagtatgttctcttctaaagcagtagcaattaatgaattaacagaccgtacatttacgatagaacagttaattaaagcgtttgaagttggctttgaaaaaggattggatgtagaacttgttccatatgaattaacagaagaacagttacatgaagttcaaacgttagcgaaagaaaagtatgaaagtaatgagtggaattataaaaagggaagggcggcngctagtgaccggagacagtatgaagaatatactggtagacgaaaacaaaaagcggcttgcacaacggaaggccaagctcgattggatggaagaag

SEQ ID NO: 1127 - DNA, 2286 bp, Bacillus thuringiensis
aatgtcacgggtgcttcttttttatggccttttaatacaatttatttacatgatcacttgggaaaatctttatctgtggccggaatggtattaatgatcaactcgcttactggtgtaatcggaaacttgctcggcggtgttttatttgataaatggggcggttataaatcaactttagtagggattgtgattacacttgtatcaattttaggtcttgtgttcttccacggttggccgttatatgttgtatggctagcgttaatcggcttcggttctggaatggtcttcccatcgatgtatgcgatggttggtacggtttggccagaaggcggaagacgggcatttaatgcgatgtacgttggacaaaatgttggtattgcgatcggaacagcatgtggtggattagttgcatcgtatcgttttgattatattttcttagcgaactttattttatactttgttttcttcttaattgcttttattggattccgcggtatggaagacaagaaagagccaggagtgcaaaaagaagtcgaaacgaaaaaagggtggtcacttacacctggatttaaagcacttcttatcgtgtgtgtagcatatgctttatgctgggttacatacgtacagtggcaaggagcgattgcaacacatatgcaagaattgaatattagccttcgtcactatagtttattatggacgataaacggagcgatgattgtttgtgcgcagccacttgttagtatgctaattcgctggatgaagcgttctttaaaacagcaaattatgattggaatcttcatttttgcagcttcattcattgtgttaagtcaagcgcaacaatttacgatgttcctcgttgcgatggtaacattaacaataggtgagttatttgtatggcctgcggttccaacgattgcaaatatacttgcaccaaaagataaattaggtttttatcaaggggttgtaaatagtgcggcgactgtagggaaaatgttcgggccagtcgttggcggagcaattgtggatttatacaatatggaagtattgtttatagcaatcatggtaatgcttgtagtagcgcttatagcaacgagcatttatgataaacgagtaaaagtagaagaaacagttgaagaaaaaattgcagtttagtttgacggaacatgtaacatgttttagaatatatttaaataaaacaacctttagaacaagggagatagctcggctgtcttaagatgaattcgttagttattaagagtaacgattaaccgagaagtcctcgctttaagtaagctcttaagagatactaggtgaaggatagttcacgtaacttatatgtgtaataacagtgagaaggagtagtagtaatagaagctggtttagagagttgacggtcggtgcaagtcaatccacgtttcgttatgaactcgcctttgagttgcagttgtgaaactaatagtagcaattgccgttaatccacgttacggatctaagcgaatgtatatttgtacattaatttagggtggtaccgcgggaatctataacctctcgtccctttttagggatgagaggttttttgtattttgggcggtgaaaataaatagaatttcaaggagggtatctcatgagctttaatcatcaagaaattgagaagaagtggcaagggtactgggaagagaataaaacattccgtacgccagatgagacagaaaaaccaaaattttatgcactagatatgttcccatatccatcaggtgcaggcttacacgtaggacatccagaaggttatacagcgacagatattttatctcgtatgaagcgtatgcaaggatataacgttcttcatccaatgggatgggatgcatttggtcttccagcagagcaatatgcacttgatactggaaacagcccagctgaatttacagagcataatattaatacgttccgtaaccaaattaaatcattaggtttctcttacgattgggaccgtgaagtaaatacaacagatccaaactactataagtggacgcaatggatcttcctaaaactatttgaaaaaggcttagcttacgttgatgaagtacctgtaaactggtgcccagcacttggtacagtacttgcaaacgaagaaatcattgacggtaagagtgagcgtggtggacatccagttgagcgtcgtccgatgagacagtggatgttaaaaattacagcttacggagatcgtctattagaagatctagatgagcttgattggcctgaaagcttaaaagatatgcaacgtaactg

SEQ ID NO: 1128 - DNA, 5972 bp, Bacillus thuringiensis
tcgttcctaaatatcccgttcctgttgaagcagtagaaacagctgaaaaactaagcattgacgtattccactgtggaatcaaagatattgcgataaaaagtagagaagctataaaaggatacactagcatgctcatgatctttacagttatatcttgaccaaaatttagtatagcgataagaccgagtactaaaacaagcgataaaatggaccttggaggctccgacatgtgcaattgatgcacgataaagctactagcggtatttgtaagtgcgaccgagtacatcagcacgatcgtataaatggagacaaaatatacaatattaaaaatgatacttgccttatttccaaaatactctcttattgtacctgtaatcccctcatcggcagagttcgaagcgtaaatcattttagcaagcgccctatgtgaataatacataacaggatatgcaagtatggtaattaacagcaatgataataaaccacctgaacctgcattaatcggtaaaaagagtactcctgctccaattgctgttccaaaaaggctcaatgcccaggtagtatcctgtttatgccactttttagggtctagatatttctcattttttactgcagtgttatcagcttgaaattctatgttttttgcagtattcccatccatataataattcctccttgtgtcctattcttaattctctttttaagatataggaatatagaccgttcttgaaaaatgaatagcttatatagtgccccacaacgaatatcccccttctaggttaataaaaatcaaaaaattagcgaagcatcaacctgaagggtttgttaccacttataaaatattttaattatatagtagtatattttattgataacttccccaatatacagacatccttaggcgaacaatagagtaaagattgttaaaaacttcacaatatattcgataacttattgatttgattgtttctccccaaagattttatttttaatggaaattcctgtaggtgtagctgcaataccacctaaacctgtctctcttaattcgcgaggcatctgtcttccaactctatacatggcttcaatcacttcgtcagcattgatgagattgtttacgccagctaatgcgatgtccgctgctgctaaagcatttgccgttccaatggcgtttctctttacacaaggaatttctaccaaaccagcgaccggatcacaaactaaaccgagtaaattttgtaatgcaatcgaaaaagcttcagaagattgctgtggcgttccacccgcagcttctgccgcagctgcagccgccatcgctgaggcacttcctacttcagcttgacatcctccatacgctcctgaaatacaagcgttgtttgcgactatcgttccaaataacgctgaagtgaatagaaaatgaatcatatcttcatgacttaactgcaacgtatctttaatactaaataggactcccggaatcgtcccactcgcacctgctgttggagttgcacaaatagctcctaatgcagcatttacttcattaacaccgatagcactttgaatccctaacaccatcaaatctccagaaagagttttcctattttctcgatagtttttaatttttacagcatcccctccggtcaaacctgttggagaaaatacaccgtcgccctcgatacttttatttattgcatgttgcatagtcgctaaatttcgttccattttactccatacttcttcataagaagttttagtttgtttgatttcctgttcgattgctaattcataaatttgcttttggcttttattagctgcatccacaatttcttttatggccatatacatatttttcactccttaatgtgactaaagaataataagattagctatattgcttaaatctcctaattccttctgagcattacctggcaatatcgaatccaaagcgaatgcatataaatattttgttttatcttccaaactatgaaagttgttaatttccacatcatattgtttaaagatcctgcgtaaaacaaattcaaagtcagctctttctgaaatcgcaataacaactggcaatggcccctgcagatttaagctaaatccatcaatttcaacatttttgacttcaatcaacccaccaccgaccgaaacacccattactctaatacttcgactttcatcctctgcatatacatctgccgtatttggatgaccagcaggactattacccaattgttcaataaaggtaatgtcaattcccttagactctgctattttaatagcatctggcactttgctgtcatcagcagctaagcctaatataccagcaataattgcaaaatcagttccgtgacctttatgggtttcagcaaatgattcataatactttaccacaacttttttaggaagaccttgaaataatttattagcaactgttccaatagccaaagcacctgcagtatgtgaacttgaagggcctatcattatgggcccaatcacatcaaaacaacttttgtatttaacaatctttttttctttaatagatgctacattcatgttcatataagcacccccataatttattatttttagctgtagttgaatctaagttattagaatgatcgattcaaaacaagttttgtttgataacgctttctttattgagttgaataaacttcccttctaatccgctatcctccgtatagtaatcatatcagtatgtccaattttaaaaaattactggcaagttctttagaatttttaatccaaaacgaggtttgatattttctctagaggtaataaattgtgtctcgacgccctcattataacttgtatatttataagtttaatctttttttattttcagaaagattgaatagacagaattttgaataggtaataaattacacttagtatgtagcaattgtgtcctttgtttgaagctgtattagttagtaaaaaagcaaaaataacacagagttcctttcataaacacattgattatattgaaaaatcattataaagatacttatattgtcttttgtttgaacatcttattttgaacgggaaacctgttgcaataaataattcattcatatgaaaaggaatacattataaaatttaaaaacgtttcagtatattaattatacattttgtataaatattaattatcaaaaaaaactaacttcttattaggatcttaacataaaggatacattccaaataacaatggaaattctgctttatcaatttctttatacgttatatttccctctttacctgcaacagcaacttgtactttttcatttgttttcacatcctctgcacctattgcaccacccgccaataatcctgtacttaacagactatcgtgaacgaaagttagagagttatggaacaaaatataatgtgtatgtacatacatttcttttaaaagaagttttgtagtatgcaactgaattaaaaaaatatagatttttatgactctttttaggggatatagcaaagtgggatcttttatatgcacattgctataccgaactagatttcagtatagtatttttttgcaactcattgatttttaccaaacacgtataaaaaccaacaatatgaaaataaacgactggctaaaattttactttcaataaaataaaaaagaacctgcaaatttgcagattctcctgataatgatttatatgagtaagactcggaaatataatacaatgattcaaaaataagttcaagtaaattcaaagaacccgctggagttcgagttctttcagaagtgatgatgttttctaggcttagcaaagtgagaaaatacaagaatataatacatcgagatttagagaatttcaatatttaaattagaggttattttaatgtgatgtaacatcagcattttgaaggaatagcaatgaataccttatacattcccagtctacataacgctttattatcagtagaaagaaaaaggaaaatccctactttcacaataaatccgccttgctactctattcattttttgatacattcctatccaccgttttaggcttctcttttgtactgtgttagccgaaaaattgtataaatcataattcgtttttcttccacctgtttcaccctttttacaccctagttttacaaaataagaagtcatcaaaacttatatttattactttctgttatctcctctctcttgttctatgcatagtctatctaaatttttattagctactaaaaaaaaatttacaggacgattaaaaaaagccaagtgcattgcactcggctttatggtcgattaaacaattttacttcagacgtattaaactgatgtagatagtctttagtagaagtataacctgaattcatgagtgttttcttttcttcttctgtgatatcaaaattaaacgacgacgtaaagaatgtattaataaatacagtgcgggcagcatcttctttggtggtttttccgctctcatgacctttaatcatggtttgagacaaattccatgcaaaatgaataagagaatggccaatatgatgttctgttgaagttgcgatatgttttaacatggcaacctccgcctgagattctaaacggaaaccaagtgtttctttgttgtagacaatttcatctgtaggatcaaagaaagatgcattgtatttcgtgtgtaagcttcttagtgtagaatgatcctctatattgcttatcagtttattaacctcgtcaatcgtatctgtggtcgtgaagtgttcttctttattcacaaaacttttccgatcaaataaacgaattgggtagttatcgagtacacctccgtctacataataatctttatcccattccacagatttaaaaaagaatgggatggacatcgaaatccgcacagcaactactaacgggacatcaggtgtcgtttcgcgagaaaacgtacgaagttggtgtgtagaaacgttcgttccttgaaaaaacacgtcttttcctgttttgtcatacaactgctgaaaagttgtgtccttactccctgtccacttttcaacgatctttcctacccactcagtgaagaaatcccctttatagataccaaaaccatcaaaaaacaaacgaatgttatcttgtacaatcgaaaaatcatcatctttaaacgctttgaaattcatgtctttgtggattttcacaagatctgcgaatggaatggaaagacctaaaagtaatgcagtaatcgctccagctgaagtccccccaaatcgttgtatttctggtaaaatcccttcttcatttagtgcacggatagcacctatataagcgcttccctttaccccgccaccttcaaatactaagttacgaaatggatatgccattatatacctccaatcaagaaattttcgatctgttatagtatcggaagtatattgaaatatattccaaatggtattaagaaagtttcatgtcctccgatacgtatggccgaattatctttattcaatggataaattgtttgaaagggaagaaatttgcttgaaatggtaatttagttggataggaaacaggaaacggagcgcatctttggatgcactgaataatatccccttttgaaatcgtatataacgtaacttcttttccgatgcattctccaagtaaaatcacgagtaagaaatcaaggaacaatctacatttcataaatccctcactctctttaacatacaatccagtgaaataatttgtttcaaatacgtagaaatatggtttaaccagcaatcaatgatcaggtcttcttaccctaagtaaacctaaatctgtttgtctccatacagaaagtgataaatagttttgtttctattcaaatagtacaatatatgcaaaattacatatctaattaattgcttttaatgttatattttaatagcgatgaatgctattatttcataagttgtcaacaagcgttatgtatgtatgagaaaaaggaagg

SEQ ID NO: 1129 - DNA, 6076 bp, Bacillus thuringiensis
acgcgttctgtaaatcaggattcgtgattgggtgttgtctatgagtataatggattgagaaagcaaaagaaagctgcataagaaaaaaatgaaaccttttagggtttattgggtatgctcatttttaagaggattatactgtttaaaagtttgttcatttcaattaatggaaaaccgtagagtttctatccttaagttgatgggcatggggagttggctataaaattgagaaatgaagcatttgatatattaaaagatatccctaaatggaaacttattttttggctcttattagctatcacactcacgcctattactgaattaattatttatcgcctcgttacgagtgtaattgagagttcacttactctaactgaactcggtaaagaattcattcgaatttttggttatgaaaagtataaagggattaaagaatcgttatggatgatgattgtatcttatttgtttttattttctattttttcatcctatctttacattttttatcgccacgagaaaaaactttactatgaaacttgtattaaaaaaatgatagaagaaattcgttatattgcaaatggaaacttcaatcataaagtttctattgtaaatcataattatctagaagaattagcaatcggggtcaatgaaattgttgaacaattaaaagtctccattgatgaagaaagacaagcggaacaagcaaaaagtgaacttattgcaaatgtatcacatgacgtacgcactccccttacttctatagttggatacgtaaatttaatccatcatgataattatagagatgaagtagaattgcgatactatattcaagtcatttacgataaagtaactcgtcttaatgcattaatgaatgacttgttcgaatatacacgtgttcaaaataaagagttaagcttgtattctgttcctattgacatagtagagttacttggacaattaactgttcaattccgtatacaatttcaagaagcaaatatagaatgtcgaccttctttcccatctcaaaagctcatggtattagctgatggtgaaaaattagtgcgtgtgtttgaaaatcttattataaacgctatcgcttatggaagcgaaggtcgctatattgaccttactgcttatgaaagcaataatatgattacaattgatataacaaattacggacaacctattcctagtacggatttacctcatatttttgaacgtttttatcgcgttgagaaatctcgctctacaaacactggtggatctggacttggattagctattgcaaaaagtatagtcgaattgcataaaggaacaattgaagtatatagtgatgatgaaaaaacaacattcactgtaaaactactcccatacaaatgttaatattataaataaaaagttcaatttcttatcatataagaaattgaactttttccattaatgcccaaaatttaataatcctttataattctttagaaattctttaccttttctttcttcctaattaagcattcctttttacaatactagtattgatgtcataataggaggatcgcttatgcaattcttaaaaaaattcgctattttattattatcttttttcattactgcacttatcgttttatatttttacctttatgtaaatggtccgattattcaagctaaatcagctattttaataaatgctaattcaggtgaaattgtttataaaaaaaatgaagaaactccagtacaatcagctgctttatctaaattaatgacagaatatatcgtattggagcaactaaatgatagaaagatacagttagatgacttagtacaaataagtaacgaagttttccgagtagaaacaagccctatacaagtaacatcgaatgataaaacaacggttcgtgatttacttcatgcattgctactggcagggaataatcgttctgcactcgctctagcagaacacattgctggaaatgaagataactttacagtattaatgaataaaaaagcaaaagaactaaagttattacaaccatctccatttctaaactctactggaattaataatgatacagataaacaatcaactacaacagcgatagacgcagctaaactagcagcaaaattagtaaaagattttccagatgtattgaatattacgaaactaacctcttaccaatttaccttcaaagattcccaggttttcaatacgaataaaatgatatattcccttaatgaaaacattaaacttcaaggtgttgatggcttacaaactagtttttcaactaacggtaattatagttttgtcagtacagcaaaacttggagatactagactaatttcagtaatattagatgcagatgaagaaaacatttcatttattgaaacaaaaaagttgctacagtatggttttgatccttcctcgtactctgcactccaagcttttaaagacgcccttacatcttggacaatattgcttcagttttaaaatttaattatacaaactataatgatttttttaatcattaccaccttaatgtttttacatatacgtcagaaaaaatccgaggatttcaattaagaaatcttcttatatatataaaaccgacttgcgcttaagatgcaagtcggtttttaattctatcatcctcttcaaatttgctgaaactggttgcaagtttaacttcctcgcccatacagacagctgaccaatatgatgaatttcatatcccattacatgtcttaaaacctatgttttttgaggcatacatccatctctgtttcctttcgttgtgttcgtttgtttagtttaaatgggttaatctattaattctattaaatccaacaattgaactattacattttaaagttctactcatatactatagtaaattactagaaaggaggtttaactatggatagttgcgttgtatttgtaaacggacaaccttttctagttctttcagtagctggtattgaaattgctagattagagatttcccttcaagtagcattagctctaagagtgcttgggataccaatctgtgattaattaccaaattaaaagaaaaagagggcattagccctctttttttattttcttctcaccttttcttaacaacaaacaaaattcaaatttaattaattataaaaattaaagtatatgaacgttacatgaaacacttgttaagatagctgtccttcacactatttatttcgccgacattatataatcaaagcacacaatgattaactttttatacggcttattttaagtgtgctagcattctaggctagataattatgactgcaaaaaaacttcaagttctcgtttatataaattaaataacgctttcactttttgaatcgattgataatctttaaattgctgttctctatcttcttatccttgaagagcactaatccaactatactctacatctacaatatgaaataatgtttctaacatgcccccagtttgcaaagtaaatcttcctctgaaagttgttcacaccacttaaaccaatcatctcttacttgccaattatattgaaataaagtgtacacatttatctctcccttacttcaattatccacctaacagcatctgttatacatttaaccattgacaatcacttctcttcggccaagttcctctacagcgtgattaattatttcacttacagataaagaaccatccaatatgatatctgaattcggcttaacagtatgaattgcctctaaataagcttttctcgcatatgtcatgtaatgttccaaatcattatgtatttcatctattgtaccttccttaaaatctcgcaaaatccttctagccatcgcaatatctaaaggcgtatcaataaatatagttacatcaatgaatttttgcatctcactatttaagtatgcaaaaggataatctacaataatatagtctaaggtattattttgtataagttgctcaatatcatgaattaatggtgttaatacccactcgtcgtaattcgccccatcatcaatccatttacaaatatcagcaggagatttatcaaatgtgtaactatcaaaatatagagcttttgagtttttaaacttatgctttaatctttctgtaattgtagttttacctccccccgaaacagctgcaattgaaattatttttgttttattatccactatactcaccaaacccctttgttaacataatataattataaatcactatcgttgctacttcttccattcatattctaacatactcatttcccataaattccaatacgtttctcctactctttttgactctcttaataagccttcttttacaaaccctattttttcgtaacatgaaatggccgatgtattaaaatcatacacaccaagagttactctatgtagttttaattcgtcaaaagcaatatgaagtactgctttcatcatatgttttcctatagaacgtcctctcatcttcgtattaccaactaatacttttccaattctagcggacttattaatattatctatttgcccaagcgaaatatgtccaataacgtctgaagtctcttcatctaccactttgaaagcgagtgtatttgcactttctatatacttctctaattgctgttcgtctaaaggaaatgtgaatgcatttcctgaccattgtattagaaattcttcggaattaatccaatttattaattgtttaaaatcagatttcttaaagctttctagtttaatcacttccttgctcctttcgtacatcatgctttataacctcaaacttatttctatataaagaatatattctccttttatataaaattaaaataaagccattcatgtgaatggctttacaaaaaagcagcataattatgctttgtttgctacatcaataccattaaaatcaaagtcagcagtaaccgttgtaaccggtgggaaaattgcttcaattttgcaaatggaaataattactccaaccgatccaggaatagccgcaagcctaactacatcacaacttacagacgaaacagtacctacataagtacgtccctctgtattaatttgaactgttcgattaattaatttcttaagttcatctctaattccttgtacacaagaattatcacatttctcatgctgttcttttttacactcttcgaatacttcccaacaatcatcttgtttacatgtacacttctttttacaattattaaatcgagaacccaatacctcaccccctaatcctttctattagtaaagtatgtccactagcttaaaagggtacgaggcaaacacataaaaagaaaaaaacaaacaattgtaccaaactttcttttcattattcattataaaaacagacttctcctaattaaaagctttttaatgagcggccgtgaatttagtcctactccatttaatgtttagacaccactttctaaaacaaaccttttttcttttaaataagacgccccttaaaaacacactagattttcccattaactcacatatacatagactttatttgtggatttcccatttttcattgtgaaatatacatttaaaaagcgtactcgaaaataagatattatttgtaattagaacattttcttcaacaagtgtttattgaaaaataccataactagtagtagttctctccactttctcttaaaaattagcatagtttgtatgaattctatatcgagtagaagacactctatcatataaagataaaatagtaggttaataaacaagccatttttttattaaaacatagaataatatgaacactattgaaagaccaactatgagaagtcaaggggagttttttatataaatagggggtgtttttctaaaaaagggcgtgccaaataaacctaaggattttcaaaaaaaatgaaaaggtcatgtttctgttgtgtgaggtggtacttcataaggcttattgcttttaagaatggcatagataatgtaacacagctttctagctaccgcccctatacaaacatagtagtgctttccttgctttcgtttcttttcataaaaagcttttaatacagggtcatgtttatgcgctgtaata

SEQ ID NO: 1130 - DNA, 6394 bp, Bacillus thuringiensis
catcacataactgttttaagctttcgttcatcataagtgctctgagatccatcttcttcatataaacacggtgtccaaagcccataattttttttttgttatatagtttcttctgtaataactcttcaaatttctcaacattaccagcttctaaaagcatgtacataaccgcttcatttgcaccgccatgtaaacttccttttaaagatgcaactgcacctgttagagcgccgtataaatctgattgtgttgatgcaataacgcgagctgtaaatgtagagtttggcatttcatgctcactatataaaacaagggaacgatcaaagatcttttcctcaagttcagttggttttttaccagttaacatatagaagaaattcgcactataagataattctttaagaggttcaattggctcctcattatttaaaatatgatagctatttgctacaatgtttggcactttacttaacagcttgtaccctcggcttttattcacttctaacgagcggttttcgatatcattatcgtaaccagctaacgctgacacacctgtacgtaatccatccatgggatgcgtctctttaggcaatgcctttagtacgttgaatacaccttctggtactgcatattcttcttttaatttcttttcaagtgttgctttttcatcttcattcggtagatgttcctccaataaaaggtgcacaatgtctaaatactcttttgtttttgagagttcgattaagtcatacccttgaattacaatttcaccttttactgtgtcaagaaacgagattttcgtctccgctgccactataccatctaatcccggggaaaatttctcttcagctttcatcattatttcctccaatcctaatagatcttcgtgcacataactgtaagcctttacaatattgtgaaactacatttctatttcaatgtatcagagtttttagaagatttcaatttattttataatgataagtttcctacacttttcttaatgtaacaatacaattttttgaaaataattcttatattttataaagaaaggatagacttctttgcgtattttcaaaaacaaaatataaagatttttcatataacaccgccaaatatacaattattctaattttatttgagaaatagaaaaaacgagctgtacataaatacagctcgttactatatgatatttatttcactatctcttaaatataatttttatataaaacttattcatttttaataaagttattattttacataattaaattgaatttcttccatttcctcatgataacttacaaataaatcatagttttgaaaataccaaagatcatcacaatctacaaaaaatataataccttccttctcaactgacactatttcgccatcgggtctctcagcaacaacccctaaagaatatccgggctgaattgaactatcccctccgtaccttacagtaaaacgtacagattcaccgtgctttatacgtaattcttcctggaaccattgcagagctttacgatcaattgaaattctcatctttattcctccagtttatgcaaactctttttttcctaatcgttgttttacaaaaaagacgaaaataattaaggctatcaatgctgaaattgcactccctgaaaataaaatacgataaccaaacatttgtgaaacaactccaagtaaaatagcacctaacccgattcctaaatcaaacgctgtaaaaaatgaagcatttgcaactcctcttttactcggatcgacaattgtaagcattgccgcttgcaaagctggctgcgctgaaccaaatccaataccgtataatgttgctgcgataattacacctatcaaaccatttgaaatagttaaaacaactatagctaaaatagtaatacataatgctggaagtatgatgaatacttctccatacttatctaatagtttccctgaaattggtcttacaattgttaatgcaattgcatatacaagaaagaaagttcccggattcacatgaattgatgatgcaaataacggtaaaaaggttgttattcctccatatgcaaacgataaaaagaatactacaatcgtgattgttaatacagatttctcaaatagctgcatcttccctttttctttttgtggtgtaaatggcatcttcgttattaatgataatacgactgccataaaagataacaacgtcgctaataaaaatagaccatcaaatgaataattttgcacaacccatagtccaatcataggtccgatcgccattgcaattgtcatcgccatcccgtaccaacccataccttcaccgcggcgtgaatctggaataatatccgttattgctgttccaacagctgttgtagaaacagcccatgttactccgtgaataacacgtaaaacagctaaaaggacaatagtcgatgctatattataggaatacatcgttaagccaaaaaagatgagtccgaaaataataaaggatcttctaccatattgatctaacattcctccaataatcggtcgtattacaacagcagctattgtaaacatccccatcataagtccaacttgcgattcattgccacctatctctttaataaagagcgggagcgttggaacaagtaaataaaatcctgtaaataaaaataacattgcgaaagtcatttgaataaatgatttcgtccataatcgttccataaaaatacctccatacactcgtaaaatattacgattaacaccttcattgtatattttttttatctcttttccctccgcaaatagacgtatcttttcatattaaatagtccaccatcagcttacattagtcttaagactttgtacgcatgttttaaacaaaagtcctatataatatgtacctttatatgtgtgaaaagaatatactaatttattaactcaacttaggagtgaatatttcatgtgggtattattaagagtaactgccgtagttccttcgactcctgggatacatgttcctgcagttcatacagctagctccgatgtaggaattgaacttcccgcaacttggcagcaatatcaaattcccggtcaagttaccccatcattttggcatcatggtacacaccccagtagtactcccattcatagccatagttatcctccactacctccgactcaagtcttttatcatttcccatcaatttattttcaaaatttttatggtacgtttaacatttaaaacagatcctttcatagctactacatttaaacgaaaaaagcacttaagattgtaaatttcacaaatcttaagtgctttttaatattttttataaatttttcttattgcccattattagcaggtgcctctcctgcattaccaccggtcgctggtggagttgtatttccttgacctcctccgttatttgctggaggtgtcgtatttccttgacctcctccgttatttgctggaggtgttgtatttccttgacctcctccattatttgctggaggtgtcgtatttccttgacctcctccgttatttgctggaggtgtcgtatttccttgacctcctccattatttgctggaggtgtcgttccttggccatttccattattttgctcatcttgtttcttttgctcttctagtttcttttgttcttcttgcttcttaagttcctcttgtttcttttgttcttcttgttttttcagttcttcttgtttctttaattcttcttgctttttctcttcttcagttttttgctgttgatcttgttttggttgctccgttgtatccggtacgctagtatttggcgatgaatcacgtttttcaccttttatacgtagctcactaccttcttgaataacgctacttggcattttaaagcgtgatttatctgtagccatttcgctcatcatttctttaaagattaactgtgcaattttcgtgtttttactactaatatactcgtctttaccatctttcatatacccagtccatactgccatcgtatattgcggtgtatatccagcaaaccaactatcacgagttgcactttctggaattttatattgagctaattgctttgatgaatagtttgtcgtacccgttttaccagctacatctaaagagcctacatttgccgatgtaccagtacccgatgtaactacagaacgaagcatatcagtaatcatgtatgcggtagaatctgtcataacttgttttggtttttgtccaaaactttgtgacttaccgtctggataaacaactttcttaacaaaatgcggtttcgtatatttaccttcattaccaaatgccgcataagcacccgctatttcagttggcgatacttcatttgtaccaatagctgtcgattctgtcggtgctgtattaaatgtaatacctagtttctcagagaattcttttgatttactaatccctacttcttttgcagttttaattgcaggaatattacgcgacatttttaatgcttcacgcattgtaattggacccatataacttctatctgcatttcgaacttcttgacccgttgaatacttaaatggagagtcatcgatttgatgatacgtagcccattttaaatattcaattgcaggagcatagtcgaaaatcggcttcatcgttgaaccagctgcacgatctaattcaattgccatattatgccctttaaatacagctttattttctccacggccactacctatagcacgaacttctcctgttttcgtatccataaatgtgaatgcaccttggaatttatcgtttggataatcaatgatattattatttaaaatattatcagcaagtttctgtgctttcggatctaacgttgtataaatttctaaaccgtcagaaccaatattagcatctggcaattctttttctacttctttcacaactgcatccataaatgcagggtatggcattgtttgtagttgagctgcaggcttaagccccttttctacgtcaacttttgatgcttcttccatttcctgttttgttatatatccatgtcggttcattaaacttagaacaacatttcttctgtctgttgctttttgaacattttcttttttcgttggatcatagttattcggtgctttcggtaaacctgcaagcatcgcaacttctggtaatgttaagtccttcaattctttaccatagtagttttgtgctgctgttgcgataccatatgaacgattacctaagttaattttatttaagtacatctctaatatttcatgttttgaatactgttgttctagcttataagctaaatatatttcttgcgccttacgctttggtgttttatccatagataagaagtagtttttaataacttgctgcgttatcgtacttccaccttgagagccataatctcctttaagactcactaaaacagcacgggcagtacctttaaagtctactccgctatgctcataaaaacgtgaatcttctgtcgctaaaaatgcattttctactaatttaggtatttgatcatacgtaacattcgtccttttttcttttccatattcatataccaaatccccgtttttatcataaatttttgaggataacggattaacaagttttgctttttccagttttggtgcgtccttaatcattacgaaaaaggtagcaacccccgccactaaacctacaataccaagtaataaacaagtaattaaaaacttgcggaaaaatgatgttttaccttttggtttttgtgttttagaagctggttgttttttctttttaacttgtcgtcgctcctcgcgagaacgataattttctgacatgttactttctcctgcctttcaattctcccgttgatttaattaaaaatattgaggtcactttcgtaaatacgtttaggcaaggaagtgtattgacctggagcattcaatattttcccaattcacagattacaaattttaaaatggctcttatacatactattttcacttctaattttctaataatgctgccccttttagcataataatgaaagaagtgaatttttattacctcgtataaataatatacctttttttcaaatggtcaatattttcttattaataaatcaaaggtgaaataaaaatagcatatcaatatgaacttcgtgtgaacttacttataattacgtataaccaatattaaatatattgaatataggtataatacctctttaattataaagatttcaacaccacaataccgttacctacaaagaattattaaaaatgaaaaataaggagttgcataataatgaagctatctccggttacctcaaaaaatatagttgctgttggttataatcctttttctatgattttgcgaatccaattaaagcatggtatgtatgatttcttataatgtaccagaaag

SEQ ID NO: 1131 - DNA, 4596 bp, Bacillus thuringiensis
tcattaataatcttcaaaataactcttggccttctcgtcctaactttagctcttttcaccattaacagtctaaaaaagacatccgcctataaatcagataaatatgatttttacttactaaccttacttacatttgaactagtagtaatgcaaatatccatatttctttaatacatataaaaaagcatatatccaaaatggatatatgcttttcttttattcttgccctacacgtttcacttctacatttttaatacgttcacgtacaacgtgacttgccataattaagcctgccacagatggtacgaatgcatttgatgaaggcggtaatttcgctttacgaatttttgcattttcgtctggtacgatttctttacgtacttcttcacgaattacgattgggttttcgtcagagaagacaacttttacaccttttttaataccctctttacgaagcttcgtacgaatgactttcgcaatcggatctgtgtgtgttttagaaatgtccgcaatacggaaacgagttgggtccattttatttgctgcacccatacatgagataattttaattttacgacgtaaacattgtttaattaaatggattttgaacgtaatcgtatcagatgcatccactacgaaatctaaaccgtgtttaaagaactcctcatatgtttcatctgtataaaacatttctagtccaattacttcacattccggattaatgtctgcaatacgctctttcattaattctacttttgaacgtcctacagtagatactaaagcgtgaatttgacggtttacgtttgtaatatctacaacgtctttatcaactaatacgagacgtcctactccagaacgcgctaacgcttcagctgaaaatgaacctacgccgccaattcctaaaataccgactgtactattttttaatatttcaagtccttctttaccgaaggctaattcattacgtgaaaattgatgtaacattcagctctacactcctattacaaaaatggtctaccatgtattctagcgtttttccgactatttgtatagaaaaagttatagaattcctaaaaatacatatttcgaaaatgaaaacatagaccagaatttcatttcttcctaaatacacgtttaaaaaagaggattcagagaaccgagcagatcgaggcgctgaagccaggaggagcacagtgtagaaatactactcgagcaccggactggcgaagcaacgatgagatgcgacagttatctgaaccggactttttaaacttcctttcaatacacgtttaaaaaagaggattcagagaaccgagcagatcgaggcgctgaagccaggaggagcgcagtgtagaaaaatactactcgagcaccggactggcgaagcaacgatgagatgcgacagttatctaaaccggactttttaaacaacctctcaaaaaaagtctagacggttatagtataaccatctagaccctattcttacttctcttcttttaagcttaattttaagtttaactcttcaagctgtgcttctgcaactgggcttggagcttctgttaataagcagcttgcgcttgctgttttcgggaatgcaattgtatcacgaaggttcgtacggcctgcaagcagcataacaagacgatctaaacctaatgcaataccgccgtgtggtggtgtaccgtattcgaatgcttctaataagaatccgaattgctcttgcgcttcttcttgtgagaatccaagtgctttaaacattttttcttgtacgtcacgctcgtaaatacgaagtgagccaccaccaagctcataaccgtttaatacaaggtcatatgcttgtgcacgtgctttttctggtgctgtttctagtaactcaacgtcttcacggaatggcattgtgaatgggtggtgagctgcgaagtaacgatctgcatcttcatcgtactcaagaagtggccaatcagttacccataggaagttaaatttactttcatcaattaactcaagctctttacctagacgtaaacgaagtgcgcctaagctatctgcaacaacgctcttcttatctgctacgaatagtaataagtcgccagcagtagcctctaatgtgctcattaacacatttgcatcttcttcaccgaagaattttgcaatcggtccttttaaaccgtcttcttcaactttaagccaagctaaaccttttgcaccgtatactttcacgaattcagttaatgcatcgatgtctttacgagaatatttacttgcagcaccttttgcattgattgcttttacttgtccgccgctttctacagcacttgtaaacactttaaagccacaacctgctgcaaactcagataagtctgttagttccatttcaaagcgtgtatctggcttatcagaaccgtagcgagccattgcatcagcatatttcatacgagggaatggtgcactaacttctacaccttttgcatccttcataactttcgtcatcatacgctccatcatatctaaaatttcatcttgtgttaagaatgaagcttcgatatcgatttgcgtgaattccggttgacgatccgcacgtaaatcttcatcacggaaacaacgtgctacttgatagtaacgctcaaatccgccgaccataagaagctgtttaaataactgtggtgactgtggtaatgcatagaattcaccatcatgtacacgacttggcactaaatagtcacgagctccttctggcgtgcttttcgttaaaattggtgtttctacttctaagaactcttctgtgtctaagaagttacgaattgttttcgttacgtcatgacgcattttgaatgtgttaaacattactggacgacgtaagtctaaataacgatattttaaacgcacatcttctgatgcatctgtatcatcagcaatgatgattggcgttgttttcgctgcatttagtacatttactttcgttgcttgtacttcaatacgaccagttgccatattgtcattaattgcgccttcaccacgttcaacaactgtaccttctacgtgtaatacgtattcgctacgaattgtttctgctacttctaacgcttcttttgatgtttctgggttaaatacaacttgcacgatacctgtacggtcacgtaagtcgataaagattaatccacctaagtcacggcgtttttgtacccaaccttttaattgaactgtttgtccaacagcttctactgttacttttccacatgcatgtgttctttcagccactgtaagttccccctatattaatttctctgctacgtatgaagcaaatacatctaacgctacttcttcttgttcacctgttgccatatcttttaagttaatgatgcctttatctagctcatcttctcctaatacagctacaaatttcgcctttagacgatctgctgatttaaattgtgctttcattttgcgatctaaataatctttttcaactgacaatccagctttacgaagatcgaacgcaacttttgcagcatggtctttcgctttttcgccaagcgccacaacgtaacaatcaatgctatgttcaagtggtaattcaatgttttcagcttttagcgccataattaaacgttcaatactcattgcaaaaccgatacctggcatttctggtccaccgatttcttgtacaagtccgttataacggccaccaccgcttaatgtagtgatcgcaccgaaaccttctgcctcactcataatttcaaaaacagtgtgttggtagtagtctaaaccacgcactaagttcggatctttttcaaacggaacattcatcatcgttaatagttcttgaactttgtcgtagtatattgctgaatcttcgtttaagtattctgtaatagatggtgctgttcccattaattcatggttacggtccttcttacagtctaaaattcgaagtggattcttttctaagcgagattgacagtcagaacagaattcgccgatacgtggctcaaagtgtgcgattaatgcatcacggtgtgcttgacggctcgctgcgtcacctaaactgtttaatacaactttaatattttttaagcccatgccgcggtaaaattcaacagcaagtgcaattacttctgcatcaattgcagggtcattactgccgattgcttcgataccgaattgtacgaattgacgatagcgacctgcttgtggtctttcataacggaacatttgaccgatatagtataatttcgttggttgtgttgcatcaccaaacattttattttcaacataagaacgtacaacaggtgcagtaccttctggacgtaatgttaagctgcgctctccacgatcttggaatgagtacatttctttttgtacgatatctgtcgtatcaccaacaccgcgtaaaaatagctcagtgtgctcaaaaattggtgtacgaatttctttataattgtaacgacggcaaatttcgcgtgcttgcccttcgatatactgccataactcaacagtgcctggaagaatatcttgcgttccgcgtgggatttgaatagacatattcagttcctcctcaaattgttttaatcttaataaaaataaaaaaactcccgc

SEQ ID NO: 1132 - DNA, 5934 bp, Bacillus thuringiensis
cctagcctcgagatcgctaggcttcgaattcaattccgatgcatacagtttgtttttgtcgcactggatgggaatagcagggctttaactaggccacttattgatgagactgcagaaatttgccagaaaacctgcccaaactttaaaggctttagcgtaggaatagatgaaactccagaagcatttaacagcttttttaaagatggaaagtatgagtttaaagaatatcaaaatgatttactttgtgattatgaagggtttttgggaagaaatctatcagcgtcttatgctccgaaagaaaatgacgaacagtataaaaactttatttttctcctatcagagctattcgaaaaatacagtaaagatggaaaaattattctcccgaatttaacgcgaagctatctaggcaatgtataaacggcctgatacaaagaggctttgaacggaattaaaacaagcctaacccctccctaagtgtagaacgaggttaggcttgttttgcattttaccacatcaaattcaaatgactttcgtacaataaagtagaatatattagaaaacaccttaaactgaggaggaactcaatggcgcgttgtacgtattgtaaaaagaagtggaaagtaaaagacatatggtcgatactcgtgacatttgaaaaagattgtccgtattgttttgggaggcaatatatgtctaatgatacttttcatcaagctaacgccgctttaccactgttatttttatgccctttaattgttgatttaagcgatgaaaatcctttagataaataccggaaataatataacagctacattcaaaaactattttctactgaattttcttctcatcattatcccttcatacattacgagcataatcgcttatactttcccttttgaagatcctgtatctcagcatgaagggcgccccctggacaatgtttatcaattatgactttaataaacattgatagatttatactgttaaacataaaaaattagcattagattccactcaaatattaatcgaaacccaacactgcttgtattatgcatttttgcatacagtattgttttctcttgtaaatagataataatggtatataattaaatcaacgttttaccaataaaaggtaataaaagtagtgggataagcaaataaccaaaacgtattaacagatttgttctatgtaaatcatgatacatatatggaatcaaaactatgaaattttatgtagtgattagattactacaagatgaaagattcatagcgaatacacttaagaaaaaaacgttccattagattaatgtgatatctatcgaacgaattgagaatatacttagggggaatttcaagtgaaaacattttgtaaagtattattaactggcgcattagctttaggcggtttaacggttatgaacattgatacaccaaaagcacatgctgacgaatgggatggttgtcattacatttgtggtcctggtgaaacggtgaacggtgttacagttcaggtacactctacacaagttacttttggtaacagcgtaattgcaagaattacaaatgaccgagctgaagaaattcattacaatgtcagccttgaaaagaaatatggcgatagatggggagaatttgaaaccaacttccgttggcaaaatcaatgggtcccagctggaagcaatgatgaaattgcaactttcacaggatatggcgatgatatttatgaagatggaacatatcgttataaagtcgaaataaaaggcgctgacggttctattgatacaatttacacagcaggaatgacagttacaggacgatagcttatgaacaagctccattatttatgattgtatttttgaaaatatcattgataattgcgttgatattattattaaaataagctcttcggggcttatttttttatacaaaaattagaatatgaatattcggaaaattaaacctttacaccattaaagtttgttgctattataggaatacatcaaatgttacaatactcaacaaattgtacaaattctccgattacacgaatgaaatgaaaatacattgctgatggtaacatttatagttgggatcccgtagctcagcagggagagcgccaccttgacagggtggaggtcgtgagttcgagcctctccggggtcatatgaaaaaccccttgatagtcaaggggttttctttatgtagcaaataaatgattattattaaaactaaatttttccctacttcttttctccattttggagaaagacataaattatattaattatcgctctacgttgttcgctagaactcgattctttactctcttttgggagctttttaaaattctctttgaaaaatagcctaatacagcaatttttatatttatttatataaatttctcaacaaaaaagatctacacagtttaactatgcagatctttgtaaatttaagtttagaaatgaatagacgaatcctattttcgccctaatttgattgcctttttgatattactaaatgcacctttaccatatattaatacgccaccgcggtaaacacgactcgttaaaccaatcatcatacatattgttgcaattagaattgctaatgcaagcgcaatctcccatactgggatattgaggaatccaattcgtacaagcataacaataggagtgaagaaaggtacataactagtaatggtaacaaccatgctgcttgggtttgacattccataaattgctatatacaaagcagcaagtaacataaacatcagcggcataacagcttgagaagattcctctatacgcgtaatgatagagccaaatagacaagataatgagccatataataagaatcctaatgtgaagaatagaatcccataaaacactagagttggagcaacagaatttaaatcaatactatttaaaatatcatttttcgaatcattaattgctgttttatatccaacagttgcgaccaagccccaaattatgatttgcgtaataccagccaataatgttgagaatagctttgcatataaatgtttggtaggcgaaatacttgaaacaactaactccataacacgagaagatttctctgttgcaacatctgttgctaattgtgcagcatacattaatatcattagataatttagcatgataaagacattaattaaaatccctacaccctcagtatgttctccatctttaaccttatctgaaaccgttttggtatgaatttctactggcgttgttaacacctttaattcatcttgagatagattcaattgctgggcgaaattagaagattgtatttgagataaaatcgtttgaaccttgctaacatcttgctgatttacatccgtctcagttatatacgtagcctttaattgtttattattcaattcctctacaacgattgcatatgtataatcaccatttttaacacctgattctgctttttgtttatccgtgctacgtttaacttgtatcttactatcgacatttttaaacacttgatgaatggttgaatataattcttctttttctgtaacaacaacaacttgatcgtcctcgttacctgcaaacaagttataaatcttgtcaaaattcatcaatcctataattaacatagaaactattattgtaatagcaaaatatgattttgatttcactttagatttatagttttgtaaaaaaattgtccagaaactattcattttgtgcacctactttcgcaataaagatatcatttaatgtaggctcttctactgcaaactttttaacataccctaattttgttatctctttaaataaaacatgtgacacttcttcatatgaaattttaagagtaactgcatttttacgtttcttcatactttctacaccttttatttctttcaaatggtcaaagtcatgatcgccaacgattacaacgttctttttaccaaaatcacttttaattttggcaatgtcaccctgaacaacaggtacacctttgtgcataatacaaatgtgttggcataactcttccacatgttccatacgatgtgaactaaaaagaattgacgacccttgtttttgcatatcaagaacagcgtcttttaacatttcaacatttactgggtctaaaccactaaatggttcatctaaaattaagagttcaggcttatgtataatcgctgttatcagctggattttttgctgattccctttagaaagttctcctacctttttgttcagatgctcagtaatattaaaacgctccagccaatagtgaagttctttttctgcatctttacttttcatgttctttagttttgcaaaaaagttaacttgttctttgacagtcattttcgcataaagaccacgttcttccggtaaatacccaattttatctgtaacaccataatttataggtttaccattccatgaaatggtcccacttgatttcgataaaagtccaagtatcattcgaaatgtagtcgttttacctgctccattcccgcccaagaatccaaatatttcaccttttggtatctcgatattcaaattatccactgcaacatgctcgtcaaatttctttgttaaatctttaattagtaaactcattatccacacccttaattcccaagatgatttatttatacaattgtatatccatagtcaaccacaatattttgccctctaatggcatcgcttttatcagacattaaaaataaaatgacatttgttacatctgaaatttcaacaaattttctatatggaatttttttcaataacttatttccttcaaaggacttcaaatagctttcgttattatcgtttatactataggacagtggtatacaattcactgtaattattcattttttatctttcaaaaatgaataattaccaacaaatgttatatttcgcattataaggttagcataagatttaaaatatttaatatgcaattttgcatattttaacattcctaattatttacatagtgtttgaccatctttatttaaagcagcccccacattcacaaaattcacttaaaacaagaatttgtttatccatactttttctataatttttcatgaaagaactgaaattaattagtaccccctgttaaacacctaaatctgatacttaaactaactaatcttcctctaataaattgttttcttatttgacttcacaattaataatacccagcaggtatagtcacaacatcttcgtacacctcctcattaaagctgaaggaacactaattaaaatctggtccagaaattttacctttctacgttataggatccgcataagaaaacatagaatacagtacctcctctgttacaactagctgtatgtcataaaccaaaaaatcataatataaaatttatagaattaatttcttgagttcaaacctctccaggttcataaaaaagagacaccatatcaaccttctggtattatcccctataggtagacagtaaaaaaagagtccatctgatatgatggactcaatactgttttatctggaggggatttttttatggcaagaaaaggacaatcatttcaaaaatatacagaagaactaaagcgagaagcagttcgtcttcgattagaagagagaaaatcattgcgagaaattcgtgaacaactcggtgtgaagagcgatgcccagattattgagtgggtaaaacgtgcgcaacaaggggagtcctttgatgatcaacgtggtgtctggaatcgaaagaattttaatagtctagaagaagaaaatgcttatttgaaggcacaggttgagtatttaaaaaagcgcaatccaaatctacacgggaaggaatggtcctaaagaaagaacgattttctcttatcgattcattacgccaagcctatccactccgatggttgcttcaaatcgcggaagtttctaaggctggct

SEQ ID NO: 1133 - DNA, 7061 bp, Bacillus thuringiensis
cattgtacggacctaattactctttaaaaaagtaataatttgtctccttacttttcagtaacatatttcctcttattattaaaaataagtcgttcctgcttaatatttttactataactctaactagtgctaaccaaaggatcataataagccaaatataatttattaatcacgtttaaagtacataagtctgcactgattgaaaatgcagaaccagcattaatatcgtttagcgtatttctaatccgctaacgacttaaatcaccttatttcactctcttcggtaaagctgagcctgaatgttcaattactagatgaacataaacattaatgtcagcattactaaaataattttcaccttgatcccaattcttacttattttcttccattctttataattattccgcttatatacttctcctaatgctaatacatccaccttatatttttttgaacaagctgtattgatttttgaatcctttgctccatctcttttgaaatatccttcgttaagcgttttttatctccatgctcaaatgttttcaattatttttgtttctccagatttattatagaatctttcatctaaaattagtctgttttaccagttaacatagaatttgacagacgaataaattcttctttgcgatctaaaaaaatgtatgtgcaataagagttatgtttaacattaacaaaacacttaatataaccaataaaccatacacccaaaatttacttcttcattgaaaaaacaacatttttagctagatatagtaagttattttaggatgaaaaatttaaaatatctatctttatatacagttcaatatattactacaattttaacaaaggaccacaagcaattgtaaaagagaaaatgaaaaaacaaattaagttttaccctatacaatcattaaaatatattaaatttattgtttaattaccaataagaatttcataaagaaagcacagacttattaaggcacatatttatctaacctacataaaataaagatgtacaattgcctactttatgaattttttataatgatatatagaaaggattcattaagttatgtttgttgggaaatagcatttatatttcttctaaaataaacagggtacaaattgcacatatcggcctgtttattttagagaaaagttgtttataagtagttcttttctttaaaagaaggaactacattttttaaattaaatttctaaatgaataaatttagcacgagaaaggaattgaacttatgtctaatttaaatttcatttctgatcaatttgctgcaattcttaaaggaaagagtaaaataaatcaaggtggttgttcggtgtcttttcaccgcaattttaaggtcctggttcaaggaaaaccaagtgcctatgtagttcccgtcggagtaagttttgaatcgttggatcaaaatggcaatgcattaaatttaggagaaatcgcggttctacaagaagagatccctgcatttatgaaatcaattgtacaacaaggaattattgtcagtgctttacataatcactggttatacatgaatcccttaattatgtatattcatatccaatcggtagagcacccgttacattttgcaagaaaattggcaaattcatttttatcgttaagcagctatccggttactaataacgaagggcaataatttatctacaatcatagatatagtaataatatgtaccagactccatgcacgttgcgcttgtataaatagtattatctaatgtatcttcttccgttattactcctccttttggaacctcacaattttacaaaatacgaaaaatgaccgatataccctcttcttcgttatctataccctgaatattttatttaccatacgctgcccgtataaaccttgatagtagggtgaaatctccattaagtcccattgaacctgaaccttgtccaaaagcacttaatggtatatccccctcgcatggctgcgatttaagacctatatattgtcttacattttgtaaatgccaattaaactcaggactattagtcactactccttgtcgattctaatacaatagattcaccccatttatccgctaaaatccaatgtaatggtggagtaactcctaaagcaggtaatggtacccccaaaaaggaaatactagctacaaatttctttaactcttcaacagatttgaattgtgtctttcgaaaccagaagaaaagccaatagatttctgaaaactgggcgtatgatttgatattgtaaagccctcaggcatcaatttgttcatcacctatcatcatgtatcccttggttgaaaccatcagcttttctgtacctcttcccagtcgatagctcgaaaagttatgggtgttgagctcaacttaacgacgacgagagctgctccccaattagtgatgaaacccattatcacatttcgtatcatgtggcataggtccatccaaggaatccagaaaggcaacggcctgtttgaggttcctcaaaaataaatgcgcgagatccatagaaaacccgtttcgaaccacaacgcgcataattgtcactgcttctaggtctggaggcaatggatatgcgggtacttgccagccgaacacacgcaattgtcgagataaatcataaaggttccagtttaatgtgtaaccttttttcagttgccaagcgaaaaccggaatatccgaaccatcggacaaaagttcgaatggttccatctcctgaattgccttgctaagaaaaagagcgaccttttgagaagccctttggacatcatagtacccacttttccccaaacgcaggtaattgtaatattgtagaagcacttgtgcgccaggacgtgaaaaattcaaggcaaaagtcggcatgttcccgcctaaataggagacgcggaagattaaatcatcagggagatcatcagcttcccgccaaattatccaacccaagccagggtagactaatccatatttatgtccggatacattgatggacttcaccctcggcaactgaaaatcccagactaaatctggttgaagaaacggtgctataaatccgcccgaagccgcatctacatgcataggaatgtccagtcccgttctctcctgtaaatcgtccaacgcttttgcaatggcggcaaccggttcgtaaagtccggtataagtctcaccgagaatcggtaccacaccaatcgtattttcatccacggctgcaaggaccccttgaggatttaatcggggatgctcagggctaaccttcacatagcgtggttcaacctcccaatagttcgcaaatttttcccaaacgacttgaacagcagaactaaacacaatattaggccgatccaccggcttaccctctctttttcgtgcattttgccagcgtctctttaacgcaagccccccgagcatacaggcttccgacgatccagttgttgaaacgcccatagttgtaagggggctgggggaatgccagaggttggctaaaatgcggacacaccgctcctcaatttcagctgtctgtggatattcgtccttatcaatcatgttcttatcaaatgatttagcatataagtgctctgcggtaggttccatccatgtactaacgaatgttgcaagattcaaacgtgcattgccatcaagagtcatttcatcatggacgatttgatacgctgtttctggtaacatgccttcatcaggcatgtgaaagcgcggaacgactgattctcctttgcgggcaaaaagaggatttatagaaaattcgggaggcagctccatttgcacgtgacgcggtagatattgtggattatctggcataacctcttttccttcatatgtatcgttttgcacttcttcttttcgatcctgcggcatactagtcccccttaattaatggtttaacaaatatattatttacaaaaaaacatttgctaaaccaagggacaattctaataaaaggtgatgccatcattcaaaataaaggagtatagtttttgattataaaatagaaattgatttatattttaatgaaaatattgaatgtttttaatataattattgagttatgtatttatagaaacttaagaggtatgattatggagtttattacttttaaagtaatttgtatctttttatttttaatgcttatgacttctatagaagttttaggatatggagttcaacttgttggggcgaaattagctttagttgcatcggcttttgctaaatataatattatgtctttaattgctcgattttctaatatgtttcaacaaccatttactgtttctttagttgatagtacagcaaaaaatggtagattagaattactaattaaacaattagatttttgttattagattctactatgggagtaatacttggagggattattagtaccattttttatgaaagttctttctaaagcgctaataccattgtcaaaagatgattcgtttttaaacatgttcaaattaatatgttcacaaaagaattgatgcaacgttaaaaagaatgagcccggtacaataccggacttatattcatacaaccgctgtatttttctgtttaactgttgggattcagttcataatgaaacatatttttacataaaagactttcgtatataaatttttcaaatgatttattagcgaattgttgaccaatatcacttttttgagtgagtaattttttagattgatgatataatgaattttgttcgtttcttttatgtaaaatattctagttttgcattaggaaagaactgtttcatataggaatacagatagttttttatatcctcttcttcttctttttgataaatgtattttccgattccatatttcccccatttataccttcttttctcttcatctaattctagttttgtcatcgggtagtttttttcaattactctcttagctggctttgtaaaacgatgttgaataaattcaaatgtaatatcatcccgtgcatcaagaggtaattcagcatttaggcgttcaaacatatgatagtatccttccttccagccttcatgcaggtaaataggagctacaatgaaaccaagaggatatccagctctagctacttttcctgctgcctcaattcgtttagctaagggagaagttcctggttcaaagtttttaatcacataatcagcgtttacactaaagcgaaatcttgtttttccgttatgtttagcatcaagtaaatgatctacatggtggaatttcgtaacaaatctcaatttcccatattcagattctccaaaatgctcaatggcccgtttaagggtatgcgttaaataatcgattcctacaatatctgaagtacacgacgcttcaaatcttgttacttcaggtgcacgctctttcatgtatttatcagcagcatctaaaatttcttcaacatttacatacgttcgtatataaggcttacttcccatcgttgtttgtaaataacaataatgacaatgtcccatacatcccgtcgcaaaaggaattgcatactctgctgaaggcttggaagtatcgaatttcagtgtttttctaacaccaacaaccagcgtggattttgctactcgatacctttgaaaatcgttatcccctggcaaatctcttacttgattatgggaagtagtatgtcgaatttcaacatccatctttgaaaacttctcaaacagctctttccccaaaggataatccaatgctttcggttcaaaatatacgagcttaggcataaatggcttattcattctaacatcccctctgaaatatcaccataatagtaagtgtaagcttggtttgcctcatcttcggtagcatatatagccatctcatttgttagtggataatacgtttcgtaaagaaatagtgctaattcattaggtctttcaggattatttacaactgctgcagcttgtatgttagctacgtcttgagtatgaggatttcggtaaaaaatataaacaatgtcaccagcatgatacgtattactttcagaagaaaattccattccatcaccatctcatttcataaaattcaatgctcacagttttactttctaatttccttgtagtgtaactatttaattacattgataatgattacgtcatacaaacatattttgaaaaatgaataataaatgtactcccaaaaaggcaagcatatatcaatgcttgcctttcgttctaacgacgatgttcaacaagatcgattacacctaaaacgacgtgtgctaaaccaaaaccaaatactgtatttgcaatcattttattagttccacgagtttgtttaagagcataacctgctgctgtcactgctgtacctaaagctgttggaattaatccttcacgaatgtccacagtgatgcctccttgtttcgtagttagtaaatttgttttaatgactcgaagtaaagtattaaaacaagtattagtatttttctttttaataaaattatgtgaaatttttatgaataatattttaaatccataacagctataaagattgaaaaaattattaattaacaaataagaaaatatcttcaaaacgtattttcttatgaaaattttatacctcagacaaaaaaatctttgcgaaaattctctccataaaaagtgctcctaaatttatatatataggagcactttttatgaaacactattctttatttgcttatgaaccactttattataataaccatgctttacaacttgcctaaaatcatctacctcgatatccattctttccgcaatatctacaacaattgtattttgtaaaacattcaccacaaatcccattaatttcaaattatgatttttacgatatgaaaattgaacgtaatccccaagtgttacttctttattatgtttcatttggcgccccctaaattatcgataattatacaatagtttcccccttttttacttctacatacggggtcaccagtttatcattttagccaattcatctcccacgtacgtattttacgttcccccacccccgggtaaattcacccgccccgggatagaaactgtgcggttttacaaaa

SEQ ID NO: 1134 - DNA, 5751 bp, Bacillus thuringiensis
gtggatgttcatttaattccggacgaacgtttagcaggggcattaaaaaaacgtggggggactgattccaaggcttgagagacagaatcaaagaaagcagtcgaaaagtatgtagagaacaaaaagggtgaaaatcctgggaaagaagcagcgaatggggaccaacttacgaaagatgcatccgactttttaaagaaagtgaaagatgcgaaagcagacacgaaagaaaaattaaatcaaccagcaacaggcacacctgcagcgacaggcccagttaaaggcggtctaaatggtaaagtaccaacttctccagcgaaacaaaaagactataacggtgaagttcgtaaagacaaagtactcgttttacttgtagagtacgctgactttaaacataataatatcgacaaagagcctggatatatgtattctaacgattttaataaagaacattatgaaaaaatgttattcggcaacgagccattcacattagatgatggaagtaaaattgaaacgtttaaacaatattacgaagagcaatctggtggtagttatactgtagacggaacagttacaaaatggttaacagttcctggtaaagctgctgattacggtgcagatgctccgggcggaggccatgataataaaggaccaaaagggccacgtgatttagtaaaagatgcattaaaagcagctgtagatagtggtattgatttatcagagttcgaccaatttgatcaatacgatgtaaatggtgatgggaataaaaatcaaccagacggtttaatcgatcacttaatgattattcatgcgggtgttggacaagaagcaggcggtggtaaattaggcgatgatgcaatttggtcgcaccgttggacagttggaccaaagccattcccaattgaaggtacacaagcgaaagtaccatattggggtggaaagatggcagcattcgactacacaattgaaccagaagatggagcagttggtgtattcgcacatgaatatggtcacgatttaggtcttccagatgagtacgatacacaatatagtggtcaaggtgagccgattgaagcttggtctattatgagtggcggaagctgggctggtaaaatcgctggaacgacgccaacgagtttctcaccacaaaataaagagtttttccaaaaaacaatcggtggtaactgggcaaatatcgtagaagtagattacgagaaattaaataaaggtatcggtctagcgacatatttggatcaaagtgttacgaaatcagcaagaccaggcatgatccgtgttaacttaccggataaagatgttaaaacaattgagccagcatttggtaaacaatattattacagcacaaaaggtgacgatcttcatacgaagatggaaacaccgttgttcgatttaacgaatgcaacgagtgcaaaatttgatttcaagtcattatatgagattgaagcaggttatgatttccttgaagtacacgctgtaacagaagatggtaaacaaacgttaattgaaagacttggtgagaaagcaaatagtggaaatgcagattcgacaaatggaaaatggattgacaaatcatatgatttaagtcaattcaaaggcaagaaagtaaaattaacatttgattacattactgatggtggtttagcattaaatggattcgctcttgataatgcttcattaacagtagatggtaaagtagtattctctgatgacgcagaaggtacaccacaattaaaattagatggtttcgttgtatctaacggaacagagaagaaaaaacataactactatgttgagtggagaaactatgctggggcagataacgcgttgaaatttgctcgcggtccagtatttaacactggtatggttgtatggtatgcagattcagcttatacagataactgggttggtgtacatccaggacacggtttccttggtgtagttgattctcatccagaagcaattgttggtactttaaatggtaaaccaacagttaagagtagtacacgattccaaatcgctgatgcagcgttttcatttgacaaaacgccagcttggaaagtcgtatctccaacgcgtggaacatttacgtatgatggcttagcaggcgtaccgaagtttgatgattctaaaacgtatattaatcaacagattccagatgcaggacgtattttaccgaagcttggtttgaaatttgaagtagtaggacaagctgatgataattctgcaggtgctgttcgtttatattcgtaatactgtaaaactaccgagagattttctttcggtagtttttttgtgagcaatgaattttatatagctgaaaaagtcatatataatgtaaccttaagaatagaaatttgttatatatgaagtttatataaataatgaaagaattggataaaaatagtgggagaaggtgagtgaatgagtatttcctctattgtaagtaggcaaaaggaatattttttaaaagggcatacgagaagcatcgaaatgagaaagaataatttgaagaagctttatgaaggcattcagcgttttgaagaagaaatatttcaggcattgaaattagatttaaataagtcagttcacgagtcgtttacaacggaagttggatatgtattaaaagagatttcctttcaattgaaacatatgtcatcgtggagtaaaccgaaacgagttcgaacagcacttactcattttggatcaaaaggaaaagtagtgccagaaccgtatggtgtgacgcttattattgcaccgtggaactatccttttcaattagcaattgcaccacttgtaggagcactggcagctggaaatacaatcgttttaaagccgtcagagttaacgccaagcgtttcaaaagtgcttaagagaatgttagatgaatcattcccggaagagcttgtagcggtagtagaaggtggcgttgaagagagtacatctttgctgaaggaaccgtttgattatattttctttactggtagtgttggcgttggaaaagttgtaatggaagcagcagcgaaacagttgacgccgctcactttagaacttggcgggaaaagtccttgtattgtacataaagatgcaaagatagagatgacagcaagaagaattgtttggggaaagtttttaaatgcagggcagacgtgtgtagcgcctgattatatgtacgtgcattcttccgtgaaagaaaagctaattgaggcactgcgacatgaaattacagagcagtatagtaaagaacctttacaaaatgaaaattacgtgcgtattgtaagtgagcgtcattttgaacgattatgtggattcttacaagatggtcaagtcgtaattggtggaaactatgagaaagatactttacatattgaaccgacagtactagcggatattacatggcaagatgctgttatggaagatgaaatttttggtccgattttaccaatcatagagtacgacaatatagaaaatgtaattggcacaatccagcaacatccgaagccgttagcgttatatgtattttctgaagataaagaagtacaaaagaaagtgacgagtaatatttcatatggtggaggctgtattaatgatgttgtctatcaccatgctacgccatatttaccttttgggggtgttggaagtagtggattagggggttatcatgggaaagaaagttttcggactttttcacattataaaagcattttagcccaatctacagcattcgacatgaaaattcgttactcttctacaaaaagtgctttaaaattcatacgaaagttgttaaaatgatgatggtgtttatcagtaggcgtagccgtatgataatagccccttcgcaatggaaggggtttttctgttcgacgttatgtatcaggcgaaaatgaatcaaacatactacataaagaatagaaacgaacgcttgctaaataaccatttttgtttggatcgaaacaaaaaatagtctatagaacataaatatttattcatgaatataaaaatttaaaatttaaggtagataggacgggaaaatgaaaaagattattaaagttgaagcagttgaaaaacattttggaaatcaagtgattatcccacctctttctttagatattaaagagggagagtttttaacaattttagggccgagtggctgcgggaaaacgacgttacttcgtatgatcgcaggatttgaaactccaactaaagggaatcttttattagatgatgaaagaattaacgatttgccgccatataagcgtcatatgaacctagtgttccaacattacgcactattcccacatatgacagtagagaagaatatttgttttggtatgaaaatgcagaaagtatcagcagcagagcagaaagagcgtgctgaagaggcaatgcgtttaacgcagttacttgagttccgtaatcgtaaacctgcgaagctttctggtggacaacagcagcgtgttgcaattgcaagagcgattgtaaataatccgcgtgtattactattagatgagccacttggagcgcttgactttaagttacgaaaagacttgcaacgtgaattgaaaaacttacaacgtaatttaggaattacgttcatatacgtaacgcacgatcaagaagaagcaatgagcatgagcgatcgtattgtagttatgaataaaggacatatcgaacaaatcggaacaccgaaagaaatttacaataagccgaaaacattgttcgttgcgacattcatcggtgaaaataatattgtgaaaaacggggaaggctatgtagcaattcgccctgaaaatgtaaaagtacgttcggttgaagagtcaattttaaaagaataccatcttggacatattgaagatatcgagtttgtcggaaatatggagaagctttatgtacgtgatgagaaaacatcagaattactaatggcatatcaaactgctgaagaggcagcacagtggagcattggagataatgtatatgtaggctgggagcaagaggacgaggtgaccttaaattgaaaaaagggaaattactcgcactacctacagtcgcgtggctgttaattttcttcctaatcccgctcgtattcgtattaggattcgccttcatgcagcgcggagcttacgggacagtagaaatgcaatttacgctggagaatatatcccgtgtgtttgatccattatacttaggaacgttatgggaaactgtttaaattgcagttattacaacagtaatatgtttattaattggttatccgtttgcgtatacaattacaattgttgaccgcaaataccgctctattcttttattattggcaacgatcccgttttggattaactttcttgttcgttcatacgcatggattgttattttacgttcacaaggtcttgtgaatacgttgttattaaagcttggcattattagtgaaccgttaaatttattatataatactccttctgtaatactcggaatggtctattctttattaccatttatgattttaccagtgtatgcagcaattgagcagctggataagcgtaagctagaagctgcttatgatttaggagcaacaccaataaaggcattttggaatataacagcgccgatgaccatgtcaggaattgcgactggttctattttagtattcgtttcttctatcggaatgtttgttgtatcagacgtgatgggcggatcgaaagtagcattaatcggaaacgtttttaaaatcaattttagggcact

SEQ ID NO: 1135 - DNA, 3953 bp, Bacillus thuringiensis
  unsure (1)...(3953): unsure at all n locations
taatcgtctcttttttctccccattgaaagcagtcgcactatctttgtactctacccaaaccatatctgctgattctgtacgataaattctttttgccttaccttcatacagcaattctagcttttgcatttcgcaagccccctgtagtttgaaaaatgtgaataatgtttttataaagaatggcacagaatgactctattctgtgccatatgaaattttacgcttcgtttaatccaaggcgttcaaagattgtatcaacgtgttgcatatgatgctcatagttgaagcattcattaatttcttcttgtgttaacttgcttgtaatacgctcatcagcttctacaagctctttaaattgtacttgtgtttcccaagcttccatcgctttaggctgtacgatatcataagcttcttcacgtaccatacctttgtcgattagtgtaagcattacgcgctgagaataaattaagccgtatgttcttgtcatattgcgtttcatattctctgggtatacagttaagtttttaacgatattaccaaagcgatttaacatgtaatttaacgcgattgtagcatctggtaaaattacgcgttctgccgaagagtgagaaatgtcacgctcatgccataatggaacattttcgtaagccgtcatcatataaccgcggataacacgagctaaaccagtcatattttcagaaccaattggattacgtttatgtggcattgcagaagaacctttttgaccttttgcgaaagcttcttcaacttcacgtgtttcactcttttgtaaaccacgaatctcaactgccatcttttcgatagatgttgcaattagtgcaagtgttgacatgtagtgtgcgtgacgatcacgttgcaatgtttgtgttgaaattggtgctgcttctaatcctaagttttcacaaacatatttttctacgaatggatcgatatttgcatatgtaccaaccgcaccagatagtttaccaacacgaactgtatcagcagcttgtttgaaacgctctacgttacgtttcatttcttcataccaaagaccaagttttaaaccaaatgttgttggttctgcatgaacaccatgtgttcttcccatcatgattgtgtatttatgctctttcgctttgttagctaaaatgcttacaaagttctctaagtcttttaatataatttcattcgcttgttttaagatgtaagataatgctgtatccactacgtctgtagatgttaaaccgtaatgaacccatttacgttcctcacctaatgctggcgtttctgatacagcacgagtgaatgcaactacgtcatgacgtgtttctttttcaatttcataaatacgatcaatatcaaatgatgcatgctcacgaattttcttaacatcttcttttggaatatcgccaagctcagcccatgcttcacaagctaaaatctcaacttctaaccatgctttaaatttgttctcttccgtccaaattgcacccatttctgggcgtgtataacgactaatcatctttttccctccaacagttgttcttgatggtcccaaatatgcaaactcttcgctttttctagagcgacttcaatattatcatttaaaatattaacatgccccatttttcgctgtgcttttgcttcttcttttccatacaagtgtaaatagcacccggttaatctattcacttgtcttaggaccccttctatatgttcgcctaaaatgtttaccatgacaactggttttaacaaatttgtttctcctagaggtaaattacagattgctcgaatatgttgaccaaattgactcgtctcacatgcatcctgtgtatagtgtcctgaattgtgaggtcttggcgctaattcattaatataaatctcaccattatctgtagcaaacatctctacagctagtgttcccacaagttctaattcatccgcaagtacttttgcataagcaattgctttttgagaaagctcttctgtaatgcgagctggaacgatagattcatgtaaaatgttatttacatgaatattttctgctactggaaacacttttgtttcaccacttacactacgaatcacaataactgatacttctttttcaaaaggcacccatttctctaaaatacattctgctttatccacaagatttcttgctgtctcaacatcagcttcacttcttaaaacaacttgtcctttcccatcatatccacctgtcgtcgtttttaagacggaagggaatgataactcagcaattgcttctgtaagctgatcttgattttgaactaatctatacgttgctactggtaacccagccttctcaatcgcattcttttctgtaaaacgattttgcgttgtatttaacaactgactaccttgtggtaagtacgcatgtttttcaagccattgtaaacatctataatcaatattctcaaattcatatgtgacaacatcacttatctctgctaaatgctgaattgcttttaaatcatcatatggtgcaacaatttcaatatcagcaacttgtgcacatggtgaatgctttgtaggatctaaaacagcaattttatatcccatttccttagctgccaatgccatcattcttcctagctggccgcctccaataataccgattgtttttccaggtaaaatgatcctcgtcatactagctcactaccttcacgcacatctttttcaatcgcttctcgtctcaattctaatgcatcatgtatatcatcatggaatgatccaagtatttgtgcggcaagtaatccagcattcgttgaaccggctttaccaattgcaacagttgcaactggaacacctcctggcatttggacgatggataataatgaatctaagccttttaatgcttttgattgaactggaactccaattacaggaagatttgtcttcgctgcaaccattcctggtaaatgtgctgctccaccagctccagcaataataactttcaatccacgttcacgagccgtctctgcatattcaaacatataatccggagtccgatgagcggatacaacttttttctcatacggtatatttaattcatctaaaatgtcacaagcatatttcattgtttcccagtctgacgtgcttcccattatgactccaactagtgatttcatattagaatccccccgattcaaataaaaaaagcctgaaatagaacagtttctcttttactatgagagaaagcgctctactcaggcatacgtatcccttgtgaatagaaaaataccgagtgactttccctcatagtctaacgaataacggtcgttaggtagagacttgcaggccatatccccgcgattatatgaggtcttatattattgtttctatggttatattaacaatatttcataaacaatgtcaataaataatcgaatgtttttttattagtagtcaataacgttcgtgttttagttatattcaaaagaagaattgcaactatatgcaagaagaaaagggaattagaatatatatttctagagatctattttacgtataatcgtttaaatggcacttcagtatgttttaaatcaaaatatatacactcttgtattattataacgatttaatttctaaataggataactgttaaagaaagaactatgctattatcctatttatttttctctattgcagtaatttctgtaattattaaatacttatttatagcatctcattatttaaaatatatacttatgatagtaataatttgtcctattttaagtattactttagtggcattaggaaaatcaggaacacaaaaaatcattgctattattttaaacagtctctatttcattcttttttcgtctttagctttattaaatttatggattatagccttcggtaaataaaaataaacacaaaaaaacctaagtcgaaacgacttaggtttttgcttgggngacgtcct

SEQ ID NO: 1136 - DNA, 4646 bp, Bacillus thuringiensis
ttaaatctttattcaagtaaaaaagaagcccgccaatgacgggctacttttttatacaagtaacggtaatttcataacagcctcttcaaccgaacgcactatgtgatttgctttctcctttacatatggatgggcatgatgaagagtaaatgaatgtggggttacttcaaacatagaaatatcattgaaagaatctccaatacaagcaacttcatttgcttcaatttgcaaatgatccattagtcgctttagagcactccccttactcacgcctcttggcataatatcaacatagcgtttacctgatataaaaacttccgcttcgccttgaaacgtatctcgtagctcttgatctaacgtcacaattttctcttcttctccaaaaacaaacaattttgcagggtgtacagtcttaccaaactcttcttctaacgcttcaatttcagcgatatgcacgcccatatatgcttcaaaattatggtgatgttcattcttcctttttgtatatcgctgctcatttgcacaaacaatatccgctagtccttttttatgtatataccgatatatttcctgagcaaccgtattttcaaaactcgattcatgaaataaattcccatccggaagtaacattgtcgctccatttaagccagttgtgtaatatgggaatgaaaacctttttacaacttcatcaattctgtgtgtaaagcggccagaggcaaaacaaatatttgtccctttctcagctaaccaacacagcgcacgttcatcttctttttgcatatgattcacatcgtaaacgagcgtgtcatctaaatcacttacaaataatttaatcatgtcctcttccccttccatacacaatatctactctaagtgtacacaaaaaatgtttgatttttgttaaaaaataataaatttttgctaaaaaaaataaacgggtgtataatcccgtttatttttgtctttttacattttgaggtcttacaatacttggtcgtacttttaaactagacattgttggacggagtaaaatttttgttaacgcgccccaatcaaatggtaaaaacggccataaataaggtgtttgtaaactttttatagacgttaaaaataaaattaatatcgtcataccaattacaaatcccatctcatggaagagacctgttaaaataataacaaacaatttcccaaccttattccctaatcctaattcataactcggtgttgcatatgcaccaaccatcgaaactgctacatacaaaattacttctggcacaaacaaacctacatcaattgcaatttgaccaattaatatagcggaaatcaaccctgctgcagacgataacggcgttggagtatgaatggctgccatccttaaaaactcaagtccgacctctgccattaacacttgtaataaaattggtaaatgcgtcatcttagtcggtccaataaaagccagatttgctggcaaaagagttggatcaaatacaaacactaaccaaaatggtaataaaaataacgaaaatataacacctaaaaagcgcacccagcgtaaaaatgtaccgacagctggattttgtctaaactcttccgcatgctgtaaatgatgaaaatatgttgtcggtgtaatcatagcacttggtgatgtgtcgacgagtactaacacatgcccttctagtaggtgatttgctgctacatctggtctttctgtatatcgaataagcgggaatgggttatagctttgctttacaacaaattcttccactgttttatccgccatcgtaattccatctacatcaatgttatttaattcttgttttataatctttactaaatccgcatttgcaacatcttgtacgtatgtaatacaaatatccgtttgcgatctatctcctactcgaaccatttcatttcgaaggcgtggatctcgaattcttctacgaattaatgctgtatttacaacgatattttcaacaaatccatccctcgcaccacgtactaccttttcggtatctggttctgtcggtgttcgccctggataactacgaacatcgatcgcgaacgcttccgtttcaccttctacaaatatcacaatgagtcctgataatacttggagcattacctcatccatcgttttcactttgcttacttgttgatggattaagcgattctctaaaagcttaactgtatcttcttctacatcccttatctcatttgtatccacggcttcttctaaaatatggataatataatttgtatcacaaagtccgtttacaaataacacaccaatttctttattcaaaatttgaaatttacgaatgccaacatcgtatgtaacgcctagtccaactgtctgttttaaataattttcattgtcacttatgaaagttgatatagggatatccacttttttaggcttcgtcataaaatccactcctttctaaaattaattgaattgctttctttgtaataggtgaccctctctcccattcatcatttccgcacattttaccaatatcaccaactccaacaatgacaggaacatttaaatcgtctaaacaatatattgtatctccgctaatcctgccaatttcaccatctggaagtccaaatttatcaacaccgtattcggttaaattcccgttccgatctacacttacatctacacgtgcccattcccaatgatgcgtattagacgctactgctaaaataccgagcacatcaatttgtttatgggtagccacatattttaaagccttttcaccagatccttctccaataaatccactgtcatcaaacatgacaaatacagggtcatatggcgtttgcataataagctcaacaacttttttccctgtcaatttggttggattactttgtgatgctgaaatacaccttcccccaaattccttcgttaaaagctcaattgtccgctttgcatattcatctccatctgtgaccaaaacaacccttcgtctcatttgatttatcctttcggtttacatataagtgctataaaaaatgaaaacaatatcgctgcggaaatacccgcagacgttaaactaaacatgccaataccaattcctaaatatccatgtttttctgctgcatgcattgctccgtgcaatagtgaatgtccaaaacttgtaatagggactgtcgctccagcacctgcaaactttattagtttatcgtataatccaaatccatctaaaattgctccgatgactacaaaagttgccattaaatgagctggtgttaactttacgaaatctaacaatagttgcccaattaaacaaatagctccacctacaagaaatgcatatataaaatccacaattcactctcctttaactctctcaaatacgacaccatgtgcaattgttggaatcgtttccttctgttgcatcatcattgggcttaataatgcaccagtcgcaacgacaaaaattcgttgtaaattccctttttgcatctcgtgtaataaatgaccatacgtaacaactgctgaacaagcgcaaccactaccacctgcaaacacttcttcttgacttgcttcataaatcatcaatccacaatcattgtatatatgcccaagatcataaccttcctcaagtaaaagttgtttcgcaatcggcgtcccaacagctgataaatcacccgtaacaatcaaatcataatcatcggcacttcttcttaaatcttcaaaatgttgttgaattgtatgagctgctgctggagccatcgctgcccccatatccaaaggatttgtgattcctaaatcttgcacttttccgattgtagctgacgtaattttaattgcacttttttcatcgctaattaatatagatcctgcaccagtcacagttgaatttgctgtccctggtttttgtccaccatactctgttggatagcgaaattgtctttcagccgttgcattatgactgcttactgtagctaagacacgatttgcaaatccaccgtctataaaagctgagccaactgctaaagtctccatagacgtcgcacaagcgctaaacattcctaaaaaaggaatgccccacttacgcgcaacataatttgctgtcactgtttgatttaataaatctcccgctaaaaagaaatcaatttgcgatgtttttatattccctttttgcaccgcttgttgaattgagtctgacattaatcttcgttcggcgagctcccaattttcttctccacaatgcaagtcatcatatgaaatatcaaattttttcccaagagggccctcagcttctttcggaccgacagcagtgcccgttgcatttacatatatatcattttgaaatacccacgtttgttttccggtcaacctcatactagcccctcctttaagacataaaaattttaaaggtataccttattaacccaatgatatatgcaccaacaaccccaaatacaatcacacttcctgccagtttaaacatatttgtagcaatccctagaacaaccccttcgctcttatgttctaaggcagcgctcgccatagaatttgcaaatcctgttaccggtaccgctgatcctgctccagcaaattgaccaattttatcatatacaccacaccctgttaaaatcgcggataataaaacaagagttgcaacagttgg

SEQ ID NO: 1137 - DNA, 6232 bp, Bacillus thuringiensis
gttcttctggttaagacgtttatacacttacttaacaatttcttctacttacacgctagatgactcttgctactcattaaaatccatacgtgctttatcaggataaacatgatttccggtgcatgaagctccatactccccatatacaacagttccgataagaggcagcaaagagtgatgacgcattaaatactgacgatatatcccaatttctctctaatttaactggacctaactcaacttgagctacgtcttttatatagggaactatctatactcgctcacatgtttactgttataactgcagatacagacccatcttgtacaatgacacccgtatcacattcctgtccttcaccagttggataaacaattgtctctttgacagatactttattccctcctactcttatcacttctggttcgcaactcgttttgtatgcatcttctaaatataatgccgctgtcatactctcacctctttagtagttatagttatacctactaatataaaaaagaagctctgcaaagtcaattgataattctgaaatttaaaattaataaaagactcctttattaggagtccactatctcaatatttcattcgcttctttttcataaattttatcaaatgacgtcataacgcgctgtgatgcttgaatcatcttttgatctgtcataagatctgccatctctttcgtcatatcaacatttgaattttctagcatatgattttttactattcctgttccgttcggtaaattagcaatgtttccttctgctagtgtaaagcttttgttttcacgttgcacgagacgtgcattcgtttcggcatctactgtttttgtttgcaaacgagcaatattattttgtgttacctcatcatataatgtaccatctgcttgtacagcaacctttgctccttctggaatacgaatacgctcattattctctcccattacgaaagcaccagatgatgtttgtaaataacgatcactatttaatgtgaaactaccatctctcgttaaaaacgtttcatcatttttagaagtaacgaaaaatgatgttgtgccggccgcgccgtcatctaaaaagaaatctgtagcgctatttgtcatttgtatatttccttgtactaaattcacatgcgttgcagctggtactacagcgtaatcgaccgaaccgatatttgttaccgccccatctccgcggcgatatgtgtcttgtacatcaaatactttagacgtcatattttctgctttaaatcctgtcgtttgagcatttgcaacgttattcgaatgaacattaatgcgctgcatgtaattcatcatgcccatagaacctatataaagaccgttcatattcgtttgaataaggcaagcgccttattcttcacctcttttctacgatgtttgtaacatttgtttcgctaaatgttcagctgtagcgatatgtatatttttctttatgtcttggccatctgtcattaatacaataggagctgatgatactgctggaattttcaacaattcgccactacttgctgtttcatcaaatttcgtaaacacaataccatctatatgaatatctttaaagtttgtaataatttcaatcatatctttacttttcattgaagctgataacgttaaacaaatataatctggttctacttgtcccatcgtttcaatcatttcttccactgtttctgacgtacgataatttttccctgctgtatcaattaaaatataatcgacgcgtgcttcttctttaaaatacgtaagcgctcttgtcattgcagcttcatcacgcacagcaattacttcagatccaattgtctttacgttatcttgcaattgctgtactgttcctatgcgcgaatgatctgtcgttataaaaccaactgtttttttcttaccgtgaaattgccatgccattttcgcgagtgtcgtcgttttaccaacgccagttggaccgattaatgcaattgtttgtacttctttttcaaagacgttttccgtattgaaatgagatttcatatcttccaatatgtacctgataacttcttcttccgtaatcatcgttgcattttcaaactttatttttaacttttcagcatatgcatgaatgaaatattgttccacatcgttttgttctagcatccgaattactttttgaataataaacggtacagattcttgattttctttctttggaactacttcttctttctttactggaacgacttgtttcacaacttttttctttttcgttactttcgttacttccgtttctttcatcggtttcacaacgacgattcctttttcaaacagctttaatagtttctctttttttcttgcccattcttcactatttcctgtttgcatcgccgcgtatgacatagaagtcgttacgttttctaaattgtgcagtactgattgaattccattcgccttcacaatttgttctgaaggatcattcacaacatccattaactgttcatgaaattgagctgtaccttcattcacttcttcctgtttttcttctggaaaagcaactaacatttcataatcctttttccaaaaaaacggtatatttcgttttacactttcatcgacaacataataataatctgtaccatattggtcaaataactttcgatacaattcatttttcgaagctgcttttattcgcattaacgcttctttcttttctgtactttccattacttcaccccctactattcaatataggcaatttgatccacaacaatttctggtgctaattcactaatacaaagtacttgtgcttccacttgataacgttctagcagtcttacaatcgcaaatctaaaatcttttctacgtgttaataacactggttctcttcccattaaacgtgcttgcttaaagacgcgctgcacttgctcaacgacacgtgtttctaaatctaaatcccagtttaataagtaaccttgatatgaattattcacaacatccgcatctaactcgattgaatcagagaagagcgctgcatatatttttccgtccggatttttcgcattttcacaaataacttttgaaatacattcacgaacaaatgatgttacaccatccacgtggttttgataaatttctttgccgtcaataataccttcaataattgttggtaaatcacgaatagaaataccttcttttagaagttgtttaataacattttgaacaagtgataaatcaatttcttttttcttaatctcttctaatagaacgccattatcattttcaagcgagttaattaagtcttttacatgttggcgctgaattaattcatgaagattacgtctaacgacaacatctaaatgtgtaattaatatgctaagtggctctaaaacttgatagcctttcatttgtgcatcttgcaccatatgctctaaaatccaatatccatcttcaccgaaaattggatctttcgctggctctgcatctaaatcagccattacgtttggtgttttcagtgctaataaataacctgattttaaaacaccttcagccgccttcgcacctttaattcgaataatgtaacgtccgcgtggcctaaagctcgtattatctttaaagttaattccaggaacgttaataccaaggtcagtaataattgacttcctcataagaacaactttatcacgcgctgtttccccgttaattttttgctttacaagtgctgctaaatctaaaccgagttctactataattggatatttatccgtaaatactccgaatgaatcttccacttgttgcagttgttcatcttcgccttggatcatttctatttctttttgaagctcgtcttctttttctttctttattcgatttttattacgaattcctaagaagataattgttccgccaacgagtgcgaatggtagaaacggtagcggagtaaaaatacccattgcgataaataaaccaccgagcgcatatacaacgacttcatgcgctaataactctttaaagataccttctgttactgtatccggtgaaccgtcaaatacacgcgttacgataatacctgttgaaattgcaagcattaacgaaccgatttggtttacgattccgtcaccgacagttaactgtgtataatgaagagccgcatccgcaaagctcatcccttgctgcatcattccgacaattaaaccgaaaataatgtttacgaataaaatgacaatcccgaaaataacgtcccctttaatgaactttccggcaccatccatcgccccgtaaaactctgtttccatatttaatttttttcgttttgcttgtgcatctttttctgaaataatacgctggtttaaatcagcatcgatagacatttgtttccctggtaaagaatcaagtgtaaaacgagctgcaacttcagctgtacgagacgcaccgtttgcaacgataaactggaatatgattaatactgtaaaaataacgataccaattaataagtttccgccaattacgaactggccaaactcttcaataacatgacctgcatttccatctgtcaaaatcgctcgcgtcgtcgaaacgttaatcgatacgcggaaaatcccgattaataacaacatcgttggaaatgactttaattcatcccactcgttaatacttgtcgctcgcatataaataagcactgacatacttagtagaaaaacgataatgatatcaagtataaatggtggaagtggaattaagagcgccactacgaatgacgctgctaaaaagatagaaaaataggttcttgcagaatctatcttaaacaaagagatctcctccaaacgcgctattatacttcaagttcattcgtctgaattaaatagcgcataacttcaattacagctacatataaatcttctggaatcgtctcatcttcctcgacttgataatataaagaacgagcaagcggacggttttccaccattggtatttcttgttcacgggcaagcgttcgtatatataatgcgagctcatcttccccttttgcaacgacaattggtgctgcatcaacgtgtttattgtaacgaagtacgaccgaaatatgagtcgggttgtttacaataaacgttgcgccatccatcttcttcgcaattgttccttgcaagattgcatgcataaagttttttcgtttccctttaacttgcgggtccccttcattatctttatgctcttgtttcacttcttcttttttcatcttaatatcttgctcgtactcccatttttgataaatgaaatcaataatagaaagaacgattaaaataattaaaattgctaagaaaataaatttaatttccctaataatttcagtaagggatgcagtccagttaaatccaatcatactgacaattttctctaaattctttttaaagagaacgtaagcgacgtaaccgattaatcccatataaaatagtgatttcaaaatatctactaaacttttacgactaaacagtctcgtaaaatagtttttcggattaatacgtgacgctttcggtttaatgactttagaagaaaataggaagccgacttgaatcatataattgaataaatgaaaagcgtatacgagtattaatatcggagccgatactttcagtaataaaatccccattaaataaaaatactcggttgaatctgtattttttccaatttgatcaaacagcaccgctacggaatttgcaatctcataccctagccaatctccgaagaaataaacgacaactgctaatacgagaatggaaaataaattatttaaatctttactccgggcaatgttcccttcttcacgcgattttttacgcttctgcggggtggccttttctgttttattatcctttgccatgcgcgtccccctacttcgttaagaaaaagttaaatagtttcgtatactcttcaagtaatacatccgtcatatttttaaacacataaccgagcatcggtacactcatcgcaataaacaaaatcccacatgtaattttaattacgtatgcattcataaaaacgtttaattgcggagcgttttttgcaattaaaattagaacaaagttaatgatgaataaacttcccataagcggaagagcaatttcaaccgctgatgtgatcgcaaataatagcgttgcgagtagactatctaagaaactagtcgtcaacaatcttgccctcgcctctgtatattgaaacgacattaaaatcgtggcaac

SEQ ID NO: 1138 - DNA, 6705 bp, Bacillus thuringiensis
tgagatactaactgcttcatgattaccgatgattccattcttgtgtaaatgcatagcaccgatatgtatattccctctatggtttactattttcgacatgatgaaattagattgaaatactgataggtgctttcctactttttcactaaaatcaaaaattttcattgctagtcctccttatacatataaaaccatccttactgtctgcatcatatgtccttcaaagtcttcttcaaattgctctaattcagcaaaacctttcgcttcataaaagcgttttcctttttcatttgctgcttctacatgtatgtacaatttacgtatcccatttaattccttaatccctctttgtaataaagcacttccaatcccttttccttgctgatctggtaacaaataaatcgcacctaattccgcttcattttgtagtctaacaggtgaaaagttcgcaaaccctattacttctccttcttcttccgcaacgaataaatgcgtatttttaagacgatatttcattttttcatcagaatatgcctcgtctaaaaaactgtcttgaatttctcttggaataatgccttcatatgtatcatgccaagctatttttgctactgattgtacagcatgaatgtcttcttgcttcatttctctaattatatatgtcatctcgatgtctccattctctttaaattatattctgctaatatactagaagaaacggcaaaaccattttcataattcaccttaattaattttaatttctcaattgaagctgttgcaaaatcaaactttccataaatatattccattacacttaaaaactgctttgtatgtaatctatttgcaattgtacaatgcggaacccattttcccggtacgtaatatgaattggggttgtcatgaaaagttttaaaataatcatgataagaataatgaagttttaacaattcatcggtaacggtcggcgctagaaagaccgttccattagtaggaaaaattccaacagaaagaaaagttactgcgtccatattttcttgaatagctacaaactcccctagtttctcagtatacaaatgaacatctaactcattataatccgcaatcgttatatgaggttctactccagctagttgatttgttccaattacatttgttaattcattttgcagttctgtaattttattagtaaacacacgatcaaatgtagcaataatagcgtacaatctttctcaccccttcgttacacatagcgcttcccattcttcacgaatcatgcccattcgaatagaatcatagtatgttccgttataataacgacactttcgcattctaccttctaagctcattcctattttctccgctactttcatcattcgttcattaccagaccaagtcgtgattcctactctaccaatctccattttttcaaatagcaaatctctatataatgtcaatgtttctgtaccgtatcctccattccagtatgttgggtcataaatcacaagccccatctctaaccaacgcgtcggtttgtattcccaataaaacccaactgtcccaatgatttgaccgttattttctataattaaattggatagcggttcttcttttaaacgagtttgcatcttttccttataggatgagtattcttgcattgaaaacggaaaatacggtgcatcccattttttccattctggattttcttctttaaacacgagattccataatgtttttatatctgattcttcaattgtacgaattgttactttatccccttttactattacgctattcataatttcctcctacactcctctttatttcatatataattataatattttttctgaaaaatcaaaacaaatatcatttattatattgtataattttgttataaggtacgaattattcatgtagaaagctggtgattcaatgaataaacgatttagtattgctttatttcttactattgttacgacaaatattattctctatttcttcttaccattaagtattgttacgaaatgggactttaatggaacgcctacatcaacaatggataaaaccacttttgtaatcgtaaatataattatatgttccttcttattctttgtatttttagctttatctaaagcagcgagtaaccagaaatttctccattggatcggcaacacaatgttactattcttattttttgtcgatattgtcatcgccctcatcgctcttggcttttcacttcctcttgatcatttcatatttttagcattagggcttttatttatattaataggttatttcagttccaaaattgatacgactaaatcaaccgtttcattagaatggaatgataagcaccttgaaaaaagagcttcaaatattagtagtatttcaatgatgatagcaggtatttttttagcgatacttccttttatcgtttctgctccctatagaggttatgctatactagcaattcttttaggaatgacgcttatcattctgccaagtacgatttatttacttattaaagacagcaagcaatctactcctttaaaaaaataggaggttatatccctcctatttcagcttaatgttttatttttcactttttctatctcaactaaaatccctttctctatccaaccctctacgccatcttttttaattaaatcatatcctgaacagctatcatcaatgagagaaacgatatctcccttcctaacgcttatttgcgcacaagaaatatcggttttcactgtatattcacctgacttaagttgtttcatatattcattttttacagtgagcacattattcgtttccttttgtttacatacggtgtaatcttgcatcttctcgataggctctatgtaataatacggatatgtcactccgccctgcatttctgaattcgcattaaaatccgctattacttcgtactctggaaaatagtctacatatgtataagaaaacgtatcgcccgtttgtttcctctgaataataaatacgtttaattgccctgcttctttaattgcatttcctccatcaattgcaataatttctttctccttatcaataactggattattagacggtgcttcttcagaatagttcacgacaggccaatgaccgactattacatacttatttgctttatgtgattgattgaaaaactccggcattgctatcgcatttttgcgctcagtttctttccaatctactctatcttctagaccggcatgcacaaaaatataatcttctgtttcaatcgctgttggcaactctgttagccaatatagttcttgtgaaaattcacttaacaatgcttctttcacttcacgaattgaagtgccctcatgaactgaaaaaaccaattgctctagccattcattaaaaattgaatgcttcctcgtacataaataattaataagaccaggattttcatttagaagagcatcaactaaaacttcacaattcccttcaacaacgtgaacctttgaattgttctttacaagattcataacgtagtttactacgcctacgctatctcgtcctttctcgcaaagatctccattaataattaaataatcttcatctttaaagttaactttatgtagtgcttcttttaaaagatttaattctccatgaatatcagatatgacaataactctagcatcattagggattgatagtttctttatttttttcaagtataagcgctccaatcatcctctttattaaattaaaacaattcgacaaaatacactatataaccttttcaagtacatataccataacttacaacctatttacggttcaataataacttaaaaaataagaagaagctgttcccaacttttgcaggacagcttcttcttattttttataattctttataaaaagaataactcaccttatcatacccttctctttcataaaaacgatgagcatcaattcttgaaaatgctgacgtgaggacgatagactcacatccgttttcctttccccagttctctatatacgaaagtaatactttcccatgtccttttgaacgatgtgcttctgctgttacaaggtcatatacgaaaacgtgtttcttattataaaagttcgtacaaatcgctacacctgcaaggctaacaacttcatcattctcattacgcagcgaaaatagtttataattttcttctttcatatttcgaaataaagagcttgtttcctcttttgaaagtttcattcgtaattgctgtaaaacaggtaatacttcatgtaattgctcttctgttactacttctttaacattcatttttaactctcctctaactatttatttaattttctaaatgttatatcattattatagaaagtaactgcccttcacttaagtgacagtttaagtgttttttataaggccagttttaaaggagagttttatatggattttactatcccattgcaattacaaagtaacacacctatttacttgcaaatttacgaatatataaaagctgaaattatacaagggactatttctgtcggcacacgtctaccctcacacagaaatttagcatcacaacttaatattagccgcattactgttgaatcagcttatcaacaattattagctgaaggttatgtagaaagtaaaccgaaacgtggtatttttgtagcaaatttcgatattgacgttatcccaaataaaaagccaaatgcagcaaagaagacgagcaatttgatagacgaaaaatttgaatatgattgtagccaaggacttattgatcaaaatgcatttccgattacaaattggaaacgagcattacaagaatccatacttacatacgaaaatgcactatttgccaaagaagaccctcaaggtgaattcgctcttcgagaacatatatcaacatatttatatcattctcgcggtgtccattcttcacctgatcaaattgtgattggcgccggaacgcagccacttctctggctactacttcaactgcttggccctacaaaagaatacggcattgaaaaccctggatttcaccgtatacacgcaatcattaaaagctgggattgacaaagttcatcccataccattggatgaaaaaggtattgatatttctagtttatacaatacaaattccaatgtcgcatacgttacaccatcacaccaatttccactcgggattattatgcctttatctagaagattagaattgttaaagtgggctaatggttgcagcggatacattattgaagatgactatgacggagagtttcgctacgctggtaagccgattccttctttacaaagtcttgattcaaatgaacgcgttatttatatgggaactttctcaaaatcttttttaccttctttacgaatgggatatgttgttttaccaccacaccttttaaaaacatatcaagaactgcatggaattttcaaacaaacagtcgctacaatacaacaacttgcttttgctaactttatacaaagcgggaattgggaacgtcaccttaatcggagtcgtacactatataaaagaaaacatcatgcgttagtaaaatccattatgaaagaaatgggggctaatgttcaaattcttggcgaacagtccggacttcatattgttttatgtgtccataacagtatgaatgaaaatgaactgattgaatccgctaaaaaacaaagcgttaaattatacccactttctccatatgatttcgtgaatgatttacgtaaggaatcatacgtattactcggctttggtagtattccagaaaataaaattgaaacgttggctagattattaaaagacgcttggtttcctagttgcaaggaaactttttaacagtggatttaacttgtaacatgttaacaattcaacaaaataaaaaagaaggctgttccaaaataactttttggacagccttcttctagttattcacctgacctagctttccttcccggacgtttcacaccagtcgtttctgttgaataggaagcttcgattatagcggctggatctacagagagaacgagatctttcattttcggataaatgaatcggtttgtaatgcaataaatgattctcttatgctcccctaaaaaaccaccttctccatgtagatacgtaacagatagttgcaattctttcataagtaaatcgcctatttctttattcttaccagaaataatcataacgctcttaccttgattaataccatctaatataaaatcaatcatcttcgtaacaatatagaaaattgctaatgagaacatcgcttgttcgattgaaaataaaatggcaacaaagatgaaaataactgcatttactgcaagtaaaaatgtactaatcggtacattaaagtgtttattcatccaaactgctaacatttccgaaccgtcaattgctccacccattttaacaacaatcccaacaccaattccaaacagtactccaccataaagtacaattaataactcagaaagtcgtaattgctggaaatggttttaaataaataatccgagtgttgtaactacattcgcataagatgtacggataaaaaatttctttttccattacctttttgcagtaaataataaaattgggatattaatttctaagaacacaccattaaagcggcaatcctgcgaccttatttgccataatagcaatagccgttaccccgccattactaatccattag

SEQ ID NO: 1139 - DNA, 5956 bp, Bacillus thuringiensis
ttgaaagtgaacaaaaaacagtttttgcttcatggcaaccatgtctctcccgccccaccaatcatttaaaactgaatgaatctttacataatcttccccttggatatttcttactcgcatatgtttctccctctcactcacttcattttttcataaattttaatgactgtttctactaataggatgaatacccatatcccgcaaaatacaagaacagactggaatatagatccaattatcataacaccaactgtacctgttattgaaaaagatattccaccaagccctggatcttgtataaatgctccagcagaaaaagcagttataattgatactattaaataaataacactcgttatttttaatatctttatagaaagatacgaggttttttcttgttccacttgtgataattcgatttccccgctctcaattcctttttgcaaacagtcttcacatagaaattcttccttaatttttttaccaccgtgcatcgtacctgttatttctttacatcttgaacattttcgatttatcatgttgttatcactccaatctgttaagattatacttatacaattctacgtttaccttaatattccttttatgtattttatagagaaaggtcgtgttttatgatttcaaaactcacatttggctctaaaaaaattaacgttcattatacattaaggcctagttgttatgcgattatttttcaatcatcttcttcaaagattgctgttatccaaaaaggagaccgttactttttacctggtggcggtatggaaggtaatgaaacaaaagaagaatgtttgcaccgtgaactactagaggaattaggatgggcaattaaaattgatcagtatatcggtaatgcggctcgatatttttatgcagaaaaggaagatatatattatttaaacgatggatttttttatattgcgaatatggtgcagaaacaaactgaaaactgtgaggaggatcatgttctaaggtggatgtctccattgcatgctatagagcttctcatacacgatcatcaaaaatgggccgttgaacaagcgcttttattacaaaaacaaaaaggatctccttctatatgaaagagatcctttttactgttaacttacttttttcaaattgagagcaggctttttcattccacctttttttacaacatataagccgataaaaataataagtccgccaacgagttgcatcaaattaatttgctctccaatggttactgccgcaaagatcactgcaaacaatggcacaagatacatataaaccattactttcgttgagcctattttactaataccgacataccacattgcaagtccgaagatggtcgcaaagatgattgaatatgcaagcgatccccagcttggcgtatctactggccacgttaaagaatttacgttgaataaacagtatataactagcggtacaattccaattaaagtagaccatgatgtgactctcattgcggagtattttgtaataagaggttgcgctaatattggataccatccccacgcaattgctgcgactaatccaattacatttccgagccacgcatactcgtaagtagctcctcctgtatgtcctgttaataaaacgaatgctgcaccaataaaggctacgattgaaccaatttgtactttcatcgaaaaacgttcttgtttgtgcaatactgctaatatccctgtaaaaataggtgacattgcaattaataatgaagcgttcgttgctgaagtatatttcacagatagcataaacatcgtttgatacattgtcgttccaacgatgccgactgctactaatcgtaaccaatcttttctttcaatacgtaatgagcgttccatcataaaagtaataagtaataataccggtgacgctactaaaaatcgtaaactattaaattgaatggatgacatatatgccacgccatactttcctattgtataatttgctccccatactaatgcaacagatactaggagccattccatttgccatcgtttcatccgaatctccccttccatatttagcatagtaaaattggctggatataacaccgtccaattggctgtttttttacccagccaatttgttatactgaatgtatataagagatgcggaggcgtttgtatggaatggaagctagataacgacagtaaaatccccatttatcagcaagttgttgactttattgaaaaacgtattacatacggagaacttcctccaggaagcttcctaccttccgaacgaaaattagctacacagttaaatgtaaaccgaagtacagtaacgactgcttataacgaactacgtgctatgggaattgtagaaagtacgactggtaaaggtacacgtgtaagtacacatatgtggggcgtttctccaacattaacgccgaactggagaaatttcgtagaaggcggtacgttcttaccaaacttaccgttacttcgccatattcgggcagaagtacaacaaaatgaaaatattattgatttcgcaaacggagaactcggttgtaatctctacccacacgatcaactacaaacaattttacgagaacaaccgttaacacattcattaagttatgatcatccacaaggctatcttccgctcagacaagcggttgtaaaatatatgagggaatatttaaaagttgaagcaactgagcaatccattatgattacatctggcgcacagcaagcacttcacctgatcgtacaatgtttattaaatccaggtgatgctgttgctttcgaaagtccttcacactgttattccctgcctctattccaatcagcaggtattcgtattttcccattacctgtcgatgaacatgggattaacccagatgatgtacaggagttatatagaaaacaccgtattaaaatgatctttttaaatccaaatttccaaaaccctacgggaacgatgcttcatccaaaccgtagaaaaaaactattatcactttgcgcagatttacgaattgcaatcgttgaagatgatccgtccagtttacttacgctagaaaagaaacaaccttgccctactttaaaatcgattgatgaaaatggaacagtcatttatgtacattctttatcaaaaatgattgcgccaggattacgagtcggctggctcgtcgctccgcaatccgtagtagaaaggttatccgacgcaaggcaccaaatggaattaggtatgagcatattcccgcagtggcttatgcagcagtttttcgaaactgtaccatttcagtcgcatatcgtaccgttacgaaaacaactagcagaaaaaagagacgttatcgttcgcgccctaaacgagcaacttcacgataaaatctctttttcaaacccaaccggcggtatatacatatgggggaaactaaaagaaccgataaacgaaaaacaacttattatgcaaagtttaaaacaagaaatcgcgtttatgccgggtagtattttcggtgcgaaagatggttatattcgtttatcttatggaaaagtgaatattgatcaaattgaggaaggtatttctcgtttgcgtgaggctattttagtttgtgaaaaataactttacataaagctctatcgtttgacaaaagaaaaatctaccattattatcaacacgaacctagttaccccgcattaacgggcaataaaactcccagctcaaaattcagctgtaacaaagaagttaggtgggagattaactgcccgtaaatgcccgattggttcaactaataatcagtggagggtgaatccccccactgattaaagtttcactttataggagtggtaaaaatgaaaatttacgttgatgcagatgcttgtcctgtaaaagatgtaattatttttgaagctacgagtgcagaaattcctgtaactctagttactagcttttctcattattctaatgctcagcagcctaaaggtgtagaaacaatttatgttgattccggagcagatgctgcagattaccgaattatgcagttagcaaaaaaagaagatttaatcgtaacacaagattacggtcttgcttcgctcgctttagcaaaaggctgtatcgttctacaccataaaggctataagtatacgaatgataacatcgaacaattgttacaaacacgatatttaagtgcaatggttcgaaaaagtggtaaacgtacaaagggaccgaaaccatttacagcagaagataaagagaaatttagagagctctttaaaagtatgatcgcactttaaaaatgaatcgtctatttgcaaggaaaacttcgcaaaacaaagaagagaatatcgtaatgaacattctcttcttgaggtttaccctttaaaatgaaggtaaattatctaagttattttcttttattccatcaggttcactacgtataatatctctaccatacttatgaaatacgtccacatgagctaacttccctgattttgcttcactaagagcagtcatataatctaactctctcccgctacttgttttaaaagcaatcaaatcaccttcatcatttttacgaacagcaacaatttgttctgctcctgaagtaacttcctgagctatttcaaattgagcttgctcttccccttgatgtaaataatcattatatactttttcaaagtcttttttgtccattaaactcacctccaaaacattttattagtatggttgggaggtgttggttttatgtacttttctgttagaaaaacgaatttttaatacctacgcaaacccttcaaagtctccaatatatcatctgtaaaggctgtactaccctctgtctctaaagctctgaaataaaaacttcttaggaaagttctaatattttgtactaaaatagcatgctgcggatgtcggatgtcttcaacagttgctatactatgtaaccagttgctccactcttcttcagttaaaagattttggtcacgtaaagacataattggctttactaatctctcatcttcaaagtgtacatatacgtaatcacttaatcgaaccttttgacgaacagctgcaagaattgcatatgaaaactcacgattttgtatagtacgcactaaagcatctagtgcatcagcagcgtgtgcagtagagtgtgcccagccttttccttctacgtaacctcttacatcttcttctaaatatacatattccagcacttgttctgctacactgtacagttgttcttcggataacaacggttctctttcatgaacagataaaataagtggtggaattaatccggagaatgcacgtttaaatacagagtctgttcccttttcaccaattttataaaataaataatcaggactaattgcttgtaacattaatcctcttaactctttttgtctaaatacatcatttgtaatccatgtgtgaagcgtactataaattaaatcatcacgtaattcagcatcaggtgatccgatataatctagcatccactgcgcatatggatatgcatctacgtcttctggtacagcataattgttatttttaatttgtagtagttcttcttttagttctagtacttcattcattatatttcttgtcccctttttgcgttttttattgtcttatccccttttatttgcttcataaaattaatttaattataacaataaacaaaaggctatacatatatttctgattatgtattacgctctttcatgaaatataacttctggatttcctaaatcactattcttaaatataacattcgcacactctttcggattatgctcatctatatacattttacaacccgcgtaatacctgtttaaaaacatcttctctgcttcttcataacttccaaaagcttcagtttcccgcttagcaccacgttttctcgcaatctcaaaatttgtatctacaaagaatttgtaatcaaataaatgcgcaacgtcttttttcaatagaa

SEQ ID NO: 1140 - DNA, 5735 bp, Bacillus thuringiensis
tatatgttttatatagtattatataaattgttttattgcgcaataaaaaagatttgaaaatatatgttttttataaacaagatcctccgctcacatcaattaattgtccagttacccagcggctgtctggagaagcaaggaatgcagcagtatcggcaatgtcttctacttcacctaagcgattgaaagcggaaatagtagtagcgtactgcttcatcatcgggtcgctcaagagttctgcattcatatctgttttaataaatcctggaagtattgcattcaccgttattcctcgtgctccaagctgttttgctagcgtaaaagtcattgtattaatagcgcctttcgtcatactatatgcaacaaaatcaggtaaagaaatgcgggtggcagcggatgaaatattaataattcggctattgtcacgtaaacgtggcagtgcttgttgaatgataaagaatggtgcttttgcatttactgaaaacattctatcaaaaaattgttcagtcgtttcttcaataaaagcaccaggaccaatgccagcattgtttattaaaatatcaaattgtgtttcaccagtgcgcttttgtaattcagtatctaaagcgttataaaggttttctacaccgtgtaaggattctaaatttgcgccgatagaaaaagcttggccaccatctgatcgaatttcatgaacagtttcttcagcgtcatcttttcgattaccgtaatgaacagcaaccaatgcaccgtcatttgctaaacgtttagcgatcgctcgtccaattcctcggcttgctcctgtaactaacgctactttcccttttaacatagtttcctcatctcctcataaactttataagtttttctttatgtagtaatgcaaacatacttaagtaatatatgagtgtatgtaagtaatgcattccaattttgatttgagaaaaaataaatagaatgaattttgatttttttgagaaaacatgttgacaacgaaaagaacaacgtcctataatacgtgtaacaaataaaagttaattaagaattttctaactttatatgttgtatatgcaaagaagaggaaagtagatgattatgatcgtttcagagagctactccaaggctgtgagggtagtaacaatcgaatcattgaagatcacctcggagcatcgcttgcgaaagggaaactgagtagagggcggcggcatcgtctccggtaaaaggacggaggtctgattggacctacaaagcttatatttcgtgagaagtataaggaagctgagtggtaacgcgaaactctcgcctcagcaatcaaagctactaaattgtagtagttgattgctgaggcgagagtttttatttttaaaaatagaagaagagaatgcgtagaagaggagagtaaatgataaagattgtttcagagagctgccccgaggctgtgagggtggtaacaattcactcattgaaaatcaccttggagcactacttttgaaaactagtaaaaagtagcggggttgttcccgatagaaaaacaaaagtctaattggacttgcagagcttatatttcgtgagaagtataaggaagctgagtggtaccacgattccctcgtctcagcaatggattgctacaagtatgtaagtaatcgattgttgagacgagtatatttttaaggtttatatactgaatattctgttaaaattactcatctcagcaatcgatgtagaaatagattgcaaaaatagagaaaaaagaggagcgatgtgagatgggaaaccagtacatttacatgaatggggaatttgtagaaaaagaaaaggcagttgtttcagtgtatgatcacggttttttatacggagacggtgtatttgaagggattcgtagttacggaggaaatgtattttgtttaaaagaacatgtgaaacgattgtatgaatcagcgaaatctattttactaacaattccaatgacggtagaagaaatggaagaagcagttttacatacactccaaaaaaatgaatacgctgatgcttatattcgcttaattgtctcaagaggaaaaggtgacttaggactcgatccgagaagttgtgtgaagccgagcgtaattatcattgcagaacaattaaagttatttccacaagaattttatgataatgggctaagcgttgtatctgttgcatcaagacgtaatacgccagacgcgttagatccacgtattaagtcaatgaattatttaaataacgtacttgtaaaaattgaggcggcacaagcaggagtgttagaggctcttatgttaaatcaacaaggatatgtttgtgaaggttctggcgataatgttttcgtagtgaaagatggaaaagtattaaccccgccatactatttaggggcattagaaggtattacgagaaatagtgttatcgagctatgtgaacgactgagtattccgtgtgaggaaagaccattcactcgccatgacgtatatgtagcggatgaagtatttttaacaggaacagcagcggagttaattccagttgtaaaagttgattcgagagaaattggagatgggaaaccaggaagtgtaacgaaacaattgaccgaagaatttaaaaaattaacgagagaaagaggagtacgtgttcccgggctgacggaaagcttagcataaataaggagaggagttaattgaaatgaagcagcagtatacagcgtatgagaagttacagtgtgaagaaatgacaggcgctgggcacgtgattcaaggtttgaagaaattgggtgtaacgaccgttttcggctatccaggcggagcgattttaccagtatacgatgcgttatacgaaagtggtttgaaacatgttttaactcgtcatgaacaagctgccattcatgcggctgaaggatatgcgagagcttctgggaaggtcggggtagtctttgctacctctggcccaggggcgacaaatttagttacgggcttagcagacgcttatatggattcgattcctttagttgtcattaccggccaagttgcaacgcctttaattggtaaagatggatttcaagaagcggatgttgtcggaattacagtacctgttacgaagcataattaccaagttcgtgatgtaaatcatgtatcacgaattgtgcaagaagctttttacatcgccaaaagcggacgaccgggaccagtattaatcgatattccaaaagatgttcaaaatgcaaaagtcaccagtttctttaatgaagaagttgatattccggggtacaaaccagaacttgtaccagacagcatgaaacttagagaggtggctaaagcaatttcaaaatcaaagcgtccacttctttatattggaggaggtgtcattcattcaggtggatccgatgaactcttcgaattcgcaagggagaaccgtattccagtcgtttcaactttaatgggacttggtgcatatccaccgggagatccattgtttctagggatgcttggtatgcatgggacatacgctgctaatatggcggtaacagaatgtgatttactacttgcattaggtgttcgcttcgatgatcgtgtaacagggaaattagaacttttttctccgcactcgaaaaaagtacatattgatattgatccttctgagtttcataaaaatgtaactgtagagcatccgattgttggtgatgtgaaaaaagcgttacacatgttgttacatatgtctatttatacacaaacagatgaatggcttcagaaagtaaaggcatggaaagaagaatatccactttcttataagcaaaaagaatctgagttaaaaccacagcatgtgatcaacttagtaagtgaattaacgaatggtgaagcgattgtcacaacagaagtaggacagcatcaaatgtgggctgctcacttctataaagcaagaaaacctcggacgttccttacctctggaggattaggaacaatggggtttgggttcccagcggcaattggtgctcagcttgcaaaagaagaagaactcgtcgtttgtattgcaggtgatgcttcttttcaaatgaacattcaagaactacaaacaattgctgaaaataacatccctgtaaaagtatttattataaataacagatttttagggatggtaaggcaatggcaagaaatgttttatgaaaatcgtttatcagagtcaaaaattggctcaccagattttgtgaaagtggcagaagcttatggagtgaagggattaagggcgacaaattcaacagaggcgaaacaagtggtgttagaagcatttgctcacgaaggtcctgtcgtagttgatttttgtgtagaagaaggtgaaaacgtatttccgatggttccgccaaacaaagggaataacgaaatgattatgaagaggtgggaagaatgagtcatactttttcactcgttattcataacgagccaagtgtcttattacgtataagtggaatttttgctcggcgtggctattatatttcttctttacatttaaacgaaagagatacgagtggcgtttctgaaatgaaactcacagcagtttgtactgaaaatgaagcgacattacttgttagtcagttgaaaaaattaattgatgtactgcaagtaaataaattataaggggtgtatggagtatgaaaacgtattatgagaaagatgcaaatgtagagttattacaagggaaaacagttgcggtaattggttatggatctcaagggcatgcgcaggcacaaaatttacgtgattcaggtgtggaagttgtagttggtgttagacctggtaaatcgtatgaagtagcaaaagtagatggatttgaagtaatgtctgtttcagaagcggttcgaaccgcacaagttgtacaaatgttattgccagatgaacagcaagcacatgtatataaatcagaagtagaagagaatctccgtgaaggacaaatgttacttttctcacatggatttaacattcacttcggccaaattaatccgccaagttacgtagatgtagcaatggttgcgccaaaaagtccaggtcatctcgttcgccgtgtatatcaagaaggaaatggtgttccggcattagtcgcagtgcatcaagatgcgacgggaacagcgctacatgtagcattagcgtatgcaaaaggtgtaggttgtacacgtgcgggtgtaattgaaacgacattccaagaagaaaccgaaacggatttattcggtgagcaagctgtactttgcggcggggtaactgcacttgtgaaggccgggttcgaaacgttaacggaaggtggatatcgtcctgaaattgcatactttgaatgtttgcatgaattaaagctaattgttgacttaatgtacgaaggtggattaacgaatatgcgccattctatttcagatacggcagaatttggagattatgtaacaggatcgagaattgttacagatgaaacgaagaaggaaatgaagcgtgttctgacagaaattcagcaaggtgaatttgcgaagaaatggattttagaaaatcaagcagggcgtccgacgtataacgcaatgaaaaaagcagaacaaaatcatcaattagaaaaagtgggagcagagcttcgtgaaatgatgagttggattcatgcaccgaaagaattagtaaaggaatagagtaagagagtataaatgaaaaatatgtaagagggggtaatacaagatgaccagtgccatgattaaaaaaggaagcacgcacttc

SEQ ID NO: 1141 - DNA, 6255 bp, Bacillus thuringiensis
ttataagaaatgtgtttcttttttatactgcctttatgccggcggatcatgtccatcctcaaaacgacgttctaagttaacgaacttattgaactctttgacgaatgcaagttccactgaacctactggaccgttacgctgttttgcaataataatttcaattgtatttttgttttccgtttctcgatcatagtagtcttcacgatataggaaagctacaatatcagcatcctgctcaatacttccagattcacgaatatcagacatcatcgggcgtttatcttgacgagattctacaccacgagataactgtgataaagcaataacaggcacttgcaattcacgtgcaatcccttttaaggtacgagaaatctcagatacttcctgctgacggttttctcctgatttcccacttccttgaataagctgcaaatagtcaatcaaaatcataccaagaccttgttcttgctttaatctacgacattttgctcgaatctcatttactttaatacctggcgtatcatcaatatatataccagcatttgagagactccccattgccattgttaattttgcccaatcatcggaagttaatgaaccagtacgaagtctttgtgcatcaatattcccttctgcacaaagcatacgcataacaagctgatcagcacccatctccaaactaaaaatcgctacattttcatccgttttcgtcgctacgttttgtgcaatatttaatgaaaatgccgttttccctactgatggacgtgctgccacgataattaaatcatttcgttggaaacctgctgtcatcttatctaattcagtaaacccagttggtatcccagtaacttcacccttttgattatgcaaaagttcaattttgtcataagcatctacaagaacatctttaatgttttggaatgcttttgcattcgtttgatgggatacttctaatatttttttctcagcctcatttaaaagaccatccacatcatcttctctctcgtatccatccgatacaatatgagtcgccgtgcgaattaaacgacgtaaaagcgccttttcagcgatgatgcgtgcgtaatattctacgttagctgcagttggcacaacttctgctaactctgctaagtaagaaaccccaccaacttcttctagtaatccttgatcagccattgctgatgtcatcattactaagtcgatcggctctcccttatcagatagcccaagcatgacttcaaaaatcttttgatgtttcgttcgatagaacgaatcaggtaccaataactctgatgctgaagttaacgcatcttgatcaatcaatatggcccctaaaaccgcctgctcagcctctatattatgcggaggggtacgatcagcaagtacatcactcatacgcaatcctccttgcttaatttatttttattgttcactaacatgaacttttactgttgctgttacttgtggatgcaatttcacagtaacgtttgtataacctaacgcgcggattgcatcgtccatttcaaatttacgtttatcaagcttaatcttgtgtgatttttgcattgcatctacgatttgtttgcttgtgatagaaccaaataaacggccaccttctccagatttcgcctttaattctacagttaatttctctaaagtctcttttaactcttttgcattttcaagctctgctgctgcatctttttcttctttacgcttttgagcttctaaagttttcatactgctatttgttgcttcagcagctaatccttgttttagtaagaagttatttgcatagccatctggtacgttttttacttctccttttttacctttaccttttacgtcttttagaaaaattactttcatgattgtgtgcctccctgtaaatagtcatcaataacaaatcgaagcttctcctcagcttcatctactgtaacatttttcatttgtgtggctgcattcgtcaaatgcccgccaccgcctaagttttccataattagctgcacattcacttcacctaaagacctgctgctaattccaatgagattctcgccgcgtttcgcaacaacaaatgatgcaataatccctgtcatcgttaataacgtgtctgccgattgcgcaataagcacttgatcgtagtaatcatcactatcaactttagcaatcgcaattccatttttataaatgtacgcattttttatagcttttgcaacccgtaaatactgatccatatcttcctttaaaagttcttgtacaagtacagtatctgcaccatgtgagcgtaaataagaagcagcatcaaatgtacgagcccctgtccggaatgtgaaacttttcgtgtcgacaataatacccgctaacaatgccgtcgcttctaacattgtcatctttaaatttttaggttgatactcaagtaattctgtaaccaattctgctgttgaagaagcatatggttccatataaactagcaatggatcttcaataaaatcttctccacggcgatgatgatcaataactactacattttcaattttatgtaacagtttttgctccatcaccatagaaggtttatgcgtatcgacaacaacaagtaacgactcatcatttgcaaattccatcgcttgctctggagtaataaaacgagaccataactcctcattttgtttcactttgtccatcaaacgcttaattcctttatcggaatcattttcatctaacacaatatatcctttacgctcatttaattgagccacttttaaaataccaatcgcagcaccaattgcgtccatatcgggagccctatgccccataataatgacattactactttctaatactaaatcctttaacgcatgcgaaatgaccctagcgcgtacacgggtacgtttttcaaccggatttgtcttacctccatagaacttaactttacctgtcgcttgtttaatagctacttggtctcccccacgcccaagcgcaagatctaaaccagattgagccattgctccaagctctgataaaggtaaatcacctgatccgacacccacacttaatgtaagtggtatattccttttagatgtttcttcacgcacctgatctaaaatgctaaatttccctttttccatctgcgtcaaaatactttcatttagcacaacgaagaatctttctgaagatgcacgttttaaatacgccccatacttaagtgcccattcatttagtcgcgatgtcacaagacttgttatattcgtacgtaattgatcatctaatccttgtgtaacttcatcataattatccaaatagatgacagctaaaacagtcctttgatcctcgtacatcttttcgatttctgtttgttccgttacatcaaagaaataaattaacttttcttctttccttacaaaaacgcgaaactttcgattatttaaagagactatatcatcagaagtttctcctttaatgaaaagaagtaatgtttctgatacatcgtaaaggtgccatccagctaatgcatgctgtcccagacatgaagataaataaggatttgcccaatcaatcccataatccttattgtataacaaaataccaatcggcatttggttaaatgcttcattacttactttctttactcttgtaatcatatctgtcgtatgcttttcgaaattcctttgaaaattaagttcaaatcgtataacgataaagaatacgatacaaaaaatgacaaaagcagctatccccataattaaatgaaaataacagagaattgaaatgagcacaaacacaaaaaatgccaatacataaacaggatataaaaaccactgtttcttatcaaattcaggcatgtatacaactcctataaagtaaaactaactcaccttccagttagttaaacagattaaaatagtataaggaatattattttatccccctattttagaacgcaatgaaatccctaagtcaattatacctaagattgtcacaagaggaaacagcatcggaataaacatgcatgcaataaaactaataataggaacccctttagtaaaaccttttctatacgctaaaaaggcgataaatgtcagaccttgcagtacaagcaatagtgcaaatatgacatttaggttagaaaataccatatgtaaatatgatgttggttctacttttataaaagttgctaacaaaataaatataacgtaataccaaatgatactctttggtaattgtatatctttaaatttaggccaagatataacgtcatgttttaactttttcaaaacactacctgatattatcactgtaatccaagaaaaacatactgaaactagcacaagtatactcggaagtaatgattgtaatatatcattcatttgtgcaagtaactctttttgttccttactaatcggcatacctgtagcacttactatcttttcgcttttcgccatactttcactaaatatactttgcatttgcttcattatatctatgttgaaaaactttatactcgcaacataaataagtacaaaaccaattaagtatgcaagcgtcccagctattaagatttcccctggcttttttcttgttttatacatatatcctaaaacaatccctatcaatccaaacataattgtcttcactaaattcatcggttgactcacaataacagtaacaaaaagtgccgctacaaaaaccacgagcacattagatagtttatgtcttatcattaatagtataaatggtaacggcaacgcaaaagttacaactgtacccaaaatcggaacatacatagatataagcaataacattgcatatatagccaacaacgcggcaccttcagtaataaatcttgcttgtttcacattttaacctctctttcaaaaaagaaaagcatagcaaaatgcacagtagagtccgactctactgtgcatttcatacgctattattcaccaacatatggtaaaagtgccatttgacgagcacgtttaattgcaactgtaagtttgcgttggtatttcgcgcttgttcctgttacacgacgaggtaaaattttaccacgctcagaaacaaaacgttttaataaatcaacatctttatagtcaatgcgagtgatgccgttagctgtgaagaaacacaccttacgacgtttcgcacgtccacctttgcgtcctgccatgtctatttccctccattctttgttaaaactaacaaatttactgtattagaacggtaaatcgtcgtcggaaatgtcgatcggttgacctacatttgaaaatggatcgtcattcttcgtaaatccagagttaccttggttacctgaattactagattgaccaaatgggttagagccttggttaccgaaaccagctcctgatggttgctgattaaatgaaccacgttgctccccaccgccattacgcggctctaaaaattgcacgctttccgcaagaacttctgttacgtatacacgtttaccatcttgtccctcgtaattacgagtttgaagacgtccatctacgcctgctaagctaccttttttcaaataatttgctacgttttctgcttgtttacgccatattacacaattaataaagtcagcttcacgctcaccttgttgattggcaaatacgcgattcacagctaacgtaaaagtagctactgcaacaccattgggcgtgtaacgtaagtcagggtccttagttaaacgaccaacgaggataacacgattcatcaatcgaaccactctcccttatatatcaattatttttcttcttctttaacaacgatatgacgaaggatgtcttcgttgatcttagctaaacggtcgaattcgttaatcgcttctgcgttagatttcacgtttaagatcatgtagaaaccttcacgtaagtcgttgatttcgtaagctaaacgacgcttaccccactctttcgtgttaatgatttctgcaccattgtttgttaaaacacctgcaaaacgttcaactaaagctttttgagcttcttcttcaacgccaggacgaatgatgtacataatttcgtactttctcattacactttcacctccttttggtctaaacggcccgtaatgggcaaggagcaattaatttatagtaattactcacgagtttagattatatcatagtaagttatatgaatcaactcaccaatacataaaaaacttggcaaacatataatatatgtgccaagctcatatctttatttttcctaggaaatattaaattaaacgttaaaaccgggagtg

SEQ ID NO: 1142 - DNA, 4737 bp, Bacillus thuringiensis
tttttatcaaatggacggcaagccgttgctgggtcttcattaaatgttaatgctttcgctgagctaaatcctgcgaatgccatacttgttagcggtgcttctgctccgcctgtaatcattgcatcagcatcaccacgctgaattgctttaaatgcatcaccaattgagtttgcaccagatgcacaagccgttacagaacaagtgttaattccttttgctcctgttgcgattgatacttgacctgctgccatatccggaatcatcatcggtacgaagaatgggctcacgcggcgtgggcctttctcagtaaaaatcttaaattgttcttcgtatgtttccataccgccaatacctgatccaatccatacaccaattcgaggtccgttttcttctgtaatttcaagctttgcatctgcaactgccattttcgctgctgctactgcatattgtgtaaagcggtccatacggcgcgcttcttttttatcaatatatttctcgacttcaaagtcgttaatttctgctgctacttttgctggaaatagttccggatcaattcttgtaagtcgtccgattccagatacaccctttttaatgttttcccatgctgtttcaacatctgttccgaccggtgtaacagctcctagtcctgtaattacgaccctctttttttccatacaaaatacactcctttttttctctcagtccttatttaccccaacgaagagcgactgctccccatgttaatccgccaccaaaaccaacaagtataattaaatcaccatcttgaatacgtccattttgcaattcctctaccattgcaattggaattgaagaagctgatgtattaccaaacttttcaattgtcatactcattttttcttgtggtaaatttaatctctctcttgcagattccataatacgaatattcgcttgatgcggtactaagaaatccacatcctcttttgtaagaccagccttatccagcacgcgaagacaagattcaccaagttgacgaacggcaaatttaaagacttctctgccattcatcataacatactcgtcttgatatagatgcttaccgccgcttccgtctgctcctaattcgaaagatagaacgcctcttccttctgaaactgctcccattacgatagcaccggctccgtctccaaataataccgctgtatttcgatcattccagtctacaattttagatagcttatcactaccaactactaatacgtttttataagtccccgtttgaataaattgctgcgctgtaatcattccgtacataaaaccagcgcatgctgcacctacatccattgcagctgcatgtttcgctccaatcgcttcttgaatgacacaagctactgctggaaacgcacgatctggtgttactgtcgccactaaaataagatcgatatcttctccgctaacccctgcatcttcaagtgctttttttgcagcctctacggccatatatgaagtatctattgtatcatcggcaatgcgtctttctgcaattcccgttctcgtacgaatccattcatcggatgtatccattattttttctaaatcgtgatttgtgactactttttctggcacatatcttccgatccctaaaatgcccacgttcacatcgcagccctccgttttatatcaattattatgacttggtactaattttaaaacataaatgtatttttgtctagaatatatttcgcataaaacagaaagctaacgcattatccactttatttttcattaaaagaaacagaaacatacctctcaaatataaaaagactcaaacccttctgttcacggttcgagcctctcttccatctaaaaagatgttttttattctttatctgcttttcttctaaactagagagttctcctcactacctttcctttatcctcttcatatctctggttttcccccaggcgagaataaaaaaggccctgaccgcttctatccacggttcgggcctctcttccaccttaaaaagatgctttttattctttatctgctttcccaagctcgtaagcttcgttcataactttcattaacaactctaacaccggctgtgccttctccatatcaagtgcaattccattatcatctaaaattgcctttgcttccggtaaatgcttcattgcgatttgtaaaaactgcatgcttttttcgttcatattatactcttcctctccattaaaactttcacatacaatagtgtaacacgcgtactacccttcgtataactctttatattttttcatgtgtgccagttgcttatttaaaccgtattctaacggagtatttctttttatcgaaattacttcgatagcctcatctcttacttcgctgttatttttatttactttatcatccgcgcgtaaaagattcatacctttttcccataatgactgtttaccactaagtaaattgtatataccaagatgcgccccgttcgttccatgttcccataagtattcacatacatcttcaacgtaaagtaaatcattccccttttcctcaatcgtacaacggcactctttttcaactaattctgataaaataagctgatgaaacatcataaaggacggttgccacggtccatataatgttggaactcgaaatacactatattgtaaattcccttttttcaatccttcttctactttcaaaaataggcgcttattttcggattcatctgtactgcctacttcaatagaagaaattaaatttaacttcactttttgttcttcacacattcttataattcgctttaaatattgtaatatgactctttcattccgaaatccactttgctgatttggctcatataagcaaaaataaacagtatcgaatctctcttcctcaaccgatctccatccatcttcatctcttatcgaataatacgtaaataacgcatttcgcccaattaataataacttctcttcattaattttggtcatactatcgaattcatcaaaatcaagaccatagacttccacttcttctgcaatcattttatttacaaggtgataacctacaaacgtaagtgcacctattatcagcacgcgttccataccaccaatcctttccctctgaaacaaatagctcctcatttatgtatatgggagcttcataattcttcttcatattttttaaagaaatcagtcgtttgcctaaccattttatatttcacatcttgcagatggaacaagacagaagtatcacattgatttagttgcctcattttctcatatctacgcaactgctgttttcttcctcttttttcttgtgttgatacgaaaattttaacaggtacacaagatggaagaagcgtaaatgatttcttatttatttttgattctaattcttcttctttggcatcatacgccaaacttaattccttcacgagtctcttgtaaaaaaatttatgctctttctcaaaacttacatattctggtaaatctaaacacggatttagcataacaacagaacgaatacattcaggatatttgttcatcatttcaagtgctacaagcgctcccataccatctgccataatgtgcattttcgcatttaacgtctcttttctcaaaacaacatcatataaacgttttgccagacgaacagattgatcgtttccccaatgtcttccgtataaattagaggaaaagaccgtgtagccttgttcaataagaccatgtaaaaaataagatttacccgcatgttgtgtccataaacttgtaccattctcaataaagtagttataatcaccgaggagcataacagaaaatccatttggcttctccggtaaataaatgacacatggttctttttctaagtaaaaaaaacgttccgtaatactcatttttcccccgccttattttctaaacatataaaagtactcttttataatgtatgaacggaatgcaaatttgcgttgaaaaatctacaaatatttttctatattcttttttcaattgtgttacaataaggacagattgaacgaatagaggtgtaaaatatgcgtttcatttgggcattaatttggtcgttcttacttgtacatatgatgagctatgtaatcggctctatgactggcggtacatacgactttaaccaagcgtctattttctcagttgttcttgctgtgttagtactagcaatttcagctgcaattccaaacgagccagtagaacaacactaaaaaaagagtccggattttatccgaactcttttttatttttatttcacatgaacgactaattcgttattttctacatcaacaactacgtgactattgtcagtaattgttcctgcaattaattctcgtgctaatttcgtttccacttgacgctgtacgtatcgttttaatggacgagctccgtacattgggtcgaaaccagcttctacaacaaattcttttgctgcatctgttaattctactgtaatgtgacggtcagctagacgaccttgtagttcttttacaattttatcaacaatgcctttaatttcattcgttgtaagaggtttgaataaaataatttcatcaacacggtttaaaaattcagggcggaaatgtcctcttaattgtcccattacaagatctcttgattcctctttaatcgaaccatcttcttctaatccctctagtaaatgagcagatccaatatttgaagtcataataataactgtatttttaaagtccactgtacgacctt

SEQ ID NO: 1143 - DNA, 4981 bp, Bacillus thuringiensis
gcaatctcaggcttgtcctcataaaaattaaacttactatacccccatttatccggattataaacgattacattccctaaacacttttcgttgttttgcacatgttcattcatagtgcttaattgagtcccaatcagtgttttactttgtgaaatacttactgcatattcaacaacatatctacttttcttaaatccatcacttagattaaccactaatggaacacctatatgtatttgttgccatccaaaagattgtaaaatgttatcgtaatacccttcaaagataaatttattcatcccttcatgaccattccaaatatataaaggtgcatagcagttataaaaattcccgtctttctccgtttccgtaattaaataagctttaaaatttagtgcttggaaaccatcagttttataaccattatcctttacccttttcctaataatttccatgtcataatcctttggcaaaatgaccttatattgcattccaatcatgtttatcactcgctttcaatcttatatacattatgataaatcgataagtagctaacgtaaaataggtataaattatgtttggtatcatttataatgatagtgcataaggggctgagatatatggaaataaatgatcttattatattcaaaactgtagccagtgagggttctattagtaaagctgctaaagagttaggttatgttcaaccgaacgtaactgagcgaatcaaaaaattagaacaagaattagaaacgcctttactacatagagataacaaaggcgtttccttattaccttctggtgacattttattagattacacgaataaaatattaactctattagaagaagtaaaagatgaaattaaaacgagtggttcttcttatataatagcgacgtcacaatctattttgacaaattatttaagtaagcgtattgaagaaaacttcagaaattatcaaatatatgtagaaagtagtagtcatttgcaaaaattacttcagcaacaaaaagttgatatggtcataacttatgaggattatcctgacgcatcgtttaaaaaagtgttcacaacctcaatttctgtaggcttattaaaagcgaaagaaaaatgtaccattgattattcaaaagaaattttcttcgttagcaatgacaaaaagtgcccttttaggaataagacgatacaatttctaaaagaaaataatttatctcagcgtcaacttcaacaattagattcttattcgcttatggaagagtttattcaggacggaaaagggatagcctttttgccgattaaaaatgataaattggtaccaattgaagatgttccagttgagaaattagctgttcatttttttgcaaatcaaaactctttcaaacaaatccctgatgaactatttggttaataaaaaaatccctcctttatgaatctaaaagagggattttcatattctatacaattgatttttcacacattttgctccacttctgcacttttctccttcttattccgtttcatattcttcagtcccttaaccgtcccaaccaatcctttcggaaaaacgagtagcacgataatatacaataaacctagaataatcgtccatctttcaaaaatcggatattccgtcgctagttctgataaataatattttagggattcaataatcccagatccagcaatagctccaattaatgttccgactcctccaatcattgtcatcaagagtgcatttagtgtcatttcaattgaaaatacagtcgtattgacaaagcgtaatgtaataacaaataaaccaccgctaattgcagctactattcctgccactacacttgcgattattttataatggaggactttatatccaagtgcttcaacacgttgttcattttgtgaaattgcctttaatactttcccaatagaagactttgtaaaaagacgtaatagaataaaaatgaagcataaacatacaagtgatacataataaaaagtaaaacgatcacggaatatttctggtaccccaaatgtaaaaccatctcctccgtgagtgagcccacgccatttttcagcaaggacgaaaaacaactgtgaaatagcaagtgttaacattgcataaaaatgacttttcaatcgtaaagaaagcaaaccaattatataactaacgattgctgaaacgataattgcagctactattccaattaaaaagttcgttattgatacgccttgtcgatcaaataaaagcgctaccccatatgctcctatcccaaagaacatacaatgaccgaacgatacaattccctgtatacccaagcaatacatcaaaactcattgcaaaaatagcaaagatgaagatttgagtgaacaaaattaacaggctccgtgaatcatttacgaacggaaatacacttaaacaaatgagcatacatactccgaagtatactttaattcggtccgatgtgttgttcaccatttcaccccttttcaccaacaagtccagttggcttcactattaagaaaaatagtaacattaacatattaattgcaagtgataaatctggtataaaatacgctgtaaaagcaccagctaatccgacaattaaagaagcaatagctgaaccttgtacgcttcctaatccaccgataattactactataaaagctaaaattgcatactgcatgcccatctcggcgaaaataacgcctgaatacggtgctaataagaatcctcccaaagctgccatccctgctcctaataaaaagacgaaagaaaatatcgcttttacattaataccaagcgcttgaaccatttctttatccattacacctgcacggatcataagacctatcttcgtctttttgagtaatagtagtagtgcgatgtaaataattatcccaatcaaaataacaaatagacgatatttaattaatataatacctccgaatgtaaaacttccttgtaaccataacggtaattttgcactaatagggtttggcccccaaaatattttaatacactcactaagaacgagcattcctccaagcgtaacgagcagctgtcgaacatgatttccatataccggtctaataagaaacctttctaaaataaatcctaggaacattcccatggctactgctccaactaaagctaatatataacttcctgtcatattaaataaccaaacacctgtaaatgctccccatgcaaataaaccaccgtgtgcaaagtttaaaacgctcattagaccgaaaataagtgaaagacctgatgctaacaaaaaaatgagcatccctgttgaaatcccatttacaaataaattgattaacacatccatccttttcacctcggattcatgttaagagattcctaaatatttatgacacatttccttatccttttttaattcattcataaaaccgttatgaacaattcgtccgttatccataatgtaaaaataatcaccaatttgactagccatcataaaattttgctcaacaagtaaaactgttgttttctctttcatcttcaaaatagctaccattaatttctccaccattatcggggatagccctttgctcggctcatcaataagtaataatccatcactattaataaacgctcttgaaatagccaacatttgcttttgccctccgctcaagagcccacttttcttattccaaaactgctttaaatccggaaatagttccagcatccactctattttcccttctacttccacaccttttcccctagcaagagcgaatgtttcttctactgtcaaatcatgaaaaataccttgattttctggtacataccctattcctttccttgaaattaaatgtgtaggtaatccacttacttttgcactatcataataaatttcaccatctgcaatgcggtgaaaccccataactgaacgtaatgtcgttgttttccctgccccgtttctaccaaacagtacagtaattgtccctttctcaacagcaagagatactccttgcaaaatatgaaactgatctaaatacgtttctatattattcacttgtaatagtgccactatataatccccctaaataagcactttgtacacgctcatctttcataatttcttctggcaatccttcagccaataactctccatgaaataaaacgataagatgatctgacaaacctagtatcatatccattttgtgttcgataagtacaattgtgctctctggatgtttcttaatattttcaatcacttgtaatatagcagggacctcctcaaccgaaatacctgccgtcggctcatcaagtaataacacatccgtttttaaagccaataacatcgcaagttctagctttcttttctctccatgtgccaaatctttcgctaatacgttctctttctcgtgaagtaatactgtttttaagaaacgtctcgcctctccaacttgttgctttaattttgctgaactcgggaaaaaactatagtaatcttgtacgaatgattgaacacttaaacggacattttcaagtaccgttaattctgggaatatgtttgtaagctgaaaagagcgaccgattcctaagcgtgttcgatctgaaatcgatagttttgtaatatcttgccctttaaaatacacttcacctgttgtaggtgaaatctgtccacttagtaaattaaataatgttgtcttccccgcaccatttggcccgataatagaaatgagctttcctttttggacagttaaatttacatctttaataacttgatgttcaccaaaagatacactaagatttttcgtctctagcaaatgtgtcacgaaatccctccctttaaagccgtgagtatgaaggaaatatgtataaagagggtcccccctctttatacaaaaacaacagaaaattcagtctatttattttgaactggtggttctgtttctttcatcgttaattctcgctctaacactggcaccggataatcaacaccatct

SEQ ID NO: 1144 - DNA, 2451 bp, Bacillus thuringiensis
ttcttttatgtaacactccgataaatcagatggtgaacgaatatggtccctcataaactccggaccagtcgcacagtttaacccaacagataatggtttcatatgttctactgataaataaaaagcttcaattgtttgcccagccagagtcgttcccattggctcaatcgtacctgaaatcataataggaaccgtttttttcagttcttcaaaagcagcttgaattccaatataagctgctttcacgttacgcatatcttgactcgtctcaacgagtaatacatcaacttctccttttaataatcctcgtgcctgccttgtataagcctcaatcaattcttcaaaagtcacaccaccagtaacactaattgctttcgttgttggtcccatcgctcccgcaacatatacttcattcccgctttctttaacagcttgcttcgccaaaagtgctgccttttcatttagttcttcatctaaatgagacagctcataatcacttagtacaatattcgttgccccaaatgtatttgtttcaataatatccgctccagcttcaatataagctttatgaatctttaaaataacgtctggtcttgtttccactaaatattcattacagccctcgtactcttctcctccgaaatcttcagcagttaaatcctcttgctgaatcattgtccccattgcaccatctaatattaaaatgctatttttcaatttttcttctatacacttcatcaattaataccttctttcacttcttgcttttctcttacatatttaacaagatgttctgtaatttcatactttaaaaatggtgtaataagataaataccattaaaatatttcatcgctgcgtcgaccaattcttgtgaaatgcgaatcccttcctcaattgctgcctctttcgtttcatgtccatccattctctctcttatttcttcaggaagagtaatacccggcacctcaaaatgaagaaaatctgcattccgcttacttactaacggcataattccaataaaaataggttgttccaaatgctttgtcgcttcatacacttcttcaattaacttgatatcgtaaattggctgagttaaaaaatactccgctccagcatctatttttcgttccattcgcttaactgctgcttttaagtgcctcacgtgaggattaaatgcgccgcctacagaaaaccttgtcgccggtccaattgatttccctaaaattgaacgtccatcgttcatttctttaatcattttaataagctcaatagaggataaatcatatacagaagtggcaccgggaaaatcaccaacgcgcgctggatcaccagttaaagctaacacttcttccatccctaacgccgataaacctaacaaatgagattgtagtccaatgacgttatgatctctacacgttaaatgcgtcaatactgggatatcatgcttcgttaataacgcacccatcgccatattagagacacgaggcgatgctaatgaattatctgctagagtaatagcatctgctcccgctctttttaacgctcttgctccttcaaaaaaacgctgtgtatctaacgttttcggtggatctaattccactacaactgtcgtttgtttttttgctttctctgctagagtgacgtgagccttcgaacgtttctcatgcgtatgaacgacttttggcctttgaatcgtttctttttctattacaggggtaatattcgcaacagcgcgcttcatactttgaatatgttctggagtcgtaccacaacagccacccaataaccgaataccttgctcaataaaattcggtgtcattgcttcaaaataagctggacttccctcatatacgtaacgtccctctacataattcgggagacctgcatttgggtatgctgataaatagccattttgcggaatcgatatcattttgaaagcttccgtcatatgaagcggccccagttgacaattcaatccaacaacatttgcaccgtaatctataaactgctttaatatttcattgacatcatttccattttgagtcgtacctgcttcatgtaacgctaattgcgcaacaatcggaatattcgtttgcttacgcaacactttaacagcatgaagtaattcaaattcatcataaaaagtttctaatagtaatccatcaacctgttcttctagtaaagcccccgcctgttcaagtaacataaactccctttccatatcagtcgttgtaacagctccgatatgtttcataccaccaattgttcctaaaattgcatttttatctgtcacagatgctttcgccaatttcactgccgctctattaatttttgtaacttgattttctaaaccatacatacgtaatttcgcctcatttgctccatacgtattcgtttgaattacatctgctccagcagctacatattgtttatgaatggatataattaga

SEQ ID NO: 1145 - DNA, 5426 bp, Bacillus thuringiensis
gcgcctttcgatggaaaggcgccacttgatgtatatatagtttacagataaacgagatgaattacaaccttttagaataaacctactgcttttccatcttcatttacatccatttgaagtgctgctggttgttttggaagacctggcattgttaacattgtacctgttaacgcaacgataaagcctgcgccgatagatggttttaactcacgaattgtaacgataaagtcagatggacgacctaattttgttgcatcgtcagaaagagagtattgtgttttcgccatacaaactggtaggttactccaaccttctccttcatattgagctaattgcttacgtgctttcggagcaaattcaatatcttttgcgccatataccttttgagcaattgtacgaattttttcttctaagggtaattctaattcataaagtggtgcgtagttgttttcacctttttcgatttcttttagtactttttcagcaaggtcaactccgccttggccacccttctcccaaacttctgttaaggatactgcatagccacgctcattacaccactcttgtaagtatgtaacttctgcatctgtatctgtaatgaatttattaattgcaattacgaaaggcacaccgaagctttgaattgtttcaacatgcttctgtaagttttccataccttttgctaatgcatctacattttcttcttttaattgatcttttgcaacgccaccatgcattttaagcgcacgaatcgtcgcaacaataacaactgcttctggtttaatgccagctgcacgagctttaatatctaaaaacttctcagcgcctaaatcagcaccgaatccagcttctgtaataacataatcacctaattttgctgccattgttgtagcgataacactgttacaaccgtgagcgatattcgcaaatggtccgccatgaatgatagctggtgtattttctaacgtttgtactaagttcggctttaatgcgtcttttaataatagtgttaacgcaccttctacacctaaatctttaaccgttacaggttgatttgcaaagttataggcaactacgatgcgagataaacgtgcttttaagtcttgaatatctgttgcaaggcagaacacggccataatttcagatgctactgtaatgtcaaaaccgtcttcacgtggtacaccttgtacaggtccaccaagaccaattactacgttacgaagggcacgatcatttaagtcaacgcagcgtttccaaacgattttacgcgtatcaattccaagtgtgtttccttgttggatatgattatcaataaacgctgctaatgcgttattggcagttgtgatcgcatggatatctccagtaaagtgaaggttaatgtcttccattggtacgacttgtgaaaaaccgccacccgctgctccaccttttaatcccatcgtcggtccaagagatggttcacgaagtgcaattactgttttcttaccaattttgttaaaagcttgacctaaaccaactgttactgttgatttaccttctccagctggagttgggttaattgctgttactaaaacaactttaccgtctttcccatcttgtaagcgcttaaaaatatcaagagataacttacctttataatgcccgtatggctctaattcatcttctaaaatatttaaatcagctgcaatttcttgaatcttcttcatactcgcttcttgtgcgatttcaatatcggatttcactgttgtagtagttgtcatataccctagtccccctttaattggttctgatgatattgtatcagttttttgtattttctgcacttatttacctcctaaaaattctttcatttctttatacgttttttaacataaatacccataagaatgttaacgattgttgtaactctgtaggtagttgacctaacatcttctcatttactccgcgcttatatacgccgatgccatctacaactttaaaaccttgttctttcgctaactgttcaaattcccaaggcatcatcgtattacaaacaacgtcttttccgtacaagcgaggataactgttctctcgtggctttgctgtcggtcctaaaattgcaatacatgcatatccatctttctttaacacacgctttatttcatttaacgctcgtaatggctcttccgtccattctaaagaattaattgccataattgattcaaattgctcattttcaaatggtaatgcagaaagatctccttttataaaagataaattcggtccttctccgcgttccttacctttttgaatcatcacttccgataaatctactcccactgctttatagcctgcgcgacttaatttatatgtaccgtagccatcaccacaaccaacatcgagcacttgtgcttctttcttcacgtattgttcaaaaaacggaataattgtacttctgctaccactgtcccacatctcttgactattttgattccaaaactctgcgctactatcccatttcttctccgctgactcgtgccaattaaatttcgtcatacattcccctaccttcacgtattatcattcatttcattctacatcattttccaaaattcctgttttatcccgcttgcagtaagacacctacctcaaaattcaatggatgcggattagttaatgggagagaactgctcataaaaatccaattgttgctggctgataatcagtcctagtggaaaaaatcccacactttatcttcaataggagatggatatgttaacgatggaatgcgtattctccaatttttgctttacttgggtttaactcatactcatgctccttctcattttgaaagatactatagatacacccaattgaaagagagggatgtacatgcgaagaaagagaaatcatcattttaaaagtggtgaaaaaaacgaagagtatgctgctgaaatatcaccagctggcattccaattagacataagcggaaagaaattgcaaatgagatagaaggtacaaataccggcacaatggtaggctatgtcgctttatttctttcgttattctccattgctttttatccagttacgctcggctccctagcaattttagttggcctattagctgtcaatttcggagcaagaacacttggatatacagcaattggttttggtagtttttctgttttatttactttactttatccgcttgctttgtcagcgttttaaaaaaacacaccaagttatacttggtgtgttcattcatgatacaacataatatgaccgcatccacaacaatgtttcgctgtaatttcttgaaacactggataattttcttcatctcgatgctcaataaatactttttcaaatcgatacatgtttggtgcatatgcccaatcttgtttcgtacgtgcatataacgttgaggaaaaaaactcctcaccaccgcaaacgatacatgtgttcttcatcgctatccctcctatgcttgtcttacttcatctatatgaacataagcataaaaaaaagaccttctattactagaaagtcttctctgaaacaaaaagaaatgtaccaaacattcctactccgctatattcttttgaaacaccagcttctgttttaaatgtttgctttacagtcataaagaatacaccatttcgtgcatctgtactttcaaattgtagtttttcttttttaccatctacattttgcgtgcattcaaaactactctcattacaattcaacgcatacttatcctctacatacactttaaaatctgattctttcggacaagttataagtaatattgccacgagaataatacttataatacccacaattgtataatatttcttcatttgtactcctttcaaatgacaagaaaacttgacttcatacgccaagttttcttagtcaacaacccattgccactcttgttctttcttatcaaaaatgagccaacctgtttctgttgcttcctctttcaattcatcgatattatctaacacctcatccgtactttcatacgaaccaactacatataccggaatttcaagacctcttcttgactcaatcttccctgctagatctatgtaaagaccatcttccattagtggaatcagtcccatgatcaattcttttgaaattgctggaaaaatttttgatttttggaagaaagaaaaacgtttcttaccgaaagcaccgagtttatacggaatgactttacttaacattcctacaaaatcagcaattctacgataatacactttgttgtaccatccgtcatcatgtgaaaaataaacaaatcgatttttcaacagcggaaagaatgttcttgcaagtggttcttttttgtgagccaaatataataattctgcaatttctttcggctctaattcatctaaatcgcttgcatcatcaaaatctacccaacaaaattcatcaaattcatcaatctctgcttgaattaacttatgtatattttcttcctcaacatattcaaataaagtatgataatgaaaatccgtccattcaaagttgtgcttcaaaagcaacacttgatgaagcggtgaagggatgttactcgcaaactctttaaacgtaattcctgatgtaataaaacaatgacctcgacgattaccattaatatatatcatattctttacttggtcagatcctccagacaaagcacctagccaccttcgttttatatgtttcaattctatagcatattttaacatgaaaaattttagaaacatagaaaaaacttcaaaaactatttacaatttcatgtgttttattacatagtgattacaagaaaaaacgcctgctcataagcaggcgtttttaaaggatttcatcagggttttgaggatgatgatttccctctttcttttcttctttttggaacatcgattgaattttatcaattgtttgtggagctaattcaatcattttttctgctaaatgtgtcgcattttgtaaatgaagaatatttactccatctttattcaccacaagaaatgctactggtgtaatagaaacaccacccgcgctaccgccaccaaatgcagcgttaccgtttgctctttgtccatcattcgtttggaaatcagaacctcctgctccaaaaccgaacgctactttagaaaccgttaacaccacaccaccgtcagccgtttgaacaggctctccaacaatcgtatttacatcaaccatttcttttaaattttccattgctgctttcattaacccttgaattggatgatccaccgttcataacctcctttgtcatatctttcctagtttttccgaaagtttgtgaactaaacataaaatttaatattgatttcaaaaaacttaagttgtaatatttagaaaaataaaaaagaaatcgattcgttatgatgcgataattaacaaagaaagatcatgaaatcgcg

SEQ ID NO: 1146 - DNA, 6556 bp, Bacillus thuringiensis
aaacctgttcccatttttagatgcggtatttttatcccatattcatgaagatcatacgatgggtttacctttattagcgaagtatggctataagaaaaaaaattggacgactcgttatacgaaggagcaactgccgttatattatgaaaaatggagaacctataatgtaatgcaaggatggaatttaccttatagcgaccaacatataaaagatttaaattatgtatgtattgatgagattagcaatccaaatgaatggttacaaattactcctacattgcggtttcagtgggggtatagtgggcatgtattaggagctgtttggtttttagttgatatgtgtaatacatacgtattttattcaggcgactattcagcagagtctaacatactacgagctaatttacctgagaaattgggccacaatataaaagttgcaattgtagatgccgcttatcacacagatgatgtttcgcaaaatgaaagattagacgatctatgtgcagaaattgaacgagttatgcaaaatgaaggaatagcattattaccgctgccacaacttggtagggcgcaagatatagtattgtatttatatgaacgatataaagaatttccgcttatagtagataaagaaattttggctggatttgaagagatgttcatatataaaggttggataaaaaataatgaagaacttaaatggattatggagagtttaaaaagaaacataatagttatggataatgacattagtatgcaaaatagttacggaatagttgtaatgagtgatgcgaatatgcaaacgaaacgagcacagttatactatgaacaacttcggaatgaaaaacggaatgccgttatttttactgggcatattgcgaaagggagttttgcagaaaaagttatgaaagaacatgtaaggagtacatgtagggtgaagagagttccgtataaagttcaccaaagtataagagacgttaaagagatgctaaatacattattaccagaacatacggtgttagtgcacgctttgaaagaggatacggatcgattacaacaaaagctaagtacagcagggtatgaaaatgtatattcacttgcaatggaacgtatagaagtcatttgaaatgtaaaggggataggtatatgaaaaaagtatttgtattcgtaagcattttcttttgttgtttcctttataacgttaaggaagggtttgcagctagtccaatgaaacctagttttgaagtaaagttattattgaagccagaacaagtattaggtgataacaaagagatgaagcaagaggtgctagaacatttccaggctggtacaaaatatgaaagaatacaagtgcaatttttagatactgcgaataaaagtttaagcgaggaaggttggtttgctagaattcgaaagaaagaatttagtaaagattttgaattaacatataaaaaaagatatcctattccaaatggtgtaattcaagatgcactagaagtagctaaaaaagaaggattcgatagtaatacggatagttatgaggcggaaatagattggggatttgagaagaaaacattaagcatttcaaataagaaaagttacagcgctaaaggatatgggatacttgatttaccaaatgaacaagctgctcaaaacatgttaatagaaagattaccagggaaaatgaacaaatggttgtatacaaattggggagaagaaatgttaaagaattcccgtatttacggtcctgtattaatgaaacgatatacaggagagtttgaaaacataaaagcaaatattgaaatttggccattaagtaataccggaaaattagaagatgacttcgtaatagaagtgtcatttaaaacaaatgaagaaagtattgcgacaaagcaaagggaattattaatggcgagtttagagaaaaaaggctggttgttaccgaaagatagtttgaagacagagcttatttttcagtaaatgagaaaaaaggaatccatatttcgtggattcctttttccaatatatgagtattaagctaagtcagctgacacgaacatatcactattttgaaggtttttagagcgtaaactataagcaactaccttctttttatattgttttacaacatcaacatgctcctcgtgactataaatataaaatgtaaaattctttttgccacgttttgcattgataattaaaggcgtaccctcattgtgtggtggtgcataatagcgatctaaaaataaaccttcgttaaaatcatgaataatttttgatttctgttcgccttctacgttatttccgtgaattgtaatagtcacattctcttcttcaagttttggatgtgtttcgtacttgctaataatggattcaataacagtgttaggaaggctagaaacgataattttaaatgctccaaatacaactaacattacaataaaccaagtcgtcatagtatatcatcccctttattctatttaataatataactcatatggtaatagtacatatggtgaagttttgtataatttgtgaaaaatatgccattttcacgaacgaaatgttagaaaaatcaattttgttacaaaaagttgaaatcgaagtattttaaaagaaaaaggtttataataaaaatataactaataaccacattactaattataaggaagtgtaactatgagtactgtagcaatcgtatatggtattattctttccacaattattgttttgtttttcgttggggtttcacgttatattcataaatggaaagaaggcgttgcgaaattaaatcacattgaagaagaacttagtgatttaatgttacatcatggtaagtaaacatttattttttaactaaacaatgtgaagaatatcacaaaacgtgctttcctaatgaaggcatgtttttttgttgtttaagaaaagaagtgtttttgtataaataatctaattattacttaaaaagggaaatttatttagtataatatataatatgtttattttagggggagtatcatgaggggattaaaagttgttggaattatagctggaattactatagtaggctgtatagctttcttttcagtgaaggaatatgtcaattccaaagaagactctaattatgtgctaaattacataaaagaacataaggatgataaaacaacttctttaattgttaaaagaaatggtgaaacattgacatcaataaatgaaaaagaaaaattaccgctagcaagtatgtcgaaaatcgttatagcaattgaatatgctaagcaagtagctgaaggaaaaataagaaaagacgagaaaatttcattgaaagaattagaaaaatactgatggtggtgcacaccctgcatggctagatgatgtaaaaggtaaagagttagtgaagggtggtcaaacttctttagaagaagtagtgaaaggaatgatccattatagttcgaatgcgaatgcatcatatttattggacaagcttggagcagcgcggataaatgaaagtttgaaagagttaggcttaaatagtcacgatgaattttatccaacgtatacaggggcattatatatgaggggctatgttgaaaaagaactgcatattcctcaaaataaagcattggacaagctacgtaatatgtctaatgatgaatatgttaagcatgtatggcaaatacatgaatggatgaaagacgagaaagaatggacaaaacgcgagatatcgttaaaagccgatatggattttcagcgtatttggtcagatcggtttataggtgcaaatgctaaggattacatgagtttattggaaaagataaatagcagaaattattttacaccacaaatgcaaggtgaggttgagaatatatttaaaggaaccgtaggagagggtatattcgaatttgctggacagaaaggtggttctacggcatttgtattaacaaatagtttctatggtactgataaaaaagggaataagattgagattgtctttatgatgaacaatttgagtgaaaaagcatttgaaaaacttctaagtaatatggattactttattcgagatattgtcataagtgagaaattcagaaataaattataatgaaataattttattatgtaaacaaaggggcacttatgaaaaatgctcttttgtaatacaggattttccaatcttattattgaatatagatggaaaataagaaaggaggttgaaaaatgacaacaatatatttcgttcgccatgcccattctacatatacaaaagaagaacgggaacgacctttatctgaaaaagggcactgtgatgcagaaaatgtaacgcatttattaaaagataaacatattgatgttgttatttctagtccttacaaaagagcaatccaaactgtaaaaggaattgcgaatacatataaattatcaatacaaactgaagaagatttgcgtgaaagattattgagcacagagccagtatcaaattttaatgatgctatgcagaatgtgtggaaagattggagttttgcatacgaaggcggagaatcaaatactgtagcacaaaagcgcgctgtaatatgtatacaaaatatattaaaaaaatatgaaggtaagaatattgtaataggtacgcatgggaatattatggtattactaatgaattattttaattcgaaatatgatttggagttttggaaaacacttcatatgcctgatgtgtataaattaaattttgataaaaatcgtttcatttctgctgaaagaatagagaaaacaggtcatcggttaaatattttgtaaaagtttatcaaaaaaagaggaaagagagaagttattgtagaagtatgactttgtaacataaaaaatatatgttaaaggaggctgtttacatgtttgagaaagagaaagaagggcttattgaagttcacaacgtatatgaaattgcaccagcagatggaacaattattggtatggcaacagaagaagaaatggaaattgctgctgaactagagctgcagtactatgcccattctcgtttgctagaagcaaatattcagttagacggttcctcctataaagagttacttcaggagttccaggagtacgaaagaaaatcaatgagcttttggcgagcaatacataagcgtttagctgtgccatgggcatgggtattacgtattgatgttgcgaatggccctatttatgtaagtaatgggaatgcttattacgaagaaatcgatgatgaagaagattatgaatagataagtaaggaagcaactttagttgcttcctttttttatttatagagattgaacagccccaataataatatcaggccgatcaatttcgattccgtgaccagcatgttcggcaagtatatattggctatgtattgagagttgtaattgttcatggatcagttcttgccacattgcttcaagttgtgttgcttcctcttttggcatgccaccattagtcaattgagtaatagaatattgaggatctctaccgataacgattaatggtatttctaatgttttacatagctcttttagtgagagagcacagtttttccactccgatagttcagaagctgtcgctttatataatgaaggcgaggtagagaatccaatttgctgttttgattgatcggtgagaataggttttagttcattataaagtgtgtctacatctattttggagtatgtattatatttttcaagccacatatcatccgagtcagtttgatcagaaattggtaaatgaagttcatctaaacggtgtaagttcatcgaagtagaatcaactaaaataagtgcttgcagcttatcttcatgtaacatcgcaaaatgttgtgcacataatcctccataggaatgaccgattagaataaatggctcttgaatagctagtttgtttagtaacatatgcagctcttttgtaacttgccttattgtacgtggttgatttcctagctcacttttcccataacctgggcgatggtatgaaacgactgtaaagtgctgtgaaagcttttttataataggaagccaatcataaaatgagcaactcattccggtttgaatgactacagtttgtttaccacctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaagctggagaccctattactaagccatttccctttcagaatcataaagaaggcggacaagcactgttagattggatgaaccaatatattgagtctcctacagaaatactgattggat

SEQ ID NO: 1147 - DNA, 5409 bp, Bacillus thuringiensis
tagttaatattattctaataaatacaacttttgttacgataatttttttaatagctggttattcccttttagattgttttatacaaaaagataatgcaaatatgaaaaagtataattgaacactcttttttgtttcaataaaaaagctcaaagctaagaaggctatgagcttttctaattattgcaccttttcatttgcatattccataaactgctctgctttaataaatctttctttgtacgcttcaggtacttcttctattgttatccccccactcgatttcgtttttactaaaacggtttgatatgacattaatgcttccatatattgttcatactcttcaggagttaatacctctttactagacttatggccatttaatttatcaaaatacggatgaagctccattaccacctttttcaattcctcttttttagccggtaataattgatcataatcaatattaccgttcgaatctccgtacgcaaactttgcattagttaattttttcagttcttttgtaaactcttcatattccttcgaacccatttcatctttcgcttctgataattttgcattaaaacgcatatacgtttctaatgtcattgctccggcatgttttttaaattctcaaaagatccatatataccatccgccataatagattggtacgcaaaacctgtcgtcgggattaaaagagctgctgcaagtactcctgcgataaggcgtttcttcctcttactccgcccgtgcttcatttttatttgtacaattactttttcttttaaatccggcggggcaacaataccctttgcttcttcttgtatagattccctaactctacaatctaaactcatttcacattccctacctctcctaaaaagatttcttctacttgctctttttgacgtagtttctttaatgccgcatgaattctagatttcacagtaccaattggaatatgtaatatttgtgctacttcttcttgtgaataatcatgtaagtatcttaagataataacttgtttcaatttatacggtaatttatgaatgagttcaattagtttttggtttgatattttacttacaacatcgttagaaaaatcaatttgcactgactttctttgctcttctgctttttttataattcgtagtcgcatccacctctttcttctataagagtgaatttgtttaatcgcaagtccaattagccaaggacgaaatggcttctcgctaccatacttacgaagcgattcatatagttgtatgtatatttcttgaacgacatcatctacatccgttttatcctctattaaaaaatgtgctgttttatatatttcttgaatcgttttatcatacaacttgctatatgcttctttatttcctgataaagttaattggattaaatgtgcgtaatctatttcacccttcatattccagccctcctttgtcttacactatatattggcaggtaattcatatttctttcgattttttaaagtttttttatataaattaatattatgattcattgagttcataagcttcacttataaccacacataactattatatatttttccaatttctgataaagatttaaaataatttatatagtcaaatttagacctgcggtaatatgtcaactaaaaaatataaacgtttaaagttatcaaaggcctatttgcttaaaaaagacatcacgaaactaaaccagtaatatatgtaatttactggaaaataattgaaaggtagcgatgacaagttttatgtcacactttcacgcacctttctggcgtaaagagttggtgactacgtagtagcgcatccaccaatcgcacaagttttcttgcggttagaacgagtgcacgtttgtgttgatgttttggtacttcattatatttttttacgtaatattcttgataatcagatacatgccttcttacagagttggcggcttcaactaagtaataccgcaagtaatgatttccattacgggataatgaagtgttttctgctgtgaatcgaccagattggtgcgtgcgccaatatagtccggcatattttgctactttggtttcatcatcaaatctttcgatttgaccaatctcagcgataataccggcggcgaatacaggaccaattccaggaatagattcgagtgtttgggttaatccagccatgattcgcttaatggatttttctatttctttgatttgctgttgataggtacgaataaccgcaattgatgttcctagaagaacatcgattgagtcttctacgaccttatccaaacgataggaagagcgaacagccctttgaatggttgatgcgacacatttcgggtcaccgaatcgatttttccctttcgtttgtaggaactcagcgagttcctctaaaggcatgtcggctagctcttctagactgaatttctcaagaaatagttccatcatggcgttgccaaagatagaagaatccacttcttgtgagaacgtattacatttataacttaagtgttggagaaaatgttgtttttcctttgtcaacattctaacgagctgataacgagatcttgttaattgctggagtgccacatactgactttcttttacgatagacatttgatttcgtccaaaccgtaaatagtcagcgatgacaaaggcatcaatctcatctgttttatccatgtcagaatagcttttcttaaaatttgcaatttgttttggattcattagaaatacctttgctccaaagcgttgtaagtcttcatcataatgaagaaacatagatggatgaaaactataaacagatgtggattctaggccgattttaaaagtttcaatttcttggttagctatacactgtaacactcgctctttgagcgctgtggcacctggcaagtcgttgttgaccgaaaagaaatctagctttttaccttcaccatttaaaatacaagcttttatatcaaacgaacttacatctaaaccaacaaataatctcatgtaagagacctcccttctatttagaatcattgcttggacgtctcgagatatctctagtgtgtacgccgaccaacaacctcgtgtatgagagcttgtcctgaatcgaaagccgccctagagctactaacatctaggttcgaggatcaggctgctcagcctgcgagtagggagtcccgcacgttcactgagaaacactctaagttatgtgataagtccacaggaggaataagaattgtcccaaatgatcctaagaccattatctagaaatatcttgagacgtccaagtattttatttattacaggactcttattaaagaaaaaatctaagtctgaaataggacttaaatattaatatacgaggaggatatatgatgaaagctatcgttgtaacgtcgttcggtggtcctgaagtgatgaaatatacagatttggatataccggctatttcagaagatcaagttttaattcgcgttgttgctactagtgtaaatttcgctgatattaaattacgttatggtaaaaaaggaaataaagcactaccttttattccaggtatagatgccactggtattgtagaacgtgtcggttctcatgtgaaaaatattcaccctggacaacgtgtcattgcttttcctcaaaatggatcttacgcagaatacgttgttgcaaatgaaaatcttactttcgtattaccccatgaagttgactttcaaactgcagccgcttgtccaatcgtatcttttacaagctataatttactcgcaaatgttgcaaggcttcaacaaggtgaatctgtactcattcatgcggctgctggcggaattggcactactgctattcaacttgctaaactattagaggctggagctgattatgttatttgtcatcaagatgaagattttgtagagaaagtcaatgaactgacaaatggtgaaggggttgatgtaattttagactctatttctggaacggtttctgaaagaagtttaaactgccttgcttattacggtcgcctcgttcatttcggtaatgctagcggtgaaattggtaactttcaaacgaaagatttacatgcaagttgccgctctatactcggttttagctttggaaacacacgaaaaaagcgtcctgaactgctccaagaaactgcaaatgaagttttccgttatttgcgtgacggacgtttacaaattaaggctacgaaatcttttccacttcaaaatgcagggaaagcacatgaatgggtcgaaagtagaaaaagtacagggaaagtaatactaaccgtttagtcctcttcctgaaatgaatactggaaacagaggtggcattcatgggatcacgaattatgcatgttattatcgctagtggtattgctgagaaactatcaattcacgataagacttctttcttacttggagctgtagcccctgatgctgttcattcaaaaaaagaaaaaggaacctcacatttttatgccggtacaacgaagaactatacgagaagaatagattatgattcattttttcataaatatgaatcacatatagattccccatttattttaggctattatacccacctcattgccgatgataattggctaagtggattttttctaccttggctaaaaaatagaatagagaatgacgaaactatcgcacccctgtactataacgattttaaattgttaaatgcaaagttgcttcatcattacgatcaagaacaacagcttttctctcttctcaatcaagaggctcacattgtggatattgaagaggtttctagagaaaacgttttagcttttcgaaagtatctttttgaagatatgttgtatccaaagcaacatttgcatgaagacttacaagtatttacgtttgaccaaatcgttggctatattgagacagctattgaaaaaggagtattttttattaaacaactctctaatgaaaaatccacttcaaaaatttaatccccctcaaatatatttgagggggattttcacatagcaatattattattggttcttctccataaccgcaaaataattcccttcgctatcagcaaagttaaacactttaccagaagacatagttaccatttctccaacagtaacatttttatttgttaaatctgtatatagttgatcaagattttctgagaagaacattaaagacggtgtaccaagattcaattctgggctcattttcgaaaaaacttctttattatgtaatataatgctcgtttccgcaccgctttttggagcgtttttaatccatctcattccttgcttattatctctctttgcaactaccaggaaccctaccttttcccgtccaaaaattttctggccttatttgtttatttacattaacctatttggtccatttaggtttctttatttcctcta

SEQ ID NO: 1148 - DNA, 5956 bp, Bacillus thuringiensis
atcttcagccttaccagcaagatcaggacgcccaattgaatctacaaataaaatatcgcctgataataaataagaatcatctacaatgaatgacgtacttccaatcgtatgccctggtgagtataatgcgtcaattacaattttagtaccccccaccgtaataacagatccttcaacaagcggttcgtatgagaaaacaacttcctctgcatcttttggtggtaaccaatacgtaccacctaccttttccgctaacttacgtcctccggaaatatggtctgcatgtaaatgtgtatccattacattcgtaatcgtaacgccatgctctttcgcaaattcttcatatgcttcaactgttcttactgcatcaataactgctgcttcaccatttgaaacgaccatataagataaacagccttttccaaggcggttaaactgatacatacttccaccattttttaaatctccaacttttataggctttacatattcactccaagccttcatgccaccagctaaataataaatattttctaatccagcctctgttaattgctctgccacaaatataaagaacccttcttttgcacatactactaaaacatctttatctttaggtaattcacttacaatatgatctacaccatctaacaagtcaaagtaaggtctattaatagaagaaacttgtttcccttcaattttccaatcttcataatccgcctcattacgaacatctaaaatgaataactctccgaataacactttctctgccacatcttttgcttgtaacggtttaacactcactctattacccccataggtatatttttattcaaaaaaatttatttctctatattcccttgccactctaacatacctggaatgacatttttcacatttgaataacctttctctttcaacatttggcaagctatatcactgcgattaccagttcggcaaataacataaatttgcttcgtcttatctaatactgcgctgtttaattcacctaatggtactgaaatggcggatggaatatgaccaaaagcaaattccgctgcttcgcgaacatctaatacaatgctctcttctccatgagacaatatagactgtaattctgcattcgtaattgtatgtggatatttcacaatttcattcacttcatgctcgtttgctttcctaacataatgcaccaatacattatcctcgtgtttcgtcccgatatattgatgtcctactttacccgcccaactttttatatctaccgtagatcctttatctgttgcctgaacttcaattacttgccctggtgctaatccttctatctccttcttcgttttcacaatcggcatcggacaagccaaccctttacaatctaaactcatatccacttttatactcataattgattcctccacaacttatatacatatacctgtatgggtatattaaaatgtttttgaaaatctgtcaacaattatgtctgacagattatcggctttttacaagtaattgaacagcttctttaattaactcttcatttgaagcattaccgctttcaaactgctcacgcaaacattgctctaaatttgtcccaacaacaagtccaattgtacgatcaagtgcagaacgagatgccgttaactgtgtaataacctctcggcaatcttttccttcttccatcatacgaagtacaccacgaacttgaccttcaatacgtttcaatctatttttcatatcttgattatattccattctataatcacctcattaccattatgtcactatttataacctatgacaatatattataccctatagggtattttgtaaacccctatttttaatatttatcttatatgttcacaaaacaagaagtgaaaccttactatataggctttcatcttccaccaaattttgaagtggaagatgaaaaaatattaatatacaacacgttctggtactactgttccgtataatttaaagccaccatctaagttctttaccttatatcctttttccattaacatgcgcgctgcaacataccctctcataccaagttggcaagtgatatatatttctttgtccattggcacttcatccaatcgatcacgtaattcatctaacggaatattaatagagtctttaatcattccctgttttagttcattaggctctcgaacatcaataagatatccaccatttttaacaatgtgatctatttcatgccattgcactgtgtccacaaaaccatctactatattacttgccgcataccccaccatgtttactgggtcttttgcagaagaatagggcggggcatatgataattctaaatccggcaaatcgattacagttaagtttgccttcattgccgttgcaataacatcaatacgcttatctacaccatcacgccctaacgcctgcgctccataaatttttccgctttctttattaaaaattaattttattagcacaggcgtagcattcggataatatcccgcatgagaatttgcctgtacatgtactacctcatagggtatatttagtcgttttaatattttctcattcactccagtcgaagcaactgttaaatcaaaaactttagccacagaagttcccatcgtacctttatataaagaatccgtatgaccatgaataatatctgctaacatgcgaccttgacgattagctggccacgctaaaggaatcatcgtttctatttctgtaacaaaatctttcacttcaatcgcatcaccaattgcatatacatatgggtcagatgtttgaaatatctcatttacctttatcgctcctctaactcccaatgctaatcctgcctctttcgctaaactactctctggttgtacaccaattgctaaaataatcatatctgtttttataactgagccactttttaaacgtacaatagccccgtcttcttctaacgcatctacaccatcttctaaaacaagctcaacattgtgatttctcatatgttcatgtacgtatgctgccatttcataatcgattggtggcattacttgattcgccatctctacaagagtaacatcaatcccgcgttctcttaaattctcaaccatttccactccaataaatcctccaccaataaccgtcgcatgacgtggtttcttctcatcaatatacgcttttatacgatctgtatcaggtacatttcgtaacgtaaacaacgccttcgcttcttcaatgcccggaataggtggaacaattggtttcgcccctggtgaaagaatcaaaacatcatattcctcgttatatgtttcatctgtagttacattctttatcgtaattgttttctcttctttattaatctttacaacttcactcaatacacgtatctctaaattaaaacgttttgacatcctttcaacagtttgtactaataacttttgtctttctgtaatgacaccgccaatataatatggcaatccacagtttgcgaacgaaatgtattcaccgcgttcaaccataataatttcatcttcctcacttaaacgacgaagccttgcagctactgatgccccgccagcaactccgcctactacaacaatttttctagacatatttcaaacctccatgttatttattatttaatttcctcatgcattaaacaaaaacctatacctgtatgggtatatgatagagtataaaaaatttaatttcaatcagtatgtctttctttcacaaatttgaaacaaataaaaaagaacttagatacctccaagttcttttgcgtatagttctataactttctgcacgattaaaccaatgtataaatacgtgttttgaaaatttaaatacacctgtatttaaattttcaaaatcaatagcttcttcacataaggttaaatccattccacgtaaaattctttaatgccacaacctgagaaaacgaatcccaatggactctttttctacaatgatatatttatttttttcgttgcatctctatcattaatcataaccatctgcgtctcgttatttggcaaaaatacgatatattttccctttctcacattcctccaaataacttttccttcttcgtctgttttccctattgagatcccaatttctttactgggttcaggtgattcgtctttcataagtataatttcaaaatcttttattggctgtttttctttatttttcacgtgaaaagttacagaattaacaaccttactaaacttcttttcattatttactatataactagtcattacgattatgaccaatacacaaaataaaatccataaaagcttattatatttattcagaccattttttaagattattaaaaacatcgtctgtcacccggtttccagaattccaagaattacttcctactgtatgggtagctattattgttacacccgtacgagaatagtcatgatatacaggtgctccactttgacatccataagtgtccatcctatatgttaaaattctaggactagtgccttcaattggtccataatctgtccacatagtatatttttcatttcctactttatcacatggataccctggaactactgcgagtaatccctttggagactctacattagtagttctatatcctaaccaacctgtataatctccagaagatccatttaatttaatggctccataatcaaattccgaatctccatcatcagtccatccacttactgaataaagctttgtccaactataaggcaaatacggtgcttggtctccatttctaccaggagtcacaataacattttttgcccatccaccaagctttttattgtaaacacagtgcccagctgtaaatactgtatctttactaattagcgctcctgtacacccataaacctcttgtccattaaattgaattactaagtgtactatagccctataaggatacaaagttgtattagtaactctaattcgatcatctcttcctattacagaatgtgtaaggatattagatggataattaaaattactgtctcttaataagtatccccaatcttccccaccatgtttacgcccttcaaatgaaggtgaaacaagatcttctccccttcgatcattactatacaaagattgttcttgaaaaagtacacgttctccctcatttgaaactgatgtccacggtacatcttctgcatacaccttctgattcaccaaaaatactgtacaaaaaaagataaaaagaacaccaaaactataaagagccaacctacatcttatagaaataaagctatccaacataacttacctcctatacaaatgatagcgaacaattgaagatccctttataaattctagtttttctttttttagaagtcaatgtaattaataatgattatcattattaattacattgacttaacaaaatcaaacaatgagtcatattctttactctgcgttcaaaaatctgtctcattaaagtttcaccctattacataaatccataacctttttcacaatcaactccgcagtattctctcccggtggcattaacaaatttgtaactgttccatacacaataggacttaattctacttcatatccgccatatgcatattcgtcttttgtcggtaaataaccaagatatccgttcatatatccaccaaagaaagccaattcattttgaaggctctctttcattgctaaggcagtttctgaaaaaggttccatcggtatacctgaaaacataccatcattaacttgaaacagttgaacttctaaatctatacgtaacttccgaataccttgcctatatttctctaatacgatagcaagccattcatccgtattcacgccccactgcttctcggctaatcgagccatgcttcgtatctcatcaatttcaggaatatccttcaacttcatttgcatcatacttgaaactgtccttaattttacaattggactatatgtaact

SEQ ID NO: 1149 - DNA, 5034 bp, Bacillus thuringiensis
ctcatttgcgacttcctaatgttaacatcttcgttagtaaatgtcaattaagttttttcatttggttggtcgcttgcgacgttaatgtcatcggcgacttgtttaaatataacacccctgtagatcaatcgtcaataccttttatattttttatttttataatcaataaaagctttgccctctcttaatttctaacacatccttagaacttcttaaacttatgtattcagattaacaatctgcagcttacactctctaacttaatactaatacttttctaaagaatgaatgtgagacccggtaaatatatattaaggatagtattttttcttttagtacgtactccctcctactcatctctagggggattataaataaaacacttctcttctttacctttaaaaaaaggaaagaaatctaatacacttaggaggcgttatgaaatgcatgttaataaaaagataatttatgtatcccatgatgcccatttccacggagcacagctactttctttacatactattaaagctcttaaagaaaactttgattactctgttgcaattatttctattggatccggtattttaattcccgattttcaaaagtacggtcctgtttattgtctcgagcaaggttatcaaacagaagaaaaggtcgaattattaataaaggatttattatcacagaattttaccctcgccatatgtagcactgtcataagtggcgatatcgtcgcattactagctagacacaatataaaagttgtttcattaatacatgaattaccgcatttaatacaacagtactctgctgaagggaaagctaaaaacatcgctgaatttgcttacaaagttgtcttcccttcacaatacgtatatgaaaaatttcgtacaatcactgaattggatcctcaaaaatgtcacattctccctcaaggtttgtttaaccacaatccttataagaacaatattgcaaaagctagaaatgagttacgtaagaagcttaacctgcctctagatagcaaaatcatcttgggtgtaggcttcgcagattatcgaaaaggaatagatctattctcacttatctcttactcagtaagaaagactcacaaggatattcatttcatttgggtagggagaacagacgttcaattcctgaatacactgccccctaaatataaagcacatttcacattagtcgatcctactcccgatatcggattatataacgctggggctgacttatacttattaacttcaagggaagatccttttccaaatgttgttttagaagcattagatgcaaaacttcctgttatagggtttaaaaatgctggaggttttgaagatgttgttacagaaaaaactggtgccttagtagactttttaaatttacccaaaatgctagaaaaaatatatgaatttattcatgatgagggattacgattacaaaagggaagctttggccaagaacttatcgaaaaaaacttcaattttcttaattacatttatcaattactagatcttctcgaacataattacaaaaagataagtgtaatcataccgaactataattatgaaaaatacttacctgatcgaatcgaatcaatattaaaccaaacctaccctctttacgaactaattttcttagacgatgcctccactgatcatagcgtatcaacttttaaaaagctgctttcaaaagaaaataagacccacctgaaggttcaacagattattaatgataaaaactctggttctgtatttaaacaatggataaaaggagtctctgcagcaactggtgattatatttggatcgcagaggccgatgacttatgcgataagacatttttacaagaggtgatacaggggttttatataaataacaatattaccttaagttacacacaatcaaaacaaatagatgaacaaggaaatgtattggctaatcattatttaaattacacaaatgatatcgataaagaaaaatggaaagccccctattttcgaaaaggggtcgaagaaatacaagatacgttacttatcaaaaatactatacctaatgtttcaagtgtagtttttaaaaatatagatatgaagaaaacagaaaaacagttagagaagttcaaaatagctggcgactggttcttctatgtttctcttcttacagagggagatatttacttcaatccagcccccttaaactatcatagacgacatttaaatagcgtaacgagaacagaagattcatactcccattacaatgaagttgtgcaaatgcaaaatttcattaaagaaagatttactatcgacggcatttctaaaatgaaaatgtatacatatagaaagtatcttaaagcatacttgaaaatttaaacatgtgctttctatgccatcaatatctcttgtaagttgctactattactcaagggaggaatactctttgaaagactttatagaggaacataaagatttaatttctcaaatcgcacacagttataatgtaaatgcaagcatccatcctgaggatcatatctttcagttcattgtcactaatcccgtcttcccatcaaaaaaagaagcgatagattactactttaaagatgggcaaaactcagcacaaatactcttaaacttaattacttccctttatcctcctacagccaatccaattcaattgttagaatttgcatccggatacggctgcgtaacacgtcatttattaaatctacaaacgaatttgagtataaccacttgcgatatacacgaagaggccatttcctttattgaaaacaaattaaatacttcttctatattatctcatcctgagcctgaacagttaaaattggactcctctacgtacgatatcgttttttgtctatcctttttctctcatatgcctgatacaacttggtttcgttggctgcaaacattgtataacgctgtttcacctggtggtttattcattttcacaacccatggctatcaaagcaaaaaatactttgggtttccaaatttaaatgaaaagggctattggtttctctcctctagtgaacaattcgatttagatgtgaatcaatacggacaaacgatagttagtccctcttacgtgtgtgacaaaattaaatcattaccccataacccaattatcaaaaagtatactgaaggattttggtgggaacatcaagacctttgggttatagaaaaagaaataaaataataacccacgctctgcttatatacaagtagagcgtgggttattattttttactacataagaactcttcaatccatagcttatttaatctaatcccatgtttaaaatctattttaggttcccaattcaattcttgttttatcttatcaatatttaaaatgattttttgaacgttctcttgtttttgtttataacagataaaatccacttttctttctgttattttctctaattccactataattcgttttaaagaaagacctttgccactccctatgttgtatacgcaagatttcaattgatttaattgtgctagttgtatagtaatttcaactaaatcatcgatataaatataatctctaataatctcctccggattcccatatatatgaatcctttcattactgagatgctggtacaaaaaacaatttatggcccctactttttttaaggggttttggtattttccatacggattagaatatctacatacaacataatctattccatattttctcttataaaaatacaaataattctccagcgaaacttttgttattccatacggggaaagtggtcttaatggatgtttctcatcaataggcaaatattcaggttcaccataaactgtgcctcccgaagaagccaatataatttttttaatacgaaaatctttaacactttccatgaaattaagaaaaaatagactgctattaatatcaccgaaaacatcttcaattgaagttgctacgttagacgtcgcagctaaataaataataatatctatattcactaaagccttatatatatcctcaacattttctaaatcacctttaataaattcaacttcacttataatattttgaggaaaattatttatatgtctggaaaatacttttacattttgcccctgtttcaataaacccaatgcgaggttgataccaatgaaactatttccacctactattaaataattattcttcctcataatatcatctctctagtaataaatttttcctatcgtcaaacttaaaaatatacacaaataaactggatcattttgattattcatcctcttatcattgtatgtttgttataaattttcattatctttattttctattttcattttagaatagcttccttattcaggttgactgcaaaaacactcataatatttactcatccccatgaatatatttaataaacaatcctcacttgtttaccccataaaaaagcttctacatacacaaagttctcaaaaaaggagcgctaaactcatgaaaaatataaatcaagaacttttaaatcatgtaatcctacataaagatcgaattccgcattaccataaagactttccccttatactattgtaaatgtcaagataaacatgtacattttcgcttgtttaagcatgtacaaaatcaatcattttctttgctaaaatgatctttaattcgataggattgtcctacaatactgaccaccgtggcatgatgtaagacacgatctagtatggcattggcgagtttagggtcctggaatacttcgtcccaagacttgaagttgatattggtcgttaggatggtactacgcttttcataacgcatatcgattaattgaaagaataattttgcatcctccggatcaataggcaagtacccaatttcatcaataataagtaatttgtattttgtatagtgctttaaacgagattctaggcgattctcaatcttggcacgttttaaattttgaagtaaatcatgacatttaataaaataagtacttgttcgctttttagcagctgctataccaata

SEQ ID NO: 1150 - DNA, 7187 bp, Bacillus thuringiensis
aacggaatttaagttccgtttttcggaacgaaagggagatagaatgagtataaataaaacggcagttaagacaatggatattttagagttgttttatgagcatgaagagctaagtttaactgagatggttcagcttacaaatatgccgaaaacatctgtttatcgtttaattggctcgttagaagagatggcgtttttacaaaaaaacgaaaaggggaaatatcgtttaggggtcgtatttttacggttcggtcaacttgtttcacaccgattatcagtaagaaatatagcaattccttatatgaaagaacttagagatagtttaggacaggcagttaatttaataattcaagatggtaatgacgcaatttatgttgaaaagatggaaggtgttcagccagtacgcgtgtatacggcagttggaagaagagcaccgctttatgctggtgcatgtccaagaattttactatcgtatttctctgaggaagagaaacggagatacatagaggaagtggatttaaaacagtttgcagatggaacaatcgtggataaggaacaattgttagaagtgttgcaaatggcaaaaaaggaaggctacacaattagttattctgagttagaaaatcatacagccgcgatagcagcacccattttcgcgagcgatggaacggttgtagcaggcattagtatttcaggattagcaattgagtacagcgaaagtaacatttcatattttattgcgaaggtgaaagaaacagcgcatcgcatttcgaaagaactcggctttttggcatagaaagagggagtaggatgaaattttctgcgttaggggatcaagcaattattgttacatttggtgaagaaattaagatggatatatatgagaaagtacagcggtttatttcaagcactgcagcaacatccgtttgcaggaatgattgagtgtgttccatcgtttacttcattagctgtttactacaatgtatacgaagtatggaagagaaatgagagaagtgaaaggtcatatgattacgttcgccagtatataaaggaactgtgtgattcttataaagaagaagtaaaacaggatgtgaaacatatttctataccagtgtgctacggggaagaatatggacctgatttagaagaggtcgcgcattatcacggtttacaagtagaagatgtgattcgaatacatagtgaaactacatattttgtatatatgcttggttttacaccagggttcccgtatttaggaggattatcaaaagaattaggaacacctagaaaagaaacaccacggttacaaatctctcctggttcagtaggtattgggggaaatcaaacaggtatatatccgcttgaaacaccgggaggatggaatattatcggccgaactcctatttcattatttaatccggaagaagaaataccaacatatattcaaagtggtatgtatttacgatttattccaataacgaaggaagagtacgtatcacttgagggggttaaagaatggatgtagaagttttgcatgcgggaatgtttacaacagtccaagatttagggcgatctcattatcaacaatacggtgtgccagttggcggggcgatggatcaaagtgcacttcggatgatcaatatgttagttggtaatgaagagaatgaagcgggactcgaaatgacgattatgggacctaaattgttaataaagaaaacgactttacttgcgattggcggagcagacatggaaccgttgttaaatggagaacgtatcccattatggcgtcccattttagcggaagaaggtagtatgctttgttttggaaaagtgaaaagtggttgtagagcgtatgtgacttttgcgggtggtatacatattgagcgtacaatgggaagcaaaagtacgtacatacgtgctgcgattggtggtatagaaggaagaatgctgaaaaaaggagattgttttcaaattggtacgtactcagaaatggcgaatcgtttcattcaagacttacaaaaagatgagcgaataaaaacgaaatgggtaattagcaacagcgtactaccaaagtataagaaacatcctaagcttcgtgtcatagctgactttgaatacgatcaatttacagaagaaagtagaaaggcattttttacgaaagagtataaggtatctaattatgctgaccgtatgggctatagggttgagggagaagttttaaataggattcaagaaaaagagattttatcgagtcctgttacatttggaaccattcaagttcctaatggcggacagccgattatattaatggcagataggcaaacgacaggtggctatccgagaatgggagatatcatttcagtagatttacctcttcttgcccagctaaagccgggggactatgtttcttttgagaaaattacgcttgaagaagcggaacaattgtacatagaacaagaagtaaatatgaatctattaaagaaattcatcgctttacgaagctggaattaggaggaatacattgtgactacaatcgatttaaactgtgatttaggagaaagttttggagtttataaaatggggaatgatgatgaaattcttccgttcgtttcctctataaacgttgcttgcggttttcatgcgggtgatccgtctattatgcgtcaaactgttgaaaaagctttggagtataacgtagcaataggggcgcatcctggatttcctgatttaattggatttggtagaagaaacatgaatgtttcagcaagtgaagtatacgattatgttttatatcaaatcggcgcattagacgggtttgtaaaagtggctggcgggaagatgcatcatgtaaagccgcacggtgccttatataatatggcggcgtctaatccggaaattgcagatgcaatcgcaaaggcaatttatcatataaatccaagtctattactttacggattagcaaatagcgaggcgtttatacaggctgcagaaaaatacaatgtaactctcgtacaagaggcttttgcggatcgtacgtataagcaagatggtacattaacgagccgtacagaagaaaatgcgcttataaaagatgaagacgaagcgataaagcaagtacttcaaatggtgaaagaaggccatgtaaattcgatcaatggagagaaagtagcagttcaggcgcaaacgatttgtttacacggtgatggggaaaaagcagtgcaatttgcagaaagaatatacagaacattcggacatgatggtatttctatatgtgcaccgaaataaaaaatgaggggaagtgttggaattggtgaaattaatcgggatattattagtggcagtgggctttttatttagattaaatacacttttagtagttatggttgcaggtattgttactggtatggtttcaggattaagtttttatgatgtgatcagcatgttcggtaaatttttcatagaaaatagatatatgtctatgccaattatattaactttaccggtaatcggaattttagagcgttacggtttaaaagaaagagccgaagcacttataacgaaatcaaaaggagcaacaactggaagagtattaatgtcatattttacgataagagaatcatcagcagcactagggcttaatattggtgggcatgcgcaaacagtaaggccgctcgttgcaccgatggcagaaggggctgcgcaaggtaaatacggtaaacttcctgaaaaattaagagaaaagattaaagcaaacgcagctgctgcggaaaatacagcttggtttttcggagaagatattttcatcgcaactggtgctattttattaatgaaaggattcttcgattcagtaggtatgcatgtcggtgtatgggatatggcactttggggcattccgacagcaatatctgcacttattgtaagctggattagatttagaaggtttgataaatatatagagaaaacaatgaaggcagaaggaaaagaagagaaggaggcaatctaatatgaacatcatcacaatggatacaatctattatgtattagggataattgttgcttttatcgctgttcgtatcgcattcgatcgtgaacatccaaacagattcggttctagtttattttgggcattgtttgcagttacatttttatttggaaatgtaattccttcgttttacgttggctgtatcgtgctcgctatggtcgttttagcctcgctaaataaagtgacaaaatcagaggaaaaagaagttccagtacaagaacgtgtaaaacatgctgagaaattaaaaaataaaatttttatgcctgcactattaattcctatttttacaattatcggtacgttgacgttagggaaaattaaatggggaaatgtctctcttgttgatccagataaagtaactttagttgcattagcgcttggtgcattactcgcatttgtcgcggcgatgcgtattacaaaatcgaaaataacaacgcctgttcaagaaggaagcagactattacaagctgtcggctgggctgttattttaccacaaatgttagcggcacttggcggtattttcgcgaagtcgggcgttggacaagtcgtttctgatttagtcggacaagtgttaccgacagagtatccgttcgttgctgttatggcgtactgtttaggcatgatgctatttacagtcgtaatgggaaatgcattcgcagcgtttgctgttattactggcggaattggcttacctttaatagttcaaatgcacggcggaaacccagcaattatggcagcactcggtatgtttgctggatattgcggaacactgcttacgccaatggcagcaaactttaatatcgtacctgcgatgcttttagagctaaaggataaaaatgcggttattaaagcgcaagtaccaattgctctttcaatttttatcataaatatgtttattatgtacggccttgtatatcgtttttaattaggaggataaaactatgaaaacagtattattaacagggtttgatccgtttggcggagaaaatatcaatccagcttgggaagtagcaaaaggtttgcatgaaaaaacaattggagaatacaagataataagcaaacaaataccaactgtatttcataaatcaataagcgtattaaaagagtatatagaagaactagggccggaaattactatatgtatcggacaagctgggggcagaccagatattacgatagaacgtgtcgcaattaatattgatgatgcaagaattgctgataatgaagggaatcagccagtagatgtaccggttgtagaagaaggagcgattgcgtattggtctacacttccgatgaaagcaatcgtaaaaaaacttcgcgaagagggcataccgtcatctgtttcacagacggcaggcacattcgtttgtaatcacttattctatggacttatgcatgaattagagaaacatgataagaaaataaaaggcggattcattcatattccgtttttaccagaacaagcgagtaattatccagggcaaccgagtatgtcactttctactattagtaagggaatagaattggcaattgaagtaacgatgacagttgaagtagatattgtagagattgggggcgcaacgcattaagtaaaatgaattgtacaacacctcctgtaaacaactggtataataagaataggaaaatacatagaggtgatttttgtgcaacaatttgaagaagtacgtttaattttagaaaaagcgaagaaaattacagtattaacaggcgctggtgcaagtacggaaagtggtatcccagatttccgttcagcaaatggattgtatgctgatgcgaatgtggagatgtatttatcaagagggtactataaccgaagtccgaaagaattttggaagcattataaagaaatctttcaaattaatacgttccatcaatataaaccaaatcgtggacatcgttttttagctgagctagaagaacaagggaaagatattacgattttaacgcaaaatattgacggtttacatcaattaggtggcagtaaacatgtcattgatttacatggaacacttcaaacagcacattgtccgaagtgtaaagcgggatatgatttacagtatatgattgatcatgaagtgccgcgctgtgagaagtgtaatttcattttaaatccagacgttgttttatacggagatacactgcctcaatatcaaaatgcgatgaaacgtttatatgaaacagatgtacttctcgttatgggaacgtcattaaaagtacaacctgtcgcttcattcccggaaatcgcaaagagagaagtaggggcaacaactattttagtaaatgaagagttaacaggacaagaatataactttgactttgtttttcaaaataagattggtgagtttgttgaagggttatcttcaatgaaataagttaacgaaaaaactgaggtatctacctcagttttttatttgggtaatcgctgtattaagcaacatgaaaacaggtcgataatgtagtaatcacatttttataatttataaaaaaggttttagtcggcaaaatagcagaataggaagaaatgttttctttaaccaataaacaatcgtcataaagtaagctaatatgtagctgttgtaaaggttctatttcgttttgctttaagtataaaactaaatcgttaaaaagttgttgcccatattcatctacagaacgttctaatgaaagttgacctactatgctagtccaccatacttgaaaactacatactaattctttaaaagagtcttcattacataattgggtgttaaaaagcttctcatagaagatatggttttcttcatgaaaaatttgtaaatcatatctgtcgttagcagtttgcttacgaagagtcagccataattctttgaaatttattttaaagtcagtggagaaatgtaatgtttttgttatgtaaggaaaacgaaaattttctttttttcctttttgattgagataaatattttgaatgtagatcataaagtttaaacaatgtggcgttttagtatgtatgataaacgaatctgtcattttcgttctctccttaagtaatgtcttttatgaatttatttctttagtatacaaagaaatgtaaactaatggtataaaaataaatttgctccatttttcttttagaataatattc

SEQ ID NO: 1151 - DNA, 4571 bp, Bacillus thuringiensis
taaaatagatataccaatcgtccacttcgcgccttcaatgactaaatgtaacaggtcataccctttccggtctgtcccgagtaaaaattgtaatgaaggtggaaacggtggcacttgtggattttcatccacatcatattgcaatgaaactcgcctaatatgtccatcattccataacgtatttccgatgctcaaaagaactaataggagaagaaacccaatgcttatccaaaatcttttatcacgttttatatacgtccacatattataatctctccttcatcgcagccggaatgagataatgaaacaatttaaataaaataaaaatcggaatatatataagaagcacactaacgatgaaaacctcaactctaataccgaaatacgatttcaaaaacataaaaataccacccgtattaaaaatccattctataatatataaattagataacataaaaaagatattcgttttcgcaaagaataatgtactaagcaacacatttcgtaaaatatgacgatttaaaatatgaaaacgccccagccctttcgccttagcaaatagtacataatctttttctagttcattttcaaaacgaagcacgaccatttttacaaacataatcgtagtcgggatgctcaaacacaatattggcaaccctctaatcgactcgcctccaattgaagcaatttgaaaaggtaaaaaacctgtttgtttaaaaaaccatacaactaaaatttgtgatactaaaataagaaggatatctggaatggattctaggaagatgagaaatgatttaattcgatgttgtatacgcggtgaactactcataattacataaacaatacaaaatgctacaaataatgaaataaaaaaagcagctaaaaaaataataatcgtttctttataatggacgaacagctgcggaaataaaaatttacctctcacatattgcaaattggaaatatccattaagttcacaaacacttcttttaaactctgtatgtactttgatacatccagcttaaatccataaaacaatttcggcagagcccctaaaataataatccccaaaatcgaaataagaaattgaatcgtcacttccatcccattcaaaaatacctttttgaccattttcacccttctctctctataatttaccccctaattttattcttaattttctgaattgtaaatattttaaagacaaaaaatcactaagctatgatcctagtgattctttatgcgcatgcctttctcttttcgcaaacggcatatataaaataaaacacccaataagcgctgcgagttctaatgaaataatatagtaaggatgcggtcctaacatatcgagtaatgaagctgtttctggcttatgagctaaaaacatataattaccacctgttttgtaattcacaaacgaaacaagcggaatcaatatgtttaaaaatatcatcgtacgcttaatagattgcaaggtcggtctatagccttccacccaagtcataaagagtggtgcccaaataagcaatacatgcgcgataaaatattcaatgaaacgaaaatgcggaaaagcatattgcaaatttggtgttaaaatggcttgtgatgcaccaataattcccgtaaaaaatacaatctcatatatacggtaacttttcgttacaatcataatcgacgctaacaacaaactaattgtacataactcaaacggtaatgaagtagctagctcaaaaatccccgctttccactcccacatatgaagcccaatttcactacctataaataaaaatgcaatcgcatatcgaaccgttatattccactcattttgacgtaataaatcttggtattgatacagaaaaaatatccccaccaacataataaataatataatggcatgttgccttgagtatggaataaacggttttaatggatgcgtactaaaataagcttccatcttccttcctcctctccttcatacaatattattgtaagaaagaaacaacgagtcaattcatttgcttacaataggacaacctctaccttacatttacatattcataccttacaaaactgtaaggttattgtaagctaaaacgatttgtcagattcttcacctcttctatacttaatgtagatactaaaacgaacgaaaaggtgataaatagatgaaaaagaaaaataaggtgttaattactagtgtagtagcaatcggaattgcagctggatcatactttgcatttgctggtggcggttcagaagtagcaatggcatatagcggatataaagtaactgaaaaacaaatccaaaacgcgcaaaaatttggtggcgaagttattccaaatggaattgaaactatttcatttgatccaacaaaaggaacatatgaattagctgttaaaaaaggcgatgaagtgaaaaagggtcagcttctatttaaatacaatgatccgactgcgaaacaaggtgtaacagaagcagaaatgcaaaagaaaatcgcacaaaaagaagtaacgttgttccaaaaacaaattgatgcggcgaaacaaaaattacaaaaagataaaaatgcaggccttcccgctgaagcattaaaagcatcagaagctgaagttgggcaattagaatcacaacttgaaatgaaaaagtttgaagttgaaaaagctgatgaaatgattaaagcagcaaaagagaaagtaaacactctttctgtaacaagtcctgctgatggcgtaattgatgatattgtgaaaactgctgacgaaaaaacaggtatgagcggggttactcttcgtcacgctggtcaatttaaggtaaaaggtcaactttctgaatatgagcttgctagtatgaaagttgggcaagaagtaactgtttcatcaaaaactgtcgctggtaagacttggacaggaaaagtaacagaaatcggttctacaccattaaagagcatggatgaaaataaaactgtttctaactatcaattcactgtcacattagataatagtgacgaattacaaaacggcttccacgtttacgtaacaagtaaatctggcgaagcaactggtacaattgttccgaaaagcagtatcgtgaaaaaaggtgacaaaaatgttgtcttcgttgtaaaagacggtaaggcgaaagaacaagcagttactgttgaattcgagactgatagcgaagcaaaagtttctggagtgaaaaaaggagaggaaattatctctaaacctgaaaaagacttaaaagatggtatggaggttgtcgcccagtgattaacttaaaaggcatcacgaaatccttccaaaatggtgcagagtccgttcaaatattacacggaattgacgtaacactgaaccaaggagaattcacttctattatgggaccttctggttctggtaaatcaacattaatgaacattatcggttgcttagataaaccgacgacaggtacgtacgaactagccggtcaaaatatttcaaacatgactgaaacagaacttgcacacgtacgtaataaagagatcggattcgtattccaaaacttcatgttattaccgagacttacagcgcttcaaaatgtagaactacctcttatttacgctggagtcgataaaaaagaaagacgcgagcgctcattagctgctttaacaaaagtcggtttagctgatcgcgctactcacttaccgaacgaattatcaggtggacaaaagcagcgtgtcgctgttgcacgtgcaatcgtaaataacccaaaattcattttagccgatgaaccgacgggagcacttgatacgaaaacaagcacacaaattatggacctcttttacgaattaaataaacaaggctcaacaatcattatgattacccatgaccgtgaaatcggggaagctgcagcacgtcaaattgtaattcgtgacggaaatatcgtccaagattggagaggttaattttgaatacgagtgaaaatatacgcatggccctttcctctatctttgctcataaaatgcgttctattttaacgatgttaggtattattatcggtattagtgccattattactatcatttcaatgggtgatggtacaaacgcaaagtttaaaaaagaattaggccaaggaaaagataacgaagtaacgatttactacaacaatcctgattacggaacagatagtgccaaaatcacacctgatatgctaaaccgtctgcaaactgtaccaggcgttaaagatgtgtatccagacgtaagtatgaaagtaaaagcatctgctggttcaaaagatgtaaatcttgatttaaaaggtggaacaggcgcctttatgacagattcgaaaataaaattagttcacggtcgtgaattaaatgacagtgaattaaaccaagcaatccctgctgttatattaaatgaagaagctttcaacaaattatttagtagtggttgggaatcaaatcaatacacagatataaaaggaaagccgtataaaatagttggtgtatacgaaacgaaaaacgactttggaatgcctatgcctgaaggttatacatcacttgaaaatgcgcctgtcatttcaggagtaaatg

SEQ ID NO: 1152 - DNA, 4450 bp, Bacillus thuringiensis
aaaaccattttttcttctttacaagtgagaaaatcatgttaaaataaatttagtttcctaggaaactaaataataaggaggttaacatgatgaaaaaatctaaactaacttttattttatatgttgtctgtattagtgccttattcggttccttcgctcaaaatatttacacacctatcttaccgatgattcaaaattcttttcatacttctctttatcttgtaaatgtaacagtttcactttttacattcgttcttgcgattatgcagctcatatatggccctttaattgatacaaaagggagaaaatctgtccttattcctagtttaattattagtacgattgcttcaatcggatgtgctttttcggcaaacatttatttatttctcttttttagagctgttcaagctataggaatagcggctatacctgtagtttcagcaacgattatcggcgatttatttgaaggaaaagaacgcggagaagcgatgagcctataccaaatgttacttgccctcgcacctgcaatggctcctctcataggtggttatcttggcggtataaatggtcacttatctgtatttctctttttatctacacttggcattatcttattaatgataaacatttcactacttccagaaacaaagccaaatgtaattaagcagtctaaagcacaaaagaattactctcttatcttaaaaaataaaactggattttctattactcttattggcttcattcaattttgtatttacttttgctttctcgtttttttaccgagtattttaacaaattcatttcatttaactgtaaataaaattggtcttatgtttgtaccaatgtctctttctatcatgctaggaagtttttgctacaagtttttgcaaaaacgcctcacaacaaagcaagctttatttattacgagtttcttcaatattatatgtgtcgttttattctctttcacatatagcatcaatatcccattcatcattatcgttacatctttgtacggttttagtatgggactttctatgccaactcacactactttattaacagaagaattcgtacaagaacgtgcaacagctatcggtatatacaacttcatccgctatcttggtatgggtacagggccacttataggtggatttcttttatttaaccaaaattacttttggattttcttcctaggcgcaattatgtttttacttgtaatcttatatgcaatgaaaatgctaagttttcatgctgtacaaaaattaaaatagagcccccaaaatgtcggctctattttaccctctttgatccgcaacaatatgaatatcaatatactttgtttgtctcataatttcatttacaatagagccttttcgtatttcttcccaccttgttcttgcagattgtccaagtaaaatttgcgtcacttgtaatcttcttgcgacttcaataataacatccgctggttttctccctttcgcctcttctaatacaaaactcgcatcaaattgattggttaacgatttccactcttcaatcgtctgcttttttccagctgaaatagaatctatattttccctctcaacgtttaatacgtacaattcagcatttaaccgatcagccatgcgccatccccgtcttattaatttctccgctgttgaactgtattgtacacaaacgagaattttttcttttacgccaattggttctattactgtttggctaattttctcgtccatatcatcggcaacttctcgaagtgataattccctaagtgctcctaaattattaagtgtaaagaagttttgtaagctttgctgaattttttcttctttatatatctttccgtctattagtctcttccttaatacctcaggcgttgcatcaacgagctgaatttcatttgctttttgtaaaataaaatctggaattcgttctcttacttttacattcgtaatttgagctacaatatcatgaacactttctaaatgttgaatattaaaagctgataataccgatataccagcctctaacaattcctgcacatccatataacgtttcttatgtttagaaccaggaacattactatgcgcaagttcatccactacgactacttgcggcgcgcgtttttttattccttccacatcaagctcataaaatacctttcctttatactgtatttctttcaaaggaactttttctaaattagcaattgcttcttccgtctcttttcttccatgcgtttcaattaaaccaattacaatatcaattccatcttttttcatttcccttgcatcaaagagcattttataactttttcctacgcctggagctgctcctacatatagctttaactttccgcgattttgctgacgaatatattctaaatattcctctggcgttcgcctttgaaacttcggttcataatcatctgcatacaaaataaacactacctttcattcgaaacaacgctacctcaatcctttagattgaggtagcactgttgctattttattaatttctgtaactctaaatttaattttaagacgttcacacgatcttctccaaacaagccgagtgcagcgccttccgtttgatccttaatcaattgattaagtttttctttcggaatattcgttaatttcgagatgcgatccacctgcaccgaggccgcctttggactaatatcaggatcaagccctgaacctgaatttgtcactaaatctatcggtacttctgtaactggaacagctggatttttttccttccagtccgcaatacttttctctactcgctttgctaaatctggattagatggtgcatagttatttgaaccagatgcttcagccttatattcaatactagaaacacgcccttgaaaataacgtggatccgtgaagttttgaccaattaatttagaaccaatcacttcatttttatcattatatattagacttccatccgcattatccttcatcactgcttgtgcaataccagtaacaataagtgggtatacaagtccacacaacactagaaatgtaaaagtaatacggataattggtgatagtatactttgtttcttctccatctttttcccctcttccttatataaacaagccgacaatcatatcaattaccttaattccaatgaacggaacgataactccgccaagcccataaataagtaagtttcggctaagcaatgcattagaactcatcggtttatatgcaatacctttcatcgctaacggaatgagtaatggaataataacagcgttaaatattaatgctgataaaatcgctgacagtggtgatgttaatttcataatgttcaatgcctccatttgcggaatcgcaagtgtaaacattgctggaatgattgcaaaatatttcgctatatcattcgcaatactaaacgtcgttaaagcacctcgcgtcattaacaattgcttaccgattcctacaacctcaataattttcgttggattcgagtctagatcaatcatgttcgccgcttctttcgctgctgtcgtaccactgttcatcgctaatccaacgtccgcctgtgctaatgctggagcatcatttgtaccatcacctgtcattgctacaagtttccctttatcttgctctgctttaataacagcaattttatcttccggtttacactcggcaacgaattcatctactccagcttcttttgcaatcgttgctgccgttaacggattatcacctgtacacataaccgttttaatccccatttggcgtaactgttcaaaacgctcacgcatacccggttttactgtatcctttaaataaattaaaccataaatacgattatctactgcaactacaagtggtgttccaccctcttttgaaattaagcctgctttttgatttacatctttcggaattattccgccttgtgactcaacccattcaataacggcacctacagcaccttttctcactttcgttccgtcttgtaaatcaacaccactcattctcgtttctgctttaaacggaacaaactcaccttgttctgcaagttctctattgtatgatatagattttccctgcacatactcgataacagatcgaccttctggtgtttcatctaaaacagaactaatagcggcccactttccaacttgctcaatcgtttcatttcctacaggtaataatgtatgagccattcggttcccaaaagtaatcgtacctgttttatctaaaataattgtattaatatcgcccgcagcttctactgctttccctgacatcgctaacacgttaaattttgtcacccggtccatcccagcaataccaatcgctgatagcaaaccaccaattgtcgttggaattaaacaaactaataatgcaactagcacagcagtatcaatttgaaaccctaaataatttgtaaaaatcggcaacgtcacaacgacgatca

SEQ ID NO: 1153 - DNA, 6921 bp, Bacillus thuringiensis
aaattgattctcctgtaaaaatattattccaataaaaatttaatacctagtaataataccaagtttcacacgaaattggcaagaccacttcttaaaaaacattcactactttttcaaaacgttacacagcaaacatgccattccctcttcaccacacctatagtcaataacatatttttaccaaatattttttttttgtttacacaccgttcatcattccttcatataagaatagtatgttcaaagtgtagaaaatatattgtgtcgaggtgtggaaatatgatatggctcattctctttttacctgctgtaatcgtttgggcatgcgttctttgcatccacgtcaaatccggaaaaagtaatcatcagtaccatgaaccattaatcttttactcacaacgtgtttctccattccgagctgaacatagtaaaaataattacaaagacgcaatagaaaaaagctatcgaaaatgatagcttttttctattcacacgtacttacatactctttttactatttgcataccctttgcttagtaaaagataataatccgtagggaaatccctacggattaaagtttcacttatttcgctggtggatcaaatttcacacctacatcttttgatccgccttcacttcttacaagttgaataattttatttgcttctttctgtgaatgttttgccgctttaaccgttactctaatatcagtaccatcagctcttacaagagcatctggatatcctccttgagatttaattactgtctcaagtaattcttgcttcgtttccattgtcgtaatggcatcaaaattttctttcgctttattcttttctgttgctgaagcttttgttgaactcatcacttcttgtaattttgctttttgttcactacgctgatcttccatttgcatacgtaaagctgtgaaattctcatcacttgattgaactgatacattgccctcttttttacttgtttctttttttgcattttcttttttgtctgtttctttattcgttgtttctttgcttgtattttcttttttcggagtttctttaggcgcttcgtttgttactgctttatcagtaccttgtttttcttgtccaatcttttcacctgttgctggcgatgctgtattcattttgtcaggagttgtcacgtaatacacagatagtacaacaactaaacttaacatcgttaataaccaaactgtttgtttttttaacactttatttcctccctatcaatttttcggtgaaactgaaacgcgatgggccggtacatctagcagccttatcacagcttcttttaccattgctttaacttgtatattatccactccctttgctacgacaagaacaccacgtactttcggcttctctgttcgtaaaacaacaggagtttctttatccccttcacgtataatgacagtcttttcatcaagagactcgtcctctacttctctcttaccgcctgttttatctgtttcacctgttgtttgtgagcgtttcactgtatttttttctaaaattttttcttcagatgaatctaaattcactttaatcgttacgtcttttactcctgctatttcttctaaagcagtttttaattcttgttcatacgctttttcatatttttctacatttgacatactatcattacttttttgtccgaaagttggtacgtctttttcttggttttgagttttttgttctttaaatacaggtacttcttcttttttacttgaaaagagactactagaaaacataagcaaaattccaagtatgagtaggacaagtaaaaacttaggtgttacctttttacccttctcgttgctttctttttgatccccattcaataagtttcgaaaaaatgagaacttcgaatttttatctttattgtccatttactctacctgtcctcccttccatttgaacttggatttgtttaccctctagttgccacctgcttgaaaagaaatctttcatttctacattcgtttcttccactttttttggaggctctttcgtgttaatttcaattggctttactgtttcgattgcatcatttttactacgttctttttctttcaacgtcacaacaacagattgaatatctttcgctgactttacttcttctatattttctgctgcgactatttgtatttcagagacagccataccatactttttctcaaactcttttcctacttcttttttcattttggtagccatctcttctaaactatatgcacgtgttagagcttgtatttcttttttcttcgaatctattgaattttttacagatccttctgctacgtacttttcttcattaaaatttgcaattacttcatttacatctgtctgcaatagtttaaaaaggggtgttaaaattaatacgactaacaaaagacttacaacaaatttaacgtatttttgcaaattcgaatttggaagaataagatgaatcattgtcgctaagagcaaaaaaacgataatatttctgatccactctgtaacaaattgcatactcttcacctcctaccgcatcataagtgtaatattccccgcagcaataataattgtaatacttaaaaagaacataaatgatacgatagctaagcaagcaaatacgtaaatgatgcttcttccaataatgtctaaacattgaataattgctccgccgccaaccggttgtaatactgctgctgcgaatttataaataaatgcaatacagaaaatttgaatcgcaggaaaagcaacaattaagcataaaatgacgagcccaataattccgactgtgtttttcaataatcctgatgcgctaataacagtatctgccgcttccgtaaacatccttccaactactggaatgaagtttcctgttacaaatttagcagttttcacagctatgccatcagcaacggctgtcgctgttccttgtacagataatacccctaaaaaaatcgttaagaagataccgataatcccaacgctaacgttttgcagaagcttggacaattttgtaactttatattgatcactcattgtacttacaatacttaatatcgttgccagtaataaaagcggtagaacgatataattcataagaagcccgcttgtattcattaagaaaatgataatcggatgaaagaaagatacagatacaaccccgccaccagtcgctataagcgccaataaaattggcaatagcgctaatatgaaatctaccattgtttgtatcgtttctcttgcatatgtcataacgacataaaaactatttaaagcaaaaataataagtaccatatatacaacagcatcagcaattttacttacactactttttgaaaaagcggattgcagtgattgcaacaatgcactaaagattgtgagcataatgagtgtgccaagcagttttccattagctgcaagctcatgaaataaatattttaataaccctatcatccactcttttagagagaattctttttctccctttacaaactccataaaactccctttttgactctctggcaaatagccaccatattttgtaacaagcccgtcccaaaattgcttcacatcttcaattccgagcttatccaattgttgatcaacgacgtttgtttctacaggagaagcttgtacaacaaccggtaaagaaaagaaaaggaagcaagcaaatagcagcttagctccaaacctcctcaacattcactcccccttatcccgtcggtaaaaatccgagaatagtttcaattacaaccgtcaaaataggaattgccataacgagaattaagattttcccagcaagttcaattttcgaagcgatggcaccttgaccagcatcttttgtaatttgagctccaaactcggcaatataagcaattccaataatttttagtaacgtttccacgtagacgttgctaactttcgcttcactcgctactctctcaatcatttgtaaaatagaatgaatttgatcgattaaaataagaaacatcacgctacctacgaacacaataaataaagatgtaatactagatttatgctggttcaaaacagcagctaaaaacgtagcaacgaggcctaatccgacaatttgtataatttcgattcgaaccgcctcctttactggaagagaaagacacttttaatcttgtcgaatagcgtattaattaaaaatgcaacatgaaataaaatgacgacaaaaccgacaaggataacccaatttgcaatatcctcacgcttcaattcttttagtacagtatgaatgaaagctaaaacaatgccgattccggcgatttgaaatattaatccaacatcaatggacatcgcctttctcccccctatagcagtaaaattacaataagtagccctgctagtacccctaagctcttaatcattttttcgtattgcagttgtaaagctttcgcttcctcttcttctctctccaaatgtgtaatacataagcgaatatgtttttgttgtgattcacgatcatgttgcccgagcgtttcaccaaattgctgcagtatttcatactcggtttgttgaaaagccgtcaacttccaattctctttcaaactatctatccaagcttcccttactgtttgttctccactttctagttttttagcgaaactttgaaatatccaatttaatggctttggcatttgtttaactaatcgctcggcagcctcagataaaggtgtgtgtccatacataatttctgcctctaatgattgaagtgctgattttaataacctaagttgcctcggtctctcactgtatcttttagcgtacgaaaacccgaaaaaggtgctgaccgcaacgattaacactgcaccaaatattttcaccatacgccctcagcctttctatttgataacactggttttccatatttatctttcacctgcataaccgttcctggacccctcgcttttgacaactccacaaacctatcaaatataccaagctctagcactgccttgagcgatggacgtctcacaacatcctcataggaaaatccgtgtgcgcttataaaaagctggacacctgcatgcactgcctccataattgcttcactatcttctttacggccaatttcatctacgatcaaaatatcaggactcatagaacgaatcatcatcatcattccttctgcctttggacatgcgtctaacacatcgactcgggtaccaaaatcatattgcgggatccctttcacacaaccagcaatttctgaccgttcatcaacgatccccactttacaggaaggaatttccgaagcacttaccccttgactcatgcaacgtgctacatctcttaagagtgtcgtttttcccgtttggggagggccaattaccatcgtgtttaaccaccttttttcatacaaatatggcaaaagcggttcagcaatccctattttttgacgagcaatacgaatattaaaggaagagacatcacgaatcattttcactgcgcttttttctgtaatgacttttcctgctaacccgattctatgccctccgcgaagcgtcacatacccacgttttaattcctcttccatcgtataaattgagaattgacttaacttattcaataagtaaatagcatcctctgcagtagtgatatagtcataaaaaaacacctttcgtgtgcaatacactctagcggccttccaattcgaacgcgaatttcctctaaagcatcgtattgcttacattcttcaattaagtacttcatcgtttttggtaaaacttctaatacctctttcatcggcttctccccactatactcgacttactatttcagtaatgcgataaaaatacagcaaattccaagcgctagaaaaaagagcttcaagaaagaaatttcacttgctacactcgctatcccaattgtcattgttaaaattaatacggtaggtccaacaaacgccaacataccatttataaacaacgctttcttcgcatcattcacataaagcataagcaaagcagcaaatatctccgcactacctgaaaataatcgaagtgcccccataacaagcacggatgtttccattgccgctagccactgtttcattcttccaccttctcccgtaacagttactaacttcgtattctaaaaaagaatatatttgtacaaccatatgcagaggttgtctatttcagaagtaaaaacataatttttctctaaagtctgaattacaatctgaatattcatattatttcatggtatattatggtacatttagtttaaaagaggtttaaaccatgcagcacgtcactttattaccactagatttatgctatacaaatgtgattttcgagctatcaagtgatccacatataaaaaatgcattggggataacggtagaaaatatcgaagacacgaaaacatttcttcttttcgcaatagaagaagagcgtcaaaagaaatccttatcgagaatgattgtgaatgaagaaaatgaaataattggcctcaccacacttaaacatattaataatgagaaaaagcaatctcacattggtagttggctcggctatccgtactggggaaaaggctataacgaggctgctaaaaaagaaatctttaaaatcgcctttttagacttacaactttcctacgtatttgctggtgctaaaacgaataatatccgctctttaaaagcacaagaaaaactaccttatatttcattgcatgtggaaaacaagtttccagacgaacacgctgcactagagaaagaagtaaagtcaccttgctctctgcatgtcgtgtcacgtgaaaattttttaaactggttgaaattacagaatgagggggaaaaatatgaaggcattgaaagttagtttaaccgttgtagtagaattagctcttatttatcttttttcattattggtcggttgg

SEQ ID NO: 1154 - DNA, 5658 bp, Bacillus thuringiensis
ttatagaaaaaacatgaaacaaactattctctttttcatataaatccgaccaaaaattcgggtattttaaataaaattcttttcgatcccttatgtattgcgacatattttagcccccaaatcctccctttgaaccgcttccaattccacctttaaattcagtagacgattgatacgatttaaacgccgatgaatttttaaaagtggatttattttgatagtatcgcccaccatagaaataatgcccacgataacctgaactactatcatcacactgccataccccaagttcatcatcccaatcccaatcagaacaactattatcattcggttttgggggaagatcttgtgcgcaaccaaataaagtgccagtcattaaagacgttacgacaccacctactagccatttcgtttttgtcaccttcgcactcccctttttaaattctattcctattatataggatggcatgataaagtagaagaaaaaggaagaagaggtataaaatgcgcttagaatatcgacttaatgatgaaacgaaagggtatcctgctttatggaactacgccaatatttctaattctgaaattatcgcacgcatgacttgtgaatattttattaaagagaaaaatacttatgttgttactgcaacttcggttgacccagacggaacagcagttatttatattcaaaaagaagttttcgccaatgacccttcagaccctacatactcccacatcggttttgaaattagagaactaagtgaaacaagttcaagcttagtagatgggcaagatgtatggaactacgaagaaattttaccatctcttcattcagatattatatatattcagcgagacggcatttctatggaattctccttggattcaagagagactgatgaagacagaaagtgctacatttattacggaaacttcacaggtgaatcaagataatattaatatatctatgcaacaaaaaaaccttacgtataaaacgtaaggtttttatatagccccacatatgccgttctctctagatgtccataaacctgctctcacaggtggatgccctcacaaatgtttgtaacttccttcttaaaaagatggcatgttagctacatttaaatattgaacttccatattaaacttattggtttaagacatgcataagctacgtacaccgtaggaattttatataaggttagttgaaataagacccccgcacgtgccgctcctcgtaaatgtccaaaaacccgctactcgcaggtggatgccctcacagttaccgtacatcttcctccacaaggaaggcttgatgatggtcgctaaatattgagcttccgtataactaacatcggttttagacataaataagttacgcacaccgcaggatgtattatttacttgtcgttatattatcacattgtttccaatgtgtaaaatacaaagtttttcgagcaatctcttgcttgtgaccttattttaatacaaattatttttgcatgcaagtgattaatcttcttcttttgcaatttgattttctggataagagatccaatcactccagctacctgcatacaatttaacattttggaatccagccaattttaatgcgacgatatttggacatgccgtaacaccagaaccacaatatacaatggtttccttatctttcgacagattttggaatcgttcttgttgcccagctttattcttaaattgtcctgattgcaacattccatccttccaaaaatggtttaccgctgttggaatatgtcctgctttatgatcgacaagttcctctacaccagcataacgtttgggctctcttgaatcaattaatgtaacatccgcacctgcacggatattctctctgaccgtttccatcgttacaagcatatgatcttgtatattagctttgaatgtttttcgtatagcaacaggaatttccgctgttgtcggtagtccattctctttccaagcctggaaaccaccatctaatatatatactttctcatgtcctacatagttacataaccaccataaacgagcagcatttgcaccggcttgactgtcatacgcaattactgtcgtatgttcatcaataccagccttcgaaagcttgtctgcaaactcctcaatatttggtaaaggatggcggccaccatgttctgctataggacttgataaatctaaattcaaatcaaaatataacgcatgaggaatatgtccttcttcatacttttctctaccccaattaggattcgctaaatcaaaacgacaatcgattatacggacattctcatcttctatatgctcacgtaaccattcgactgtaactatcatctttaacgaccttctttctctttcaaacgacttacatattccataaccatttcttctgtaacatatttacgctgcaaggtaacaccattttttgcaagatcattaatctgcttcgttacaacattaatgacatcaaccgaaaattctttcccatttgacgcaagagatacggcagcttcaatagctgcttcacgctgtgcatctaattgtaaacatgcttttacactttcattttgtttacgagaatgtgctgtaattgctttatgtacttccatcttctcttccccctaaatagttatacgtttttattcaattccattgcaagccggatcatatcacgacatacaatcccattttcaataatctcttcttcataatgcttcgaaaagtaatcaaaatcaatagaaaaaatacgaaatccacatttttgatataaagcaagttgtgaaacactagaattgcctgtaccaacttcaagttttgacataccatatcctttagcagtttctacagcatgccttaatagcttcttcccaatcccttttccttgcaaatgctctgcaaccgcaatattcatgatttccatcgtctttggccttgtttccaaaagaacatatacaccgataacgctccccccctgcttagctacgtatgttaatcctctttgtacatacgtagctatttgccgttcacttggatcagcaagtaacaataaagccttcggtatagcctcttttggaatacgttctattacaacagacataaaaaattcccccttctctattgttctaaaccctccttgtctaccataaataatagaaaggagggattcaccatggacaacaatgagaaaaaatgcaacgtcatctctattgatggaaagaagaagaaaagcgacacgtattcctatccaaaattagtagttgaaaacaaaacatatgaattttcttcattcgtcttatgcggtgaaacaccagatggcagacgactcgttcttactcatatgatttctaccgatgaatttgctggatttgtaaaatctttagatactgtacttcaaaagaaaattgaacgaatctttttctcataacgactatataacataaatttctttttcaatctctactaactgcttttgcaattgttctttactttgttcatatagagatacatcgatcgtttcagccaatgcaaacaatatactttcataatagttcatcacatcttgctgcatcactttttcgaataaattccacttcatatcccactcttgcttataatgatgaacaaataaatgtttttcatcagctacatagtttgatacgagcggttctaatacagatttagcgtcttcttgcataaaagccttgtcattcttttcaaaaaagcttttctcatttttaaaatgtgccagtgcttttttgaaatcttttatttcaactgaagggaacggttctttatgtgtaatatctttgtattcatactccactgttccattcatagaaattgattcattttctactttacagttcactacaatttcatcctttgcacgcttcatcgcttcgtctatccatttttcaaggcgtaatgatgtcgcacgcatttcttgtaataaatcatgctgaataaatgctactaattccataacacactgttgcaattgtgttttcacatttccatccgttcgaagtgatgccggattaataaattcagtaaacacatcattatagcggaggaatagacgctgttgcacgtaataaagcaactctttcacttcattttgcatcgcctgttcttcagcaagtacactatatgaagaaatgatatgaagtagttgatcacgctctgcttcatattttttcgtttgcttctctttctcttcattcccctgctttgcaccctttatcatgtttactaaaagctgatctgccccttgcaacgcaccatatagagcatgcacagaaacaagcattaaatctctcatcataaaggacgtaaatgattcctcaaacttagtaatcccagagttttgtaaaataccatacttctctttttcaacattctttccttgtttctcttcaagcgcacataaacttgaaattgcaaataaacgcggatttctaataccgtattgtagtagctgatctgcgatataaccttttaccatttcaagttcttcttcagactctgctaaatccgccgcattaattaagaagaacattttatcaagggcaaaagtatcctttacacgaccaagctgaattaaaaattcacggtcagcacgagagaatacatggttataatatgttacaaataaaatagcatctgcgtttttaatatactggaatgcaacatccgtatggcgagcattgatagaatccgctccaggtgtgtctacaagcgctactccctgccttgttaaagcacaatcataataaagttccatatactcaacgaagcatgatttctcttcattcgctacataatcagagaactcttctaatgtaacttgtacttgttctcctaaataagtagaaactgcatcataccctttttgtaccgctcgtaaaaagctaaatgttgttttttgcttcccagttggtgaaggatatttcataacgttatcaatttgtgctaacgcttcatctaacgtagcaatctcataatgaaacagcttataaacagctttcatatcttctaataacgcttgctttgatttaaactgaacaattactgttccatgtggtttttcctctgtaaccggcaaaatttgattaatcgttgccgtcgtcgggtttggtgatacaggaagtactttctcaccgagtaaggcattggcaaatgatgattttccagcactaaatgccccgaataacgctactgtaaattgttttgtttctacacgtcttcttttctctattacctcttgctgtacatgtttcagcgctggcaatggctctaatatcgtttcagcttttttcactttctctaatatccgctgaatatttaaagccgccgttcctttcagctcttcttcatgaatcgctacgttatcgtttacgatttcctgctcttgtagtgtaaatttctcactaacaatttgcttttccctttgcaatatctcatctatttgcaaaccttcaggcgtagcaacatgatcgtgccaaacatttcgtaaatagtcttcatatgccaccaaattgttattgtattgtaattgtgtttctttcgccgtttgcaacatcgtatatgtttcaatctcttcttcaatacgagcaactgcttccctcacaatttgctttaaaacga

SEQ ID NO: 1155 - DNA, 7136 bp, Bacillus thuringiensis
tattctttcgccaaactcccactgattacatgtaagttttttgttgtgtatgaattagaaactattattttgaaggtgaacctttaatatatttccacaagtcatggaagacattagctttgtgtaatgtattaagtagtactaaggtgactgggccgatgattaatcctaaaaagccaaaaagtttaaagccgacaaatagagcgacgagtgttgctaatggatcgagaccgatgttagatgaaagtactttcggctccataatttgtctttggacaatcacgacgatgtataaaatgagaagaccaatggcgaatgcggtatcgccagtgaaaaatacgtatataacccatggaacgaagactgcgcctgttcctaagtatggtagtaaatctacaactcctgtaataatcgcaatagtaatggcgtatggtacgcgtaatattaaaagtccgattagtacaatgacggttgtcatagatacgagtgtaagttgtgctttcacaaaaccaaacaaagcttttcttaagtcgacaaaaatagtttttccatagccatgtacacgattcggtagcaattttcttgctttctgagcaagacggtgccaatcgtaactaatgaagaaagtggctaataaaatgaatacaagaacagttaaagttgttggcagtgcactaatgaaattcgttaacccgcttataatggcggttaaaagttctttcatttgtgttgttgcttctgttcctaagttttgaatgttttgtgtaattgtatagcgctgtggttctccaagatgattaaatttagagattaaatcatcgtagagaggcataatatgattaagtgcaaattgctgagcgaatgtaacgatatctggaaactttactgtaacaagttgtagtaagtatgttgtggcagatattgcttcagtcacaagatatgtaacaagtccaacgatagctccaaatacgagaattaagctaacgagtactgctagtgcgcgaggaaattgtagtttttgattaaggaaattgacgacaggattaatcaaataagcaaatgcaaaagcgataataaaaggatagataagccctgacatgtatagtaatacatagaacccagctaccgttgctacaatgacaaatatgagtcgcaatatcatatatagtaagtttcggttcaaagatgtatacctcccattccaatttggattatcctaattcgttcaacttataacgagtgtgctccactgattaaagtttcactttaccccgcattaacgggcagtaaatctcctacccgaagtgcggctggatcaaaggagttagctggagataaactgcccgtaaaagcccgattggtgaaggctaataatcagtggaaaatgccccactgattaaagtttcactttatgttatagtggaatgatggatttttcctgctttttcagtatatgagtgactgtgaaagcttggtgttgatgcttctactatatggtaaaaacttcattttctcttctttttattttacctgtttctaattagaaaagaaagaagagacgcccgttttttaaaatgtatacatgcttaaattttgatggtgaaagtctcagtttgtcattttaaaatacataaaaaatgaagtaattcatgttgaataggcatcgatatagcatgtataacgataggtttaaaggtatttttgtttggaaatgagttcattattttcagaaaggaagtgcaaacatgattagtcagtcaacgttatttttattcatactacttattataggacttattgctaaaaaccaatcgcttactgtagctattggtgtgttatttttattgaagtttacgtttttaggagataaggtctttccttatttacaaacgaaaggaattaacctaggtgtaacggtcattacaatagcggtgctcgtaccgattgcgacaggggaaataggttttaaacaacttggagaagcggcgaaatcttattatgcgtggattgctttagcttcaggtgtagcggtcgctttgttagcgaaaggcggcgtacaattgttgacgacggatcctcacattacaactgcgcttgtttttgggacaattatagcggttgcgctatttaatggggttgctgttggtccgttaattggggctggaattgcctatgcggttatgagtattatacagatgtttaaataaggaattttatagtaatataaaatttttgaattctttctgttcacaaaagtcagataattgtttataataggattagaaactttgaaaagttacataacagcagagactttacaccagataaaataaaaacaacataaaacaattttataatgatattgttttatgttgtttttatcataaaactcttcggaatgtattttcctcactaacttgttgttttgagcgtgaggattcggggagacattcacgctcatgctttccatgtaaacaatggacaataagaggggaacatcgcaacaaatttgcatgatcgtgcattttgcttgcctaaagagtgaacgggcgttcataattcataaggggagcaaatagatataaggagcaagattgggagaattttcaggaaaaggagagaatgtcatgactgttattcgaggtttagaaggggtagtagcaacaacatcatctgtgagctctattattgatgatacattaacttatgttgggtataatattgatgatttagctgagaatgctacgtttgaagaagtagtgtacttattatggcaccgcaagcttcctaatgaaaaagaactagcggaatttaatgaaattgtatctgaatactataaagttccaggtgagattttaacatatttgaaacaagtagatttaaaaattgcacatccgatgtctgttttacgaactgcaatttccatgctatcattatacgatgagagcgctgaaattatggatgaaaagtccaattatttgaaagcggttaaattacaggcgcaagtcggaactttagttgctgcttacgcgagaatccgtaaaggtttagatgttgttgagccaagaaaggatttatcattagctgcaaacttcttgtacatgttaaatgatcgcgagccaaatgaagttgaaattgaagcttttgataaggcgcttgtacttcatgcagatcatgagttaaacgcttctacatttactgcacgtgtttgcgtagctacactttcagatgtatattctggtattacagcagcaatcggtgcattaaaaggtcctcttcacggtggggcaaatgaaaatgtaatgaagatgttaactgagattggtgaagaagaaaatgtagagtcatatattcataatgctcttcaaaataaagtgaaaatcatgggctttggccaccgtgtgtatgagcagggtgatccacgtgcaaaacacttacgtgaaatgtctaagagattatgcgtgcttttaggagaagagaaatggtataatatgtctatcaaaattgaagacattgtaacaaaagaaaaaggtcttccaccaaatgttgatttctattcagcttctgtataccattgtttaggaattgaccatgacttatttacacctatttttgcaattagccgtatgtcaggctggttagctcatattctagaacaatatgaaaacaaccgtttaattcgtccgcgtgctgattataatggaccaacgcatcaagtgtatgttccaattgcacaacgataagcgaataacactattttgatagtgaaaatacgctttcaaaagtctgattttttcggaaagatgtaatgattagaatattttaatttgactaacggtttgaactgaggggttattccctcagtttcatacatatgaaatttcaaacatgggggttatcacattgacgacaggtgaaaaaattactgtaactaatggtgttatgaatgtaccaaacaatccgattattccatttatcgagggagatggaattggtcctgatatttgggcggctgcatctcgcgtactagaagcagcagttgaaaaagcttatgatggtgagaagaaaatcgtttggaaagaagtgcttgcaggggaaaaagcattcaaccaaacaggcgagtggttaccagaagaaactttaaacttaattcgtgaatatttaatcgcgattaaaggtccacttacaactccagttggcggtggtattcgttctctaaacgtagcacttcgtcaagaattagatttatatgtatgtctacgtccagttcgttattttgaaggtgttccttcacctgtaaaacgtccggaagatactgatatggttattttccgtgaaaatacagaagacatttatgctggaattgaatatgcacaaggatctccagaagcagaaaaagttcttgctttcttaaaagaagcaatgggtgttaataaaatccgcttcccagaaacatctggtattggtattaagccgatttcagaagaagggacaaagcgtcttgttcgtgctgcaattcaatatgcaattaacgaaaaacgctcttctgttacattagttcataaaggaaacattatgaaatttacagaaggtgctttcaaaaactggggttacgaagtagcggaacaagaattcggcgacaaagtatttacttgggctgaatacgatcgtatcgttgaaaaagatggtaaagatgcagcgaataaagcgatggcagacgctgaagtggctggaaaaatcatcgtaaaagattctattgcagacatcttcttacaacaaattttaactcgtccacgtgagttcgatgttgttgcaacaatgaacttaaatggtgactatatctctgatgcacttgctgcacaagtaggtggaattggtattgcacctggtgcaaacattaactatgtgactggacatgctatctttgaagctacacacggtacagctccaaaatatgcaggtttagataaagtaaacccatcttctgttcttctttcaggtgtattattattagaacacttaggatggaacgaagctgcgaaattagtaactgcttctgttgagaaaacaattgcttcaaaagtagtaacttatgatttcgcacgcttaatggaaggtgcaacagaagtgaaatgttctgagttcgctaatgaacttattaaaaacatggatgtagcgataatcaaaaacgcataattaaagcgggggggtaaattatgacaatcaaacgcaagaaggtttcagtcatcggtgcaggatttacaggagcaacaacttttttcttattagcacaaaaagaactggcagatgttgtattagtggacattccacaactggaaaatccaacaaaagggaaagcgttagatatgttagaagcgagcccagtacaaggttttgatgctaacattattggaacatctgattacgcagatactgctgattctgacgttgtcgttattacagcaggtattgcacgtaagcctggtatgagccgtgatgacttagtagcaacaaactctaaaattatgaaaagtattacgcgcgacattgcaaaacattcaccaaatgcaattattgttgtgttaacaaatccagttgatgcaatgacatattctgtatttaaagaagcaggattcccgaaagagcgtgttatcggtcaatcgggtgtattagatacagctcgtttccgtacattcatcgcacaagaattaaatctttctgtaaaagatattacaggatttgttcttggtggacacggtgacgacatggtacctcttgtgcgttattcatatgcaggcggtattccgttagaaacgttaattccgaaagagcgtttagaagcaatcgtagaacgtacacgtaaaggtggcggtgagattgtaggcttattaggaaacggtagtgcatattacgcaccagcagcttctttagttgaaatgacagaagcaatcttaaaagatcaacgccgtgtattaccggctattgcgtaccttgaaggtgagtatggttatagtgacctttacttaggggtaccagtaattctaggtggtaacggaattgaaaaaattattgaattagaacttcttgcagatgaaaaagaagcgttagatcgctctgtagaatctgtacgtaacgtaatgaaagttcttgtttaataattgaatagtagtgaaaaagattcgggattccgaatctttttctactatttaccgaattgtttttttgaaataatatgaaaacgctatcgatcgtaatctcctatgatggaactgtagatatatactatacatggccctcatgctagtaaatttcggataaggcatctgttctagtatgataataatgcgaaaaaatcggacggggttgtaacatgttagagaaaacagttcaaattggccgtaaaatggatgaaattacaggaggagagaaattatctatcactgaccaaattgaggataaagatgggatattgtacttagggttaacgaatgatgccaatccattatatattcagcatgattacgcatcccaaactccgtatgaaaagccgattgtaccaagcattatgctaacgggaatgattacaacggcggttacgaaatatttaccgggtccaggaagtcatattacgagaaaggaccttacattcgtgaaacatgttcaccattatgaaacgttacaaatccactttgaagttgtggctgtttctgaggaggaacatacaattgatatgcttgtatctgctcatgatgaaaaaggagaaactgttgtaaagggttcattaacagtaacgccaccttataaatctgtttccattatggaaaaagcattagataacttttaaaagatgaaaataaaaatagcgctagcatacctttaataaggatgctagcgctatttttagttgaaaaacccttctttgaacccttcagcaaattctgagcaacccgttttaatcgtatcccagctaggagcgttaaaagcaaggatacatgtgattgctaaagatagaatggatagtattagtcgcataatagacctccgaatattattaatttatatattaagattaataatattattatcggtaattgaagtcaattaaaggagtgattttttaggtgaggtggaaaaga

SEQ ID NO: 1156 - DNA, 4098 bp, Bacillus thuringiensis
gtttacttttttgctgggagtatgattttacagttgtttttgatgtcacctatgatggctgtaactagtgttgatgtaaattatccattattattttgcattcaattatttgcgagtgtttttatatgtatgataagtgctttattgcaattatttttacctagtttacttgtaataatatgtatgattactgctgttttattagatagatttatattacatggatttttatttacaaatgctttttatataaatgtctttgaagatgctactggtttatttatacgcttatttggctgtttttttatcttttttataagtgtatggattttatctaaaaaaagttatatttctatgaatgatgagacagaggtggtctagtttacattatgatcttatattatttgttaaaaagagatttatatgtaaggtttcgagattccatcaagataatggtttttttattcttaatttacgctattattgcaattgcctttttatacaatcagcctcttagtaatggtaaagaatctgtattagtagatgttaccttttatcgattttttcatggagtagattttgtggatttatcttatttttataaggaggggcgattttctatccctttttattggatattctttcaaatcactcctttgttgcttgtagggaattttgctttttcagatattcaacagaatggtgtttatttatttcctcgtgttaagaagaagcattttctgtggttaacgaaaatattatctttgtttttttatataattattatttggattggtatgtattttatttggtttagcgcttactatttgctttctttaggcgagtataattttttaaatttatatagtcaatttccttataagatattaggtactatgctaattcaaataattataagctttttattagctttgatttttgagtttttaactttttatataccgataactattgtttttgtactaatgttgttgtacctatttttgtctattttctttcatagtatttattttttaggctcttttgttatgccaaatcgttggtattttgttgatcacagttcaattcaattgactttaggtaataatcaatctattcaatataatgatttacttttaataggagtagtaattgttgttgtaatgattttattaggtagttttttgttttaaaaaactagatgtgataggcgaataatttatggacaattatattaaatgtgaatgtatgacgaaaagattaaaaggaaatattgtgttagataatattagtttgtcagtaaaaaaaggcgaatttttagttttgaaggggcataatggctctggtaaaacgatgattttacgcgctatatcagggttaatgcgcttgaattctggagttgtttatatagataatgaaataattggaaaacaaaagcaatttcctgattctatgggaatattgattgaatatccaagttttattccagggtatactggttttcagaatttgaaatttttatcatcgattaacaataaaatctccgatgaggagatttataatattattcaaagggttggacttgataaaacagataagagaaagtataaaagatactctttaggtatgaaacaacgtttagggatagcgcaagctttaatggaacaaccaaaattactgttattagacgagccaactaatgctttagatagtgatgggataaaagatgttttagatattttgaaagtagaaaaagccaagggaacgactattgttgtagccagtcatgatgtgcatgttctagataatgaaatggtagatcgtattgtacatgttaataatggaaagttggtagattaagagtgacgagaaaacatatcttaataagtattggattgtgtctgttgctatgtatatttgctagtttatttagatttaaaacattaaatctaaataatgaatcttataaagtggtaaaagatgagtttttatctaatagaacttttgaagatgagcgaggaattacgtttcatgcacttgatcctcttgatcctacaaaagtttatgatccctatgaagaccgtgaagtagtgacgtatgtgttacctttagatattacaaatacaacaaatcgagatattaacttgcttagtaataagtctatttccgatacaatgttttattctaaaataggtgagttttataatttaatcccttattcaatggaattacctaaaaaatatcagtttgatcctgtaatacctgctggtaaaacggtacgagggtatatagggacaaattattttacaggagatgacccttataaaaattataaaaacttttcaaatgaatcaactaaagtgaaattcatttcttttatgaaggataggaaagggaaatatcatgaattggaaataccgataaattaataaaatttatgattgatacagctatatgttaatggtatttgtagattttgcaacataacaatatcttttaaagtcggagtttttttgtaggtgtaagtatctatggatgctacacctgcaaagtttccggctttttgtaattgttgatttagattttattaaggaatttctggtagtcatattctttcaaaggaaacttgaaagaatatgacttagatttaatacgaaatttgtaacgtgaaattgaaatagcgagacagagaaaaggaacgtaacaaatgaaataaaaactttttttgaatataaggcccgacatcttgccgattgttgtcatagttataagacaagtgttacaattatcattaggtatatacattttagtttttttaattaggagaaaaattggcataacatacatttgatttttataacgactgattgtaatagagaaaaagaaaacaatcggaagttttattttaataaaaagaggagcgtatttcctatgatcggtattttaaaaaaggtgtttgatgtaaatcaacgccaaattaaacgtatgcaaaagacagttgagcaaattgatgcattagagtcatctattaagccactaactgatgaacaattaaaaggaaagacgcttgaatttaaagaacgtctaacaaaaggtgaaacagtagatgatctactacctgaagcttttgcagttgttcgcgaagcggcaactcgtgttcttggaatgcgtccatatggcgtacagttaatgggtggtattgccttacatgaagggaatatttctgagatgaaaacgggtgaaggtaaaacgttaacatctacattacctgtatatttaaatgcattaacaggaaaaggtgttcatgttgttacagtcaatgaatatttagcacaacgtgatgcgagcgaaatgggacaacttcatgagttccttggcttaacggtaggaattaacttaaatagtatgtcacgcgaagagaaacaagaggcttatgctgctgatattacgtatagcacaaataatgagcttggattcgattacttacgtgataacatggttttatataaagagcagtgcgttcaacgtccacttcactttgctattatcgatgaagtcgattctattttagtcgatgaagcacgtacgccgcttattatttcaggacaagctcaaaaatcaacagagctatacatgtttgcaaatgcatttgttcgtacgttagaaaatgaaaaagattattcatttgatgtgaaaacgaaaaatgtaatgctaacagaagatggtattacgaaagcggagaaagctttccatattgaaaacttattcgatttaaaacatgtagcacttcttcaccatattaatcaggggcttcgtgcacacgttgttatgcaccgtgatacagattatgttgtacaagaaggcgaaatcgtaattgtagaccaattcactggtcgtcttatgaaaggtcgtcgttatagcgaaggattacaccaagcgattgaagcaaaagaaggtgtagaaattcaaaatgaaagcatgacgcttgcaacaattacattccagaactacttccgtatgtatgaaaaattatctggtatgactggtacagcgaaaacagaggaagaggaatttcgtaacatttacaatttgaacgtt

SEQ ID NO: 1157 - DNA, 4247 bp, Bacillus thuringiensis
tgacgaattcaaagaactccaaagaaatatatgaacttgctgagaaaattgctttagatgattttgataaacttgaagaacaacatgaattttcacatacatatacgcgcaaaaagaaattgtttatggaggaaatgaagccgcaaaatggacaaccgctgaaaaagcgtaaaagacatcgtatgttaatcgctgctgcttgcttattgatcggcatgccgacaaccgtttttggagcagtaaaggtctataatatgattgttcaaaaacaaaattatgaagtaaatatttcagtaacaaataaggactcgaaaaaggctgataagtggtataagctgaaaatcgataaattaccagaaaatatggaagcaattgatgactctgctatgaaatattcctttaaagataactacgcaatgggtggattttcattcgttctttggagagtaggagggaattcagattttccaactctgtactcgaaaaattatgaagaaaaagagataaatggtaagaaggcagtaattgtccatagagaaaatggtaataaagatttaatgtttaatagagtaatttttctctattttgaggaagaaggaattatgttacaaagttatattggaaatgatataaacgaagaacaaatgatagatgtgctagggagcatttcacttgagcccacgtcaaaagaaaagtcatcatatataagcgattatgataaaaagtattttagccaagaaagtaaaacaactaaggtaattcctttgaagaaggatagcaaacgactatttcatataggacaaaaggttccagtaacgatatctatggataacagccaaattgaatatgtgatagaaaaagttgaagtttttgattcaatcaaagattttaaacaagagaactttaatgaacttggcctagagatattaagcaagaataaggctttagatcagacgggaaaattactatcatacagacgagatgaatataaattagggaatggtaaagattcaattgatacattagtagattcgaaattagttaatgttaaatttgtctacttaacaacaacagtgaaaaatattggcaaaaagtcgacagaagaaatctatatgcatccatccataaaacagcttaaatttgaagggaatgcatggaaatacgctaaagaagaggggatggacgcaacgcgtattatgacaggtgaagttgattatttagaacctcacggagatggaaaaagtttttacaatattggcagtatcacaccaggagaaacggtaaaagttaatttaggttattttgtagatgaagataaattagattcaatctttttggatgctttcaattacagagggattggtgacactgaaaatatgaattcgaaaaatcgttggtggtttgatattcgtcaataataaaacaataggaacaacaggacaaagaagctgcttatatttagcagcttttttcgtcttcatacatatgtaaaacttctttcgcacgcatacgtaaaccatctatcaattctgtcggttctaaaacttttgcatcttttccgagtctataaaataaaggggtaataaaattgatttctcctttatcaattgttgaatgtatatatcctgtcccgttttcgtttgttacaacgaattcttcaaggtaaggcacgcttttacattggcgtacgccttctggtgtcagtaaaacatgtaactgagtagggatgtgtactacgttagagttagaggaaaaccactcttctaaattcatgaatgtatcctcattttctttcgttgataatatagaaagaatacgatcgatgcgatacagtaatacttttttcctgtcatagtcataggacggtaagtaccatagcccgtcatgagcatatacaccgataggatgaacatgttttgtttttatccccgttttagattcgtattgaaagtgtaaatttttattttcaatagccgctgttaacacttcgtttaaaagtggtgtatcaattgttctctttggattccaaaaggcgatataagaacgtattttgtcaactttcgctttcgcatcatgttgtagggagctatatagtttatgtgtaacggaatttatttctgtgttaaaaggtaagtctctgtagtagcttaaagattgaaaggcaaaaaagatggagactgcttcttcttcggtaaataaaataggtggaattactctattcgataatactttatatcctccgttgcgaccttgttcagcgtaaatgggtaatcccatatcacttaaatctaaaatgtatctatggacagtacgaacagaaatattaaattcatcagctatttcttgcgctgtaaatgcttttttcgcagaagcaaatataagaatatctaataagcgtttagcttttgacaaatgtatcaccttttttctttttaaacatgacataaattgtcgtgttttattgttagtatattgtttacagcataatgttatcaagatgagatgtaaggaggaaaaaatatgtcacgtgaaatagttttatttattgcggcgagcttagatggatatattgcgaaagaagatgatgatttacagtggttaatggaaaccgaaggggagggagataacggttatacagaaatgtacgaaacgattgatacaataattatgggaaaaagaacgtacaattatgtagtagagcatacagaaacattcccgtacttagataaaaaatgttatgttttttctaattcggaaaaaggttcaaacggaaacgtggagtttgtaaatgaagatgtagtagagtttacaaaaaggttaaaatcgcaagaaggatctaaaatatggatggtcggtggagggaatctactgagagaattctttaagaataatctaattgatgaatatgttgtcacgattacccctcacatattaggttctggagttccgttatttcaagataagaatccggaaattaatttaactttaacggatacgaaacgttttgggcaatttgtaaatttatattataaagtaaaatgataaagaaacacgactactgatggtagtcgtgtttctttatagatggcaatgaaatgataaagcaagacccgtaatcgacttcgctcgttacagtaatatttccgtcgtgtagttctacaatttcttttacgatagatagccctaaaccagttccgcctgtagatcgtgttcttgctttatctacacggtaaaagcggtcaaaaatgtgagggaggtcttcaggtggaataccttcgccttcatcttcaattgtaatggagatacgtttatgttcttctgtgatagaaatgtttatatgagaatgttcttttgaatgtctataagcgttatttaaaatgtttactataacttgttcaaatcgctgttcatctaagtttactagcagtgtaggaggacaagagaaagaaactttaatgcatctttctttatacatggcatttactttttcggctatgcgagttaggaatgtgtgtaaatgtacttcctttacttgaatagaaaagttatgttgttccatttgtgcaagtgaaaataaatcttgaactaagtttgtaatgtaatcagactcatcttttataattgataaatatcgcatacgttgttcagaaggggtgctttcttttgaagcaatgtcagcataacctcttacgtatgttaacggtgttcgtaattcgtgagcaacacttgctagaaattcacttcgctctgttttcatataatgtaaatcatttgcgagcgtttgaatagatgatgctagttcaccaatttcatcatttcgagtagtcgttaatgaaacggacaaatcgcctttactcattttttcagttgcatgtttcatgtgtaacaatggttttgttaataaacgtgataataggaaaattgtgatgactgtgagtagaaacgtgatggcgccagcaataatgaattgtttcgttaatccatttaccaacttttcaatggattctgttccaagaaacatatacacatacccttcatgttttccagctactatgataggactaactgtacatatataattagatgttttccagtgattttctataatcgctccgttatggtctgttcgagtctgcatgctactaatgtgattttttatagtcgtgtttatttcgttagatttagctagcacttctttatttgtaattaaaataacgacagttgtttcagcttcagattcatcgcgc

SEQ ID NO: 1158 - DNA, 7030 bp, Bacillus thuringiensis
tgctggcttaatataagctggagatattcgtgagggagtggggaaacgccttgttacatttggtgcattcgttgagattttaccgggcgttgaaggacttgtacacgtatctcaaattgcaaatcgtcacgtgaaaaatccgaatgaagtattggaaatgggacaagaagtaaaagtgaaagtacttgaagttcaagtagcagagaaacgtatttctttaagtataaaagaagcgcttgaggaaaataatgtaactgaagattatagtcagtatgagccaaatgctgattctgctactttccaattaagtgatattattggtgaacaactgaaaaaattaaagaaataatgaggggtacaagtggtaagggcaaaacgtaaattagatcatattgaatacgctctttctactggtcagtctcgtacgcatggctttcatgatattgattttgtgcatcaaagcttgccaaattcaaattatgacacaataacatgtgaaacaaaaatcggcgaactttcactaagttcgccgatttttatcaatgcgatgactggtggtggaggagagaaaacgttacatattaatgagcaattagcatatgtagcgaaacatcataaccttgctatggctgtaggttcgcaaatggcggcgttaaaagatgaaagtgaagctgcttcttataaggtgatcagaaaggtaaatccaaatggtattttctttgctaatttaggtagtgaggcaactatcgaacaggcagagcgtgccgttgatatgattgaagcgaatgcattgcaaattcatttaaatgtcatacaagagttaacgatgccagaaggagaccgtgattttactggagtacttcagcgcattgagaaaattgttttaaatagtaaagttcctatcattgtaaaagaagttggatttgggatgagtaaggaaacagtgcagcagttagcgaacgtaggtgtaacagcaattgatattggtgggcaaggtggtacgaattttgctgctgttgaaaatgaaagaagacagcgaatgctttcttattttaataactggggcatacaaacagcaacctcgattattgaagcaacctctacaaataataacctctcttttattgcatctgggggcatacaaacagcgcttgacgtagcgaaagcgatcgcattaggggcgaatacaactgcgtttgctggttactttttacgtattttaatgcaagatggtatcgagaagttagtggatgaaattgagctcctacatacagatttgaaatttataatgacagctcttggtgcgaaaacgatagaagagttgcaatctgtacctcttgttgtaaagggtgaaacgtatcattggttaatgcagcgtggtattgatactgcgcattatagtaggagataaaaaatcaaccgttcggttgattttttttgttctattctttttcgtaatataaagtggagaaaggaattagtattatataaaaatatcatttcgtaaaaattgcaattgaaaaagggttgaaaaatgtagatggtgtgttgtcgaattactggagagaacttaatttttaataggaataggtgaagataaaaagaagtaatgggaggatatagtgtgtgaaatattatttcaatataaatagaaaacattaaactgattatgtaaaagacggtttcgtacaatatcgaaaccgtctttttgcattaattagtgctggttttgttttcgagcctgttctggtgtatcaagtccagttgcacctggatattgtagtgattgatcacgatcggattcaacgcggcgtgattctcgtagttttcgttcttggcgatctttacccataatgaataacacctccttgttaaaagtgttgctgttataagaaaaaactatgcgtaaataaagtggattaactttcataaaaagttcccataatggaaaacataggaggtgaagttgatggatggaagtactttttattttgtagcttggatagggtggatcattgtaaccttttttatgaaaaaggaccttattcggtggaagttaggcgcttgtatactgatttttataatttgctctccgttacatgtaacgatcgcctcattcgtggtatcagtaaatgctcttttactttgtattatttcttttatagggatcacgctatattctgtctggaaaaaattatatagcttactttcggcacttattattgcaatgttatatacaagttttcatctgttagaaatatatgatccgatttggattgtggtggatagagtgtttctgctaagtagtggtcttgtgtatgcatcggtgttattgcatggagatcgcatattacgattatgttctctatatgtagggatgttacaaggagagctgctagtgacatttatttttaggaaattgaattttccatatgattacggtagtttagcattttttgatatcgtcgccatttctacattattcatggcaatattgttttggattgcaaaagcatcagtatacatggaacggtttaagagaaaaacacgtaaaagaaaggcgagggtaatacatgactgaatatacaccagccattttatgcggcgtaatagcagggacagttacaagggtgctaatgcttcggacggatacacggcaatatccgacgaggctacatgggaaaattattcatattgcaatggggttaattgcagctgctttaggagcgattgcaatcccgtctattttgaaaaaagatttttctgccattacatttcttacattagcagcgacacaatttcgtgatgtacgtaatatggaaagaaatacgcttcaacaattagatgggtatgagctcgtaccgcgtggaaatacatacattgaaggaattgcattggtttttgaaagtcgcaactatttggcaatgttaacgtcgtttgcaacgacgtttgcgtatataggattccgttcatggattgcaggagtaattatggctataatcgcattttttattgcgaaaaaattaatgtctggtaaaaggctacatgatcttgttgaaattgagcacgttccgcttcgttttgaaggagcagggctttatattgacaatatttacattatgaatattggattgccagcaagacaagaagaaattatgaaatatggtatgggttttattttaaagccgaaatcaattgatgcgatggttacaatctcaaatttagggcaacgacaagctattttacacgatgtttcagtagcgttagggatttatagagattctggtacaccagcgcttgtaccgttagcaaagcgtgatttagaggatggcagggttgggatttttgtcctgccgcaagatcaagatgcagagaaagcgataggtgtcataggaaatgtaccaacgttagaaagtgctgtccatatgtcatcggaagccccgaaaggaaggggagataagagatgatgttagaaagtgttattctggcagttataacaacgactccagaaaaatttgcaggtggtgctcctttattcgtttgcgaatcgacagaggaactagaatttgttgcaaataatttagaggcaattttagatggtattgcacatcgcttacaagagaatgtatatattattgtgaaacattagcaacgtgtgttataatgtgaggtgttttgatacgttgagaaatattctggaatgcaaatcccttcttgcacaaagaagggttttttacataataaacagaagcaagttgaaaggatgaaagtatatgccgaaaccagtaatagcgatagtaggtcgcccgaacgtagggaaatctactattttcaatagaattgttggagaaagagtttcaatcgtagaagatattccaggtgtaacgcgcgatcgtatttatagcgctggagaatggttaaatcatgaatttaacattattgatacgggcggaattgatattggagacgagccgtttttgacacacattcgtcaacaagctgaagtagcaattgatgaagcggatgttatcatttttatgacaaacggtcgtgacggtgtaacagcagctgatgaagaagttgcaaaaattttatatcgttcaaataaaccggttgtacttgcagtaaataaagtggacaatccggaaatgcgcagtgacatttatgacttttatgcattaggatttggcgaaccattcccaatttcaggtacacacggattagggttaggtgacttactagacgaagctgcacaacattttccaaagattgaagaagacggatatgatgaagacacaattcgtttctctttaattggacgtccaaacgtaggaaaatcatcacttgtaaatgctcttcttggtcaagagcgtgtaattgttagtaatgtagcaggaacaactcgtgatgctgtcgatacaccatatagtaaagatggaaaagattatgtaattattgatacagctggtatgcgtaaaaaaggaaaagtgtatgaaagtacagaaaaatatagtgtacttcgtgcgctaagagcgattgaacgttctgacgttgttttagtcgttttagatggtgaagaaggaattattgagcaagataaaaaaatcgctggatatgctcatgattcagggcgagctgttgttatcgttgtaaataaatgggatgcagtgaaaaaagacgaaaaaacaatgaaagcatttgaagaaaatatccgtgctcatttccaattcttagaatacgcaccaattgttttcttatctgcaaaaacaagaaaacgtacacaaacattaataccggttatcgatgaggtaaatgaaagtcatagtatccgtattcaaacgaacgtattaaacgatgtaattatggatgcggtagcgatgaatccgacgccaactcataatggtagccgtctgaaaattttctatgcaacacaagttgcggtaaaaccaccgacatttgttgtgtttgtaaacgatccagaattattgcacttctcatatgagcgtttcttaaagaatcgcttacgtgaatcatttggcttcgtaggaacgccgattcacattatcgctagagcaagagactaatggagaggatgtgattttatgacaaaaatcacagtagtaggagcaggtagctggggaacagcgttagcgatggtattagctgacaatggacatgatgtacgtatttggggaaatcgcccagaacttatggatgaaattaatacgaaacatgagaatagtcgatatctcccaggcattacattgccaagcacaatcgtagcctactcttctttagaagaagcattagtagatgtaaatacagtactgttagtagtaccaacgaaagcgtacagagatgtattacaagagatgaaagaaattgttactgaaccaattacttggattcatgcgagcaaaggaattgaacctggtacgtcaaaacgtatttcggaagtgattgaggaagaaattccagagcacttaattaaagatgttgttgtactgtctggaccgagtcatgctgaagaagtcggtttacgacaagcgacaacagttacgtctgcagcaaagcgtatggaagcggctgaggaagtacaagatttatttatgaatagttatttccgtgtatacacaaatccagatatcgttggagttgaacttggtggtgcgttaaaaaatattatcgcattagctgctggtataactgatggtcttggattaggtgataatgcaaaggcggcattgatgacacgtggtttaacagagattgctcgtttaggaagaaaaatgggcgggaatccgttaacgtttgctggtctaactggtatgggagacttaattgtaacgtgtacaagtgttcatagccgaaattggcgcgctggaaatatgcttggaaaaggacactctttagaagaagtgttagaaagcatgggtatggttgtggaaggtgtaagaacaacgaaagctgctcatgaattggcagagaaaatggaagttgaaatgccgattacagctgctttatatgacgtgctgttcaatgggaataacgtaaaagatgcggtaggctcattgatggggcgtgttcgaaaacatgaagtggaagctatacctgatttactgtaaagaaaagcgacagaagtacatttgtacttctgtcgctttttattttttgggtcttttcaccattttttcatttttgcataggatgaagagtaacttgaggagagggtgaaaagaatggataataatatttttaataatattgagaaggaagcgaaagtaaataaagaggatatttttaaattagcatcatccgtgcaaaatgcgaatttacgtgatgaaactgtacttcgtcaattaattcatcaagtggctcttatggcgggacgtgaagtgccgaaagagcaagaggatcaaattgtaaaagcgattattaataataatatgccaacagattttggctcgttaagcaaaatgtttaaaaaataaattatgagaaacaaagagtttgtagattgcatatgatagccatgaaagaatgggaatagagctgtttttgggcatatttggtcaaccgaagtgagaggtacaatcgcttcggttttatttttgcctagattggtgaaaaatgctggaaaacctattgattaaagttatatattcgcaatttgtagtaaaatgttctttttgtatttgtttaaagattttaatttgttaaaatagtataaaaatagattgataaaaaggggtgtgtatatgtcagaagggcttatgaaaatgtggttagctttaggggcaattggatttatgttttttgcagtaagttttattttattaagtagacataaaataaagaataaatttttgaaagggattacagcattagtagcgtacacccttatgattgtgtcaggaattgttatttttcttgttgtatttagtggacctgtacagcagtaaatggaatggtctcgaaaatactacatacaaagaaaattagattagtatgaaaaggtgatgctagtgaa

SEQ ID NO: 1159 - DNA, 5116 bp, Bacillus thuringiensis
ttcaatatatctagctattcatgataaccgtaggtgtttgctataagcctgtagagtttataagctcatcgttgcttatcccgatttcctaccgtcagattcgtacttctcggtaccctaccacactcttgtgtgctatacctttcggtatagtgcaattttagacccgtaccttcgcaaattcgtcagacccataagggacattctcaccatagttatcttttcagccatccgacctatcctacaccatatgattaaaaatcacttaggctcgttcagccgacttcacctagcttcatacacaatctgtctactaacaaatcatgcatgtaggagtattaatggagttgtttcaattcaacatgacgattttcattccaactctcgatatattagttattgttgcttaagataaatttcagcaacactctcacttcacgtctaaacgcttatagagaaacgtgtcgcgcctgtagtactccactacatcagcaccaactactccagtctcattatctgcaaagcatcttgtcatcggtgccatcactatacgattacgaagagaccaagctccaacttgaattggatcaaacaactttgtttcttcaacgttttcaaaaaatcccccagcatttacatttgttccttcataaatactcgctgctttattacttgaacttgtcatttttcttcccccctaaaaaatcttactataatcgcatcatacttacttttagatagtaacgtcaatttttacgactttataacaaaaaattcgaatattcaaaaacaaaacactgcaaataatattaaaaaggtttccttaggaggaaaccttttttgttgaccatatatggctgtcaattcgtttatctctttaataaaaaacaccttatcaatagaagtgaaaatggttcagtattcttctaaaaataataacttatatacctaaaacaatgaaagccctacctctctttcatccttacggctcctcgttcgtgccagtgtgaatcacgatggcaaaaatcaagtaactatttatcgaagtattcaattaaacttcgaacattcataaaggaaattaaaaaataaaaatggatttgattgtagtaataacaatagaggtaatgctctaaaagtggtttgaaagagttgaatgtctttgaaatgataaattttctataattatgttcccaaaaaattcaagatcttttttgggatataatacattatttgtaatgaaccttaacaaaagctttttatctgattttctgtgataccttcaattaatcccagttcactaatcaaaaattcatatgcgttatctaacatcttcttttcgcttgcattaagtgctttttctttctgtatacgcattaaatcacgcacaacttcagcaccttcttgcattttacccgtctttattttatcagtgttcaatttatacctttgtttccacgtaagtaatctatctgattccccatgttgaaaaatatccattatgtgtgctaatgcggttatatccgtaactggtcgtatattcgaattcaatattctccctgctggaatcattagttccatattactagccgacatttttataacataatactgttgtttttctcctgagatttccttctcttctatggctttaattatacctgctccctgcattggataaacaatattatcaccaatttgaaacaaataatccacctccatatatggtaaccttctcaagcttaacatacttttagttttttagcaaaatttttattttatcataaaattattttacgagtcaatacttcagaagcaagaaattaaatttacacaatacattataaaaatcgcaattccattaacggttccacacacattcattctcctttaacacaaaaacacatcactacatttaagtagtgatgtgtttttgataaggcataaataaatatctacttttccgtctatatactaacctgtttgctaactgtttccctcgctaaaagaaaactcataatcacttgcgctgctactctactcgtcatatctctgaaatcaagagttggatcaatctctactatatccatcccttgaacgagcgattctttaccaaggaattcaatcgcatctagtaaagtcgtactatccatcccaccaggcccaattgctggacaacctggtgcaaacgcttggtctagcacatccatatcaagagaaatataaatagaagtcacaccttgatttcttaatacttcaatactttccgtgataatatcttttatttctcgctctcgtacgtctttcattgtatacactgttacaccatgctctattgcatattcatggtacgcacgtgcattagaaaaattacgaattccaatttgaacaagttgttttccagtaatgacatcattttctagtaaactacggaatggtgtaccatttgacgggcctccatcatctaaattacgtaaatcatgatgagcatcaaattgaataattccgacctttcctttactgtttgcaaaacctgttatactcggaaaactaatcgagtggtcaccgccaagaacgattggtatcacgttcgggtttactttcgttacatgcccaactgttttcgcaattcgtttatgactttcttttatatccgtcacatgcatcgtaatatcgccgcaatcatataagacactttctttcatatcgtgttcttctgtaattgcatatgtgctatatgcatctaacatcgcacgaattgtttttggcgcaaaactcgctcctgaatgactaatagacggtttagaaaggggtgctccaattaaggcagcaccgaatatttccacaccttcctcccaatctttaatcatctcactccatttcgtcacttcacgatcaataaactttgcatttttctttaaatagtggccgtgctccacgattgttcacctcttgtatatgcaatattaccattcttccatactgtattcacatgacttacgccgtaatgatacggtacgtaagcataattgtaagcatcccataaaactaaatctgccttacgaccaactctaattttcccagctacatcaccacggttaatggcatatgatgagttaaccgttacggcattccaaacttcttctggtgtcattttcaattttagcatcgcaatgctcataataagctgaatattttcagttggacagctacctgggttaaagtctgtagctaacgcaactgcaacaccttcatcaatcattttacgtccacgagcaaagctttctttatttaaatagaaagttgttcctggtaataaagttgctactgtattagaatttgcaagcatttcaattcctttatcagaagcaccaactaaatggtccgctgatgctgcaccgatttctgccgctgcttccgcaccaccaagagggtcgatttcatctgcatgaattttcacatcaaagccaagctctttcgcttttaataaaaattcttttgattcttctacagagaacacacctgtttcacagaaaatatcaacgaactccgctaattgcttctctttcatttctggtagtaggtctaacatccattgtaaaaattctttcgatctacctttatactctttcggaactgcatgagcacctaaaaatgttgaaactaaatcgatcggatgctctttttgtaattgtgctgttgcctctaattgtttccattccgtctcatcatctaatccgtaaccactcttcgcttctacagtagtaactccgaaagatagcatacggtctaaatggaatttcgctttttgaacaagttcttctttcgacgcctgtttcgttgcatttacagttgaaagtatgcctccgccttgttctaaaatttctaagtacggaactccttgtagttttagtgcgatttcattttcacgagatccaccaaatacaagatgagtatgcgggtcaacgagaccaggagaaaccattttcccgccgcaatcaataacttctctcgcttgtaatcctttcgcttcttccgctgttccaacgaaagtaattacaccattttcaattccaaccgcaccgttttcgataacaggaagcgtgttcatcgcttcccgtcttaacaagccatcttcttgatccattgttagtaattgaccgatatttattagtaaagtgtccagcatgttttctcctccttatttcatcatcggaatgttaacgcctttttctttcgcagtttccacagctaagtcataccctgcatccacgtgacgaacaacacccataccagggtcagaagttaatacgcgctcaattcgttttgctgctgcttctgttccatctgcaacgataaccattcccgcatgaagtgaataacccataccaacgccaccaccgtggtgaacagatacccagcttgcaccgtttacactattaattaatgcatttaaaattggccagtcagctactgcatcactaccatctttcatcgcttctgtttcacgatttggagatgctactgatccacaatctaaatggtcacgaccgataacgattggtgctgataattcaccatttgcaaccatttcattaatgatgcgaccaaatttcgctcgctcaccgtaaccaagccaacaaatacgtgatggaagcccttggaattcaacttgttgacgtgccatacgaatccagttacataaatgttcattatcagcgaactcacgtaaaattacttcgtctgttttataaatatcttctggatcaccagaaagtgctacccagcggaatggtccttttccttcgcagaataatggacggataaatgctggaacgaatcctgggaaatcgaatgcatttttcaaaccttcatcgaaagcaacttggcgaatgttatttccgtaatcaaatgtaattgcgcctttttcttgcatagcaagcattgcttccacatgttttgtcatactttcttttgataattgtacgtagcgttctggatcttcttcacgaagtttcgctgcttcttctaacgtgtagcctactggaatataaccgtttaatggatcatgagcagatgtttgatctgtaactaagtctggatgtaatattgcgct

SEQ ID NO: 1160 - DNA, 5636 bp, Bacillus thuringiensis
agtatatttaaagatggatatggaattgctaaatagggcaaaaagaataatgtaatatcaagtaataatttgtacaaacaatattaatgatcttcgtaaaaaagatgcgagtgtatagaacaattacatattttataacttttttatattacacgatggtcgtttataagtaggaggaagagatgttgaaatatagtaaattagcaattgtaactgcattatcaatgattttattagccggttgtttcggtccgaaaccagaagaagaattatatgtagcgtttgaaaacgctgctaaacaagaaaaaacaatgtttgaagatgcaaaaaaacttgagactttagagaaagaaggacaagaattatataaccagattgttcaagaaggaaaagataataatcaaactgttaaagaaaaactgaatcaagcagtgaaaaatacaactgaacgagaaaaagtgcttgcaaaagaaaaagaagttttaaataaagcgcaagaagaagtgaagtcagctgataagtatgtgaagaaaattgaagataagaaattgaaagatcaagctgataaagtgaaaagcacgtatgagaaacgacacgattcatttaataaaatgtatgacagctatgacaaatctttaaaacaagaaaaagagttatatacaatgttacaagataaaggtactaaattaaaagatattagtgaaaaagtaaaagtagtaaatcaatcttataaggatattgagtcagaaaaagataaatttaatgaattcacaaagtcttataatacagaaaaagtagctttttataaacaagcaaatattaaaattaaagaagagaaaaaataaaacagtttggcctacacttggccaaactgttttatttttttgtataagtacgactataccatggaacaggttcacttaattttttttcttgttttaatgcttcaggaccaatataatcttgaattgttttttttgccactgttaaagataaggttgttttcggatttcgataggaggattcaagatgaccaagatgcggtagaattcgaaaatcttctttcgtaggagggatgtggaaaaaataatcgcctaaacgtataaggacatcagattgttgttggctaaaacgtgggtttctagaaaaatgtaatccttctttaattgcttttttttcagcaatcaaacgttctaaagctgtcttttttaaccagtataaatatttaggattagtagctgctttagcatgacgattcacaacgaaaatagattgagctagtcgattaatagaatgttggttttgtaattgagattgtggttgtgaaggtttcatattgaatctcctttcaatttttcattattataccataaataaaataggtatttattatacgcaaaaagtgattgtatatattttcaatattaaagcaatattgttacaaaaaacaactattttgtataatagtaatagaatatgttttttaaatttgataatgaaagagtgagaagtttgaaagaaatattaaaacaacagtatgccattatagatattggatctaatacaatgcgtttagttatttatgaaaagcaaaatggaggtttttataaagagattgaaaatacgaaagttgttgctaggttaaggaattacttaattgatggtgtgttgaatgaagagggaatagaagtattattacagacattatttcaatttcaagaaagtacaagattccatcagttgcatcatgtactttgtgttgcaacagcaacaattagacagtcggagaatcaagaggaaattaaaaagcttgttgaaggacaaacggactttactcttagagtattatcagagtatgaggaagcgcgttacggatacttggcggttatgaattctacatcgttttcagaaggaataacggtagatatcggcgggggaagtacagaagttacatactttagaaatagagagattttagagtaccatagttttccatttggggcactttctttaaagcaacaatttattaaaggggatattcctactaaagatgagttagagggaatgcaacagtatttagagtttcaatttcgaacgttaccatggttaatcaataagaaattacctcttattgcaattggtggtagtgctaggaacttagtgaaaatccatcaaaatttaatatgttatcctatagcaggattacatttatacaagatgaaagaagaagatattgaaagtgtaaaagatgaattggaaaaattgtcgttcatagaacttcagaaattggaaggattggcaaaagatcgagcagatacgattattccagcggttgaagtatttcatacacttgttaatgttatagaggcaccggcatttgtattaagtagaaaagggttaagagaaggtgttttctatgaagagttgacaaaagatttggggatttcatattatccgaacgtagttgaagaaagtctgcatttactatcacatgaatacgaaatggacatggaatttgttattcagcttattaaacatggaagactaatttgcaaacaacttgaggaaatagggcttatttctatgtcagtaaaagactgggaagtgttccatcaagcagcgaaagtatttaatataggcaaatatatagacgaagaagcaagccgtttacatacgttttatttattagcgaataagacaattgatggcatgatgcataaagatcgagtaaggctagcgcttattgcatcgtataaatcaaaaatgttatttaaacaacatttatctccatttgaaggttggtttgataaaagcgaacaaaaaaaaatacgcctgttaggagctgttttacaattttcagctactttaaatgtaaggcaacgatcgcttattgataccatatctataacagaaaacgaagaaggattaacatttaaagctttatgtgaaaaatcggcattagcggaaaaagtgcaggctgaaaaacaaaaaaaacagttagaaagagtattaaaaacgaatattaacttgttatttgaactaaaacattaggttgtacggatgtctttacaaaaaatttacactttataatattgtaatttgctaaaataaaagtaactaaattatagtaaaaaagtttcaaggggaagtgtgaagagaatggaattattgaaggggaatgcagtaaatttaaatgatacagcttattacaataatcgagagttaagttggttagcatttaatgaacgtgtcttacaagaagcgcaagatgcaaataatccacttttggaaagattgaaatttattagtatttttagttcgaatttagatgaattttttatggtacgtgtagcgggattaaaggatcaagtgagtgctggatttaatcagccagaaaataaagctggcttaacaccaaaaaagcaattaaataaaattgcgatgaaagcccatgcactaatgacagtacaatatgatacatttaaaaattatgtattaccagcgcttgagttagagggaattgaacgtttaacattcaatgatttgacgaaagagcagcgagaatttatagaagagtattttgatgagcaaatttttccggtgttaactcctgtagctatagatgcatatcgcccatttccaatgttattaaacaaaagtttgaatttggctactcttttatatgatgagaagcaagcggaagaggaaaacaggacgaagttaggaattgtgcaagttccttcattacttgagcgcttcataattttaccgagcgaagggcaaaagcataaatttattttattagaagacgtaattagtagctttactcataaattatttacgggatatacagtatcatctgttactcgtttccgtattacacgcaatgcagatttaacgattcatgaagaaggtgcgagagatttattaaaggtaattgaaaaagaattaaaaaagcgtaagtggggggctgctgttcgtttagaagttgggaaagaacacattgatgaaagagtactagcgttattatatgaggttctggaagtaaaagatgaagatgtatatataatggatggtccattagatttaacatgtttgttttctttatataaaaaactagctcctttatatgaacatcttgtatatccggctcttattccgcaaccacctcaagatttaggtgatgaagaagatgtatttgaaaaagcaattgagcatgatattttattacatcatccttttgaatcatttcagccggtagttgattttgtccgtgatgcggcggacgatccgaatgtacttgcgattaaacaaacgttatatcgtgtaagtggtgattcaccgattattcaggcgttaaagatagcggctgaaaagggaaaacaagtgacagtattagttgaattaaaggcaagatttgatgaagaaaacaatgttcattgggctaaagaattggaacaggcaggctgtcatgttatttacggtgtaagtcacttgaaaacacatagtaaaattacattagttgtaagaagaaaaaacggaaaaatcgaaaggttcgtacatctcggaactggaaactataatgatgcaacagcgaagttatatactgattttggatatattacatcaagaaaagactttggggttgatgcaaccaatttctttaattatttaagtggttatacaacaaagccacattttcatcatttatcggttgctccatttgatataagagagcaatttatagatttaatagatgaagaaatccgttatcataggcaatatggaaatggatatattatcgctaagatgaattcattaacagataaaccattaattaaaaaaatgtacgaagcatcacaagctggagtaaaggtagagcttattgttcgagggacatgttgtttaagacctggcattccaaatgtaagtgaaaatattcgtgtagttagtgttgttggaagatacttagagcatagccgtatttattatttccatcataatggggaggagaaaatatatttatcttcagctgatttgatgacgcgaaatatggagaagcgagtggaaatatctttcccgatattagatattgaaatgaaggcacgaattaaggcgattttacagcttacattagctgataatgtgaaaacacgtgaacaaaataaagatggtgattactattatgttattaatagtagtacagaagaaattgatagccaagtgaagttgtttaagatggcatatcaaaatacagacgctgaataatgaaaaaagtaaaaacctcttatgtcaataagaggtttttacttttttctactcatatgctccaaaaatggaagaatgagtagaaacaatagttttattataagcgtgtaatgagatggctcgttgagagaataatatttgaaagaatcgttattttaacttagtaatagtatggttgctgacatggtccaccgtaacaaggataaggtgctggcggcgggaaaggtggtggataaggtggataaaatggtcgagggccgaaagctaatgctccgccgagcaatccaccagcaattccagctagaaagggaacgccaaaaaacgggaagaagcgtgagtcgcctactgaaccaataggtgctgaacgg

SEQ ID NO: 1161 - DNA, 5959 bp, Bacillus thuringiensis
agtaccaccgattttgccacattcatatgcgtattgtagacaagggaacttctctaaatctggtttttcaaaatgtaaactaccgatttctaataaatttaatttttcataggaagaaggtagccgagtaggatagtgaaacgcatattgaatcggcattctcatatcaggagcaccgagctgtgccataactgatccatcaataaattctactaaagaatgaatgatactttctttatgaatcattacatcaattttttcatatggaatatcaaatagccatctcgcttccattacttcgaaccctttattcattaatgtggcagaatcaatcgttagttttgcgcccattaaccagtttgggtgctttaaagcatcttttgcttgtaatgtttgcatttcatcacgtgttttatcacggaatgcaccgccagaagctgtaacgattaatttctcaatttctttattattttctccgtttaaacattggaaaatagctgaatgttcgctatctactggaattaagcgacatccgttttgtttcgctagttcagttacgatatgtccagctgcaactaacgtttctttattagcgatggcaatatctttcttcgcctttaatgcttcaatcgttggaagtagtccggaaactccgacaacagaacttaatacaagatttgaatcagggtgagtagctaccgcaattaagccatcagttccgtatgtgatttttgtattcgctgaaatacgcgtacgaagcgtgtctgctaagtcttttgttgcaacgcttacaatacgaggttgaaacgttttgatttgttgctcaagaagatcgatattataatttgcggttaaaccgacgattttgaaatgttcaggatgagctgaaacgacatctaatgcagatgtgccgatggatcctgtggaacctaaaatggatatatattttaccatgaaaaaacctccaaagttgtttcgaatatttctgcaaacctatataatattagacaattgaagtggaaattcctgctatataaaatagaaaattcgggtttgtttggaagtgaaatgtgataaactgtaaaaaataacgaaaaagcaatgaaagagaagagtacatattcgaaacttttcagagagctgatatgtggtgagaatcagtaagggatgaatatggaatggactctggagcttctaactgaaatgagtaggtaaagacggttacttcacgttattgaagtatgaagtgagctaatgatagctaattaaggtggtaccgcgggagtctctcgtcctttttaaggatgaggggctctttttattttgcgaaaggaggagttagtgtgagtgaaaaaataatgttaacaggaattaagccgacaggttatccgcatttagggaattatattggtgcgattaaacctgcattacaaatgtcaaagaataatgaaggaaaagcattgtactttatagctgattatcatgcattaaatgctgtgcatgattcagaaaagttcagcagttatacgaaagaggtagcagctacttggttatcgcttggacttggggaagatgttgttttttatcggcaaacagaagtaccagaaattctagaattagcttggattttagcttgcctaactccgaaaggtcttatgaaccgtgctcatgcgtataaagcgaaggtggagcaaaataaagaagcggggttagaggtcgatgcaggagtgaatatggggttatatacgtatccgattttaatggcagctgacatattattatttcaagctacccatgtaccagttggaaaagaccaaattcagcatattgaaatcgcgcgtgatattgcgacgtattttaatcatacatttggcacgacatttacacttccggagtatgtcatacaagaagaaggagctattttacctggtcttgacggaaggaagatgagtaaaagttacggaaatgtaatcccattatttgcagagcaagaaaaactacgaaagttaatatttaaaatcaaaacagattcttcacttccaaatgaaccgaaagaactagaaaccttatttacaatttataaagaatttgcgacagaagacgaaatacagtcattacgtgaaaaatatgagactggaatcggatggggcgatgtaaaaaaagagttgtttcgcgttgtagatcgagagttagctggacctcgtgaaaagtacgcaatgtatatgaatgagccggatttattatatgaagcattagaaaacggtgctgagaaggcacgcgctattgcaaaggtaaatttagcggaaattaaaaaacggattggatttgagagggaacgttaagcgttcccttattttttttgataatctgtaataatcctctcaataacagggggaagattattaggtaattcatcaagtgaaaagaagcgtagttcttttgattcactttgatcgcatacaaattcaccataaaattctcggcaaatataaacaacgagtacaccgtgtacttgatcgccgtttggatagatttgaaagaaatcaggccctgagtatgtacggaatagttctggatttttaatgataagtccagtttcttcatatacttctcgttttaaagcttcttctaacgtttcgttatattctaatgcgcctccaataatgccccagcgtttaaaatctgtacggagctgcagcaatacttcatctttttcatttaatataatggcgtgtgatcctattaaaataagtggatgatttcctactagatttctcatatcttcaatataacccatgtcattgctccttgtatttaataatagttaggaagttcttttaacattctttctgttttacgtgctgtaaaggctaagttatggtcatctttcgttctgaaaaataatgtgcgtaaaaaggttttaatattggcacataaaatacaatactcattaagcgaaaggcgttttctaatttgaggaagcctttttatttttttatgaataatagaaattaactcgttttgaggaaaatcatgatacagcattgctagtaatggagtaacaatgcgttcatcttcgttattatgaaaaaggtcagatggaataaagattttatttaataaacaatgaattaattcttcgtaccattcaaaagttgtatacgtattatgaacaatttcagtaaaggcatcagatacgtgagcaagacaatgagcccatcctttattttcgatatagccccgaaaatccgtttctaagtttgtgtatgtaatgagtttgttttttatttcttcgatatcctcctctgtacaaaagtagtgcgaattagcaaattggagtattaacgcaattaacgaaatagtgtaagaacgtgtgaaaaccccatctgaatgtggggagtaaatgtcacaatataaatactcatcacttaaacaagtttgcagaagtaatttcagctgatcatccataaggaattcatgatgaatgaaatgcgcaaaacatttatatataagttggtaacgaacgtagctatcagtcgttccgatatactgaagcatgttcaaagttaactcatttacgtctatatgctgtagttgcgtatagtcattttgttgtataagctctaactgttgttgcaatgctgtaatatccactggagaacctcctccgcactttaaagatgcgatcttttctagtattctatatattcaaggacaatcctgctcatgcaaggagaacgattagaaattcgagtatgatatagatgagggaagaatatgacgacgatagaacagttagaaaaatattttaaaataagaagaaatgcttcttctattatgataaaagaaaataatgcagagatttttacagaagagcaattagaggaaatgatgcaatattgcgttgctgaagctaaaaaagatggattagaaaaactacattttgaaatctcttcaaaaagtccaaattatgatgtgtataaaaaatgttttgaaacgtattcatttgaatatgttacggaaaacatgattgtatttaaagatatatatgaagtagaagatgcagaaagtgaaattgattttaagcttattgaagaagttggagaagaggctttttattcactgtggaatgaagcgacgggagaaccagtcgctcatgatcaatttgtgcatatgatgctacaagaaattggtgagcaatggaaagaacattgcttaacagcgagtgtcgatgaagagccgataggaattgtaatcccgcatattgaaagaggtacgttagaagaagggaaacttatgtacttcgcagttactccaaatatgcgtaataagggatatgaagcggcattatttgcagctgcgatgtttgtcttaaaggaaataggtgcatcttattatattggtgagacaaatatacaaaatgaatggatgaaggatgtttttgaaaagaatggatgtcagctgcttagttcaactgagagatatgtgagaaagttttaggaggatgaatgatgtatactctcgaactcgtatagcgggaggggactatatatgttaaagcaatccatgcattcattcgtgttattgtatccaaatgtattgttagaaggctggaatgttgaaaaagtttcagaacgttatgaaggtgaaaagtggggaactttttggtttcaggttgttactccaactgggatgtttcgagtaaaggaattttttctcgatataatggaaccagtatttccggatagctgtatttctcaagcaaaaggagattgttttcaatataaagggcttgtgtattggaaaggtataaattataaaggaaaagaaagttacgttacatctatatggaaaacacaagttgaaatttctattgatcgtgggtatgtaaacaaagatgaaatggaaagatttctattcgggttacaaccagtaaatatgaagtttgcgaaaatgatattacatacaccatttcacctattgagctttcaagcaaaaagagatggaattggtgagataggaagatgtagagagtggaatgctccagatgacgtatcctatgtaaatttgttaattcatgaaaaactaaattggaaacttgaatcggtcggtttcggaaatgacgaaacgcagtatgtatactgggacgaagttaataaactatatgcactttgggtttgtagacataaaaacaaagcgtattatcctatttcttcatggacaatgaactatggcccaaaacaaattataaacgggttagagttttatccgcaccctaatcgcggaacagttgtatacgaagatttaggtaatgaacaaatcgcatacgtatttcgcggtaatccttgtacaaattttgaacaagtaaaagaacttttcgcctgtttgtaagataaaaagaaaaatgagaacgacaaagtagatatttgtataatacaatagagtgagattcgattatatgagaaagcgttggtgaaagaatgggacagcaaagaaattggttacaagcaactgtagaaagaaataaagataatacgttacaaataaagtgggaaaataatatagaagaagttcgtatttattggagtacttcaccagatcatattgaagaaaatggagaattacttgcaacagtaaatggggaattatcatatacaattgaaaaccccagtgaaaatgaacgtccatattttagattagtaggaagtaatggacaagcagtaacagtagccgagcgtagattgccattacaaggtgcgtttaacttccgtgatatgggaggatatgaaacgactgaaggccgtaaagtaaaatggggcaaattataccgctctgaagaattagcagggctaactgaatgggatattgcctatttcaaaagtctggttaaagttaatttgcgattaccgtacagacttttgagtgaagcataagccgaattcagaaaatacaggtgctc

SEQ ID NO: 1162 - DNA, 6376 bp, Bacillus thuringiensis
tcatgtgtgagaactggggattgcatttttgggggcacttggcgagggacaccagttagaagagttgccaggatttgttgcgctctcagatgacagaataatcggaattataacgtatgaagggaccagaaatatgcgcgaaattgtatcgctagatagctttgaagaaagaaaaggaatagggacgaaacttgtggattgtgtattacaagttgcagaaggagaacggtgcatacaggtttggcttattacaactaatgataatatgaatgcgttacgattttaccaaaaacgtaattttgtaatgactaatttatatgtgaatgcggtagaggaggcacgaaaaataaagaaagaaattccacgtattggatatgataatatcccgattttacatgaaattcagttggagtatcgtttagtgaaatgatgtaacaattttcagaaatatgagttgttaatcttgacggatagtttaatttaggttaccgtaaaattgtaatctattaccatattaaggggtgacgatgtggcaactatacgtgatgttgcaaaattggcaggtgtttcagtcgcaaccgtttcacgagttattaatgaaaaaggatacgttcatgaggacacagtaaaacaagtaaaggaagcaattgaagaattacgttataggccaaacagtgcagcgaagccactatttaaagaggattcaacgataattgcattacttgtagataatttatgtaaccaatcaaacatcactttgctacattgtattgaggaaatagcatataaagaaggttatcaaatcattatttgtaatatagagaataaagatagatacatacatatgctgaagcaaaataacattgcaggtgttattttgacaagagcagtttttaaaagtgtaggaaaaattccatttccgtttgttgtgatcgatgagcaacaatcacatggaaattattatgaaagtggacagagagctgtttctttattaaaagagaaagggtgtcactttcttgcatatttcggtgagggagaagaaagtgaagaaatggaagatcatatagcagggtttttagacgctgtttgggatgaaggaatctcttatcgagaagaatgtgtacaagggtatacaaataaacaatttattacattattgcaaaacaatccgtatgtagatggaattgtagcctcaagtgatcagattgctattgatttaattcggtcagcgagatttctaaatatacatataccagataaattaaaaattgttggaccgaatgggagcatagagtgtgaatggagaggttcatcactaccgacaatagaaagctatgtcagagataatggaaaagtagcttttcaacaattaaaaggaaaaataaaaaagtaaaaggtgcgttttatacgcacctttttataatgtaattgcggcaataaagccaaatataagtaacggtatattgtaatgtagaaaagtgggtacacatgtatcccatatatgatggtgctgaccatcagcatttaaaccggatgttggtccaagtgtactatccgatgctggagatcctgcgtcacctagcgctccggctgtaccgataattgcaattgtggccattggactaaatccaagctgaatgcaaagaggtacaaaaatggttgttaagatagggatggttgaaaaggatgaaccaattcccatcgtaacgagaagtccaataacgagcataagaaatgcagcgagtggtttgttatttccgattatatgtgcactcgtttgcactagagattcaacatgtcctgtttttcgaagaacagcgccgaatccggcggcagcaatcataacaaagccaataaaggacatcatacgcattccgcttgttaatatcgcatctgcttctttaagtggtagactgccactaactgataagacgataatacctgctaaagcaccaaaaatcattgattctgttgttaattgaacagttaatgtagcaatgatagataataacccgaaagtaatgctacgttttgtatagggaacgatttcattttcggtagtatgaatttgttctgtttcatacgtacaaggttttcggtacgtaatgaataccgctacacataatccaataatcataccgattgctggaatagtcattgcttttggaataagtgcgacatcaaatgtaagaccgctttgcgcagcgttggtttgcaatacgtcatgataaatttttccgaaccctgcagggatccacatataaggagtaatcaatccaaatgtaataatacatgtgacaagtctgcgatccactttcagctcagttaatacttttaaaagtgctggaattaagatggggatgaaagcaatgtgaacaggaatcacattttgtgagaaacaagccatcattaaaataatgaataaaataagtaccttagaataaacttgttttttcgtgtcttgttcattgccaatccattttaatgcagtttgaatcatagcatctggaagtcctgttttggaaagggaaatagcgaaaccaccaagcattgcataacttaaagcgattggagcactgtttccaagaccagttgtaaaagtgttaatcgtttctgaaataccgagtccgccgataagtccgcctgttaaagctccaacaatgatggcgacaatgacctggacacgtaacaaactaagcaatagcataattgctactgcgacgagtacagcgttcataataaatgtaatctccctaaatttttattctgttaagacaagtacatatgaaacattttgctatgtttatacatacttgcgacatattattataaaatgttttctatgaaatgtaaaagagccttttgtgactaatgctgaaaagctagctcttgtttaattgattgcaaagaattggcgaataattctggttcttctagatcaggagaatgtgctgagtttgggaaccaaatcatcttttttataggcgcttcaataatatcgcaatattcctgaacgagtgcataaggggtttgataatcatagcgaccagaacaaaaataaactggaatagataaacttgagatagaagaaaagaaatcgattgtcagcatttcttcccataaaacgccagattttaaatttcctgcgagaaacttgaaccaatctaatagcgtgtactcaggagaaaagaaaccttttcgtatgaaagaaaaggaagatccattttggattgcgcctccgaatgtgccaagccactttctttgaataatgagacgtctcgtatctaaaaatggtggctttcctaattttaaaagggaagctaatgcttttttatgattatgtttttttgcagaacgaattaaatgttgatatagcaattcttcattttgtttcatatgtacaatttgcccaataccgatgtaagcctcaatatactttggatattgatgtgctatgttaagcccaatgatacttccccaagaatgaccagcgagaaatagtttttgtttgttgaaccttttaagtacatattgaatcacttcttttgcatcggaaacgaattgttcgattgtgaaatttgctccgaaatcttttattgaaaaggatttaccagccccgcgctgatcccaattaataacaataaattgcttctctaattctttttgaaaatggcgaataaatccgatttgtgccatcccaggtccgccgtgacagcataataaaataggttgctctacgttttgtccacgcataaggagagtttgttttcgattattaatcataacgctttctatcgtagcgatactgttaggaatgagttgtttgttttcattatagaactgaggggtgtagctacgaaaaagcatattgaaaacctccttttgtgaaatcgtatgaatcgcacaggctattcattttgcatatactgttagaaaatcattgtaacataccatactagtgtcatttcaacacgggaggagggaaattgtgacgattggagaaattatagatggtttaaatagacgtgaacccatcgctattatagcaaaacgtcttgaaataagcccgtatacattatcgaagaaattaagattgattggatacgaatatgatggagagcagaagaaacgtatttttgtaggagatggagaagaaccacgtcacttacaactccaagaagcgaccgcccttcaatatgagaaaacagattatcaattgttaatttatgagcaattacaaagcatttatgaattattaagaaaaagagaagaagtaattgtaccaattatgagtaaaagtgcagagaagaagagacgaaccttttctattaatacagaaatattatcacaattggaccttatatcagaatcgaaaggaattcaaaaatctaaacttgtagaagaggcgttgcaccaatttttacagcaatatgaagttgacaaaacatcacattttgataactaaagaaaaggatactatgttcattggaagaacgagtatcctttttatgatgtatattacgtataaaatagaggatcagtataaatcctttatggcgtgaaaaatgaaatttattattagagaaacacttaatttactttttgaattcttccatcaataactggctgaattggttcttttaattgttttacgtaatcgactaacgcttcaaagtcgtttggaccagtttctgcatttttaccatttttaaatgatacgaatccgtcaccgccagaagctaagaaggcatttgcaactacgctatacattttagatggagataattcttctccgtttgttaaacgtatatttgtaactttttcaccgtttggtttatttgcatcccacgtatattgaatacctgaaatttgaagcattcttgttgttcctttttgccattgctgatttaaaatatcgcgaatgtcttgacctgttaaatctactttaattaattgatttccaaaaggttgaatgccgtataactcaccccacgtaatatcaccagcatctaagtcattacgaatgccaccaggattcatgagggcgatttgagtttgcatcgtttgacgctgagcatcggcaactaaatttccaagagtggactcaccagcatcattttgtttacggtcgataggtgctgtagattttccgactacttcatttacaagtggtgcaattttttctttatattgatctagttttttctttacttgtttatcaggttctacaccttcatgatagggtgtaacaacttcagcttttttctttacaatatcctttgttttacgatcaattgttacatccacgtctgagaaagccgttccgtatgaatttgcttggacaattagtttattatttactgtaccatttacatacgtatgactatgtccaccgaaaataacatcaacttctgggtctgtttcatttgcaattcgagtaagatcgccatttgttaccccagactcatcggttgttccaccgacatgagcaagaacgacgatagatttaacgccgagacgttttaattgttgtgttgatttattaattgcttctacttcatcagtaatttgtacattgttaagcatcgtaggcataacgacatttggtgtatcagttgtaacaaccccaatgaatcctacaggaacaccatctaccatttttacagtaaacggtggtaaaaataagcggccagttgatttgttgtagaagttagcagctacataggggaagttagcccctttgaaattccctgttttttcatgatatccaccgtaaatgaggcgttgcatttcatcaataccttcatcaaattcatggtttccgattgtaccgacatcaaattttaagtcatttaaaaattcaattgtcggttcatcttgtaataatgctgaaactggtggactagctccgacgatatcaccagcatgtacgagaagtgtattagggttttgttttttacgttcttttaaataagtagctaagtaatcagcgccaccagcttctttattattgatttttttaacagtatctagttgtccatggaaatcattaataccaagcatttgtacgtctatgtagcggttttgttcagctggattctgagatgggggagcggcaaatacgcttgaaaaagtaatggtgcttaaaacagcaacggcaggaataatttttttccacataatataattctcctttttttataatctgacatcatacgacataattttaatagattcataggattatagctacataaaaatttagtcttttcgaaaaattaacatatttacaaaaagtgaataatagagtgaagacctttttttattgtcgatttcatcgtgtatctactataatggagaaaaaagtaaaaggtga

SEQ ID NO: 1163 - DNA, 6804 bp, Bacillus thuringiensis
ttaattctttttcaccggtttttgttattgctaatgtcagatagatgcagaatatacacccgtgtcttttacaatccctacgcaagcaactaaaatcatcgtaatagattggcgtcaattcaaatgttggtgtaccgaagtaaaatggctgaataccatggaaccaatctgcttctgcaactgcttgcaagcttactttccccataaatgctgcaacgattgtaccgaacaataaacctagcaaaatagagattgaacgaataaatccgtcgaagaaacgatacataatgatgataaatagtaacacaccaaatgctaacgctaagttttcaagacttccgaaatctttgcttcctactccgccagccatatcattaatagcagctggaacaagtgtaactccaattactgtaacgacagatcctgttacaacaggggaaaacagttttacaagctttccaaataatttcgcaaaaataacaacgaataacccggcagcaataattgctccataaatagaagacacgccgtattgtttcccgattgcaatcattggtccaaacgctgtaaatgtacaaccaagcacactggaagcccaataccgaaaaagcgatttgataatgcttggaaaattgtcgcaacgccgcacattaataaatcaattgagactaaatatgttaactctttttgattcaaaccaagtccaccgcccacaataagcggaacgataattgctccagcatacattgcaagcatatgctgcataccaagcgatgcaattttaaatggatgctgcttcatcgtttatttcacctccgcagtttcttgctgtacaaatgtaactgtgccgttatcaagtgatgcaatttctgctagtgattcaacacgaacgccttgttcacgaagcttctttcctccatcttgaaatgctttttcaataacaattccaattcctgcaatactcgctccggcttgctctactaaactcattaaacctaaagcagcctgaccatttgctaaaaagtcatcgatgattaatacacgatcattttcatcgatatgatttcgagataatgaaatttcatttgtttcttgttttgtaaatgaatatacgtttgcaacgtacatattatcttgtaacgttaacgatttacgttttcgtgcaaaaattacttttacaccaagctctaatgcagccataactgctggtgcaatgcctgaagattcaatcgtcacgatttttgtaatgttctcttctttaaaacgtttagcaaattcttttccgatttcttgcataagtactggatcaatttgatgatttaaaaaagcatctacctttaatacgtcaccagataaaacctttccttcgttcaaaatcttttcttgtaatactttcatgtttgttccccctcttatgcaataaaaaaactccaaaagccgccaccactcgttacaagtgagagacgcgcttttggagtttcgcaaaaaaagaatgctaaacaagcaattatattcgtcctcactcatagtcaaagtatttacggtacttcggtagaaacttgcaggccatatccccgcgattatatgagtgtagctaactatttattttatagaaggattataacgtactttttatgctttgaaaagcatttatcaaaaaaacacgtacaaatttttaaaaaccactattttcgttcgagttttgcaaactctttcattcccaattacaacttcgttaaaatgattggcccatcttttgtaatcgcaattgtatgctcatattgagctgataatttcccgtccatcgttcgtacagtccacccatttaaatctactttagaatatcgcatacctatatttacaatcggttcaattgtaattaccattccttcttgtaactgaggtccttgtccttgtttcccaaaatgaaaaattgctggttcttcatgaatctctttaccaatcccatgtcccgtaaagtctcttgcgacagaaaaaccttcatttgttacataactttcaattgcatagccaatgtctcctacatgattaccaattaccgcctgatcaatccctttatacaaagcattctcagctactaacaacaacttttctgcttcatcagaaacttttccaactctatacgtccaagcagaatctgaaagacccccatttaagtttactaccgtgtcaattgttacaatattaccctcagttaaaggaacatcggccggaaacgcatgacacatttcatcgtttacagatgcacatatcgcatatggatacccgttgtaacctttctgttcagatgtggcaccatgcttttttaaatacatttcaacaaacgtatcaatctcttgtgtcgttatacctggctttatcattttcgcaatttctttatgacatgaagcaagtaattttccagattcatgcatcaaatctatttcatttttcgttttaattgtaatcatactacctctacccttccttgctaaacctactatttgctactaaacttctatcatacacaccctctaccaaaatttcaaaactctcaattacaaaaagtaaaaaatatgtatcatatatttctaaatcaaaataaaaaaacagaagatccctctgtttttttaatcacgtttacatatatagttcattttcaagaactcaaaacaaccaccatttgttttctgtataaacgttccaaccgcttcaaatcccgcccttttatacacttttatcgctctctcattaaatgtcgctactgatagtgttatatatttgcatccgtatttttctttgctaaaagctagtccagcattcacgaactgtaaaccaaatccattgccagttatatcaggtctcattccaagtcctatatcaaccgttccattatttattttacaaaccgtaaagaacccaatgagagtaccattttctttcacagaaaatacatgattccctctactctcaccctctaaaaactcagctaaatcttcttcatctgcctctatatcgtaaaaggaatattcccctttataatgccagttatatgcaatctcttccgcctcttcttgcgtcattactgtatatgtataaaccatcttctatccccctataaaaaaaagctgcaagtaagcagctcttttttataactcataaatttctttatacttcacttctaaataatctgctaagtaatttgcatttaacccttcgcctgttacatcttctaaaatttcaagtggctttttcgttttaccatattggtgaatatgttctgttaaccattcacgaattggtgttacgtttccttcttctaataatgcatcaaagttcggaatgtcttttaacattctttgcttaaattgcgctgcatacatgtaaccaagcgcataagatgggaagtatccaaatgagccaccagcccagtgaacatcttgcaatacaccttgcgcatcattttccggacgaattcctaaatatgcttccatcttatcattccaagctgctggtaagtccttcacttgtaatgtaccatcaaataattctttctctaattcataacgcaccataacatgaagcgggtatgtaagctcatctgcttctatacgaatgaatgacggcttcgattcgttaattgcatcataaaattcatcgactgacatatcatcaaattgaccattgctatactcttttaataaatcataatttttcttccagaatgatttattacggccgataaagttctcaaagaataacgattgtgactcatgaatacccatagatgttccactacataacggtgtaccttcaaatttctctgaaatattttgttcatatacagcatgaccacattcatgaattgttccaaacacagccatgcggaaatccttttcgtcatagcgtgtcgtaatacgaacatcccctctatttaatgtaatctcgaatggatgtactgtttcatcaagacggcctgcttcaaagtcataattcaattgctttaatagttctaatgtaaagttcttttgtttttcttttgaaaaattttccgataaagcacttgtttttaatccttttttagactcagagatttcttttacaagcggcacgatgcgctcacgaagttgaccaaatacgtgatctaaaacttctactgtaatacctggctcatacatgtctaataatgtattgtatttatatgtttcgtaaccccaatatgtaataaatttctttttaaattcaacaattttttctaagtacgggcggaacatttcgaaatcagatttttcgcgagcttcttcccacacactctctgctttcgcttctaatttcacatacgcttcgtattccgcttgtggaattttcttatttctatcatattctttccgacactcttcaaccattttcttcgtcgtttcagaaagtttatcttcacgtattaaagcttcaagctctgttaaatagttccccatctcatctgaagtcgacatagcaaacacttcggatgaaagcataccaattacttctgaacgttgatcaacaccttttttaggcgcccctgttcttaagtcccaaaacattaaacttaatgcttctccgtaattttgtatcttcttcacatatgttaaaaattgtttttctacttcatatgtagctactgtcatcgtataaaaacctcccttttctacctcaaacttaattcgacacggaaatctaaattccttttataatagaaaaaaagcttggcaagcgccaagctttctccttataattctttaccttctaccggtagtacgtttttcaccgcttctaccactttctcatcttctgtatcagataagaagattgatatagcacctttatcgtcgctcgtacgaattaaacggccaatcccttgacgaagacgtaaaatcatatacggtacatctacatcccagaatggatcatttacatgtttacgcttcgcctcaaacacaggatcgtttggagggaatggtaatgaccaaatgataacatgtgataatgatgaaccaggaatatctaaaccttcccataaatgaacggcacaaagtacagtctcttcttcattttggaaacgagaaacgagctgactaatttcttgatccccttcatataagaacggaactgacatttgttctttacttacatattctttaaacgctgcaagttcttgcgttgtacggaataatacaagtgtacgtccgtttgttttctgtatattttcaagtgtatattgacactttctttcccactcattttctttcgtatgcgatagtaagtttactgccatttgctcttcataatcaaatggtgaggcaactgagaatgataagtaatcttttacccctaggctatttgctgtaaatgcgaatgaatcgttattagataatgtagcagatgagaagatatacgggattttcttcgagaatactttctcttgtaatacttcttcaactgcacgtggcataattactaacgtgaaggctccatcaccttcttcaccccatgtaattacatttttctcatgcatgaatagacgaagtgaatgttctaatacatctaaatgttcatcaacgatatttaaatcatacgtatttactgtatgcatttcactttcaaatactaacgcatcaccgacttcaccaattttcgcataaagtcgttttgcttcagctgttactttttctgtcacagtaatttctaaacgatcagaaccggcaatttcttttttgttttcttgtaacacatcaaagaatcgctctgtttgccaaattgtttcttctactaaatgtgcaaactcttcacgaatatcgttttgtaataatctcgttaaaagttgctccatcatcgtttgctttaaacgatatgttaaagctttttgagctgcatattctacaagatgtccttcatcgaatacaacacaactactttctggtaataatggaatttgtccttcacgctttcgagcatcgtacgtccaaatatgatccatataaaaatcttgagaacaaataattaaatctgctgctttacgataatgttcacgtgaaagagtttgaccgcaacgatgacgagaatcacaagtgaagcaatcttggaagtaatcccaatttacttttgaccattcttcgtcatttaatagtggaaattcttttcggtcaccatagtgagtaaagttttgcatcgtaccatgatcaaatacgaattgtggtaattcataatatacgtcttcaattacttctggagctcgtccactcataacatcttcaagcttacgtaaacataaataattatccattgatttcgcaagtcttacatctacagataagcctaacgcttcagataatttcgcaatgtctccttcttctttcacaagctgctcaattaacgtttcatctgcacaagcaattatagctggttttccagtataacgcgcatagcaaattgcatatagaagatatacaatagttttccctgttcctacacccgcttctgcgaacataactttcttttcttggaaagcacgctctaattgaaacgccataaaaatttgttcatcacgctcttcaaaacctttttccggaaggatgtcgtaaaacacatctccaatccactcattcaacttatcataaaaattgtcttgttttcctacttcaaatggtaatctcttctcagtaaacatccttagcctccaaccaaaaagtttttctataaaaagatatagtaaccgctacttatatgtgtgcagccactttctcctgttgccatacatataaatac

SEQ ID NO: 1164 - DNA, 4804 bp, Bacillus thuringiensis
tgctaacgttttttgcttactttcatgcattaactttgcaattggcttcttttgaaaaatttgcttcatctttcactcctccaagttttaaattttctgaaaatttttaattcgcttttttattttactcattacgcttttcctagtcaatacttttgtcgaaacaagtagaaattcttctgaatatgcacgatccttattattctttctatatatctttccattatttttttggtattattatacatgtcgattccgtgaaaaaggcatgccccccttattgagagcatgccttttttacttatttcacagtatatgaaccttgttcaatccagctatacatatacttttcatcttctgtttcatgtgcttgttttacaatacgaagcggacggaatgtgtctatcataacagctaattcaagcgtctctttcttccctatacttgcctctgttttccccggatgcggtccatggggaatcccgctcggatgaagtgtaatagaaccttcttccacacctttgcgactcataaagtttccttctacatagtaaagaacttcatcactattaacattactatgataatatggtgctggaattgactctggatgataatcgtataaacgtggtacgaaagagcaaataacaaaattatgcccttcaaatgtttgatgtactggcggtggctgatgaatgcgccctgtaattggttcaaaatcctctacattaaatacccacggatataaatagccatcccatccaacaacatctaacgggtggtgtcctaaaacatgtttatgcatatagcctcttgattttgtcattacgacaaactcgcctttttcatcatatgtctctaatttttctggaccacgaagatctctttcacaaaacggactatgctctaacaattgtccgtattcatttcgataacgacgcggcgttgtaatttggctatttgcctctacaacaagaaacttagtctctccttcatctggaataacacgataaatcgttccaattggaatcgttacatagtcgccttttctatagtgaatcgttccaaacatcgtttcaattttccctgttccataatgaacaaataacatttcatcgccatcaccattacgatagaaataatccattttttctgttggactcactactccaattaacaaatcttcatttccaagtatgaaattacgtccacttattgcatcaccactttttttactttctttcgttcgaaagtggcgatgagaaagagcaacatcctcttcatactgcaactgacaagaatgcgataatgcagaatgacctacttctgttggcatataatgatgatacaaaatagactgcgtaccagaaaaaccttttgttcccattacctgttcacgataaagcgacccatcttttttacgaaattgtacatgtcgtttatgaggtagttctcccatgtgacgataaaacatgcccatcacccgcttccttttcttttttgatcgtattacgtagtgtacctaaaccagtaatcgacagttctacaacatctccatcttgtagccactcttctgtacccagttctaaaatacatcctgttcctactgtcccagaaccaatcacatctcctggatataacgtaacgtcctctgaagcacgttcaatcatttcagcaaatgtatagtaaatatcttggaagtttccttttgataatagttttccatttacatgagcagtcatttctaaattatatcgatcaccattacgataaacgtctaattcctctttcgtaacgagatgtgctcctaaagaagttgcaaagtcttttcctttcgctggaccgagacctactttcatttctgttgcttgtaagtctctcgcactccaatcgttcataatacaataaccaaaaatatattcctctgcttgctcacgagaaatatttcgcccttcttttcctattacgcaagcaatctccaactcataatcaagctttttagactttttcggaccaattacaaaatcaccggaaccaattacagcacgatgattagtaaaataaaaaaccggaatatcataccattcaggcacaacatctaatcctcttcgtccacgagctgtttttacatgttgttcaaatgcgtaaaaatctcgaatactactcggattaggaagagcagctgtcaattgtacttcttctaaagcatatatacccttatttggattcttaatattccgcactacttctacatactcatccgctttctctaaaaaatctatcatagaagaagggattttcccttcactagcaagattcatatctattactttgtcaccttcaagccatccagcccgtagttcttttgaaggaagacgaaatgtaacaaatttcatcctgattcctccttataaaaatgaaatttccaccagcaaagggacttttgctggtggatacaaatcttataagtttccgcgacgctcttgttctctttcaattgattcgaataacgctttaaagtttccttcaccaaatccacgagaacctttacgttgaatgatttcaataaataaagtcggacgatctacaattggtttcgtaaagatttgtagtaagtaaccttcatcatcacgatctactaagatctttaattcttttaacttatcaatttcttcatcgatttttccaactcgtgcagttagctcatcgtaataagtatcaggtgtatctaaaaactccaccccatttgcacgaagcgcttcaactgttttaacaatatcacttgttaataaagcaagatgttgtacaccagctccattatagaattctagatactcttgaatttgtgactttctctttccgtctgctggttcgttaataggaaacttaatacgacttccattcgtcataacttttgacattaacgccgaatactctgtactaatatcgtcatcatcaaaatgaatcatttgtttaaagcccataacattctcgtaataactaacccactcttccattttttcaacattaccaactacatgatcaacagcaattaaaccagactcctcaaatggaatattaaattctaccttttggaatcctggcataaatgcccctttataatttttacgctctacaagcgtatgaattgtatcaccatacgtaccaataactgcttttttcaatgtaccgtcctcatctgttaattcctgcggtggagcaattgcgacggcaccacgtttcactgcttctgagtatgctttatcaacatcatcaacaagtagtgccacatccttcacgccatcaccatgagtctttacaaactctgcaatacgattttcactacttaaagctccagacacaacgaaacgcatatttttttgcacaagaacataagataccttttcacggtttccagtttctaatccagagtaagctacaattttgaatccgaacgctctcgcaagataataactcgattgctttgcattccctacgtaaaattccaaatgatctacatcacgtactggaaaaaagtcctccatttgtgcagctagcgtatccatagatttttgtttcataatatcttcatccccctgtaaatagattaaatggtccatacttaaaaccaaccgaaaacgcttccaacattaattaatagaaattagttagcaagctaacaaattctgacctttaaaattttctatcttttctgtcaaattcctctttttttcttacatataaaattcgacttttttctctttgaaataaagcgggattttattcagtggctttttgattattcgttgaatcaagtttcaaccgcagcgtttaattagccatgaatgctggataatgaggtaactttaatacttgagggtatataagaagaatataaaaaagactccaacatattaactacttactaatacgttagagtctttattttttttgaatgattgtatttatatatctcatactaatacatttgcaaggaatagaataaatgatgttaatattaccgctccacctaaggatcctaataaatctgtttttgttacttgaaacacttgttcactgttcatatccctcattctccttccttttttgtttaatttaaaacttctattatactaatacacttgatagaaatacgattaacgctgttaatactactgctccacttgctgatcctacgaagtcaccttttgttacttgtaatacttgctctttcatatctttcattctcctctctttttcttttattacaaaacttctattatactaatacgcttgatagaaatacgattaacgctgttaatactactgctccacttgctgatcctacgaagtcaccttttgttacttgtaatacttgctctttcatatctttcattctcctctctttttcttttattacaaaacttctattatactaatacgcttgataaaaatacgattaatgctgttaatactaccgctccacttgctgatcctacgaagtcaccttttgttacttgtaatacctgctctttcatatctttcattctcccttctttttcttttgttacaaagcttctattatactaatacgcttgatagaaatacgattaacgctgttaatactactgctccacttgctgatcctacgaagtcaccttttgttacttgtaatacttgctctttcatatcatttatcctccctttttataagttatctatatgtaatttctaagaaatgtttatttcatagtttttatgttaacgttacattaaatttgataacgtaacgtttgtaacatta

SEQ ID NO: 1165 - DNA, 5239 bp, Bacillus thuringiensis
caaaaaaggagtgaacttaaaacgctttcaataataaatactcctatcaaaacatgaacaaggattccttgattataaacggactctagcaatgatacaagtgttggaatacatttcaataatacgctttcaattcccataaaaaattaataaaataatacattactctatctcattctactaccttctagcataagatattgtaaaatcatatcatttaaatcagcgaacgttcttttctaggttcgctaataaacttagtagaaaatgaatataaaaaatgacctcttgcttttatgcaaaggtcattttttatattcatcattaaacttctaaatagccatttttattatttgattgccatttccaagagtcagcacacatttcttctaatccgcgtgttgcctcccagcctaattcacgctttgctttcgatgcatcagcaaaacatactgccacatcacctgggcgacgctctgtaattttataaggaactttcttgcccgaaactttttcaaacgcttcaaccatctctagtacactatagcccatgcctgtgcccaggttataagcatctactcctgttgtactcagtactttctcaagcgcctttacatgaccatttgctaagtccacaacatggatgtaatcacggactcctgttccatctttcgttggatagtcatttccgaatacgcttaattcttttaacttacctaccgctacttgcgttacatatggcattaagttatttgggattccatttggatcttctccgatacgcccactttcgtgtgcaccaaatggattgaaatagcgaagtaatgcgatactccattctgcatctgcaaatgctacatcacgcataatttgctcaatcattaatttcgtttgaccatatggatttgttgcacttaatggaaactcctccgtaatcggtgacgtttccgggataccatatacagttgcagatgaactaaagattatcttctttacattatgtttctgcattacttcacatagcactaacgtgcttgtaatgttgttatgataatatgttaatggaatcgctactgactcccctacagctttaaatcctgcaaagtgaataactgcttcaattgaattttcttcaaaaattgcgtcaagcgcttcgcgatttaaaacatcttctttataaaacttaaattgttttcctgttatttcttttactcgatttatagattctaccgagctattcgaaagattatccactactataacttcgtaaccgctatttagtaattctacacatgtatgactaccaatatatcctgctccacctgttacaagtactgccataattaacaaacctccccattactacatatccttataataagcatgtaaacattaatctagctagaatttaaaatagctaggttaataaaaaatttctttatttataaaaattagtcttacagattttcatcctataaattacccactaattataaagaaactttttcacgaactacagctggtcttcctacggaataatagtctacattaaactttttcacatattctaaaccatggcaattacgaccatcaaaaataataggttgtttcattaatttgatatactgttcaatagggaattcttttatatcatcccattcagttacaataagtgttacatcggcatttttaactgctcctgcaacagagggcacatattgaacctcattaggtaatactttctttgcattttcagtagcaattggatcataagctacgaccttcgcacccatttttactaaatcatttgcaataacaatagatgccgcttctctcatatcatcagtatttggtttaaaagctaaaccaagcatagccacttgttttccttccatatcacctaatacattttttattttttcaacgagcgatgcctgctgattattatttactgtaataactgattttaacagatcaaaatcatgctcgacattaccagcaatttgtattaaagcatgtgtatcttttgggaaacaagagcccccatatccgatacctgcttttaaaaattgtgtaccaatccttttatctaatcccataccattagctacatgctctacatccgcacctaacttttcgcaaatattagcaatttcattaataaagctaatttttgtagctaagaaagcatttgctgcatatttaatcatttctgaacttctaattgttgttttaaaaacaggaacattaaaaggtttattcacttcttccataacatcagcagttttagcatcatcagccccaataactatacgatctccatagaaactatcatgaattgcagaaccctctcttaaaaattccggattcgataccatgttgattttcacatctgctttcaaattttgctgaattaaatttttaacatgatcatttgtaccaactgggaccgtacttttaattactacaatcgaatctttttttagattattagcaatatctaaagcaacttgctcaatatattgtaaattagccgaaccatctgtttgttgtggcgtacctactgctatataaataacatctgcttcttcaatcccttggcgacaatcggttgtaaataacaatctattatcattaatatttttactcatcaactcatctaaaccaggttcatatattggtgaaataccttctttcattttcgcaactttattctcattaatatcaatacaagttacacgatgtccaatatccgataaacaaacccctgttactagccctacataacctgttccgaaaatagcaatattcattttttatcctccttatttattaacaataaaaaaagccccttaaagaaaaaggcttttaaaacttatttaacaaaatgttttacaactccatttagggcataatttataaagcaccatgcagattttaggatacttaacccttcaatttccctatataatttccaattcattttagccattttgaactttttactagaaatagagttttcaacttttctatacttcgataaaacctcatctaagccataggcataatgaccttgtcttaatatttttaaccatgttgcagtatcttggcgggtcctaatgttaggcatttgtactttccctagcttctcaatatccaacatcaccgttaaacaaccaattattgtattttttaataatccattataattaattttttctggcacatgtacaattttatcagtaagggtaccatcttgattcataatttgataacccgtaaacgaaaaagctacatcattattctgcataaaagtcaattgtttttctaatttttcgggtagccatagatcatcgctatctaaaaaagctacatacttccctcttgcattattaatgcccgtgtttctcgcaattgctgctccacaatttttctgcaattcaattaatcgtatacgattatctttcttaatctcttcttttatcaattcacaagtattatcttttgaaacatcatctataataatcatttcccaatttgtataagtttgagattggacagattggattgtttctttaataaaagaacttgcattatatgatgggataataattgacacaagtgattgattccctatttcaatctcacttagatttatttccatttcaatactactccttcagattttctttgatattttcatcaaaattttaacagctctttaaaacttttgatgaatgagcgaattggtttttcagttaaatgaaatttttttacaaagaaaattgttagcatacatatagctggaatagttcctctcatccttttaaataatggtccttttcctgtaaaagtattagaatcaattagtttattttctgatgttttctttttatgaaaaacaataatttgattaacataagctatactatatttctgtttcaataaatctgcgagcaagatattttcttcaccagatggatattttgccccaagaccaaatctctcatcaaacttcaaatctccaatatcaattttatttaaattaataaagaactctattgatgaaatttttaaaaccccgcgaatacctaatttttctataggagcttgtggatattctttataatattgttgaatttcggggtcaaatatctgaaaacttagcgcgtcgatattcctatatttaaatccttcaacaaccgtttcaaatgcgtttttaggataccagcagtcatcatcagagaacgtaacaataccattatccacatattctaaacctttatttcttgcatgagataacccttttttgcttaatataacatgatggtaattaaaattgtatttcattaataaactgctaattctatcatgattttcttgagacacaataataactttaatattattaatagtttgctcttctaaactattaaataagcgtttaatatactcaattctatttcctaacgtgggtactataacattaactaaatattcatttcccaattttctcaccatacttttatcacttaattaataacgctccataattctttatattgctgacgtatatcctgccaagtattattttgagctattttcttagcactgatacttaaatcctctttaatattaggattatctaatattaaattaatcctttcagacagctcctcgtcattatttataataaagtgttctaatcttgtatttttaagcaaataattcatctgaacatctttacttactataactggtgtaccaacagctaatgcctctaatggtgctaagccaaaagtttcatataagctattttggatataaagatttgaataataataagcacttatcaattcactttgatttaaattacctatatatataacctttttaggatccatcatattcattaccttgtcatgaacatttccctttggcccagcgattactaagataaaatcatccctttttatatcattcacaactttaactaattgttcaattcctttgtacttaaaagttccgcaagcagtaaatataatcttttttcttttttctaaaggaataagttcgttaaaaatatttttgtctggctttatagtcagaaatttttcggaaacgccatttggaataactttcaatttcttttttggtattttataatcacttataatcatttcctttaacccttctgacacgcatataataccatctgcaagcttcaaagtaataaatt

SEQ ID NO: 1166 - DNA, 3817 bp, Bacillus thuringiensis
aattcgtgatcctttacttgatctccctaattgtacgttagctcgtcgcacgtggaatcatcgcgtattcaggtgtttctctatccttttccttctccacgcataaatggcggtacacgctcttcaattgttgctgagcaaatcacctttgtatccccaacttcaattaatacagatccctctggatgttttaaataattcgtatgaatatgtatatggcgtaattctgttttctctctaccatctactcgcataaaaataacctcctcttaattactactcgttagtatagccaaatttaaatgtatgatatgtatacaataaaagaaggagaacccaaaaagcaattctcctttcttacttaagtatatcaaattattcaagattaaaaactacctgtattcacgttttctggacgatctacaggttttattaactttccgcccttttcatctataagatttgcttttccatttacttcaatagaaatatttttcacacctttcttttctgttaaagataaaactaacgacttcaatacgtaatttgaaatcatatttttatctgggtttacaaatatattttcattaaagtttaatgtaaggtttccgtcttgtaatttcggattcgtaataagcttaacgcctggattaaaatcatttaggagcgattgatggatcggaccttttacaagctcatctataattgctgcatagtcattttctttaccttccgcaacgcggcgtgtgactggtacgtagtattgctgtttattattattttgcgccataaaatacagtgtgactggttttgtatttgttacatctgttacttgttcatcatcgaagttaataccatttgcacggctcactccttcaccaagcggtgtaccaccaaccggcatttttgccaatttctcaccatttatttggaactgcacttgttttatctctgtaaattgcgtcaacgtccaagctatagattcaacaatttgacgctcttcttctttcgcatagtttttcatttctttagagaaatcaataactgccgttccgtcctttttcaaatctaaggtcatcgttgtattcgccggaatgactgcacgaaacccatttggtaataaattcgttaccggtccatctttcacaaggtattctaacgtttgcttcacagtctcatttgctttcggagtaggtatagctaacgtttgtggtacaacataaccatttttatcaacaaggtatagttctctatttaccatttgcccttgcttatcttttttagctacttctttcttcccaccctctgtatacgtaacttgttttggtggatcaatttgttcagttgctttctcttgatttataaagccacaccctgttagtaaaacagcgctcacagtagcaccaacaacccatttaaaagtggatttaggcatgccattcccccctaaaatctaagtttgtactattatgtatacgagctgtttcacgttttagaacaagctgtgcctcttataaattgaaactttaatcagcaggggtcttactacccagcaaatagcaagataaaacaaaagctcctgatttctcaggagctcacttatataaattctactattattctttttctaaatgaatatgcttcacattttcaatcggttgaccgaaccattttgatgcaatttctttaaacaagcctatttttcctgttgttaagaagagatgatcgctttgttcttctccttcattcaacattttactatgatataagattgtacttacttcacgtgctgtttcatcaccagaactaattagttgcactttatctcccattacttttttaataacaggtcctaaaatcggataatgtgtacaccctaatataagtgtatcaatatcggtacttttcagtggttgcagcgtttctcttacaacttcatacgccatttcactttcgaaattcccactctctacaagttcaacgaaaggtggacaagctaaactttctaccataacacggttattaatagactttaacgcctcttcgtatgcaccacttttcaccgttccaatcgttccaataatcccaacgtgatacgtgtttgtcacttttaaagctgtacgtgatcctgggtgaataactcctactactggaattggtaattgtttttgcatctcttctaatacaactgcagttgctgtattacacgcaataactaacattttaatatttaaatttagtaaatgctccgtcatttcccacgtaaatcgacgtacttcttctcgagaacgtggaccataaggacaacgtgctgtatctcctaaatatatgatacgctctttcggcaactgacgaattaattccttcgctactgttaaaccgccaactcctgaatcgataacaccgattgctctattcaacttcatcacccgttttctcattcatcatcttttatgtttatcattatattttacacactttaagttcgctcacttcaaatgcttctgtatgaaaattttcatttgcccatgtatagactaggaccttttttattttgctcctttttttcgtaatttgcaagatagaaaaataaccgaccttctataagaaagtcggtttcttctatataaagtgcatattcattgctccatctttttttgaaaagaagacattcccgttaataagaagaaatgagcagaaattaaaatgacgataatttatttacagccctttttatagccttacctatttccacgctagactgtggattttgtcctgtaattaaatgaccatctactactacatgcggcgtaaaattgggggctacataaaacaaagctccttcttctttcaacttactttctaacaaaaacggaacgcgcttttctaaatgtacagctctttcttcatcgtttgtataacctgttatacgcttacccgcaacaaaaaacgagccatccttatttttcacaccgactaaagagcttactccgtgacaaacagccgctacaatccggttattgttatacatattctcaatcaaatttgctacatatggattacctggaaaatctacaatcgccccgtgcccaccaccaaataaaaccgcatcataatccgaaaaatgaacatttgaaatcggcctcgtattttgcaataaagaagctacatgcttgaattcgcgaggtataccattcggaatagacactctatctataggtactctcccaccttttattgacacaatatcaacatcaaacttagcctttttaaatacatgataaggagctgcgagctcttccagccacaaaccagtcgggtgtccattcatatcatgagcacttgttgaaactaacagtatccttttcaacatatcccctcctcgtatagtatgtttaaacttaatttttttactttcatgagagacctgtaaaataactcttggacgtctcaagatatttctagataatggtcttaggatcatttgggacaattcttaccgctcctgtggacttaccacataattaagagtgtttctcagtgaacgtgcgggactccctactcgcaggctgagcagcctgaccctcgaacctagatgttagtagctctagggcggctttcgattcaggactagctctcatacacgaggttgttggtcggcgtgcacactagagatatctcgagacgtccgaggaatgattctaaatagaagggaggtctcttacatgagattatttgttggtttagatgtaagttcgtttgatataaaagcaagcattctaaatggtgaagggaaaaagctagataccaattcggt

SEQ ID NO: 1167 - DNA, 7512 bp, Bacillus thuringiensis
attgtgcatttggataaggaccaaaatatttccctttatctttttttacgtttcgagtaatgagtaagcgaggttgcttctccgctgtaattttaataaaaggatatgttttatcatcttttaattgaatattatatttcggatcatattttttaattagatttaactctaaaataagtgcttctaaattcgaagaagttacaatatattcaaaatcaacaatttctcctacaagccgcagtgttttcccatcatgtgaaccagtaaagtacgagcgcacacgatttttaagcacttttgcctttccgacatatataaccgttccttgcttatctttcatcaaataacaaccaggttgatctggtaaaatagccaacttctctttcaaatgttcgtgcactcgtctccctccatttctacatacttagcatttttattttcccttgaaaacatactatgcccaaacacccaacatacgttcttttattgtaacggaaagactgtaaaaaagaaaataaaaaaagctaccaaatggtagctttttttattttagaagtgtttagaaactaattctactaacgcttctttcggtttgtaacctaacgcttgatcaactactttaccgtcttttaatacgaaaagagctggaatgctcattacttcgaattgacgagcagtttcttggttttcatcaacgtctacttttactacttttactttttcgcctagttctgcatcgatttcctctaatacaggagcgatcattttacaaggtccacaccaaggtgcccagaaatctaataatacaacaccttcgctagtttcagctgcgaagctttggtcatttgcgtttacaattgccattttatttcctccttcaagtatattctaccaagagtatatcattaacttatatacgtggcgaataatatgtatcgttatgtattgtaacaaaaaaatgttcctttatactatataaaaatacggattaaatactaaaaagatgagagacaggggatctctcacctttttctatatataggggtacttcacttggaactcaagggtactaaaatcatgaatgtacttttaactttttaaactcttctgttaaaagaggtacaacttcgaataagtcaccgacaataccgtagtcagctactttaaagatacttgcttctggatctttattaatcgcaacgattatttttgagttagacatacctgctaaatgctgaatcgcaccagaataccacatgcaatgtataagtctggggtaacaactttaccagtttgaccaatttgtaatgagtaatcacagtattcagcgtcacaagcaccacgagatgccccaacagcgccgcctagtacgtcagccaactcttttaatggtttaaaaccttcttcactcttcacaccgcgtccaccagcgataataactttcgcttcagaaagatccacaccttctgccgttttacggacaacatcttgaatgattgtacgtaaatctttcacatcaactgtaatagaagatacgtcaccgctgcgagactcatctttttccagagttgcaatgttatttggacgcactgtcgcaaataagatgccgtctgttacaatcttcttctcgaatgctttaccagagtaaattggacgagtgaagataacatttccaccttcaacctctaaagcagttacgtcagaaattaaaccagcttcaagcttcgctgctaattttggtgataaatctttgccaagtgctgtatgtcccaagacaataccttctggattttcttcagcatgtacagctaaaaacgcttgtgcataaccatcagatgtatatgattttaatttatcattttcaactgtcacaacgcgatctgcaccgtaatgaatcaattcatttgcaaaagaggcaacgctgtctccaattagaagacctactacttcaccgccttctgcaattgtttttgctgctgctaccgcttcaaaagaaacgttacgtagcgatccatcacgaacttcacccattactaatactttacgagccatagattttccctcctgcatatataatttcgtattttattagattactttcgcttctgtatggagcaacgatacaagttcttttacttgatcttgcagctcgccttgtaacacttttcctgcatctttcttaggaggcaaatagatttcaattgtttttgtctttgcttccacatcatcttcttctaaatctaaatcatctaattctaattcttctagcggctttttcttcgctttcataatacctggaagcgatgggtaacgcggttcatttaaaccttgctgtgctgttactaaaactggtaatgaagttgcaatcacttctgtatcaccttcaacatcacgctcaatcttcacatttgtaccgtcaatttcaagttttgtaattgtcgttacatacggaatatttaacgcttcagctacgcgtggtcctacttgtccagatgcaccatcaattgcaacgtttccgcctaaaattaaatctgcatctttatcttttaaatattcagcaagcacgtttgctgtcgtgaactggtcgccattttcgacgtcatcttcaatattaattaatacagctttatcacagcccattgctaatgcagtacgaagttctttctcactatcttcgccaccgactgttacaactgtaacttctccaccttgtgcgtctcttacttgaattgcttcttcaattgcatattcatcgtaagggttgatgatgaattccgcttcgccatcgtaaattgcaccgtttttaattacgattttttcttctgtatcaaatgttcgtttcatgagtacgtagatgttcattccatttacccccttgtttttcagaaagattctatcaattttaattttctgttaatttatattaaaaaaataattgaactacctgccactaaatgaaggtttacgcttttctaaaaatgcagctacacctactgtgccatttgatactcgtaaatacttgaccaaaaatctgtgattcacgttgtacaccttcatagtaatgagacgattttgtcgtttgcaataactctagtacagcacgagttgttgctggactttttccagcaatttgttttgcaactttaagcgtatcatctaaaagagattcttcagagaacaatccgttaacaagtccccactttaatgcttctgcaccagtaattggtgtgcttgttaacatcatttcacaagctttcgctttcccaacataacgtggtaagcgctgtgtacctgcaaagccaggaattaatccaagtgttaattcaggtaaaccaagttttgcactttcagttgcaaagcgcatgtggcaagacatagcaaactcaaggccgccgcccagtgccgctccatgaattgccgcaataactggttttgaacatttttcaacacgctcaaacgtaacttgtccaagctgtgctaattctgttgcttgcttcgcttcagtaacagatgtaaattctttaatatctgctcccgctgagaagaaacgtccttcaccatgaataacaacaacacgaatgttatcatccttttccacttgatcaattaattcagtaacgtcatgcataacttgtgaagacatcgcattcgctggtgcgtgatttaacgtcgccaccgcgatatgatcttcaactcttacagataggaatttcaacatgatccctcccattattgacgataaccacaagctgcaataagtagcccgtgtaccgtttttgaaagtgcgaccagatcatacttatgatcgctcattacccaattggtcacaacttcatccactgttccaaagatcatttgtcttgccacgcgaacatttaaatctgcttgaaattcaccttgttttataccagtctctaaaatctcatccataacttgtaagtagccttttaatacttcatttattttaaggcgcaagtcttgattggactgcctcagctctaattgcgtaacgatagcaagaggatcattttgcgacaacagcaagaagtgcgtttctaccaacatgaataacttcgatacagcgctttcaattcctgctgttttttgacgaattgtttcgacaaattctcccatcttctcttggaataaggatattaatatatcttctttatttttaaaatataaataaatcgtgccatcagctaccccagcttgctttgcgattttagaaacttgcgcttggtggtacccattctccgcaatcacaatgactgccgcatcaataatttgattgtatttcggtctatttttcttcactttactgtccccttcaagaagatgactgaatgaatagtcattcatattcttataatactgactatttagaaaagtgtcaatcctattttttcaaaaagaaagggccttagcccgtttgctcatcctcattctttctcttctcttcatctattagaacacggcgcaaaattttccctactgtcgttttcggcaattcatctctaaactcatatactttcggcactttataagccgctaaatatttacgtgcaaactgatttaattcttcctcagagcactccgtaccttcttttaacacaacaaatgctttaactgtctctcctcggtacggatctggaactccaattgtcactacttcttgcactttttcatgctcatataatacttcttcaacttcacgaggatacacattaaatccactcgcgacaatcatatctttcttgcgatcttttacatagaaaaatccatcttcatccatgtagccaacatcacctgtatggagccagccatcttgcaatacagccgctgtttcctctggcttattccagtatcctttcataatttgaggacctttcactacaatttcccctatttctcctggcggtaatgcctcaccagtctcaagtgacataatgattgcttctgtatctggccacggaactccaatgctacctggcactcgcttttcccataaaaaattactatgtgtaactggagaggattctgttaaaccatatccctctactagtttaccacctgtaactgtttcgaacttttcctgtacttctactggcagtggtgctgatccactaatacaagcacgaatagaagaaatatcgtattcttttaaaagtgggctatttaaaagagcgatataaatagttggtgcccctggaaatagtgtcactttatgcttcttaatcgcttcaaaaaccattttcatatcaaactttggaataaggaccattttgtatccttgcataacactcaaattcataacagccgtcatgccgtacacgtggaaaaatggaagaaccccaagaacgacttcttctccttctttgcaattatataaccattgaactcccattaacgtgttagagacgaggtttttatgcgttaacataacgcctttcggaaatccggttgttcctcctgtgtactgtaaaagagctagatcattttcaggatcacaaggctcctcaacatccgtattcacttctttttctactgaattccaaagatgaatcgtttcactctctgatactttcacaactaaatttgactgttttttctgcacaaatggatacaatagatttttagggaatggtaaaaagtccgcaatacgagttacgataatatgctcaatttttgtagcagattgaacattcgttactcttggaaacactaaatcgagacaaagaattacttttgctcccgagtcatgaagctgatattctaattctctctctgtatacagtggatttgtttgtactacgatacctcccgcaagtaatgtgccgtaataaccaattacagcttgcggacaattcggcaacataatagcaactcgatcacccttttccacaccgagcttttgaagataatttgcaaacctcttcaccttatcatggaagtccgaaaacgtaatatccttccctaaaaagtgaagcgctttcttttctgggtagcgagaagccatctgttctacatatctatgaagcggctgaatatcataagaaatcgtactcggaatttcctctggataacttttcaaccatggtttttccaccttcattcccccttcaaatacataaaaataaatgaatgttcattcatgatggttattttcattatattatagtcaccatagcgttacaatcataatattctgacttttgtataactatgctttacttcattaacttcttattatatgtagaaactctcttaatcttaaaagagtaagagagttatagtttaacttaatcttattatcgttaacactgctcctggagtagttgttgataatgttgcgacagctaacaaaccaaataattgcaagctaatagcatctcctgctgcaagagttgtaatgattgttgcactaaatgatgtggttgctaccgcaggagcattaatcgtcccagcaagtgcccctccattaattgtaatccgtgaactgactaataatgaagccgttatattaattgtatatgaaatataataattaccagcatttgcaaccgtaaatactgtgtttccaccagaaacagtaattcctggaccgatgttttgattatttggaagcgggacattcgttccaccaagaactacagatatcgctgttcccgacgtattatttgcaaatgcatatgtcgccgtgatacttgtacctgttgctccggttggacctgttgaacccgttgatcccgttggacctgtcgctcccgtcgaacctgtttgatcctgttgaacccgatgatcccgttggacctgttgatcccgtcggacctgttgatcccgttgatcctgttggacctgttgaaccggttgaacccgttgatcccgctggacctgttgatcccgtcgatcctgttgaacctgttgctcccgttgatcctgttggacctgttgctcccgtcggacctgttgatcctgtcgctcctgttggacctgttgaacccgtcggacctgttgctcccgttggacctgttgctcctattggacctgttgaacccgtcggacctgttgctcccgttggaccggttgaacccgttgaaccggttgaacccgttgatcccgttggacctgttgctcccgtcggacctgttgctcccgttggacctgttgagcctgttgaacccgttggacctgttgctcctgttgatcccgttgctcccgttggacctgttactcccgttgagcctgtcgctcccgttggacctgttgaacctgttgaacctgttgaacctgtcgctcccgttggacctgttgctcccgttgatcctgttggaccagttgctcccgtcggacctgttgaacctgttgaacctgtcgctccggttgaacctgttgaacccgtcggaccggttgaacccgttggacctgttgatcccgtcgatcctgttggacctgttgaacccgttggacctgttgatcccgtcggacctgttgaacccgtaggacctgttg

SEQ ID NO: 1168 - DNA, 6583 bp, Bacillus thuringiensis
  unsure (1)...(6583): unsure at all n locations
cgtgatttccataagaaacagattgtactagcttatcttctgacaaatacgcaaaattcgtcatctcttcttttactgctttttcatgaacttcattccaaacttttagatgctctgtaatttcttttttatgcttattccactctacttcatctaaatggtacaacggaggaacattatacaataattcagacagcattcgatttccaacttcatcttttacctttaaacttccccattcccaatgatgcgttgtaataacggaatcattgtatactaatttatataatggtaccgaatatactgggtttaaatatacttggttatattcttctttcaatggtacttgttttgcatatttttcaggcacattttgatttggtgaccaatatccaccgacataatacggacttgttttatttttccgcatatcttcatcgtcccatttaataacaggtgtttcaattccgtgtgcaaatgcaatcgtactactagcaaaatcatttccgccttcagaaccaacgaccatacccttttcttgcgcaatgtagtccattcgttttaaacgtgcttttaaatcttgctcttgtgtcgttatatgtttcgctgaatagtcatcgtaaatttcacctgtcgcatcacaatcaataaaccatgaattatatttaggaccattttgtaatatatcattcatgcgttcctttacactaggcagcgataaagtcggatttaacttgcgacctcttcctaaaaagccttgcaccttttctccgtttttcttcgttacagtagcctcttcgtataatgacgggtcattaaaggatgctgtgttccaatttttatcacttttttcgtgaatggaatgatacgaatcatacggaccaactaaataccccatttccttagcttttgtcacgaaattaggttgcataaatccttgttcccagttcggcagaccaatccacgctttttctattcctgcctctttcatttcctttaatatatccgttccatctgcattaccccatttacttacctcttcaaccgcatcaccaagtagcgactttaataaatgcttatttaagctatacaattctgtattcgttaagtgacctacacctttctttaatagcacactagcttcctgattaacgttttgaaaaatatcctctttataaaattccttcatcgataatacttcgtttatataacgtaaaataacatttttttgatacttatcaatgaaatcttgtttacttacttgatccaatacattcagttccccaggctcggaactattcttttgaataagttcttttatatgactaaacagcgggctatttatttgctcccttagttttggccaatttatattattttctaataaaccattttgattccaaaaataaaaatgcgccgctccatataacttttcgatttctttattttttctagccttttcttgtaatgttttaaattcaccttttcgaacaatatcatccttatacagtttagcaatgcttaccgcatcattatttgtcacatataattgaaatccatatgttttatttttatttatgctcggaaattcatgtgtaaaatcaaatcctattttcggatccgaatgaaatttcaattcattattaaacatattcgttgcaatatatacaattgaatatctcgaaccatttaatgcgaaaaacttcatagaaaatgattcagcaaatgaatatgcatcatcctttaaaaacttcttccaattctcatcattgctcggaatttgcttaccctcccataacggaagtgtataattttcagcttctactttcggccatgtaaagctttctgcaccagtcgattccacttcaatgtttaagtggtcttttttcttttctaattttatttttactttttgatctggatattcccacgatgtacgatccttttctttttttacattcgataccttcattttcggtaggggttgtgatgcctgttcctttgccccctcatgttctacagttaatgtgaatgtttctggatttacatcataagtaaaatctttatacgtcgctttctttattttagactcttgtacagcattactaccttttacgtcacaaccgactaaagtcgaaaacgacatagttgtaagaagacatatcgctatcatttttttcatcctctgcacctccaccaatgaatatacagatgctttgttacaggaatgtggcaaaaaataatagagctagcattttgctagctctgtttggagtattaaaagttgatatgaacaactataattcgcttagaaaatatgtaatacagtaactacattttttctcaacaattatgaaactaaacaaatcaaaattttaacaagcattcttcaactgaaaaaataagtgtatacaatatatcctaaaagtagtactaaaatgattattcctgtacctttccgattcataccgcctgctatatcaactggactacccgtttccgctctattgagtccgtcacgtaaagaacccgtaggattactttttaattcactttgtctcatacgctctcttttttcttctggtgactctttattcatttaatcacctccaaaatgaatgcactctttacttacattattcaaaatcaacatttgttttatatttttccgaaaaaacctaatttaaaataggtttgcaacgtaaagaaagctagccatgccagctttctttacgatccaatatgctcttccttatttacaataatacctttatggtcgatttcaagctcacatactttcatatctgtaaatactctcgctaattgctcagcgatttcttgacgcttctcatatggcgttaatataaaaatagatggccccgcaccactaagtgctgtgccgtacgcaccaaattcttttgcgcatttacgaatagatggtaataatggtacgagttctaaacgatatggttcgtgaaaatggtctctctccatcatttcacctacaacttcccaccgcttttgacataatgcagctactaatacgttacttatcgcactagctttaactgcctcatgaaacggaaacatctttggtaatacagatcgactttcatctgtatttaattctgcattcggaatgagagaaattacccccaattccttgctctcaattcttacgacggaaacatcctttccatcaagtgctccaattacagttccacctaatatagaagcagcaacattatcaggatgtccttcaaaatttgtagcaatttgaactttttgatcagcagttaagttcaaattgcctagttgattcgcaagctctatcccagctacaatcgctgatgcactacttcctagccctctcgttaatgggatattactagtaacttctattatatggggtgatatagaaggacatactttacatgccgtgctaacgattaaatttttatcgtctgtcggtattgattcttcaaaggaatggattacttgccatttatcagctttttctttaaccaccacacctaaatacaatgacaaagctattccaactgaatcaaatccaggaccaacattcgccgtactagcagggacacgaacgctaaatggtatcacgacataatcacccctttaatatgatctttaatttgttctatatcatttgacacacttgcgatgtctagttgatttgaagaaatagcgatatcaggatccttcaaaccatttccagttaataccgcaacaactgtttctccctttttgattttcccagattgaacatgtttaattacgccggctaatgaagcatttgatcctggttcagcgaaaactccttcagtttttgctaataacctatacgcatgtaaaatttcttcatctgataccatatctatttcaccacgagactgctcggcagcctctactgcatacgaccaacttgctgggttaccgatgcgaatcgctgttgcaattgtttcaggctcttcaattacatgcccttttacaattgcagctgctccttccgcttcaaagccatgaattcttggctttttataacctttttctttctcatattcacagaagcctttccaatacgctgtaatattccctgcattcccaacagggatagctagaacatctggtgcattttgcaattggtcacaaatttcaaacgctgctgttttttgcccttcaattcgataaggatttactgagtttactaacgtaatcggctcttctgcagcaatatttcttacagccttaagcgcatcatcgaaattcccttctattgaaataatttcagctccataagcgaccgcttgcgctaattttccatgtgcaatctttccttctggtattacgataatgcatttcatcccaagacgtgccgcatatgctgcagctgacgctgatgtattacctgttgatgcacaaatgattgcttctgaaccttcttctttcgccttagcaactgccatgaccataccacgatctttaaaagaacctgtcggattcgctccttcgtacttaccatatagctgaatccctaattgttttgatatatttaataatggaataagtggtgtgtttccttccattaagctgacatcaggtgtattttcattcaccggtaaataagacgcatattgttttaatagtcctttatacatattgtttttcctcctcaataatgtagtaactgtttatttcacttgcgacagcttctatcgcttctaaaactcgttcaaattgatacttggaagttcgatgtgtcacaacaacgacttctgccagttcacggtttaaaggtaattgaataacctcttttaaacttacagaataattaacgaaacattctgttattttttgtaacatcccaggctcatcttgtaatgaaatgcgtaagaaatatttcgaaactacttcttcatcaccttgtaattcataaggaactggttcttttaacgcacttttatttttcggaacttgattcatatttttaacgattgaaataatatcacttactacagcagaaccagtcggtaacttcccagctccgggtccataaaacatcacttctcctaccgcttggccatggacatacaccgcattaaattcattattcacatttgataatggatgctggctcggtaaaagcgtcggttctacacttaaatgaatggctggtccttgtttttcagctttaccaattaacttcatagtaaatcctaacttttcagccatttgtaaatcttctttttcgacctttcgaatccctcttacttgcacatcatctaatgaaacattcatcgaaaaacctaagtttgcaagaattgctacttttctcgccgcatctagtccatctacatctgctgtcggatccgattctgcaaagcctaatttttgtgcttcctgtaaagcctcttcataagaccatccattttgactcatttttgttaacatataatttgttgtaccatttacaattcccattattttttcaatttgatctgatgctaacccatcagttagtcctcttaacactggaataccgcccgctacactcgcttcgtaacataaatcacaatcattatcgttcgccagttgaagaagctctgcaccatatacagccattaaatctttatttgctgttacgacatgttttttatttcgtaaagccttaacaatatgctgatttgcttcttcaattacgcccattacctctactacaatatcaatatttgaatcatttagaacttcatctgcatgacttgttactgcaattccatcaatacaaacatcgcgttctttttccaaatcacgtacaacgactgttttcactttcacttcgtatcctgtatcaagtgcgatttttttataatgttctttcaaaatatgaacaacaccacttccgaccgtacctaaacctaataccccaacatttataacgttattcatcttctaatctcctcctaaaagtttaattgttacatctataaatcaccttactctgcttttttgtcatgcaggtggtggttatttccgtacttataaatcgtttcatattaccgcacctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctggacataagcattatgcgtccagggctgaccaaactggagaacctatgactaagccatttccctgtcagaatcataaagaaggcggacaagcactgttagaatggatgtaccaatatattgagtctcctacagaaatnctgataagaatggagacatcaggacattattggtatagccgtttattc

SEQ ID NO: 1169 - DNA, 6403 bp, Bacillus thuringiensis
tgtcttgacctgttaaatttacttttattaattgatttccgaatggttgaataccatatatctctcccattgtaatatcaccagcatctaagtcattacgaataccaccaggattcataagtgcaatttgggattgcattgttgtacgctgggcatcagcacttaaatttccaagagtagattcaccagccgtattgagtttgcgatctagtggcgcaatagacttacctacaacttcattaacaagaggtgcgatttttgcttgatatttctccatcttcttctttatttttttatcaggctctatgccttcatgataagttgtaacaatttctgcttttttctcaacaatatcttgtgttttacgatcaatctttacatcaacatcagcaaaagccataccatatgaatttgcttgtacgacaagtttattattaacagttccatttacataagtgtggctatggccaccaaaaataacatcgacttctggatcagtctcatttgctaatcggacgatatcaccatttgttacgccgttcccatctgttatacctccgttatgtgcaagaacaacgatagatttaacgcctagtttttttaattgctttacggatttgttaatagcttcaacttcatctgtaatttctacattctttagcatagtaggcataacaaggttaggaacatccgttgttacgactccgataaatccaacaggaactccttgtaccttttttatagtgaatggtggtaaaaataaacgaccggtggatttattatagaaatttgcagcaacatatgggaattttgctcctttaaaattccctgttttctcatggtatccaccataaataaggcggttcatttcttcaacaccttcatcaaattcatgattccctatcgttccaacatcgaatttcaaatcatttagaaattcaatcgtaggttcgtcttgtaataatgctgaaacaggagtacttgctccaacaacatctccagcatgtacctttaatgtattcggattttgtttttcacgatcacgtaaataagcccctaagtactcaattccccctgcatctttattgttaattttttttacagtgtctagttgcccatgaaaatcgttaataccgagcatttgtacatctatgtagcggtttgattctgtacttgcttgggctgaaggcatagcaaatacactagtaaaagtaactgtacttaatgctaaagcaactggaatgatttttttcaacataaaatttctctcccctaattaaaatctgacataatacgatgttattttaatatattaagagaattatttccacaaaaattctaccaattataaaaattaataagatttcattgttttctgacaagatatttcttcctcaaaaaatgtatatttctttgttttgagaattattcaaaatattatcttgatagtaatataacaatacttctaagaactctaaaaaactctaatcgatttattttagctgttaagaagagtattcaatccaaaattaatggagatttatcaacctaacatctcaatatcaccatttaaaaagatgctcctggatttatccaagagcatcttttataaagctttattttttacttgtttataatttatcaattaacaattatatagttgtaatcagtcatttaaaaataataggagtgcttcattaaattctttggcatgcgttgcatttagcccatgtggaccaccctttattaacgttactttagaattaggaattgcttcatgtgttaatttcccactatattcaaatggtacagttgcatcagaatcaccgtgaataataagagtaggtatattaaacttctccaagtcttttctaaaatctgtcttactaaaggcggtaatacaatcaagtgttcctttaggtgatgcactggctgcaatatcccaattatataaacggaatggctcactaactaaatctgttcgattaccagctgcgaaaaatcccttagtaaattcatcaagaaatgcatggcggtcattaatcacaccacttttgaacgcttcaattgttgcatcatctaatgccccttcaggatgatcctctgatttgtataaatatggaggaactgctccagcaaaaacagccttttcaatacgatctgttccatacgtactaatataccgggctacttcgcctccacccatagaaaaaccaacaagtgtgacattttgaagctctaaatgttctaataattgatgtaaatcagaagtaaaggtatcatattcatacccttcccacggctgagatgattttccaaaacctcgacgatcatatgttataactctgtatccagcctcaacaagagcgggaacttgatattcccaagattgaccacttaacggccaaccatgaatgagtacaactggttttcctatgccatgatcctcataatatatctcaattggtgcttgattttcggttcctacagtaatttttgccattttcctacctcctttaatatatatccttttcttcaataatccggatgaatctcataacctatttatgcacatttatattgtgaacgctaagtatgaaactctattgttccgatgaattcattttctgtttatggaacgcttccccatctcatacttttttcatcacgaagtatttgctgaacatttctcctattcaattgtaataacaaaagtaggtgactatcaatatcgttctatctatagaatgtataggtaaaaccaattcattttatagtgaaaataactatagttaccacctatacaaactatagataatttagaattgattaacgaatcagttttcaaatactataaatttgtatagcgcttcatgttccgtgaatgctgctataaccaatattattggtcagcttagttataaacgaagaaacttatgatagtattcgactatttaaactttctttgattacttaatttttaggaggaatacataatgactgatctctattctcgtattaacaaagatgatgctctcgtgcttttagtagatcatcaaactggtcttatgtccggactagtacgtgactatggtgttgatgaattcaagaacaatgttttagcccttgctcatactgctaagttttttgatttaccagttattttaacaacaagtttcgaaaacgggcctaatggacctttaatgcaagaattggttgatctctttcctcatgcaccaaaaatagctcgacctggacaaattaacgcatgggataatgatgattttgtaaaagcaatcgaagaaactggaaaaaaacaacttatcatcgcgggcgtagttacggacgtttgtgttgctttcccagcactttccgctataaaagctggatatgaagtatttgctgttactgatgcttcaggaactttcagtaaacaagttgcagatgctgccaatacgcgtatggcacataatggcgtacaacttatgaactggtttagcgtagcttgcgaattacaacgcgattggcgcaacgatgtcgaaggttttggcaatttgcttgctagcaatcttccaggctatcaaaatataattggaagctataggggagctcaacgagatcttagtaagcaaaatgtataagtgtattccaaggaaatagctttaaatcactttttaaagtagatagtataaatttagtgctgattaaatcagcactaaattttacattaaaaagtatagcagtgttttaattgacagaaaatatattattttcgataaacaattaaaaaaggagcgttttattatgagtaagttagaattgttaaatccggagaacagtgcattaattttgattgattttcaaccccaaatgacttttggagttgcaagtattgatagacaaacattgattaataacgttatgttgcttgctaaatcagcaaaaacttttaacgtacctactattcttactacagttgagacacgcagcttttctggttatttttggccacaaattcttgacatattcccaaaccatgaaattatagaacgcagttcaatgaactcttgggaagatccaaaatttgttgaagcagttaaagcaacaggtagaaagaaattaatatttgcagcactttggactgaagtttgccttgcattccctgtgcttgaagcaatgaaagctggctatgaagtgtatgcagttgatgatgcttcaggtggtactagtctgacagcacataacgctgctatgcgtcgtgtagaacaagctggtgcaattccagtgacagcaattcaagttttacttgaataccaacgtgactgggcacacaaagacacttatgatgctgtaatggaaattgtaaaggagcacactggcgcttatggtcaaggagtagaatacgcatatactatggtgcacggcgcgcttccaagcaggaaaatatgaaacaagaaggagtagctgtcgaagagacttatacagggaacacgatggatgctgctgatccagtaacaacgattgttacatgggaaattcaacaaggtaaagaaaaacagtttgaaacatggagacatgaaatcgaagctgccgctactaaattcccagggcatttaggtgtaaatctaatagtcccaaataacgaatcgagagagtatactgttatttttcgctttgatacgtatgagcatctacgtgcttggcaagaatcagacattcgccgggatttgttaaaaacggcagaacaatttcaagttactaatccgagttacaaaactgaaagtagtttggcttattggtttgttactccgaaaacgccagttccaccgccaaaatggaaaatgtctatcgttacccttttgggtgtatggcctcttagcatgttagttcctaaagtgataggacctattataaaacatatgaatcctattatgtcggccttttttgtttcagtatgtatagtgtccttgctatcatgggtagtcatgccgattttcggtaaattatttcatccatggttacaaaataatagaaagtagacgaggtgtgaacatgaatttaccggatatgatcttatataacggaaaaattactacccttgacccttctcagcctgaggtatctgctatcgccataactgatggtttagtcactgcagtaggtggagatgagcttcttaatagtgccacggaaaaaacaaaaaaaatagaccttaaaagaaagagagctattccaggcctgaatgactctcatatacacgttattcgtggtggtctgcattataatatggaattacgttgggaaggcgtgccatcactttttattgctctagaaatgctcaaagaacaggcaaggcgtacacctgctcctcagtgggtaagggtagttggaggttggtctgaatttcaatttaaagagagacggttgccaactttggaagaaattaatgccgtttctgaagacactcctgtctttgtgctacatctttacgatagagcacttgtaaatcgtgctgggctgcatgcactgggatatacaaaagatacaccagaccctccaggctgcttaattgagcgggacaaacgaggtaatccaacgggccttttaattgcgaatcctaacgcttctattctttattcaagtttgggtaaagcaccagcacttaattttgacgaccagattaattcaactcgccattttatgcgcgaattaaatagattaggtattacaagtgctattgacgcaggtggtggattccaaaattatcctgatgattacaaagttgttgaacatttagccgagaaggaacaattaactttgcgtattgcttataatctatttacgcaaaatccaaatcatgaatatgaagactttgcttcatgggcaaaaattgtttctccaggtcaaggaactgataagtataaaatgaatggtgccggagagatgttagtattctcagcagccgattttgaaaaatttcaaatgccacggcctgaactagctacgatgatggaagctgacttaaagaaagtaatttctctattggtggaaaaccgttggcccttccgtttacatgcaacttatgatgagtcaatcacacgtttcttaaatgtattcgaggaagttaacagtgaaattccttttaatggtctacgatggtggtttgatcatgcagaaacaatctcagatcgtagcatggaacgtgttaaggctttaaatggaggtattgccatccaagaccgcatggcttttcaaggtgaatactttgttgatttatacggaaaggaagctgcaaagcgtactcctccgatttatcgtatgttagaccttggtatacctgttggcgccggaaaaaatgcaactagagtttccagctataacccttggatcacgaatggggttc

SEQ ID NO: 1170 - DNA, 5507 bp, Bacillus thuringiensis
acatgtaatctctttctgttcttctttaggctttactttctctttttccaatttcttccgatagacaagacgttgcgtgtcattcatcttcccaatatttttatgaatattatccagaacttctttttgcaaaggctgcaactctttttcttgtgttaatccagtgtacacctggcgtatataaaagtttgtggtgttgtacatattcttagcgttatgacaacattcttgaaaataagaatacatacgatgccctttttttatccagatttgaagagttttatagtttgatggattttcttttgccattttattcacctccttgttaaggatattatagcaaaaaagaacatacgtttccgtttttttctcaaaaataaaatattcctttcaattcacctcaccaccttcatttacgtttagagatgggagtcctctcgaaaggcatgatagaaaaaatcgtttttatagcaaaacatatttattgtctgtacacctaattaactatataataacatgtagtaagaaagccttttcaaaacattattattcatcaagggggtacttataatggatcgagttcaaatggctgaaacgctagaattttctcgtattattcaaggattttggcgtttagcagaatggaatatgacgaaacaagaattactttctttcattgaagattgtatggatatgggaatcactacttttgatcacgctgatatttacggcgcatatacgtgtgaagggttatttggcgaagctttacaattaaagccttccttacgagaaaacatgcaaattattacaaagtgtggaatcgctcccccatcaccgaaatttccagagcgatatgttgctcactacaatactagtgcagagcatattatgcaaagtgtagaagcatcacttaaaaatttacatacagattatattgacgtattacttattcatcgtcccgatccttttatggatccaaatgaagtggcaaaagcattttcacaattaaaacaagaagggaaagttcgtcacttcggtgtatctaacttcttaccttcacaatttaatatgttaagttcgtacttagatttcccgcttattacgaaccagattgaagtttctgcattgcagcttgagcattttgaaaaagggacaattgatttatgccaagaaaaacgaatcaatccaatgatttggtcacctcttgctggtggggagatctttactggtcaatcagaacgcgccgtacgtgtacgtgaaactgtgcaaaaagttgctactgagctaggtgtttctagtatagatacggttatgtatgcttggttacttgctcatccagctaatatgataccaatcgttggctctggtaaattagatcgcgtaaaaactgccgctcttgctacaaaagttaacttagaccgtcaacaatggtttacaattttcgaaagctctaatggacatcctgtaccataatgcataaaaagaagagctgttttcttacagctcttctttttcatatgtatttctagtcatggcaaatacacacatatctcttaatccgtttccatctaccgcaacactcgcactttctaacgtaccttctaacttaaaacctaatttctcaggtatcgctctactcttcttattgaaagaatcacaacgaatttctacacgatttgcttttaattcagaaaaagcgtaatccgttatacctttcgcagcctctaccatatagccttttccgctaaaccttgtatcaatccaatatccgatttcaaattgaggtatatcccaattaatacgatgtaatccggctgaagcaataaattcacctgtttctttcgaaaatactagtaatcttaaatcctcacgttgcaaaaattgaatatgtgattttctaatactttcttctacttcttgctctgtttgctctttttgtgcaaacaccatccaaggttttagttcttgtattgaagcctgaattgcatcatatacaactttaccatctcctggtttcggcattcgaataaaaagtctgtcagtataaaattcagaaggaaaatcgaataataacggattcactgtaaacactccctatatttcttttatatataataatatccatctgaagttatatagtaaagaattttctgaattgaaaaccttttactcattcacttccaccgctacacgaattccagattcaatcgcaccttgaatccatccgtgatatagcgttgtatgatctccagcgaagaatattctcccctctggtttgacaatcgctggttgcagctcagattcttgacctgcttgaaaaagtgcaaatcctccaagcgcatacggatccaatgtccagctttttgaaattccagatatgaactcatcatacacttgaccacctaatattgttgctaagttgtgtaatgcgtaataaatacgatccccttttgataaaccatcccataacaacgcgtcataagaccatgtatagctacctaacatcatagccggtcctttctccccaattccataatttggataataggcataacgaattggcaaatctgttataattctgccacctaattgtccttgttcttcccaaaatcggcttttaaattgaattcctattttcgtcgcaggcatataatgtaattcacgaattgctttccatttttcatgagatatagaatcaaacggatctacttctacaaaacgcattgtcgaaaacggaatggtaacaataactaaatctcctgtaatactactatattcaaaagtttcctcgttccgatagaaagctgtcacaccattatcgtgttgatgtaacttcattaatttttgattatatataatattctcttctaattgcggtaaaaatgactttggcaatctatcattcccgcccacaatttcacaaaatccgctctcctcttgcataatgtatagaaagcgtaaagtctctacaaacgaccgttccaaaaaaccttctaaatctaataaaacaccaatcatctcaattgttactggcgaaaagtaagtattatactgataaggatgatactttaaaaattgtccagtagagtatctcccaaaatcctttacaacaatatcccaatttttttctgggttcttttttataaaatttataatgggctgtaccgctaacaataataattcctctgacgtttttccaacttcattcatttccacaggatatcttagaatacttggatctttttcatattgttttaacgtcgttttccgtccatttacgtatataatatccgtctcattcctattaataaaaggactcacctgtagcccaaattttcttatatatgccatcgttaatgtatgcgaatacggaattctcattgctccaacatctaaatataatccggtatcttccattctcactgtttctatacggccacctacccggttatttgcttcaaaaattttcacatcatgtcctgcagcctttaataaagatgctgaaactaacccagccataccagctcccactacaataatctgttttgggcttatcgtcttcttcaatcctttatctataacttttaacgcttcatccatttcagtgttatacattatatctttctgcacaattccaccccttacttcatcaaatggacgttagtggtttagtgcattttattcataaatccccataaacataacaccattgcaatttgaatattcactaaaagtacataagagacagatctcacttttctttatacttcgtataatatagcaactacaaagaaggagtggttaaaaatgaaacatacttatgactacgatgctacaaaaaaacatttagaattaaagaaacaaaacttatgtaaaaaacttagcaatatgacactatctgaaaaagaacgtgaacaactaaagcatgaaattgacaactatgaatatattttaaatctagtcgaaatgaatcattatgaacgcggattttctcgttaaaagcggaaataagattatccgcttttcattttgagcatttcactacgcatttttcataagtaaatatataataggatgtacattaagattgagaggtatattctatgatcaagttaagtgtattagaccaatcacctatttcagatggtagcacagcagcccaagctttttcacatacagttacgcttgcacaagaagttgaaaaactcggattcacacatttttgggtatccgaacatcataattccgtaagcttagctggttcaagtccagaaattcttatttctcatattgccgcaaaaacggaccgtattagagtcggttcaggtggtgttatgttaccgcattatagcccatataaagttgctgagaatttccgtgttctagaagcattgtatccgaaccgcatcgatctcggtgttggtagagcacctggtggtatgccaatagcaactcgcgcacttcaagaagggaaaatggtctcacttgatcaatatccagaacaaattgcagacgttgcaatgtacttacatgatcaagtaccagaaaaccatcactatgcaaacttaaaagccactccagttatcccaacgtctcctgaaatgtggatgctcggttctagcggagagagcgctaaaattgctgcaaacaacggagcttctttcgcatttgcacaatttattaacggcttcggaggccctgaagttatgagggcttaccaagaacaatatgagccttcatttttaggagataagcctaattcaatcgttgccatctttgttatatgcggagaaacaaatgaagaagcggaaaaaattgcttctagtttagatctatcaatcttattattagagcaaggaaaacgaactactggtacaccttctattgaaactgctcaaaattattcatacagcgcttatgatttattccgtataaaagaaaatcgtcaacgtatgattgttggtgatccgtcttctgtaaaagaaaaaataataaacttaagcaaagcatacaatactgacgaatttatgattgtcacgattactcatcaatttgaacataaattaaattcttatcgcttactagcaaatgcttttaatttataattctaaaaagagatgcatcacgtttaaaatgtaccctatagaatagacacttgaaaaaagtctattctatagggtatttcttgtataataaaaggaaaattgggatcggagaatgttgaaaatgacaaaaaaactatttacagaaagagaaattcaaattctatcaaataacctatacgtaaaatctgtaagtcagaaaggtatcacttatacagaggaatttaagcatatttttattgaggaaaatgaaaaaggaaagctacctcgaaatatttttgaagaatgtggttttgatatagatatgattggaatgaaacgagttatgtcatcgggaagtagatggcgtgctgcttatagaaaaaatggtgtattgggtttaagggatacacgtatcgaaaacgc

SEQ ID NO: 1171 - DNA, 7543 bp, Bacillus thuringiensis
caaaaaatgcaaactgatatcaatttgttagcgaataatttcacaaatcaattcaatcaatatatgaatgatatgaatacaggcgatgctttaaagcaattaagtgcattggaatccgctaataaaattatttcaaatcaatttacgttttcagagaaagaaccgaatattttaactgatgctgcagcgattcaaaaatatttagcagatgtaaaaaaacaagtatctgaatatgatacagaacttgcaggaaagttagaaagtgatattcaagagacggtaattaagaagttaaagcaatctatgtcgaatgatggaaagcaagaaatcttcataaatacattaatgaaacaaccagatgctcgaataaagaaacaaatcgagaatttaattgcgaaattacctagtttaaacatggaagaaatcggtcaaagtgatttgccagatacaacgaaattacaactgcaaaatgtaattcaatttacaaaaaaatataataaagaaaataatttttattatgatcctgtaaataaaatatctttaggaaacgctattaaagaagtaaaggatagactttatacagagggaattacatttagtgatactgcgaaagtaattaaaatggaatctccgcaaattttgaagataaagattccagaagaatttaaactagatggaagtacaggattcttacatattgatggtgaggatcgtacaagtgattttcttcaaagcgaagcaggagaaattacaatagctcctcgtaatgaaggggatataaagattgatctgcatgtgaagttaaaagatccaaacatcaatatagatgttttctctcctgtaatgtggcagtgggaattgagtgggactcataaaaaagaaactagtcctgaaaaagaaaaacctaacaaagaagataaaggaacacaaacggaaaatagcaaggtggaaaatgtggttcataaatcacagtatggcataatgccgttagtacacaatgctaaaacgcctattatcaaaaaaatggaaaacacaacaggcaataatgaaggaagccaaggaggcggaacagggaaagataacggaactggaggaaacccaggaggcggaacgggaacagataacggaactggaggaaacccaggaggcggaacagggaaagataacgaaactggaggaaacccaggaggcggaacgggaacagacaacggaaccggaggaaacccaggaggcggaacggggaaagataacggaaccggaggaaacccaggaggcggaacgggaacagacaacggaaccggaggaaacccaggaggcggaacggggaaagataacggaaccggaggaaacccaggaggcggaacgggaacagacaacggaaccggaggaaacccaggaggcggaacgggaacagacaacggaaccggaggaaacccaggaggcggaacgggaacagacaacggaaccggaggaaatccaggaggcgaaacgggaacagataacggtaaagttactgaaagtacaacgaatcaagtagtacatcaaaaagcagaagtattaacaaaaaatatatctagtgtattaataaaagaagcagtagatacagtcgaaagttatcaaggtttaatgagcctttacgaaatgtattatgggattgatttaagaacgaaagatgtaggtcctaagttagaagagggaagtttagatgcaattgcgacggatcaatctttgtactacgtattaaataaacaaagtttaattgatttaatttcaaatcttgtttcatcaagtattactacagaaataaagcaagatatgtcaggtttaaaacaaaaaaataaactcttatcaacaatctattactagtgcggatcaaaattctatgctactagcggagaaattaaatggaacgacgcaacaagcaactagtatgaatgaaaatttaggagagtatgtaaaaggtttagcgaaatggcgtgagaatagcttaaagctagttgaagagcagcaagtattaacaacaaatcatgctggtgagcaaacagctattttatcgttagattctggtattaaatcattaatgatgcaaagtcagtcattggtcgaaagttcgaagcatagtttagcaacttcagacgatgtatataaaacatttgatcaaattaatggacaagcaaaagaaattcaagacagcggaacgacaattgtttcaaaagctgatctattattaaatgactttacgaagaaaatggaagatgataaatcattctccaaaaactttacgaaaattttagcgaatagccgtattggagatcgtcaaaatgagatgctatatgactttttagctagtccagttcaaaagcaaaatgatggagtaattgcagcaggtaatgcttttacaccgtacttaattgtattaacttgtttcattgttgcattatttacagcatacgcaattgcgaatcaagaaaagaaacgaatgcaatcagatcattttgaagagaaattctcattaattgatatgaatgtaccaactacagtagtagctttcggtatatcaattgtggaagggattagtataggtatcatttctgggcgtcttttaaagttcggtcaggatcaaagtttactatggattgcgttcatcacatttattatgatggcgtttgtattggtctcaacctacttattacgacaaataaaaatggtaggaatgtttatactattagtatttttaagcatgtacctatttttaactgaggcagttggaagtaaagtagatcaaatgtcgtctgtcggaaagatacgtcaattctcaccgcttcagtatatagaaagttttctaaatgattttattagtggtaaagatactgggaaagttatttttgtcgtattgtttgtaattgccattattggattggttagtaatctatttgtatggcataagaaatgggaggaaaaagaagtaaatgatcaaacaatggagcatagtggctaagttatcatttctctctatccttttactgtttgtcgcgctaccgataaggagcgcggctgacagttatcttggtgatgatgggaagattaagtttaaagtggatcgacttgaagaaagcgaccaagaaaaaaataaaaaggaacataaggaaacagaattagataaagcatcgattgagttatttaacaaagatatagaggaagaaattgagaaaaagaaaaagaaagaacaaaaagatatggaagctttgcgagattctctttttacaaaaccaaaagagaataatagtgttaaagatacgaaaaatagtttatttagcagtgaatacattgtcagaaaaagtgcagatgaagtagcgagtaatgaaacaatgaatgaagagccaattagtataacaataatattattatttggcggcggcattctacttatttgcatcggtatttatacggttcttcgtaaaagttggaggtaaagtgatggcaatacaaacacatatcaatgtgacagtagattttagtaaatggaatggaaatacatatgatttgcgtattccgaatcatcaatctattaaatatttattaaaaaacttattagatacgctaaagattgataatcatgaaggttcacattttgtaattaaagtgaaaaataagtcaattgttttaacagataatgatcgtttaattgatcaccaaataacagatggagatattttgcaagttttataaagaatattttttacttttagttatttgaaaataagttattacgggttataaagaaaaggagaagaggataaacatgacggaaaaaataattcaaattgatgcaatgaactatcaatttcaaatagaaaaagaaaattggaaattggagatgaccaaatctcaaacacgtataaaagacttccgtcaattcgatataattacgggcgaatcatctgaatttgtactattaacaatagaagaaacggatgatatgtttacgtttctatatcaagtagataaaaaattatataagtgggacgatcttagccgttttggaagaaatgagaaattaagactacttcggaatgttgcgcagtttcgtaaatatttaaataaacgaatcacgttctttttacatccagacaatatagtttttaatgctaatttaataccaagtattatacatagaggaattcgagatattgttccgccaaccccattattagaagagcaatttttaacacaatataagtgtctaattattgctttattctcccaaaaacataactttgatgatttgtatgctgggttactaaaagatgcaaaagaaacaacatttgaacagaccgttgctcaaatggaaagcttagatgcattactgcagtttcttgatgacagctttgagaaggaacaaacaaaaacagaaaaaaatatgcagttagtacctaaaaaaagctataaatcatttaaatacttagctttttccttcatagcggcgacagttattttagctgctcctttaatatatttcacttttataaaatttccttatcaaaataaattgttagaagcaaatgcaagtttcatagcaactgattatgacaaagtcattacgcaattgaatgaagaggagtttgaatcattaccgattgcatctaaatatgagttagcatttgcatacattacagctgaaaaactaggtgaagctcaaaagaaatcgattatgaaaaacattagtttgaaaagtgatgaaaagtatttgctgtattggatgtataacggaaaaggtaattttgataaatcattagatttagctaagacacttgatgatcctcagcttattatgtacggccttgttaaacaaattgaatcactgaaaaataatccggatttatcaggggaagaacgtgatcaaaagttaaaaacatatgagcaacaattagatgaatataaaaagaaatatggcaattcatcaaacgataaaaatttgtcggacacagagaaaaaagagtaagcacttgatgagacagttgaaaaggagcagtgaacacggatggagcaactattagtattgacttatggagacaaaatatataagtgcacattacatccaaatgagcaatcaatagtgtcgattggaaaagagtggacaaatgatattacgaatccaagtttagaacaagaagtagagttaaagtggaataatgaagtaaatgcttggatggtacaggatcaattaatagaattcaataaggaaattgagattgggaaaacaagagatgtgagcttgaaaatctttatatctattgttggcacaactaaagtgtttgatattggaacgaaacattctcttacagtgagtcaaaacgattacgatgatatttctattaccgggactagtgtagatttaatgctatctcgcgaaacgttgtacgattcttttaaagtgaacgtgtatggcggggatgtatttcataattatacgaagttaaaagatagcgttatgttggaatcaggagacgtattatattttgatggtattttattggagattggtagtgaagacattcaagtactttcttcagaagataaagtgaaatctgcgttacctattttagtagaatcagaaacgaattatcaaagtggttatccagactatcatcgttcaccacgtattatttaccgtgaaccagaagagaaaatgacaattgcaaagccttcaagtatgccatcaaaaccaacggagcatttagcaagaatcattgcaccttcacttgtcatgattgtcgtaactgtattacttgctattttcatgaaatatggaatgtttattatcgcatcgattgcgatgacattagtaacaatcattgtttctgtcacatcgtatattaaaaatttgaagcaatataaagtcgacattgttgaacgagataaaagctatagagagtatataaaacaaaaaacgaaagatttacatgcagaaagtgaaaaacagcgtcacgcattacattatcacaatccaaatgtagaagtaatacgtaatatggcagttcaagtaaatcctagaatttatgaaaaaacaatgttacatcatgatttcttaacatttagcgttggaacaggacaagctaatacgagttttgaaattcaatttaatgaagaagaatttagtcaaacgaaagatgaattaatcgatatagcacgtgaactaagacagcgttatctatcattggaagatgtaccagttgtaacagatttaatgaatggaccagtcggttatattggccaacgctctttagtgttagagcaattacaattattagttgcacaaacggctttattccatagttattatgacttgcagtttattactatttttccggaagaagaaaaagaaaaatgggattggatgcgctggttacctcatggaagtgttcgcgatataaatgtacgtggatttgtataccatgatcgtagccgtgatcaagtgttaaatagtttgtatcaaatattgaaagaacgaaaattaaaactagatgaaaaaagttctactaatgaaaaaatgtactttgcaccgcactatgtcgttctcattacagatgaaaaactaatattagaccatgttgttatggaattctttaatgatgatccgagtcaattaggtgtatcacttgtatttgtacaagatgttatgcaaagtttaccggagcatgtgaaaacggtaatagatataagagatgcaaaacaagggaacatcatcttagagcaaggagagcttgttaaccgtcaatttaaactaaatcacgtaccgaaagggttcaatttagaagatatttcacgggcattagcaccattaaatcatttgcaaaacttaaaaaatagtattccagaaagcgtaacatttttagaaatgtacggcgttgaaaaagtaaaagaactgaatatcacaagtcgttgggagaaaaatgcagcgcataaatctttagctgtaccacttggattacgtggtaaagaagatatcgtaaacttaaacttacacgaaaaagcacacggaccacacggattaatagcaggtacaaccggttcaggtaaatcggaaattatacaatcgtatattttatctctagcagtcaatttccacccgtacgaagtagcctttttactaattgactataaaggcggcggaatggcgaatttattcaaaaacttaccgcatttattaggaacaattacgaacttagatggagcacaaagtatgagagcgctcgcatcaattaaagctgaattgcaaaaaagacaacgcttatttggggaaaatgatgtaaaccatattaatcagtatcaaaaactgtataaagaaggcttagtaagtgaaccgatgccgcatctatttttaattagtgatgaattcgcggaactgaagtcagaacaaccagaatttatgaaagagttagtttctcacgcgcgtatcggtcgttcgctcggaatccatttaatattagctacgcaacaaccgagtggtgttgtagatgatcacatttggagtaactcgaca

SEQ ID NO: 1172 - DNA, 4036 bp, Bacillus thuringiensis
tatcaattttctactatgcaaaacgaagaggaagctcaaaaggttcaagaattatttaaaaagaaatttataaataaagcggtagagccctttgggaagtttggactattaaaaatgaatgaattaacgcctcttcaaaggagagttttagtcgaaaagcatttaattagtccaaatctagcagggactgaatatggagcatgtctgttatcagaaagcgaacacattagtgtgatgcttaatgaggaagaccacattaggattcagtgcctatttccaggactacagttatcaaaggcgcttcaaagcgccaatcaaatagataattggattgagaaagaggttgaatatgcttttgatgaatcacttggatatattacgagttgtcctactaacgttggtacaggattaagagcttctgtaatgattcatttaccagggctggttttaacaaaaagaattagccgtattatacaagtaattcaaaaattaggtttagtagtaagaggaatatacggtgaaggtagcgaagcgttaggtaatatatttcaagtatcaaatcaaatgacgctagggaaatccgaagaagatattattgcagatttaaagagtgtcatgcagcaaattatacaacaagaaaaattggccagagaattaattgtacaaaattcgagtattgagcttgaagataaggtttatcgttcttacggtatactagcaaatagtcgtttaattcaatctgcagaagcggcaacttgcttatcggatgtacgacttggtattgatctaggatatataaaaggtatatcgagaaatattttgactgagctaatggttcttacgcaaccaggtattttacaacaatacgcaggaggacctttaggaccagaagaaagagattatcgaagagcaaccttaatccgtgagcgattacgtattgaaaaaaactaagcgcaagtaggaggcgatttctatgatgtttggaagatttacagaaagagcacagaaagtattagctttatctcaagaggaagcaattcgcattgggcataataatattggaacagaacatattttacttgggcttgtacgcgaaggtgaaggaattgcagcaaaagcgttaattgctcttggattgagcccggagaaagtgcaaaaagaggtagaagcgttaattggacgtggaacagaagcttctcaaactgtacattatacacctcgtgctaaaaaagttattgaattgtctatggatgaagcgcgtaagctaggacattcttacgttggaacagaacatattttacttggcttaatccgtgaaggtgaaggtgtagcggcacgtgttttaaataatttaggcgtcagccttaacaaagcaagacaacaagtgttacaacttcttggaagtaacgaggcaagttcaggtcaccaaggtggttcatcgacaaatgccaatacaccgacactagacagtttagcgcgcgacttaacagttgttgcacgtgagaatcgtttggatcctgttattggacgtagtaaagaaattcaacgtgtaattgaagtgttaagccgtagaacaaaaaacaatccagtgttaattggagagcctggtgtaggtaaaacagcaattgctgaagggttagcacagcaaatcgtaaataatgaagttcctgaaacgttaagagataagcgtgttatgacactagatatgggaacagtggtagctgggacgaaatatcgtggtgagtttgaagatcgtttaaagaaagtaatggatgaaatacgtcaagcagggaatattattctatttattgatgaacttcatacattaatcggtgcaggtggagcagaaggtgcaatcgatgcatcaaatattttaaaaccatctttagcacgcggagaattacaatgtattggtgcgacaactttagatgagtatcgtaaatatattgaaaaggatgcagctttagagagacgtttccagccaattcatgttgatgagccgagtctagaagaatcaactcaaatcttgaaaggtttacgcgatcgttatgaggcccatcaccgtgtgtctattacagatgatgcaattgatgcagctgtgaaactttccgatcgttatattacggatcgtttcttaccagataaagcaattgatttaattgatgaagctgcttcaaaggttcgcttacgttcttatacaacaccaccaaacttaaaagagcttgaagtgaatcttgaggaaattcgaaaagaaaaagatgcggctgtacaaagtcaagagtttgaaaaggctgcttccttacgtgatatggaacaacgcttacgtgagaaattggaagatacaaagcgtcagtggaaagaacaacaaggaaaagaaaattcagaggttacggtagaagatattgcaaatgtcgtttctacatggacacgtatccctgtttctaaacttgcacaaacagagactgataaattattaaacttagaatccattcttcatgatcgtgtcatcggccaggatgaagcggtagtggctgtagcgaaagctgttcgtcgtgcaagagcaggactgaaagatccgaaacgtccaattggttcatttattttcttaggaccaacaggtgtaggtaaaacagaattagcaagagcattggcagaatctatgttcggtgatgaggatgcaatgattcgcattgatatgtctgagtatatggagaaacattcaacttctcgcttagttggttctcctccaggatatgttgggtatgaagaaggcggacaattaacagagaaggttcgtcgtaagccgtattcagttgtcctattagatgaagtagagaaggcgcatcctgatgtatttaatattttactacaggtattggaagatggtcgtttaactgattctaaaggacgtacagttgacttccgtaatacgattgttattatgacgtctaacgttggtgctgaggcgttaaaacgtaacaaacatcttggatttaacgtacaagatgaaagtcgtgattattcggatatgaaaggtaaagtaatggatgagctgaaaaaggcatttcgtccagaattcttaaaccgtattgatgaaattatcgtattccatatgcttgagaaaaaacatattcaagaaattgtgactcttatggtaaatcagttagtgaatcgcttaaaagaacaagaaattgaattgcaattaacagaaggggcgattgcagctattgctgataaagggtttgatcgtgaatatggtgctcgtccactacgtagagcaattcagaagcatgtagaagatagactatcggaagaacttttaaaaggtgctattgagaaaggacaaaaagttatctttgatgtagaaggggaaacatttgtcattcatagtgctgaaaaggtaaaataagtatagacaaactaagagggctacgagatagccctctttcttgtacgagaaggtcaaatgtttatagatgaaagcgaagtgaaatataaaaagatatggctaaaaagaaaacaaaattcacatgtcaagagtgtggttatcaatcaccaaaatatatgggtaaatgtccagggtgtggtcaatggaattcgcttgttgaagagatggaacccgttgtatcatccagacgcctaaattatgcaaatgcaattcaaacagaagtaacaaaaccaagacgtcttacagaagtagaaacaaagtctgaggcacgtattgaaacaaaatttcaggagtttaaccgtgtactaggtggcggaattgtagatggatctttagtacttattggtggggaccctgggattggaaaatcaacgttattattacagatttcctcgcaattagcagatgcttcatatgatgtattgtatatatcaggtgaggagtcagcaaagcagattaaacttcgtgcagatcgtttacatgtaaatggtagtaatctatttgttgtatcagagacagatttacagcgtattgcagcacatattgaagagatgaatcctgcttttgttgttattgattctattcaaa

SEQ ID NO: 1173 - DNA, 4978 bp, Bacillus thuringiensis
agcgcttttgtttttcacttgtaacattaggcttatacttgttggcagatgactggaaaagtattttttacttcccaggtattctttcaattttagttggtatttatgtattaattacgatgaaagatacgcctcaatcttgtggactaccttctattgaagaacatactggagaatatccaccagatgaaaaagtaaaagaccgcgaacgcgagcttttagtaaaggaaattttatttaaatacgtattaaacaataagtttttatggtacatcgctattgcgaacgttttcgtatatttcgtacgttacggcgttgtagactgggctcctacttatttagtagaggaaaaaagctttactcatagtagctcacgtactgcttacgctctatatgaatgggctggtattccaggtacacttctttgcggatggatgagtgataaactatttaaaggacgtcgtgcacctgctggtattctatttatggtcggtgtatttatcgcagttcttgtttactggttaaaccctcctggtaatccaatggttgatagtatcgcacttgtcgcaattggatttttaatttacggaccggttatgttaattggtctacacgctctagacttagcaccaaagaaagctgctggaactgcagcaggcttaactggattcttcggttacttaggcggagctgctttcggctagtgcagctatgggctttatcggagatgcattcggatgggatggcggattcatcttattacttgcatcttgcgtacttgcaatgttcttccttgctcttactttaaatacagggtcagtaaaacaaaagcaagcttaaataacatataacaagcataaaaatagctcttagcatttacatacatgctaagagctattttttattttcattgctgttcctactaatgataacaaccaattccttccctactataaaattaaaagatttgatgaaacacctttattaaaacagctaacgtaacagatgtagcaaatccccctagacaaattaagcttaccccttgactatatgacaaattttgaaatgatttcattacttccatcctccctatctcccctttgatacttttattttaccaatgggaaaaatctcataacatcgatttctctaacaactaacttacaaatttgtaagttaacatcttttcaacttatatatctagtatttccacaaataagagtcatttatacataaaaaaagacctcagttatactaaggtcttcgttacattctatttcattttataatcatcaccggacatttcactcgttttgctattttatgacttacactcccaagcaccatttcttgcagtgtattgagccctctacttccagcaatgacaagatctatatctcctgtatttacatattgaacaattgtatctccaggatcaccatgtaatatcgtaattgtataagaaatgttctctttctttaataaaccttcaatctcttttaatttatcttttcgactagccgatattgtttctaaatctgtttgaccttgtataatatctgattttgccgttctattatctactacgtacacaacttcaacatttgtttcttcgctacatttcgcaatatatgttgcatgctctgctgctcgaagtgcatgttcagaaccgtcacatgctaatataatttgtttgtacatatgctgaatccccttttcgttatcctactcgtattatataataaggccccctaaaaaggaggcttttaactagcaattcttttattataagtcgctaaatttgcaacaagttttgaactacgttcatttaatcctgttatagttactttcacaccactttgttcatacttcatgataactttatcaattgatgccactgctgaatcatcccatacgtgcgcatgagtaaaattcatttcaattccttttacatcttctttaaatgaaaaattatttatgaaatcggctgtagctacaaagaaaagttgaccgtgaatttcgtatattttcttattttcaatatataaatgtttcacgtgaatctttgccatattgaatgcaaataacaccgcactaattactgttccgataattacacctaatgctaaattatgtgtaattaggacaatcacaactgttacgatcataacaaatgcctttccttttggtactttatgaattgttgttacagagttccaatcaaacgttccgattgaaaccatgatctttaacaagcgttaccattaataatgccattgcacctgttgcagctgaaatcatcccagttcttccgccaacaaatgaaatggtaactgcaatacaaaaggctgcgtatagtccaactgttggatccacgcctgcaataacagagaaggctatcgcttcagggattaatgctaaagcaacgacaattcctgataacacgtcccctctcacattagaaaaccaatcattttttatcgtttgaaacaaaataccactcctctactcctttatcatttgattttctccataagaaaatctagccgactgcacgaaggctattatataacgagtagaagattttttactatgtaaaagtttcctaaagaaaaagacgctatatcagtagcgtctttgctcattttattaatgtccaccgtgtccttgaccactttcctaaacaatttctaacctctcatctagtattccttgtgtttcaaatgaaatatcactcgtacttcctaataagaaaccgtgattatatggttcaagtgttggatcatctttaaacttcggctgaatgcttgcaaggaagtcatacactggttgtgaagctttaccttcttctaataatacaacaggtgcatgtttacccatatgtgaaaaaggtgccccagcaactgctaaatctggtgttttacttgaaacaaatgataaaccgtgaccaggttttgtgaatccccagccaaattttgttttttcatctttaaatttagcgaacgcaatcgagttttctgtaggggtctctccactaatacgcgttactttcccgtatttgcttagctctttttctacttcttttgaaacaattttttctggccctaatacatatatatttgctttatcttttctcatttttaatgcctctattgtcgcttctggcactttattcttttctgtatagagtagtggttccggcatatgagaaatccaatttacagcgggggttgtatataaacgtccttcttctgcagacgaaccgataataacactatttggatagcttcctgttatatcggcatactccttatcaacatccttcgcaaatatagctgggtccgtttcttttatttgttttactttataaccttttaattgttcaagcgcgctagtacctacatctcccatcaccataatttgtgttccatctttcgttccgattggatttaatcgttttatttcttttaacgtcatttccggtatcttttctttttctataaataaaatcggcccgttattcggatgatgaataagatctgcactcgcaatacctaattgccactcgcttgctggtactaaaataacagcacctggctggttctccttatgagttgctggccatatcgtttgcgaagttaatactgccatttgcaaagggtcatttgtgtttaatctcgttacattttttaaacttgtcgttaataaatcattagatgcaccttcgttcatttcttttggcgccgttacctcctgattcattttcatttccttttgctctgttttcttctcttttgtagattcatggtttttatggtctgtattcgtttgtccgcatgcagtaagaccaactgctgtaattattgttatcccaaaaattcgggtcatttttttcactataccgcctccgtattaatcatttttgagccaatatgattacctaaaatgtaatttcaactccacaataacaagcaattctgaagaaattatgcagacgcatcataatctgcaccatttcttcatgattttgcattacactttaagtaacgattataaatatggagggctctctatgattgatatactgctcgtagacgatgaaccgagaatgcttgaattattaacgctttatcttacaccaattggatataactgcgtatgtgcgacttcaggagaagaagctattttacatatagaaaatcgaaactttaaatttgttttactcgatattatgatgccaaagatggacggatgggaaacgtgcaaaaaaatccgatcttttagtaacattcctattattatggttacagctcgtgatcaaacagtagatgtcgttcaaggattaaaacttggagccgatgattacgtaacgaaacctttccatgaagaagaacttttcgcaagaattgaagccgttttaagacgtacaaatgaacataaacaaatccaatatcacggtattgtatgggatgaaacaaaacacttcgtttctgtccataatgaagagctccttctcacaccaattgaattttctttactcggattatttttacgtcatgtgaactacgtattaagccgcgatcagctcattgaacgaatttggggattaaatacaaatacagaagatcgaacagtcgattcgcatattcgtaatttacgtgataaattgcgaaaagcaaatttccctattgatcatcatttaaaaaccgtgtatggagtaggttatcgatggattgatactgaacagtaaggggtaaaacgatgaaacgaatttcaattcaattcggattttattttttaattgttacacttttaattgaaagtgttctatttgtattgctctattatagtctcgtaaacactagagtaaatgaagaaatgacagctttattaaaacgtggaaacagtcatcgtgatgtacttgaaaaatattatgataagcaaacaatctctcacgtagcattaataaaatctgaag

SEQ ID NO: 1174 - DNA, 8166 bp, Bacillus thuringiensis
aaaaaacatgtgagatggaatttaagttgaaataaattagggaccaattaataatatgaagacgctgtcataaaaagtgaatagagttgtgaacataagcaggacaaagggaaaatggggaatgtaatatgattagtattccgaaagacgaatttcaacaaattcttgtgaaggatttaatgatttcatcggaaaaagtagctcatgtccaaattggaaatagtttagaacatgctttactcgttcttgtgaaatctggatattcggcgatacctgtcttagatccaatgtataaactacatggtttgattagtactgccatgatattagatggtatgttaggattagaacgtattgagtttgaaagactcgatgatatgaaagtagagcaggtgatgaaagaagatatacctgttcttaaattagacgattcatttgcaaaagctttagaaatgacaattgatcatccttttatttgcgctgttaatgaagaaggctattttgaggggattttaacacgtcgggctattttaaaattgttgaataagaaagtaaggcaacataatcgataacgtaagaaaagtgacttcatagaaacgaagaagtcactttttttttcgtgcatatcacttgtgtatgtattatatttaaaaagacataaaacataaggaaagtttgcgctggacaattgtattttctgaatgaaagcattcgggtaaattaaggatgaaaagcttattgaaataaggtgtatggaagctaaggaaagagggagaaagttgcaaattgatgattttcaaatgatggttgtgttagctcaggaatcaaatatgagaaaagcggcggaacgtttatttgtttcccaacctgcgctgagtcaacgattacaatctatggagaaacaatggggaatgaagttttttattcgctcacaaaaaggattgacaattacacctgaaggggaaaaagttgcaaattatgctaaagaaatgttgcaaagggaagaagatataaaaagtgagctagctgttttcagaacggaaactcatggaacgttaaaaatagctgttgcatcagttatgggtcaatattggcttcctcctgttttgaaaaagtttgtgcataaatatccttctgtcaagatatcgctgtttactggatggagtagtgaagtgcaaaagcagttttatgaaggagacgttcatgttgctatactgaggggaacacaagaatataaaggtcagaagcaacaattatttgaagatgaactgtatttagttgataaagaaataaaagatatttcgatgttaaaagaaacaaataggccgttcattcaatttaaaagtgattcgacttattatggacaaatacaaaattggtggtatggtttattttctaatccgcctaagcgaacgattgtagttgaccaaattgaaacatgtaaacaacttgttttaaatggtataggttatgcccttttaccttctactgttttaaaggaagtacaggaaaatatgtataaaacacctgttcaactgacgagagaaacatggttgttaacaagtgactcggcaaggcagttgaagcaagtacaagcatttttagaaattatagaagaaattcaaagggaaaaataagattattatcttgctactcgctctttcgtttggtagagtaacattataaatggatttaggaggcaacaagaatgaaaatgatggacgctaacgaaattatttcgtttattcaaaaaagtgaaaagaaaactcctgtaaaggtatacataaaaggggatttaaaagaagtaacattccctgaaacagtacaagcatttgtgaataaaaagtcaggtgtattattcggagaatggtctgaaattaagacaattcttgatgagaataataagcacatcgttgactacgttgtagaaaacgatcgtcgtaattctgcaatcccgatgcttgatttaaaaggtattaaagctcgcatcgagccaggtgctattattcgtgaccatgttgaaattggtgacaacgctgtaattatgatgaatgcaacaattaacattggtgctgtaattggtgaaggttctatgatcgacatgaacgcagtacttggtggacgtgcaacagtcggtaaaaactgtcacgtaggtgcaggtgctgtacttgcaggtgttattgagccaccttctgcaaaaccagttatcgttgaagatgatgtagtaatcggtgcaaacgtggttgttttagagggtgttacagtagggaaaggtgcagtcgtagcagcaggagctgttgtaacagaagatgtgcctccatacacagttgttgcaggtactccagcacgtgtaattaaagaaattgatgagaagacaaaagcaaaaacagaaattaaacaagagcttcgtcaattaaacccagagaaataaaaagtaaaaaaagcgtaagagcgtaaatgggctcttacgctttttatagatagaggtgcaaaaatgacagtaagcaaatttatccaaattcgtagagatttacatagaattccagaaatcggatttaaggaatggaaaacacaacagtatattttagattatataggaacactttctcatgaatttgtggaagtgaagacatggaaaacgggtgtaatcgttaaagtaaatggaaaaaatcccgaaaaaataataggttatcgtgcagatatagacggtttaccaattacagaggaaactggatacgagtttgcttctattcatgaaggaatgatgcatgcatgtggccatgatgtacatacaacaatcggtttaggccttctaacgaaagctgtgagcgaaagaatagatgatgaccttgtatttctattccagccagcagaagaaggaccaggcggtgctcttcctatgttagaaagtgaagagttaaaagaatggaaaccaaatataattcttggtcttcatattgcaccagaatacgctgtggggacaattgcaacgaaagaaggactgttatttgccaatacttcagaattatatattgatttaaaagggaaaggtggccatgctgcctatccgcatactgcaaatgacatgattgttgcagcgagccaccttgttacacagcttcaatccgttattagtcgcaatgtgaatccacttgatagtgcagtaattacaatcgggaaaattacaggtggtacggttcaaaatattattgcagaaaaatctcgtttagaaggaacgattcgaacattatcagtggaatcaatgaagcgtgtgaaaagcagaattgagtcaattgttgcaggtatcgaagcttctttccagtgtgaggcgattatagattacggagcaatgtatcatcaagtatataaccatgaagagttaacgagagagtttatggaatttgtacataaacaaactgatatgaatgttattacatgtactgaggcaatgacgggtgaagattttggttatatgcttcgagaaatccctggatttatgttttggcttggagtaaattcagaatatggtttacatcatgcaaaattaaaaccagacgaagaagtgattgaaaaggcaatcacatttttaagccaatatgtaaagtggaaagggaatagaaaataaaacttccgctctcttgaaggttccaaaaaactttttgttctgaggtgtaagtaacgctcgtatagattgattttagacatttacatacaaatggaagaattaaagttaattgtactgttttaataatgagcagggggtttagccactgctcattattaattatttgactaacttatatatgtttacttttagtatgaaaagtgtgtaaaatcaatgtgaaacatagaaaaaagggtggggaattacgtgcaaattagcagtgcgattttatgtttcgtcttatatgcgtatgttattattgcggcggtttattttgggataagtttttatgcctatcgtctagtagataataatgaatatgacgaaacatacaaatgggtgaagagatatttatcacctgtactagaaattatgaatgggtttgtgctctttttatttattggattaattgctttctcaacgagtttagtagggaataaaactacgttatttgtattgggtatcattatttttatgttgttaggaataaggattggtaatacggtcttttgggatgaaagaaaagtagatggttggacgggaatgttaattccgtgcatgttagctgcaatcgtgacaaatatagagcatgaatattatcaattacatttttggcttattatcgttttaacaattctttctgttttgtatataagcacagtagtactaacatatattgcacatgaaaaaggagatgttaaaggcactcgtttctttagaggacgggcattattttggagtgtgccgacgatggcagttatcgcgcttattgcgatattagtaaatggatatcaattttctaattggcaactatttttagaaaattggtggatctttatcttttcgtttattgcttttttaggtgcaacgcattatttattccatcaacatcattacatatgggcgttgttatttgcattcacacagcttctatttgccttttttggtcaagaaacattattattcgtttttgaaacatttagttcttttggaaatatatttgtatttgctatgctacttgttggtatcgctttttacttgcaacaatatttttatatacaaaaacaaaaataagagctaatcatagtttttgtgacgcatataaagtgtgttacactgaaaataaatagtacttgaagttattggaggaattcttgtgggtgagaaagaaaaagaatttgctgtcattggacttggtcgctttggtggaagtatttgccgagaactagctcaattaggtatggaagtaatggcaatcgattcagatgaggataaaattaatgaatttgcaaatatagcttcgcatgctgtaattgcagattcaacagatgagatggtattaaaaagccttggtattcgaaattttgatcacgtagtcgttgctattggagataatttaaattcaagtattttaacgactttgattttgaaagagttgggtgtaaaaaatattactgtaaaagctcaaaatgattatcatgaaaaagtgttaagtaaaataggtgcagatcatattgtgcatccagaacgtgatatgggaaaaaggattgctaataatattgcatcaagcaatgtgctagactaccttgagctttcagatgagcatagtattgtagagattattgcgaataaaaaaattgatgggcactctttaattgaattagatattcgtgcgaagtttggattgaatattgtagcaattaaacgaggcaaagaagttatcgtatcccctcgagctacggagaatattcaagcaggagatatattaattgtcattggtcatgacgatgaagtggatcgatttaaacactttttaagataagagaaaagaaaaggacaatgccttcatggcattgtcctttttcttatatttccataatgattggtaaaatcattggacgacgtttcgttttctcatataggaatggggctaatgtgtctgtaatttcatttttaatttcagaccattgtgttgttttacgctccattactttttctaaatgagttgtaattaatgtttgtgcatcattgattaaatcgctgctttcacgcatgtaaacgaaaccgcgtgagatgatatcaggtcctgctgcaactttaaattctttcatatcaatgcttacaactacaattacaagtccttcttcagaaaggatacgacgatcgcgtaatacgatattgccaatatctccaataccgtttccatcaatgtagaccgaaccagatgggatttttccagctacgctagcttcatccgaacgtaaagcaagaacatcgccattatccataatgaagcaattttcttcagggatgccacaatcatttgctatgttcatgtgcatacgctgcatacgatattcaccatgaattggcatgaagtacttcggtttaattagacgtaacattaacttttgttcttcttgtccaccgtgtccacttgtatggatatttgaaagtttcccgtgaattacatcagcgccagcgcggtacaacatgttaattgtacgacttacgctaattgtatttcctggaattggtgaagaagagaaaacaactgtatctccaggaataatttgaatttggcggtgtgtaccatttgcaatacgtgaaagtgctgccatcggttcaccttgactacctgtacataaaataacaactttattagctggtaagcggtttagttgagatgcatctatgaatgtatctttcgggcaacgaatataaccaaggttttgtccaatttcaatcgctgcttccatacttcgaccaaacacagctactttacggttgttttcaacagcagcttcaacaacttgttgtaagcggtggatatttgatgcaaaggttgcgaatataatccgtccttctactttacggaaaatgtcttgaatgctatcaccaacgcgacgctcagacatagtaaagtttggaacttcactgttcgtactatcagataatagacatagtacgccatctttaccgatttcagccatttttgttaaatcagctggttcaccaactggtgtgaagtcaaatttgaagtcacctgtatgaacaacttgaccttgaggtgttttcacaacaacgccgtacgaatctggaatactgtgagttgtacggaagaaggatacagacgtttttttgaatttaataacgtcatcttcttgaatctcgtaaagttttgctttacgaagtaagccgtgttcttctaatttgtttttgatgagtgcaattgctaattttccgccgtaaatcggaatgttcacttgacgtaataggtaagggattccgccgatatgatcttcgtgaccatgtgtaatgaataaccctttaattttatcttcgtttcgcacaaaataagtgtagtctggtattacataatcgatcccgagaagttcgtcctctggaaatttaattccagcatcaattataataatttcatcttgaaattgaacagcgtatgtatttttaccgatttcaccaagcccaccgagagcaaatacagcaacttggtcgttttttagaaatttcatatcgctatacgatttccgctaatgttaaatcagcgttttctttttcatattcaagatgagcgccagtaacagactgaacaaactcgatattatatgcgaacttatttaactttgtacgaacatccttttcagacgtagcctctaaatataaaacttttgtattttcacgtactggaacctcagttaatttttcttgataaaatactttaaaaatcatttggaaaacctctccttgtctatgttttgcattatctgttacttattataaagcaaacagtcacgattttcatgttttttcgaatgagaatgaagaaaaagcccgaaatgggcacaatttaagcgattgtctttttacggactagaccgtttaaataacgcttgagctttttcttcagcttcttcagcatgattactccttcctttccttattttaaacatgcctattactagtgaaaactctatctctgatataagagataggacaaaagtgaatggtgaatcttgtcctttcccatacagtgaaagttattctatagtaacgatcagtagccgttagttataggtatagtatgaggaagaatggaaaagaaaattcatccgaacaagtatctacatgttttactaatatatatatgcaaagtttacaaataaggtcagaaagggaacgctttcttcacagatgtttaatatgttatacttttttttagaatttgaaaagtgatattcaaaataggaatatagagtcccagaaaggattttgacaaatgaatgataaaattgtcttttttgatattgatggaacattattagatcatgataaaaaaattccgcaatctacacgagatgcagtaaaacagttacaagaaaaaggtgtacatgtagcaattgcgacagggcgcgcgccatttatgttcgaagatattcgcagggaacttaatatacataattatgttagttttaatggacaat

SEQ ID NO: 1175 - DNA, 5262 bp, Bacillus thuringiensis
tatcacaccttttcactccagtcaacttaaatgatccgcccccaaggtaaagacccaggggagaaggaccagatgcatcagagtcttggcaataaattaagtcaccacgcagtggactagaggcctgtggcaagcgactccactatcctgcaacactatggcggctaatgatatgaccaaatacctgaaatacgtggtacatggagccactgcagcactacgccgttcgcagaagaaccgccccaaacgtacggtacaccttgcattgatgttgcatatgcaagtacggaagaactgtcgccgctatcggcgcctgtattattagtgccgttagcgcgttgattgttattttggttattgttaggcttattatctactgcgcctccaactggtgttttagataggtaacgtgttccgatataaccagtttgcccgttgtagttaattttgctccatccagagttttcagagattacttgaaccttctgaccttgtggaagtgcgcctatgattctataatttgtaccttcgccgctacgtacatttagtgcagaagcattaatgtagtaatcgccaattgcaccttggttaggttgttcaggttgttttggttgctcaggagtagtagtgccacctttaacgaattttacaaattcgctactaacaaagcctgtttttccttggtaatttactttaaaccaaccgttttcagatccaactacgtttaatgtggtgccgtttaaaacgccaccaattacactatggtaagcggcagggcctgtacgaacacgtaaagatgtagcgttaactacgtaagaaccgccagtttgaatagttccattattattgttttgctcttgtttgttgccttctgtaacgttttcgttagaaccgccttttgttacatagtctttgcttatataagcagtttgtcctgcgtaattgattttgaaccaatcttgaacttctccaacaacttgtactacttgtccttttgtaacagaacctacagttgtgtgagaagtgctaggacctgtacgaacgcgaagggaagatacatttactgtatagtttccgcttgctggttttacttcttggttgttattattcgtattgttgtttgaagaacctgcattagaagaaacgccagatacgaattcgccacttacataacctacttgtccattatggttaattttcacccaaccattttcttgtccaattacgtttaatgtttgtccttcatatacacgcccagaaacagaactagatgtgttaggagctgtacgtacacgtaatacatcagcggtaactttattgtttccacctgtacttacattgttgtttgctgcgccactttttgatacaaattcgccactaacaaagcctgtttgtccattaatgttaattttgaaccaaccgttttcttcgccaatcacgtttagtgattgaccgttataaacgcgtgagatgatgtcgtgagaagtgtttgatcccgcacgaacatgtaatacgctcgcgtttaccttataagatgagctgtttgatgcagaagcttggacagttgtagcagctttttgtgtattttgttcaggtgcagcttgaacactatcaagtgtaggtgctgctcctcctgctacagacactgccgcaagaccggcaagatactttttcataatttgtcgattcctttctgtctgtaatgtagtgaagaaatatttaccaactgttaaaaattctaaagagcatgtcgattactgtcaagacttatataggaatctgaatatgacaaaaagattacaagaaaaaaatcaaggcataaaattacaccttgatttccatttaaatgcatatattgaatatgaaaggacagaaattattcgtgtttaagaagatgccatattggattgtaataagatttgattaaaagatttttgcagttttttggtgataggcccaacttgcccatcttgaatcgcggtcccatcaaggtgggtcattggtaaaatttcaatcgttgtgcctgtaaaaaagcattcatctgcttgataaacgtcacgaacgctgaaaagttcttcctgcacaggaatgtgaagagtattcgctaaagaaaggacatattgacgaataatgccatttaaaataaggtgattggctggatgtgtgtaaagcgttccgtttttaattaaaaagaagttggaatggcttccttccgttacaataccgttccttacgagaagtgcctctttacagcctttccgttcagctttcgtagcagctagtacgtttggtaataaatttaatgatttaatgtcacagcgtagccatcgagtatcgggttctgatatagcgcgtataccatattcaatccataaagccggtcgttctttttttgtaatataggcataaattgtcggagggttgtcatatgaaaatacatgtgtgcgagcttgtacaccacgagatacttgcaaataaatggtgccatcttcgtggaaatggtttcgttcaattaatttgtaaagtaaagtgatgagctcagcttttgagaaagggagcgataattctacttcttccatggatcgatataatctcgttatgtgcggatctaataaatgaaagttccctttatataggcgaataacctcatagacaccatctccgaactgcgaacctcttcttcaagttctatgtacgtttgttgttttgttgtatcaataacttcatcattccaaagtacaaatttttcgtatgccaatttccgtcccatcctttcgtaagtacgtaagtaacgtgaaactttcattcatgcgagataaaaatcactatagtaatttttatgtgagcaattctctacatatgaccatatatgtatttgtaaatcatagagaaataaggatgatctaccccgcattaacggcagtaaagcccctacttacaaattccggtagagcaaagaagtgaagtgggcgaatcactgcccgtaaatgcccgattgatgagggctgattaaagtttcactttacagcattttgtatatacaaattcgaaaataagaaatgagaatcctgcttttaaataaaaaaaagcaacattcttatggaatgctgcacaaggagggtagctatctttcatagggacattgtctcgttgaatgctttgtgtatggaaacaaaacaagttgaaagacaattataagaaagtagaaacaaaagatttacacatttctttaagggatcttacgaaagatgagagataagaaatatgtagaacctcgtttacatattttattatagagattcttcattaacactatgtgaatatttggtaaaggttatgtaattttaaagttaatgaatataagtagttgtatggaagaaaataaaaaaagaggctgagattactcagcgctcttcttttcttctttaataactgtttttacttcaccagttttgatcttattactttcagagaagcgaagtaagtcaccttcaatgattttatcagacatgttcaattcattttgggcacgatcaattagtggctgggattcttctttcggtaattgtacaacttcgccagtagcacggtcatagaatgtactgtttgtgtacatgtatttatctgtaacgaagctaccgtcacgaagaacaacgaatcctttattatcaggtgagaatacatcatgaccgaatcgaacgtcatttgtagaatctacaccaagtaagtttagaatagttggtttaatgtcaatttcaccagttggttttgaaattgttttaccttctttttgacctggaacgtgaataaacatcggtgttttttgtaagttcatatggtcaaatgcagtgatttcttcttttcctaagaactgtgccattgcacggttatggttttcagaaataccgtagtggtcaccgtagaatacgattactgagttgtcgtaaataccttctgcttttagacgctcaataaagtgtttcattgcttcgtctaagtaacgagcagttaccatgtaacggtcaaatacgccatcaccagaattgtattcgtcgattaatttcgtattatcatcgtaagtgaatgggtaatgattcgttaaagtaaggaagcgagtatagaatggttgcttcacttgttttaacatatcaacagattgatcgaagtactcgatatcttttaatccccagtttagttttgtttccggtgtaatcttgtagtcaagctcgttgtagtaacgatcataaccaagtgccggatacataatgttacggttccagaatgttgcgttgtttgcatggaatactgcagtgtagtatccttgctgacgtaaaatttctggagttgctgtatattcattgttaccgtgtgtgaagaatacagcaccgcggtctagtggatataaagaagtatctactaggaattcagcatcagatgttttaccttgcccagtttgatggaagaagttatcaaagtaataactttctttcgtaaattggtttaagaatggtgtaacttcttgtccgttaactgttgcgccaattaagaatgtttgtaacgactcaagagagacaacaattacgtttttcccttttgcagtaccgaacatatttggatctggtttactttgtgttgttttcacatagttttctgtttcttgtaatttactaccgtcagcgaatgctttttgtgaacttgattttgcttgtaagccaagatcgtatacttggtgtacatataatcctaagtttttaacaagcataacgcggtcgaatgaacgtgttaatagttctgggcgttcagcttctgcaagtcctaagtttgcgaagaaaatagcaactgttgatacgaagtatagggaacgcatcgggcgtgctacacgctctgtaggtgcaaagtttttcattttctttaatagaacgaagaaaatgataatgtctgcaaatgcaagaataattttgtagttaaataattctttcacactagaacctaaacttccgaagttagatgtttgtcctagcaccggtaatgtaacgaagtcattgtagaatccgtagaacattacgttaccaacaagaacgattgttaagacaaaattaattccaagtgctatatagttacgttttttcccttttgcaaataatgcaagaccaacaagcagtaatgatgctgctaatgggctaaggaataaaatgaattcttgcatgaaagattcaagttttaagtcaaagcttgtgcgtgtaataaggaaagttttcagcc

SEQ ID NO: 1176 - DNA, 6239 bp, Bacillus thuringiensis
aggcctattagaggatgtagaagggctgtataatagagggatacgagattgtcaatctattcaagcgattggatataaagaaatctatgattattttgagaatcgagtttctttagaagatgcggtatcacaattaaagacgaattcgcgtcgttatgcaaagcgtcaattaacgtggttccgtaataaaatggatgtcacgtggtttgatgttacaaacggtgaaaaaacgtcagaaattttacgatacatagaaggaaagttacaagtaaagtcgaataatagtaagtagagaaaaagaggaggattcgacatgaagcaatcaatcaatattcaagatcagtttttaaatcaactccgtaaagaaaatacgtttgttacgctgtacttattaaatggtttccagcttcgtggactaattaaaggatttgataattttacagtcctgctggaaacagaaggtaagcaacagcttatttataaacatgcaatttctacatttgtaccacaaaaaaatgtttcaattgaattagaatagtaatgaattattgtacataacaaaaaagagcgagtttcctcgctctttttttatttgtcataaacaatatatagtgaaatttaagcgattctaaatacagtaaggcggatgttagtatttcctgttgcagggatcgtaatctcattaagtgtagattggacagagattcttgcaccagctgctaatgtttctattgtagtaaatgaaagtgagtcgcctattaaatttgaagagaaattatcagttgcgactgctccattaattgaaattcctactccgagtggagcgcatcctggcgcagttgtagaaatggatacgctaattacataaataccaccgttaataacagtaactgtatctgtgccgttgaagataatattgtttacgttaattgcagtactaaaaataaaattattaaattgcagtactgtttgctgaatattgtttgttacaacaattgttgctatagggaagctaggtccagtaggcccagtaggtccggtaggtccaccagaaggtccagtaggtccagtaactcctatgccagtagcgccggtagcacccgttggtccttgaatgccttgaggcccggtagcgcctgtgttaccttgaacaccttgaggtccagtggcaccagtagcgccagtagcacccgtgttaccttgagcaccttgaggtccagtagcaccagtagcgccagtagcacccgtgttaccttgaacaccttgaggtccagtggcaccggtagcgcctgtgttaccttgaacaccttgaggtccagtggcaccagtagcgccagtagcacccgtgttaccttgagcaccttgaggtccagttgcaccagtagcgccagtagcacctgtgttaccttgaacaccttgaggtccagtagcaccagtagcgccggtagcgcctgtgttaccttgaacaccttgaggtccagtggcaccagtagcgccggtagcgcctgtgttaccttgaacaccttgaggtccagtggcaccagtagcgcctgtgttaccttgaacaccttgaggtccagtagcaccagtagcgccggtagcgcctgtgttaccttgaacaccttgaggtccagtggcaccagtagcacctgtgttaccttgagcgccttgaggtccagtggcaccagtagcgcctgtgttaccttgaacaccttgaggtccagtaggtccaggaggcccgccagaaggtccagtaggtccggtaactcctataccagtagcacccgtgttaccttgaggtccagtggcaccggtagcgccagtagcgcccgtattacctcgaggcgcctgtgttaccttgaggcccagtggcaccggtagcgccagtagcgcccgtgttaccttgaggtccagtggcaccagtggcgcccgtgttacctcgaggcccagtggcaccggtagcgccagtagcgcccgtgttaccttgaggtccagtggcaccagtagcgcccgtgttaccttgaggtccagtagcgccagtagcgcccgtgttacctcgaggtccagtggcaccggtagcgccagtagcgcccgtgttacctcgaggcccagtagcgccggtagcgcccgtgttacctcgaggcccagtagcgccggtagcgcccgtgttacctcgaggcccagtggcaccagtagcgcctgctggtccagtaggtccggtaggtccttgaatgaacgaagcagaattaactagagcagtttgtaatgctgctattaatttaaggagctcttgaagtgtgcaagggtcaattcggaataattttgtaatgtatagtaaatagttaatgagattttgaagctcaataaatacagcgcttgctacaaaggttggatttcttaatatagttattaagtttttaataatagctaacccttgtgctttcagggaggaagtagcgtctagtgaacaaataaatttactcagtaggttcaatgtatcgattaggtcttcaatattttggggagatggatttgcgaaaagttttgggattatttttgttaaatcaataataatcgcacgaaatgttctaagttgagctttagtaattgggattgatggagtattcgggattcgtccggcgctacttggaaagcatggtttggagaatttgttttgattgtcgttataacgagacattaaatctctcctttctcacgaaaatgtgaacgaaactcatcatagtagatgcagaaattagttaaatggtcatagtaaaatcgtttgtttaaagaaaaaatagaaaaaacgccttacaataaggcgttttttctattttctgcgtattgataatatcgctttaaggaaatttttgatttgaatccagcgagttttataatttctgattcaggagtttctttttttattaagtttaaaatataggtgttacgaaaatgttgtcctgaaattcctttacgtaaattggctctagccacttcgaggcgaatcattttttgtatagcaatttccgttaatgcctttggtgcatcattttcatatacccacctgtatgttccacggttaaaatcgaatgcgacaaataatggatcatcactatggtatttaggacgaactggttctgggatgcttttgtaataattatatagttgttttttgtcttcttttgctaatgtaattgttctttctacacctgcggttgctgggattgataatgtattagtttcaaagtgaacgtgatgcattgttaatgctgtaagttcctgtaaggataaaccgtagtcaatcaatagatttaaaatagcaatattgcgatccattaataaggggcgcacaggaagttgtttttctgaaagtccttctaatgaagtgactatatactttaaccttttttcttcatcaggtgaaatgaaatcttcgttacgaagtgtacggtctggttgaatagatatttccatattcttcaatggattaggaatgtttagaaaatgatgcattctatttagtacaataaatacacgatgcatcgttttttctgagtaatgtcgattcgtttttaaatcggaaaagtaatcttcgtagtcttttgtacaaagtgtagcccatatattactggaagggagctttttgtttttttctaaccaatgtccgaagtcttcaatgtcataaacataacgtttaatagttgagggttttcggcctttattcaataaaaaaatagaaaaggcttgtattgtatcatggaattccgttgtctccatagtcccaccaccttaattatttcttatattatagcaaacttttctgaaaataggcatttacaagggggacaggaataataatatttggtgagtggataaaatgaggtgattgtatggaacaatcgatgcgaaagaaaaacaacaatcaaattaatattgtgttaaaccatcgaaagaaaatttctttgccagccgcagaaaataaaacggtaatttcaaatgaaactgcaattaaacatgaaatgctgcagagaattgaagaagagatggggaagcttgttgggatggaggatataaaaaagataataaaagaaatatatgcttggatttatgtgaataaaaaaagacaagaaaagggattgaagtcagagaagcaagtacttcatatgctgtttaaagggaatccaggtacagggaagacaactgttgctagaatgataggaaaattgctgtttgagatgaatattctatcgaaaggccacttggttgaagctgaacgtgctgatcttgtaggagagtacatcggccatacagcccaaaaaacaagagatttaataaaaaaagcaatgggaggtattttgtttattgatgaggcgtattctttagctcgaggaggagagaaggactttggaaaagaagcaattgatacgcttgtaaaacatatggaagataaacaacatggttttgtattgattttagctggatattcaagagagatgaatcactttctttcattaaatccagggcttcaatctcgttttccatttattattgagtttgcggattactcggtaaatcagctattggaaattgggaagagaatgtatgaagatcgtgaatatcagttatcaaaagaagctgaatggaaatttagggatcatttacatgcggtgaagtattcgtcgcaaattacatcgtttagtaatgggcgatatgtacggaatattgttgaaaaatcaattcgtacacaggcgatgcggttgttgcaagaagatgcgtatgataaaaatgatttaattggaatatcgagtatggatttgatgctcgaagaggagacgcacagtacataaactgtgcgtcaatttttgtgtataagttcgtttactctttttttgctttttcttggtgtgttttatggaagtgttccattttagcgctcttttcgtgtgctgaattaggatcgtgtccaaattgatttactgagcttttttgagctcctttattaacgtggtttgtcatttgtattcacctcactttaaaaattagtataaacattatataaagaaaaaatcgttagaaaagaaaaacctctttacgatatgtaaagaggttagattgctatttatgcattgaacgttctttcgtttcgatacgtctgtgcggtaaatgccatttgtaatgaatagaaaccatgcggaagcaaacaattaaaatgaatagaatgtaaagagcccaatcgctaacaataatttgagctccaattaagaaacctgctaaaattgtccaaaaggcatatacttcagctcgaagaacgagaggttttctgcgggctaaaagatcgcgaatgataccgccgccgataccagttaaaacagctgctacaattgtggcgctaattggtaaatttaatttttgggcatataatgctccttgtacagcaaatgccgataagccgatagcgtcagtgatattttcccactttttccaatgtctaattaacttatttggaaaaagaaaaataatagtcattgataaaagtgcgatttggaataacatgtcttgttgccaaaacgcgacaatcggataaccgattaataaattacgaagggcacctcccccaaatgcggttgccattcctaaaatatacaccccgaaaatatcataatcctcttccattgcaacaatggctccgcttagtgcgaaagcgattgtgcctatgatgctaaaaatctcccatgccatgaattttctcccccgctaactagatgaaatgtgcttcctctgctattatattagaaggtttaaatttcgaaaaggatgagtgaacatatttgatggaagaaaaagaaaaagtcatattagtaggctgtcaattgccacaagatgatgatgaaaaatttatgcattccatgaaagagcttgcatcactagcgaagactgcacgagcagaattgttagtgtcaacaacgcaaaaacgaccaaagtttcatccggcaacttacataggtaaagggaaattagaagagcttacaatgttaactgaagagttagagccggatgttattgtatttaataatcgaattaacgcccggtcaaattcggaatttatcctcagtattagatgccagagtaattgatcgaacgcaactaatactggatatatttgcgcaacgcgctaagtctagggaatgtaacctttaagtatgaattatctcacttgtaatatacaatgccccgtttta

SEQ ID NO: 1177 - DNA, 7361 bp, Bacillus thuringiensis
ttattgcagctttacacgatttagcagcaacatttagaaatagggcagataaaggtgttcaagtacaagtagagattccagaaattccagtgctagcactttctcctcgagatgctttttattcggaaacagaagtcatcccatttgaaaatgcagcgggtcgtattatagctgattttgttatggtttatccgccagggattccaatctttactccgggggaaattattacacaagaaaacttagagtatattcggaaaaacttagaagcaggtttacctgtacaaggtcctgaagatatgacattacaaacattacgtgttattaaagagtacaagcctatcagttgataggcttttttttcaccttttttccttttcttcatacgatacttaagaatgtaacgtataggtggggatactattatgattgtaataggccgttctattgtacatccttatattacaaatgaatatgagccatttgcagcagagaaacaacaaattttatcaataatggcaggaaatcaagaagtttattccttccgaacagctgatgaactcagctttgatctcaatttacgagttaatattattatctctgcactagagctttttcaaagtggatttcagtttcgcacatttcaacaatccttttgcaacccccagtattggaaaagaacatcccttggaggattcgagcttcttccaaacataccatcttctattgccatacaagatatttttaaaaatggaaaactatatggaactgaatgcgcaaccgctatgatcattattttttataaagctttactatcattgtatgaggaagaaactttcaatcgtctatttgcaaatcttttactttatacatgggactacgatcaagatctaaggctcataacaaaaaacggtggcgatcttgttccaggtgacctcgtttactttaaaaacccacaagtgaatccagctacgattgagtggcaaggagaaaacacaatctatttaggaaatttctttttttacggacatggcgtgggtgtaaaaacaaaagaagaaattatttattcattaaatgaacgaagagtcccttacgcttttatttcagctttcttgaccgatactattacccgtatcgatagccgtataatgagccaatatgcttcttctagtacaccacagacatccataagctttattccaattagagatgatgcaatcgttgcaacagttggtcatacaactacaatttattaaaaaagcgcctacacatgtaggcgctttttcttattattaagcttttgtatgttctttatggtcacattcgcaatgagatccacatttcccgtatagtactgttgatttttcatcttcaaaatgtccaattgttccttcacatacttggcatacgattgttcccattttcatttccccctaagtttatggtcctaaaaacttttagctgtccatttcctatcaattattgggcttttgtatgctctgtgtgatcacatccgcaagatccacatttcccgtaaagtaccgttactttctcatcttcgaagtgtgcaattgtaccttcacaatcttgacatacgattgttcccatttttcatttccccctaagtttataatcccaaaaactttttgtaaccgcttaactttctgtctttattttaatatgttatactttttacgtcaataggtttttagtataacacattaaatatttttaatttaaattagtatgcgatattaaaataaaaaaacagccatatttataagtacgactgtttcacattaattattcttcatattccgcatgtaaagaagttgacggaactagaaatttgaaaaactgagctaactcctttgcttcctcttctgatcctaatttaaaaatctcctgtatatattgaacattctctacatcatctcgtccgagtaaagtagaccttcctgtttgcatacaaacaatgagcggctttccaaaaaacatatttgtataaataacaccaaaatcataacgtgtatcatgtgtcataaaccctaaaaatcgtaccttcacactttcatgctcatcatacaatttttcaaacattggtttccacctttctacatcacgtttcattaatagtatattaaacaaaacatgtaatactccttttaattgtcaaaaaattcagtaggatgtagaatgatagtattctactaagctagggggaacttatatgcaacacgcctttattacgcttgtaccgaaatccaaccaacaatcagtttcaatagatgatataaaacaactttttcattattataaaacagttacttctaaaactggtgcccaaattaattacacgtatacaaataccgcttttccttatgaaattttagatacatctacaacaacattaaaacttcaatccactcacgaccggtatgactcaatttatattggtgttggtatagaaaatgaacaatctttcatccaagtttctttaccacctaatgcaacatttggtgacaaagggaaagcaaatgaattttgccgttttttagcgaagaaattagaaggagagttacaattatttaatggaagaacaatgtatttttataaacgctaatttaaaaaatagataatatgattaaaaataatatacaattcgaacatgtaagaaataaagcttgctttcttacgtgcaatacaaaatatgctattacataggctaatattggaacccgaaaaaaagaaactttataataacttatcccattgataatgttatcagtgaaagccatcatagtagtaatataaaataacatgtaattttcatggaaccttctcctttgacatgctctattttattaatatatgggggtaagtttgaatcaattacatattataggatgatatatattaccttcgaagtaagttaagcctgaatcatttgttaaagtattatatattcattcgacaagtacgtttaaagaccttgcaagtcatttgatgaaaataaaaatagcccctctcttacaataagagaagggctatttacattacttaaattattttacaatgtgaattggcattccaagagcaacttcagctgcttccattgtgatttcacctaatgttgggtgagcatggattgtttgagcgatatcttcagctgtcattccagcttcgatagctaaaccaatctcagaaataatatcagaagcacctgcacctgcaacttgagcacctacaagaagaccatcttctttacgtgttacaagttgtaggaaaccgtcagtgctgtttaatgataatgcacgaccgttagcagcgaatgggaacttagatacagttacagtcattccagcttcttcagcttgttttttagtgtaaccaacagatgctagttctggatcagtgaagcatactgcaggaattccgatgtaatcgatagctgatgcatggccactaattgcttctacagctactttaccttcgtaagaagctttgtgagctaatggtggtccaggaacgatatcaccgattgcatagatgtttggtacatttgtacgacattgctcatcgatttcgatgatgccgcggtcagtcattttaactccaacttgctcaagaccgatttcttgagtgtttggacgacgacctacagttactaatacgtaatctgcttctacagtttggatttcacctttaacttcaaagctaacttttacgccagtttctgtttcttcaacgcctttagccatagcttttgtatggatatttacgttaccttttttctgtagagcacgtttaacaacagagctcatagctttttcgaaaccagctaagatttcgtcgccagcttctactacagtaacttctgtaccgaagttagcatatgcagtacctaattccataccgatgtaaccgccgccgattacaacaagttttttaggaatttcaggtaagcttaaagcacctgtagagttgataacacgtttagagtatttgaatcctggaatttcgattggtgtagaaccagttgcaagaacagcatttttaaacgtataagtttgagctgcatcttcagtcataacgcgtaatgtattagcatctacgaagtaagcttcaccgcgaatgatttcaactttgttacctttaagaaggccttcaacaccgccagttaatttcttaactacgccgtttttccattcttgaacttttgtaaagtcaacttttacgttttctgcagtaatacccatgtcatcagaatgcattgcattctcataacgatgacctgcattgattaacgcttttgaaggaatacatccaacgtttaagcatacgccaccaaggttagctttttcaatgattgctaccttttgacctaattgtgctgcacgaattgccgcaacgtatccaccaggacctgcaccaacaacgactgtatctaattcaattgggaaatctcctactaccattgttattacgcctccattactaataattgtgggtcattcaatagacgtttaatttggtttaacgctttttgagcagttgcaccgtcaattaaacgatggtcaaagcttagagataatgctaatactggagctgcaacgatctcaccgtttttcacaactggtttttcagcgatacggccgataccaaggattgctacttctgggtggttgataactggagtgaaccattgtccacctgcagaaccaatgtttgtaattgtgcaagaagcacctttcatttcagctggagctagacgaccttcacgtgctttaccagcaagatcattgatctcgttagagattgtgaagatagacttacgatctgtatctttaacaactggtactaatagacctttgtctgtatcagctgcgataccgatgttaagtaatgtttatgaactacttcttaagatgcatcgtctaaagaagtgtttaacattgggtattcacgtaatgcagatgttaaagctttaacaacgtacggaaggtaagttaatttaatacctttgtcagctgctactgctttgaacttcttacggtgagcaacaagttctgttacatctacttcgtccattaatgttacgtgaggagctgtgtgtttagagttaaccattgctttcgcaatcgctttacggataccactcattttctcacgagtttctggatattcaccagctgggattggttgtgcttttggtgcttcttctttcgctgctgctggagtagcttctactgctgctggagcctcagttgctgctacagtttgtccaccatttgcaaatgcatcgatgtcagcttttacgatacggccattcttaccagtaccagctactttatgaatgtctacacctttttcacgagcgtatttacgaacagatggcatagcaattacgcgctcatttactacttctgcagttgctgctggagtagcttccgctgctggagcttctactgctgcttcttcagcttttggagcttcatcatgatcgtcacctttaaatttaaggttttcgtatccaggagcatcaaatttaattaatgtatctcctacgattgcaactgttccttcttctacaagtacttcaagtactttacctttaacaggagaagggatttctactactgctttatcattttgtacttcaagaagtacatcgtcttcgtttacttcatcgcctggtttaataaaccattttacgatttcaccttcgtggataccttcaccgatatctggtagtttaaattcaaatgccacggaattcagccccctgattcatttcattattatggaatatgtacaaaagaaaccagcatgtgctgatttcttttgcacatgaaaagctaaaaattagaagttcattactttgtttacagcttcaacaatatctttgtggtttggtaaccatacgctctctgcttgagagaatgggaatactgtatcagcagctgcaacacgtacaactggagcttctaagtttaagattgcacggtcgttaatttccgctacaacgttagctgcaataccagcttgtttttgagcttcttgaactacaactacgcgacctgttttttcaacagaagcgatgattgtttcgatatctaatggttgaactgtacgtaagtcaacaacctctaaagagataccttctttttcaagttcttcagcagcttttaatgcagcgtgaaccatagcaccgtaagcgataacagatacatctgtaccttcacgtttgatatcagctttacctaaatcaattgtgtaatcaccttctggtacctcttgacggaatgaacggtacaatttcatatgctctaagtagataactggatcgttgtcacgaatcgcagagattaaaagacctttagcatcgtatggagtagatggaataacaacttttagaccaggttgttgagccactaatccttctaagctatcagcatgtagttcaggagtatgaacaccaccaccgaatggagaacgaactgttactggagcagtccaacgtccaccagaacggtaacgcatacgagctaattgaccagaaattgaatccattacttcataaacgaaaccgaagaattggatttctggaactggacggaatccttcaagtgcaagaccaactgcaagtccaccaataccagactctgcaagtggagtatccattacacgatcttcgccaaattcagcttgtaaaccttcagtagcacggaatacaccgccgtttacaccaacgtcttcaccaaatacaagtacgttagggtcatttttcatttcaacgcgtaaagcatcagtgattgcttgaatcattgtcatttgagccatggcttacttcgactccttttctttgtagatttcatattgttcagctaagttgtaaggcattttttcgtacatgatttccattaaatcagttactttttgttttggagcttggtcagccttagcaattgcttgtttgatatcttcttttgcttcttcgattactgtctcttcaacttcttgagaccataggcctttagcttctaagaacttacggaagcgtacgattgggtctttttgttcccattcgttttcgatatcttttgtacggtaacgagttgggtcatcaccagccattgtatgtggaccgtaacggaatgttaaagtctcgattaaagtagggccttcgccatttactgcgcgctcacgagcaaaagcagttgctgcgtatacagctaatggatccataccgtctacttgaattccgtaaatacctgctgctactgctttttgtgctacagttttagctgcagattgcttttctactggagtagagattgcataacggttgttttgaacaa

SEQ ID NO: 1178 - DNA, 5866 bp, Bacillus thuringiensis
tccaggatttttttcttattatagtaaagaggcgaatgctgtattctcaggagatgtattgttccaaatgagcattggaagaacagatttacctggtggaagtttcgctgaattaattggaagtattgaagagaaattatttgtattaccagatgaaacagcggttttatgtggacatggtccagaaacaagcattggctttgaaaaagaaaataatccgtttttacaataaggagtcattatgggaatggagctcattttaagagaatggatggggaaagaaaaggattattcaatttcatatagtacgtatatgaaccttgtattgtatacagaaggtcatggatattatatgaaagaacgtgaaaagattggaagacaaggggatttttttacaagtagcaacgtatcctctgtgtttgcaaaaacttttgctaaactttttattcgtcttgttgaaaatggtgaagttgctccgaatatttgtgaaattggcggaggaacagggaagtttgcctatgatgttttacaagaatggaagcaattatctccaaaaacctttattgatctaaactattcaatgattgaagtgagcccttttcatagaaaattacagcaggagcaccttggctcattttctaatgtatcgtactatacctcctatagtgaaatgggagattctttcgagggaattcttttttcgaatgagttgtttgatgcatttcctgttgaaataattgagaaaagaaatggtatgttgtatgaagtacgtattacatatacagaggaaggaaacctttcagaagtatgtaggccgttagataaaagaattggtcgctatttattgaaatataatattcatattgctgaagggcaacgttttgaagtaccaattgtgatggaggagtatataaaagaaattgcgaaatggtttcaaaaaggtatatgtattacagttgattacggatacacaaaagaagaatggatgtatccagcacaccgtgaaggaagtttgcgagggtattatcagcataagctaatacgtaacccactagcgcatccaggtgaaatggatcttactactcatattcattgggacgagctaaaggagatgtttagtatgcaaggaatgagtgcagtatggcataagaaacaatctgagttcttgttagctgcagggatattagaacagcttacgagccatcaagatatgaatcctttttctgaaacgcaaaaacaaaatcgagccgttcgttctatgattttgaatggaggagtagggagtgcatttgatgttgttatacatacaaaagatatgcaacatttacatttggatcgatatgtagcaatataaaaaaacaagacacagtatatactgtgtcttgttttttaatacgacttatgtagtaatatatatttcctctcatgatatatatttatattaaagatatgagatgaaaaatatagaatacgttctttttcttcgattattagtccctaacctaataatacgcgaacgagttgaatgattgtttcattctctactttgtaataaatttccaatccttttctttcactagaaacgattttagcgctttttaattttgctaaatgctgtgaaattgtagattgtggcatgtttaagccagtatacattgtagaaacgttgcttggaccgcgctcgattaatccttttacgatacataaacgaacaggatgagctagcacttttaataattctgcattactttcatatagttctaattctttttgaaaggtttctaacatgttcttttccacctccgtgtgagctattataccatactatacataccaaaaatttaaagaaaagaaaatagttgttgcagaaaaaaagtcctaaagtaaagaaattgtaagaaaagagaccctgatgtaaataaaataggtaaattagcatgtttttgtaaaatgacatttttgggtgaaaatttcgatgtgttttaaaaattgaaagatatagatatatttgtaacacaattttatcatgattttcttattctttcaaatgaatatacaaaatttttaaaataatatgacaaaggaattataatgatatatatagaatataaaacaggttaaaagaaaagaagctgaatgtaattcgcttctttatggtgataatgaaatatttgcttacggctgataaatcttaggatgatcaagtcattagtcatttattctaaaattcatcttttagcaacgttaaaaacctgtgattccatatgttctcataaaaatcaattgtctcttttgcggacataaaaggattattcaacgtagaggttgttttctgtaccataaagttttcgtatcctagtccgtgggcaaacttaatcgtagcatccatacagtactctgtttgggcgccacaaaattcaatgcaatttacagataattgatctaaaatttcttttaagtttgttttataaaatgaatttgcatgtgtttttcttacaaaaaaatcttgttcttgaacatctagatcggtatgaatagcccaaagttctttctcgggtactaaatcatcatcacaatgttgaacaaaaaggattggtttatttaattttctgtatgaataaattcttttatttacttttgttagtaagttctgtaaatcaaataaatgctcctcgctataacatacgccattttgtaaatcgataacgattaaaatatctgaacaaatatccattattttcacccctttttatttcttaatatatcaattaatccattatttagaaatagatgatatacttttatttttttatggactataagaaaagaagaaattcaaatgaatataactaaaacgcagaaaaagaagatatgaaaacctaatctcatatcttctttttctctatgcatttacaggttcttctacataagaaagggcattttcaaaatcggatattaaatcgttaacattttcaagaccgactgataaccgaagtaatgaattagagattcctctttcatcacgagcttcttgcgacagtgctgcatgtgacatttttgctggataagaaagaattgactctacagctcctaaactaactgcaaaaacaggtaattttacttttgataaaaattggcggagtgcatcttctgactgcaaagtaaacgataagaccgctccagctgatgttgcttgagattgttgaatatcaaatccgagatgtgtttgtaatcccggataatagacattttgtactttagcgtgctcttgtaaataatgtgcgattttattggcatttttagctgaatgctcgaggcgtacgtgcaatgtttttagaccgcgaagtacgagagaacaatcttgaggtcctaaaatagcaccgaatgcattttgtaaaaatccaagcttttgagcgagttctgcatcttttactactgctaatccggcagtaacatcactatgaccagcaataaattttgtagcactatgaagaacgacatcagctccaagttcaagtggtttttggaatagtggtgtcaaaaatgtattatcaacaaaagtaagagcgccaatagattttgcgagtttagaaacctcgcgaatatctgtcacttttaaaagtgggttagaaggtgtttctacataaaagagctttgtatttggtttcatgttttgttttatttcttctaaattggtcatatcaacaaatgtatgtgaaacaccgtaacgggagagtacctcagttatcactcggtaagtgcctccgtacacatcttctgaaatgagtacgtgatcaccttgtgaaagaaggaggaatgcagtggaaatcgctgcaatgcctgatgcaaaggcgaatccttttgttccgccttctaataaagtaatgatatcttcaagagcttcacgagttggatttcctgacctgctatagtcatattttccgaacgtatctacatcaaactggtgaaaagttgatgtgttataaataggaacgttcacagcgcctgtttgcgagtcatgtttatattggttgtgtagtaagagtgtatctatagaatagctcatattcttacaccttcttttacgagtttaatggcttgctttaagtcttgaattaaatcgttactattttcaatgccaactgagaatcgaagaagacgattgcatacgccgtttgctgttctaatttcttcaggaatatcagcatgtgtttgcgttgctggataagtcattaaactttctacaccaccaagactttcggcaaatgtaattaaggataaagattgtaagaatggattaatccaagcttcatctttaaggcggaatgaaatcatgccgcctcttcctggataaaatacatctgtcaccccgtcttcatcatttaaatacgcaacaactgctttcgcattttcttcatgttgtctcatgcgaagcgctaacgttttcataccgcgaattaataaccatgagtcaaatgggcttaaaactgcacctgatgcattatgataatgagcgatttcctcgcaaagttcctttccttttgcaacgacaagcccgcttagtacatcgttatgtccccctaaatatttcgttgcgctatgaagtacaatgtcagcaccttctgttaatggttgctgtatataaggtgtgtagaatgtgttgtctacaataagaagtagtccgtgccttttcgctacagttgcgacagcagcaatatcagtaacttgcattaatggattagttggagtttctatgaaaatagccttcgtttcagttgtgatagcttgctcaatttgtttaatagactgtgtatttacgtatctacatcgaacattccactttttttcatgctcagaaaataatcgatacgttcccccgtataaatcttcagatacaataagttcgtctccagagcggaatagagaaaggacgaggagaacagccgccatccctgaactacaggcataaccttgttcgccatattctaagtctgcgatcgcctgttctaaaagaccgcgagttggattgccagttcgtgaatagtcaaagccagtagatttaccaattccttcgtggcgataagcggttgagaaataaactggtggattaaccgttccagttgtagtttcactacgatttccgatttgtgctagttttgtttcgattgttgacatgtgaaaattcctcctttttaaattgaaacattaagtgaatataaaataaaaaaagccttctaagaagaaggctttcggtttgaatagagtcttcttctcatctgtcaaatctttcacaatttgctggaattagcaccttattaacaaaatgttaatggttgctgaggcgtcacagggccagtccctctacctctctagataagaatgttcgtatgaaatttttattatgtttttaactttacaataaaagataattgaattgcaactttattttaaataatttttatttttccgcaagtgtcattgacttttaattttgtgcatgctaaatttattaaaaaattaacaaacattgttaaaaggggaacgcatttccttttagctacataaataaaataataaagacaactcttattgagagcggtggagggaaaggccctgtgaaacccggcaaccttcaaacgaaatgtttgaaacggtgctaatacctgcaaaacgaatgttttgcataataagaggaggaacaattatgtccccctcttcaaagtgaagagggggtttttatattgatagaaatgagggagattcgtgaaattactagatttattatcaaaaggaattgtaataggtgatggtgcggttggaacgttattgcattcacatggtttgcaaagtagctttcaagaattga

SEQ ID NO: 1179 - DNA, 6135 bp, Bacillus thuringiensis
  unsure (1)...(6135): unsure at all n locations
ttattgagaaaggtggattcttatgctagattttacctggaagtttttctccaaaacaggaagcattgaaacgtacttgcttttgaaagaaatggaaaaagacgtaaacgatgagatggatcaacatgaagaggagctagcgcatctagactctccaatttcttgacccgttttgttcaaaccttggatggtgacgaacatgtttcaaaaagttgagggcatcgttatccgtacgacagattacggagaaacgaacaagattgttacaatattctcaagagaacttggtaaggtaagtgcaatggcaagaggggcaaaaaaaccgaaaagccgattagcatctgtgtcgcaattaatgacacatggccagtctcttattcaaatgggatctgggcttggaacattgcaacaaggcgagattatttcaactatgaaagaaattcgcgaggatatatttttaactgcttatgcatcatttattgttgaattaactgatacagcaacagaagataaaaaacataatccgtatttatttgaaatgttatatcaaacgttgcattatatgtgtgagggtgttgatccagaagtattatcattaatttatcaaacgaaaatgcttccggtattagggatgcgcccgtactttgatacatgtgcgatttgtcatcaagaaacagactttgtcgccttctccgttagggaaggcggttttctgtgctcacgtcatgcggagcaagacccgtatcgtataccggtaggagaagctgttcataaattattacgtcttttcttccatttcgatttacataggctcggaaatgtatcggtaaaggatagcacaaaaaaacaaatgcgtttagtattgaatacatattatgatgaatattgcggaatttatttgaaatcaagacgttttttagaacaacttgataagtttcaaatataattttgggccgtatacggtcctttttacatactttctttttcgaatagcatatttagtatataatatttaagagatagtataacttttttcgttgtgcattaaaggtggtgattatcatagagctgaataaacggcaagaacatatcattcagattgtaaaagatcacggtcctattacaggggaatcaattgcagcgcaattgggtctaacacgtgcgacgctaagaccagacttagcaattttaacgatggctggttatttagaagcacgtccacgcgtaggttatttttatacgggtaaaactggggggcagctattatctgaagctgttaagaaaattaaagtacaagattatcaatctagaccggttgtaattgataaaaatgtttccgtatacgatgcaatttgtacgatgtttttagaggacgttggtacattgttcgttgtagatcagatgactctattagttggtgttgtgtctcgtaaagatttattaagagcgagcttaggaaagcaggatttaacctctcttccggttaatattatcatgacaaggatgccaaacattgcgatgtgtcgtagagaggattctttatatgatattgcgatggaattaatagaaagacagattgatgcaatgccagttgtaaaagatacgaaacaaggtttagaagtgattgggcgaattacaaaaacaaatattacacgtgcgtttgtaaatttagtaaataacgaataagtgtaatttgtttaaagtgaggtaatgtaatggataataaaatcgtatatgtcgtatctgactctgtaggagaaacggctgatttggttgttcgagcagcaatggggcaattcccgtttgctcctgatattagacgtgtaccgtatgtagaagatacagggacattaaaagaagtgatttcgattgctaagagtaatcaagcacttatatgttttacgttagttaagcctgatatgcgcaaatatttagtaacagaggctgcaaaagaaggggtagaggcatacgatattatcggccctcttattgatcaaattgaagaaattacggggcaagtgccgagatatgaaccaggcgttgtccgtaggttagatgaagaatactttaaaaagattgaagcgattgagtttgctgtgaagtatgatgacggcagagatgcacgaggtattttaaaagcggatatcgtgttgattggtgtttcgcgtacatcaaaaacaccactttcccaatatttagctcataataaacgcttgaaagttgcgaatgtaccactcgtgccagaagttgacccacctgaagaactatatcaagtggcaaaagaaaaatgtttcggtttgaaaattacgccagataagttaaatcatattcgaaaagaacgattaaaatcacttggattaagtgatggagcaacatatgcaaatattaatcgtattcaagaagaaattgatcactttgaggaagtaattagtaaaataaattgtcaagtaatcgatgtatcgaataaagcaattgaagaaacagcaaatattattgtgaatgcagtgcaaaaccaaaaaatgttttagcacatttaccaaaggtgaatgtgcttttttcgctcgtgtgaaatatggtacctatggattttgtaatagattgtagtgtaatggttatacttatactcctttgtcttttagtatattcaaggtgtgagtttgtcatcctgaaatgtaagatgaaaaaataaagggatatgtagcgtagttgaagaaaatatattataataaaaaattgtgataaaaacctatattttacgtttagactttaatttttcagaataaactagggataggatttacgaaaaagacatgtaattacgttaaatcgacaaaatctatacaagaaaacgcacattatggaaggattcacagaagggatgtagaatacagaaatatgcaaagcatcaacaacatattagttggtgtagatgtatatcccgtgaaggctgaaattgtgcaagttggagcggaatttcatgtcggaattttgtttgtcgcatcatatgctcatcctttaaggaaatagcaaggcaattggatctttgtagatactgaacaaaatggagttgatcgttatatggatcaacatgaaaaagttacaaatctcaagatcaaacagtatatgtggcttgctactcttcttataaaaaggtgtgtatgtattgtttctaagagatacatttgtaacagatgagcaaatgtatacaattttatatagcaagtatgtatatgcgatttatgcagataaaggacctataggaaaggttcaaaatcgtttatacaatgtaatcggcaacactttctaacaagtttagaaaaatattgtcgaattataaaggaattttttaatttatatcgaatacaaaatacgacacggagatggagttatggggaacagaattcccgaagaagttgttgaacagattcggacatcatccgatattgtagaagtcattggtgaatacgttcaacttagaaaacaggggcgtaactatttcggcctttgtccatttcatggtgagaattctccttcattctctgtttcatctgataagcaaatttttcattgcttcggatgtggagaaggtggaaatgtattttcctttctaatgaaaatggaaggactggcttttaccgaggctgttcaaaagctaggcgaaagaaatggaattgcggttgcagagtatacatcagggcaaggacaacaagaagacatatctgatgacactgtcatcatgcaacaagctcatgaattattgaaaaagtattatcatcatttattagtaaatacggaagagggaaatgaagcactttcatatttattaaaccgtggtattacgaaagagatgattgagaagtttgaaattggttatgcatcacctgcttgggatgcagcgacgaaaattttacaaaaaagaggtttatcgctgtctagtatggaacaagctggccttctaataagaagtgagaaggatggtagtcattatgatcgcttccgtggaagagttatgttcccgatctatacgttacaaggtaaggtgatagcgtttagtggaagggcgttaggagatgacactccgaaatatttaaatagccctgaaacaccgatttttcacaaaagtaaattgttgtataacttccaccaagcaagaccgtttattagaaagcgtgggcaagtggttcttttcgaaggatatgccgatgtactagctgcggtaaaaagtggtgtggaagaagctgttgcgacaatgggaacagctttaactgaagaacaagcaaaacttctgcgacgtaacgttgaaactgttgttctttgctatgatggtgataaagcagggcgagaagcgacgatgaaagcagggcaattattgctaaaagttggttgccaagtgaaagtcacatccttgccagataagcttgatcctgatgaatatgtgcaacaatatgggactactgcttttgaaaatcttgtgaaatcaagtgtgagttttgttggttttaaaataaattatttgcgtttagggaaaaatttgcaagatgagtctggcaaagaagaatatgtgaagagtgttttaaaagagttatcgttgttacaagatgcgatgcaggcagagtcatatttgaagtcattatcgcaagaattttcgtattcaatggaaacacttttgaaccaattgcaccaatatcgcaaagaacaaaaggtacagcaaaaacaaataaagcaggttgctaaaacgtctcaagtcgttcaaacaaaaccgaagttaacaggttttgaaagagcggaaagagaaattatttaccatatgttgcaaagtgcagaagtagctgttcgtatggaatcccatatagaagattttcatacagaagaacataaagggattttatatgaactatacgcatattatgaaaagggaaatgaaccttcagttggaacatttttaagttggctctctgatgaaaagttgaaaaatattatcactgatatttcgacggatgaatttattaatccagaatacacagaagaagtgttgcaaggccatttggagacgcttagacggcatcaggaaaaacttgaaaagatggaaattatctttaaagtgaaacaaatggaaaaaacagatcctgtagaggctgctaaatattatgtagcatatttacaaaatcaaaaagcgagaaaatagcttttttgataaagttttagtataatgaatgtttgtatctcgcgtaaggaggggaacagatggctgacaaaccagctcgttctaaacaaattgaaactgaaatgacccttgagcaagtgaaagaacaactcactgagctcggaaaaaaacgtggcgttcttacatatgaagagattgcagaacgcatgaatggatttgaaattgaatccgatcaaatggatgaatactatgaatatttaggtgaacaaggcattgatttagttggtgataatgacaacgaagaaggccctaataatcgccaaattacaaaaacagaagaagagtttgacctcaatgatttaagtgtaccacctggggttaaaatcaacgatcctgttcgtatgtatttaaaagaaattggtcgtgtagacttactatctgcagaagaagaaattcgacttgcaacgcgtattgaagaaggcgatgaagaagcgaaacgtcgtcttgcagaagcaaacttacgtcttgtagtaagtattgcaaagcgctatgtaggccgtggtatgcttttcttagacttaattcaagaaggtaatatgggtctaattaaagctgttgaaaagttcgattatcgtaaaggtttcaaatttagtacgtatgcaacttggtggattcgccaagctattacacgtgccattgcagaccaagcgcgaacaattcgtattccagttcatatggttgaaacaattaataagttaattcgtgtacaacgtcaattattacaagatttaggtcgcgaaccatctcctgaagagattggtgaggaaatggatcttgctccagaaaaagtacgtgaaatcttaaaattgcacaggagccagtttctctgaaacaccaattggtgaagaagatgactcccatntaggtgactttattgaagaccaagaagcaacatcgcctgcggacatgca

SEQ ID NO: 1180 - DNA, 5965 bp, Bacillus thuringiensis
ctttttaatcatttggattttttatattcatcatcgttgttactcctctatatttaagataatatcttccttaactctaccatagaaaaacgattaccaggacagctttttgtaactccttctaactctctatgacctagtatattttctttctttatagcaaattgcttcataaacattttgcataaagaatataatgcattcacttgtgcaggagttggatcgtatttatcgaaatttcccgtcatacatattccaattgtatgacggttatggtctttcgcgtgcgctccaatatgtaaacctcgcccttccactacagttccgtccttttcgataaaatagttgtaaccaatcccgctccaccctcttacagtttgatgaaattcatgcgttttatacacgtcccatccatcttcagctgtatggtggataatcagttgatttactttttctaaaggaactaattcatcttgaaatgttagattgacatatttaatttccatttgaactgcctcctcttaaaaatcaatcataataatcgttttatcatctggttttattctcttttccccttccagcttttcaatgattgctacatattcgtttatactattctttcttatatatgcaacagtttgttctaatgaccaatctgggtggaataacccgtctgaacaaataaaaattccactcacttcatctatatgtaattcaccatgttgtaaataatgtatcgcttctttcattccatttgcaactgaataaccatttggcatatttgcaagataacgattgtattttaactgttctcgcacatcttgaaaaacatattcttctggtacagataacccttttttacgatcttcttccctcttcctttttgctcgtttactaattccttcaactgtgtctttcgttaatacttgcatcgttccattttgaaaagttgcgacaatcatacagtccccaagctgcgcatattcaattttctcaccaactatttgaactgccgcgatacatgtgcaccacaaatgctctttttttctcgtgtctacttcatattctaacattttgctttgtaatgcttcatttgctttggtaactgcaaattgtaaactatgattctctcgtaatgcagtaaaataatttgcaaataaatgcgaagcgatgtatgctccattatgtccattttcatcacgaaacgggacaagtggtgttgcaccgtcacatacaccataaatctttttatctttattacaaaaataagaatcctcacattcttgcttcaacgggcttttctgttgatatgtttttatcttcacaactgtatcccctttcaaatgataaaatactcaaattctttcgattaatctaatttaccaaaataaactgtttttacccaaaactttcaatatcatatataatcttgaaataatatgaatttttcagtgaaggacgggaaagaaatggtcagattccttggtgttattatcggttctattattattgcggttgcctttaatcttttccttatcccccacaaaattttaagtagtggaattggcggaattgctattattttagggattgtaacccctgtaaacacaggcattattaactttgtattaaacttacctatccttattttagggtacataggccttggaaaaaaagtgatttttaacacagttgtctctgtagttgtattatctgttgcattatactacgttccagtaaaagtcgtagcaacagatccattgttatcttctatcttcgggggtgtcatcgccggagctggtattggtcttgtttttaactgtaatggatccactggtggatttgatattatcggtatgcttttatcccgcaagcgagacattaaacttggcggattccttattattttaaatgcagtcgttgtaataatcgcaggattcttcttcacctgggatgttgcacttacaagcttactttcaatttatgtaactggtaaagtaattgatgctgttcatacaaaacatcgtaaagttacacttatgattgtaacaaatgaagcagaaaaaatgaaaaaacagcttctttcaactgttgtacgtggaataacgttacttgatggcgaaggcgcttattcaagcgagaaaaagcgtgtacttatgacggtcgtttctcgtgaagaattagcaagtatgaaacttacaatttctgaaattgacccgaatgcattcgttaatattacagaaactgtagaagtgttaggacttttcagaagaagttaaagactaggtgggaatacacctagtctttattttgcataaattcaattctgtttccaaacgggtctgatacgtaaaatcgaattacatctggccgtgcataatcatcaatcacttttacacctttctctataagtgtttgcttaaattcattaacttcattcacataaaaagctggatgagcctttttagctggtgtaaagttccgctcgacaccaatatggatttcttgatttccacatttaaaccaacatccacctcgttttttcaactcttctggctttggaatttctaccataccaattttattcccataaaaatcacgcgcctcttcttcacactctacaggtgcagctacttgcacgtgatcaatcccttgaatataatttttcattttctctccccctcctctaccctaatgttatacggaaaacagccgtctgtaacttacaaaagggttataaaacaatataagctccccttattaccatcctgcattcactttgcaaaaaaaataaaaaaataaaatttattctataacttccattttttatagaaatacacatcacatctatattatagttatgaatagacaaatctttttagatgctatttgtacggaggaactattatgagtcgtaaaaaatattcaccaactcaaaaaaaacgtcatccgaacatttctagacgtttgcgaaaccatatacaagatcgttcattaacagaaatgtacgcatctctgttcgaacataatcctgatagtattatttcattaaacttagaaggagttattctacatataaatccttctgccgaaagaatattaggttacacttctttagaattagaacagaaaaatattacctctattttaggagcccatatttctgagcaagtattacaaaatataaagaatactgaagcggataatcaacaagagtatatcttatctatttatcataaaaatggattcttattagatgttgtgacaaaactagttcctatttttgttcaaaatcgtcttactggtgtatacgctattatgaagccacttgaaaaatcagaaagaattgagaatatgctaaaagaaagtaagaagagattacgtacattagtaaactccatgcctgcgtttgttatatttaaagatcatgaagggcgctggcttgaggcaaatgactacgcactttcttgcttcaacttccatcatgtaccttaccacgggaaaaaagatagcgaactcattcaatataatgaagcataccgagaagcttttttacattgtgaagaagtcgatgaactagcatggcaacaaagacaaattcttcatggcgaggaatttattatacatagagatgatttcgatttaatcttaagtatatcaaaagttccgctttatcatcctaatggttctcgcaaaggtcttatcgtgatggggagagatgttacagagctaaaagaaactgaaaagttactacgaaaatctgagaagctcgcagtagtcggacaactgacagctggaattgcccatgaaattcgaaatccactcacttccctaaagggttttctaacattgctcctccctgaaataaatgaggagcaaaaatggtatatcgatgttatgttaagtgagatttcacaaatggaatccatcacgagtcaatttatggcgatgtctaagccacaagtattatctatccaaacttgtaacatacaaactttaattgaagaggtagttacatttattttaccgactgcaattatgcatagcgttcatatcatcatggatcattttgattacgtatatgatattcaatgtgacggtaaccaattaaaacaagtttttataaacatattaaaaaatgcgatagaagcgatgccaaatggcggaaatattttcatccaaacaaaaccattagaggataatttcatcttaatacgaattatcgatgaaggttgtggcattccagaagatcgtatctcccgtctaggcgaacctttttatagtttaaaagaaaaaggcacaggactaggattaatgatgtgttacaaaataattgaagaacatcatggtaaattacacatttcaagcgaattaaataaaggtacaattgttgatattgagctaccactttcttcatctcatcttgcaatccagtcctaaataaaaaagaagcatctgctaatggttagcagatgcttcttttttaaaatactttgtcataccactcttttgctttttctacttcacccatcgttaattgatgccctcgattttcccaatgcattgttacattcgcgtttgcattttctaatagtatcttcaattcctctgactctgctgatgaacaaattgggtcatttgtcccagcagcaataaacacagatttccctgctaaatttgctaattgcattcctcttcttggtaccattgggtgatgaagcacagcacctttcaatgcattttcgtaatggaataataagcttgctgcgatatttgccccattcgaataaccgatagctacaatgttatttctatcgaatttatattctttagccgcttcatctaaaaattcatttaattccttcgtacggaaaattaaatcctcttcatcaaaaatgccctctgctaatcggcggaagaaacgcggcatcccattctctaacacatttcccctaacgcttaataccgacgcttccggatcaactatttctgcaagtggtagtaaatctaattcattaccacctgtgccatgaagtaataacaacactggttttgacgtatcttttcctttttgaaaaacatgtttcatcataatccttttcccccttcaatcactttaatctaaatttctcacttcaaatggtaaaagcgtttgttcaatctgttttctatgttgttcatattgttccggtaactttaattcctcacccatcgtctctaacgattcatcatgagcgaaaccaggaggatctgttgcaatttcaaataagatttcaccatgttctctaaaataaatcgcgttaaaataatttcgatcttgtacaggagttacgtgatatccaaaacgcgacacatgctctttccagtctagctgatcagcatcgtcactcgctctccaggcaatatgatgaactgtgccaacgcccatttggccacgaccgattgttgataatttcaaatcaataatatttccaatgtcagcagaagaacggaatcgaacaaattcaccctcttctccaattttctcaagacccataatatgttctaacaattcagctgttttttgaggctgtgtagataaaagaacagcacctccaaaccctttaattgctacttctggtgtaacttctccaaaactccaattatttaattcgcctttttctctttcaactaattctatatgcaaaccatgcggatcatcaaattctaaatactgctctccaaaacgagtcatttttgtatacgaaacatcgaatttttctaatctattttcccaaaactccattgcaccttttggtacaacgtaagacgtaattcctacttgaccatctccaataataccttgacgagcacctgcccatgggaaaaacgtaataattgttccaggctttcctccttcatttccaaaataaagatggtacgtacctggatcatcaaaattcactgtttgtttcactaaacgtaa

SEQ ID NO: 1181 - DNA, 9089 bp, Bacillus thuringiensis
ttaggtgtgctcgctcatatgggctcagctgctgagtctaagtagggggtgaaactatgttatttaaattatcacgtcatagtatgaaaaagatgttaaaagattatatggttttacttattggcctcgttattagtattagtattttctacatgttccaaacgatggcgatgaatagtgaatttacaaaagataatagtctaattagtagtataaggctcgtcttctgggtaggtgcaatactattatccttcattactgtattttatattatatatgccaactctttcttgctcacattaagaagaaaagaactcggtatgtacatgatgcttggtgcaaaaaagaaaaaagtagcacagttattatttattgaaacattcggtatgggtattgtcagtattattatcggtattttagtagggatgttactcgcaagtgtagcagggaactttttaatgaatggaatggaaatttcagcaaaaggtagttacgcatctgtatacacaccagcaattttagttacagctattttcttcttaatattatttttcattactggcataatgaacagtgtccgattgttacgaaaaactgaactagagttaattcgtgaagatgaaacactagatgaagtgaagaaaagtaaaactcgcattattataatgacagtacttggtgtattactagtaagtacagggtactattttatgatcaatgtaaaaatttatgctgaattaggttttattatagcaaccatcgttacaacacttggaacatattttatctttagttcattactcccattttttgtgatgaaaattaaggggaataaaaaacgaaatgaaactggtctaaatagttttacatatgcacagctacgctttcgagtaaatagtttatcgagagtattaggtactgtagcaatgttaattgcattaggcgcaggtgcgatgacggcaggtatggcgttccaaaaaaatgtaggtattatgacagacttttctcgtgtatatgatgttgtaattcatgatccgaatgatcaagataaagctgccttaaaagaaatggaaattgttgaagaaagcaagtacaaatataaagtagatggagaagcggtttattatttacgtaacgacttaactgcgaaaccaccacttgtttcagaccattttgatacaaaaactttaaaagagcctattcgtaaacgtgtgactgaacctttaactgaacctgtatattcagctttagaggctcctgaattagcaaaattccctcaaatgccaaaggattgggaagacgcagttgtaagagagatacaaattacgcataatcaatttagcggaaaaccagtaaggattgcagacgaagagcattataaagggattcaaggaacagaacatactgtaacattagcaaaagtagatgatatgaaaaaatataaaccgttattgatcgaaatagacaagagacaaaaagaacaaattgaaaaagcaacaggtgaaaaggtagacttatttacgaaaatgacaatttatcagtttatgaacagcttcatgagcggaacaatgtttatgggatttttcctcggaattgcctttttagcaatgatggcaagttcccttatgttcaaaatattaacaggtgcttctcgcgacgtacgccgttatgaaatgttacgaaaaattggtgtgagacgcagtatgttaacgaaaagtatatataaagaaatttcatatttatttatcttcccagcgatcattggcatttcccacgtattagtagggcttaacttattcagctttatattagttgacccgtttgtaaaagtatgggtgccaataggaatcttctttgtcatttatttcatttattactggataactgttcaactttataaaggtatggtaatgccgaaagaagaggtagctaaatagtttatgaaaagagtccttgtgttgaaagcaagggctcttttctatgtgtttttataaaaatgtgtatgcgagatgttttcaaatctttctgtaatgaatataacttgttagacgtaattcgttataacgttggattatcacattctcaaactgtcttattagaaaaggatttaaaaaatccattgcctactaagcttcattccatgcagcaaaaacatattttgataagatagaagcagatcaaaaacaatttattacttttgagaaatcagctcattatccacaatttgaagagaaagaaaaattctataagtggatgtgcgatacattcataaaataaagtatatccgaactttagagaattgaaatagttagcgagatgtataaagatttttagatgcatagtattacatagtattaactgaagcgaaattaaataaaaagactcttgataaaaaataagagtcttaagtacaaccaactatgaatgacttttctttttataaagagatacaaaaataaaaaaagatagctgaagacaaattgttttcagctatcttttttcgtttaaagtggaggtaaatcaatcttaccttcttcaaataattcttttatcatatgcttcgtataaccagcggcttgaccaaatgtgatttttgctggcattggtgcttcgttagcatctacaactacatcaataatacacggtttattttgttttactgcattttcgaaagcgggaaggagttcatctaaattctcaacacggtatccaatacctccacacgcctctgcatattttgcaaaatcagggttcgttaaatctgtttcgaattcgatattacccatgacttcttgctcgaatttaatcatcgcaattttattattgtttaatacgacgacaacgattggtaatttatattttacagctgttacgaagtcattcatcgtcattccaaatccgccatcaccacaaactgcaaatacttgtttatctgggaatgcaatttttccagcaagagcaccaggtaaaccgcaaccaagtgttgcgagccagctagaaatgacaaattgctggtttgtcatacggaagtgtcttgcggtccatactgttacatttccgacatcaactgatagaattgcgtcatcatgtgctacttgctgcagagcatgcataacgcgttgtggtttaattggaatggaagagtcttcttcttgctcgtgtaatttttcttcccactttttcatcatttcttggtgctgttctaagaaggaatggtctgtgtgttcttcaacattttcaattaaccatcgtaatgttttatcagcatcaccagctaaaccaatatctgtcgcataacgtttcccgatttgggcaggatctgtatcgatatgaattgtttttgctttttcaggtaagaagccggtgaacggataagaagtaccgaccataattaaagtatctgcatgcttcattgcttcataagaaggtttcgttccaattaatcccaatccaccaatacaaagagggtgttcatcaggaataattcctttagctggtaatgtaagtacgattggagcaccaatttgttctgccaatgcaagtaaagattctctcgcatgttttgttccttttccagctaaaatcacaggctttttcgcttcatttattgcgagtttcgctgcatctaaatcttctttttgtggaaacaactcaggcaaagtaaaagaagtatttgtaacacgggcaccatttttcacttcaaatttcggaacatcatctggaatagtaagaacggatacaccttttttcgtataagccattcgaattgcttgattcactacggcaggtagttgctctgctgacataatacgctggttataaaccgcaacatcatcaaacattctttctaaatttacttcttggaaaaagtccgttccaagtaaatcggtttctacttgacctgaaattgctagaacaggggctttatcgagtttcgcatcatataaaccatttaataaatgaatagcaccaggtcctgcaattgccatacaaacgccaagttttcctgttaatttcgcataggcagccgctgctaatgcaccagcttcttcatggcgaacttgaataaatttaattttatcttgtttttttcttaaagcttcaatgatagaattaatggaatctccaggcataccgtatatgtgctctactccccaatcaattaataaatcaactaatgcttcacctgctgttttcccaaacataattgttcctccttataataggtagataacattatgttttgaataaaaaggaaaaatatacaagtaagaaatttatctagttatttgtaatccaagaatcagtgtgggaggaacaaaagtttcactttagcaactttaatgatgaccagcgaataaagtgaacactgttattagtaaaaaaccactagttgcccacattagaaatgtaaggaaagagagctgtttcttagctttccaaagcatttcatgaattgtgacatatccaagtgaaccgatagcacttcccataatgaggccttgcaggtgaagagcttttccttccatcaaaatgccaaaaactgtgccagtaccgagaataagagaaagtaataaagtcgttaataaaaaggaaatatatttatgttttgtaaaaagaaatggaataattaaagctaatccttctggaatatggtgaacgacgattgctattaaaaagggaatggcagagtcattatgatttataaaagctgtacctaacgcaaatccactcggtatattatgaataaatatagcgaaagagagaaaaaggaaggtttgccatgcttgttgatcttttttatgtatcattggatggtgacaatagttatctaataagctcataactaaaataccgatagctataccaagtataggcccaaccatttcgtagcttgaaaatgtttcaggaataatttcaagggataaaagcccaagtaaaataccaccacataatgcgtataaacgatgcatcttttcttcaataagttggcgtgttgctactccaacagcacctcctaatagtaatccaccgaacgaaaaaaatgttacaatcattggaatccataaacgttccatagtatcacactccgattctattcccttatttttagcttacgaaaaggaaagttagattagtccaagtaattgtgtttgattatagagaaaaaagtagtgattcgttataatttatatattaattttaagtgagaaaatgaaaaggggaattggttatgcaacaaattaaaaaaataggaaactcattttggtatatgacacctgtttctgaaacagatagacctatctagaatgggtcgttggacaagaaaaaacgttaatgattgatgcaggaaattcagaagaacatgcacaattatttttagaaatgttaaaagaacaaaatgtatcgaatcctgattttgtagcattaacgcattggcattgggatcatatttttggattatctgtattacagaatgcattaactatttcgcaggctgaaacgaaaaaagaaatgcaggcaatagtatcttatgaatggacagatgaagcgttggacgcacgcgtaaaagagggtactgaaattgcattttgtgcggattgtattaagaaagagtttgaagaaaaagcgagaaatattaacattattcctccaaccttaacgttccaggatcaaatggaattagaccttggtgaagtgacatgcgtgttaaaacatgtgggcggagatcatgcgcatgattcagttgttatgtatataaaagaagaaaagatattgtttgtaggagattgtatatatgcagatattttttcttcaaagtggaactatacgacgaaaagaacgtttaaattgatagatgaattagagaaatttgatgctgagacatatattctttctcatggggcagctataaatcgagacgagtttttacaagaaattcatttgctaaaaacagtaggaacatatacagaagctcataaaggcgatgaagagaagataaaggcagcgtataaacaagagctagatagagaattaaatgcagatgagttagaaacaataacgtattttgtcaatggttatgaaatgaataatctgtaagacactacattaatcaaatataattaaattgcacaaaaagagtattgaaatttaattcaatactcttttaaatattaagttccaagcaatttctaaattttttggctggttcatcatctggatttacaccactttcaaaactggtagtgaaaggtaaccactgccaatcttcgcatcctacaaaagctacccttgaccaattctcaatgaattcaatgaaattattcgcaatcttatacccatgtccttctccatcgtcgtggcttaggtaaattatcggagcatctatatcatctttcatatcaaatgctaaataatctccatttcccacttcacaaaatgctaatttgttgtgccaaactacatcatattcatcatctagatttgaaaaaaactcgtcaaccaagtctttacgttctttttcgaattcagaaagactttctaaactccagtggggtgaaccgaaaaaaatatcagtaatttcatttggtagctctacatcatcaggtaaaaaccagcgtaagctaaaatttcctgagaactctaaaagtacttttttgaagctatttggtagtttaatacccagtttttcttctacttggattatttgttcaagggaagatggttcatctatacaaacttcttgaacttcaccacctatgtatttaattctagaagttataatttctattcgttcttttagtaactcataatccatcttatcacctcatgttatattaattaaagtatatcattcttaataaattttttcgtgttattgaggttttaagtagcagctttctttgctaattcagtaatatattcaaagaaaacatcatgttttacatcataaacgacatttacaggtcgtccatcagtagtttcttctgtacgtccttggcttggtccgtatgtatgaacgatactattaatcgtttcagtttttgcaaggctagtgtttccgacaaaagcggtagttagtacatcccataaatagtaagtagagttcgttgagaagtgaacgagaggagggaccattgcatagcattgaccaaggaaatccataccaatatactttcgctcttttgcccactgttcacgtatgtttatagttaacggaacttggtttgtactttctagtgtcactaagtcgattttaatttttgcatcccatacacgagctactgcttcaggatcccaaaacgaattccactcagctgttccatcatgctctggttcatgtacattgccagctttaagaaatgtaccacccatccaaacgaggcgttcaattttatcttcgattatgggagcttcatataatgcacgagcaaggtcagttaggggcccagtaaataataaagttgtttttccttccgtttgtagaagcgtttctattaaatgatgatgcgcgggttttgccaccacgggtgttacaacttttccagactcatttaaaattggtagagcatctacataaaatgcatgcatccgccagtctttcggaaacgggttttgcccgcgagagtttgaagcggctacggcaatattacctttgccgaagcgatcgataattttacgactggcagacattgcgggttctaaatagcagtctgctgggataacagatacccccgtaagttcaatgttttccatttgaagtaataaaaataatgaaattaaatcatctacgccgccatcatgattgaagtacacttttttcttcattgtaatctccatcctatatgatttagttagaaattaaatatgaattgaggaaaagtcatcaataatttccaccacttcaatttctccattaatcagtagctcaggaagatcatttctaatatttcctttccaatactctctagcttgttcgattttttgagaaaaaggaattccatcttctttcggtaaaagattcccgtcaccttcaaaagaatttccaatcactcgtagtttaacaatctgtaaaacttctcgattgtaagaatcaaataatgttttccattttaaagcatcttcatagctttttgaagcgtataaacaagataacctggaagggtattcagggaattcttgtagtctaaccatttctacaattgtttctctaactgctctaattgtttgatccatataactcataactactttagtattttcattatttatatgtaattcgttatttttatagtgtttatttaaaatttgtatgccatcttcaccactagcatttaattgttctctttcaaaaaagaagtgatatagagtattgtgttgatttttgttaaaaagaatgatttgtccgatatgcatttttttccttgttacgatgtgatatgcgtaaaattctgcttcattcatggttatcctcctagtaatagtgtaatgcaatgttaaatttagtaattcaacattgcgatatatataacctctataagtaaaagtgagaatttgagtagaaaggaaaaaatgaaaacgttttaaatttgttcacaaaatgttcacttacgaagaggtttccaatgtcgatataatgacaaagactcaaagagaaaggatgatgaaatttgccaacaacaagaaaggaaaaactccaatttggcatgatgatgtgccttgggatggttatcgtaatgacgttttacaatttactaatgaatgaaacaggaggaccaatttatattaaagagattgcattagaactattaattggctttattattgcactattaattgaaatatgtatcgttggaccttgtgcgaaaaaaattgtattcatattgccatttgataaatctaaaaaaataaatattatcgctgcaatggcgacaactatggtaattggaatggtgttctttatgtcattattcggcatggctatgatgtatttacatgggggactacaaggagatttcattttgattccatagagtgttctgataatattaaaactctcataatggctgtatacattaatattgacaatt

SEQ ID NO: 1182 - DNA, 4804 bp, Bacillus thuringiensis
taatctcgatctataacaaagagcaaggaacgtatcactggttaattcttcatcactgaacgtcccttgctctccattacttttgaatattttttttttgctcccattgcactttgaatcatatccataatttccgggataatatccgaaatagggaattcatcaaaaccggctaaccatgtaattggttcggcaatttctggatttgctgttttcgcatataaccaaactaaatcatatacaacttcaaaatctagcttacttaaatccgcattagctaaatcaatagtggctagtgaaccctcttgaggatttgaaggagacaaaatccctaacttaaacatatcagcaaataaatcacgtctgaattgtgctttatatcgtttaacagtagctgctgtactttttaatcggacttgttttccatctattgtaattgtcttttccatttactattacgctccttttggtgctgctggttttttaacgtacacttccttgtaccaatttttataaatttcttgcgttgttttagatgttgtttttgttttaaccataggtcttccccctggtgctaaaataattggactagaaacaaacttcagttcatttgtatttggctcagctgaacttgtttttgttttagatgcaagtgttggacgacttgctgaacagttatacataacatgtcgagttgcattgacatcaccatcaaactcaaataataatgcgaatggttttccttttgcatcagccaattcattcaatacaccatctgtttcgtctaattcctcaccaagtgcatcaatagcaaacttttctgggatagtagcaatacttaatgttccatcgtaaccctgattattacttgctgcgtaataaagcatgtcatccgcatagaattcaattaaatcaccgcgtggctcaaatgttagttccactccaccaggtaatggaattggtgtaccaaatgtaactaagaaatccttaatatctaatggcacgtaatgtacatttttcaaaccgaatgttaccttgttttcattcatttacaacaacctcgtttcatatattttttgaaatagtttttcagattcaataaaagtcccatatgactcatatggaatctcataatcatccaggacttgttctagcttggcttctgcaactaaatccttcttagttgtataaagctctatatttacatcatttattttgtgataggtcttattgtcggctgccatgttaggtgatccatctacaaagtagcaaacataaggcggtgaaggtacgggaacacctggtgtttcagtgaaatgcgaataagccacaggataacctgtagcctcaagaattttctttagttcacctaatgtcattgcccaatcgccctttcaacacgttcaacaaaatcatgaatcgcatgttcttcagctggtgcaatatgaacctttgctggtactcgtccaccatttgccttcgcatgacctttctccagtaaatgagtaagctgcggttttaaagcattatgaacaataattgcgttcccatccttcttttttcgccaacctttactatacctacctgtatttttagggcttttttgctttaattcacccactaaattatccgctacctcttccttcgccacttccatgtcttcctcaattacattggcatatctttgtagttccctagcaatttcattggataaatcatcgatattagccacctgtcttcacctcacaatagagttcaattctttcatcgtctctttcgtatgtgcgataaatgttgtatttcttgttgtgatactgtactttctgttcttcttgataatccaatgtgtaaacaatcaatacacatttgggcttaaaaccattttgaccagcttgaaagaattcattttgagaaacactttttttctcacaaaatacttgtcttgtaaactcttctgctacttctatttgtcctaaatcgtctgtagtagtcgttacaactggaaagaatacaatgtcattcatttgtaatcacctgctaaagtgagatgatttttcaacatgttatacgatgcctggaatctttcagcctctttgacctcagcaacaaattctgctttgcaatatacttttatcgctcttttgattaacggatcatcgtcatgattcgctttaatagaagaaacacccgacaacattaagtcgtgtcgagcttcctctattgcatcgtttatttcatcgtcaagggcatcatgagaaatgcgcaatgccttttttatatcttttaaaatcatgattcgttacccctcaatgattgttcagctgacatcgcttcctctttcccttgcactttttcaccattcgataattcataccatccaccgccagtatgcttagggaatgtagaaatctctttatttccttttaagaatcctttttcaattaaaaaggcaacacgttccgaatcatttgactcgtacatatcgccttttgaatatccaacttttgtttctttatcaatgaaagcattcaagactaaatgattcattgtatcactcctttattaagctgctggagctttttttaaaacaactaaagagtttttgtctactactttaccatccacaatcataattgcctttgtaacttgatcgtcagtttcattgtcttcatatttcttaacacccatttggtagtttgtattcagaatataatccttgtaattaaataagaatgcaaatgttgttccttcagtagccgttgcgaaactatcaacataattacatagaacaactggacgacctaataaaatgcgttctggtttaccggaaatcccgtaatttgtacgtgcaatcggctggccgtctgcatctgtcattgccgaaaattccataaatgtctttttcgtcatcgtccaaatcgcgcttgcttcatactcaagtggtaaagccgcttctgcatctgttaacgttttgtagttaattttcgcaacatctaatgcttgtccgtcaacaggtgtttccgctagaatcccttttggcttaccagacccatcaccactaacaatcgcttgttcaatcgcttttgtcatagcttccacaatattattaattaatgttgtttcaaataccgcaagagacattgtttctacttcaagagaaaccgctacggcacaacgtaatttgtgatagttgaaagtaatgcttcctgtagttttcttttgtttatcacttccagaactttcagcaacccatgttgcgactggtttaactgttgaagttggtactgttacgccgcctttaatagctgtacgagtaattaaaggtagaatcattcctaccgcttcaatcttttcgataattttatctaatactgtttgtgggataacagaaccgatgtcacttgttttcgtaacagcatttgcacgtaattcagctggaattgtttcaccgcgtaatacgtaattcataaaagcattacgatattcaactgtatttgtaccaagttcacgtttttcatttgatggatccgtattaaatgtttcaatcttattagtaccagctgcatttccttcattaattgaacgtgcttcatttaaaagttgttcacgcttctcaatcgctgccaactgattattaatatctcgtaactctgtttcaattgcatcaaggttatcaatagagcgagtttcatcacttaataattcactgatttcagatttacgttttaataattgttctttattcatgttcaaagtccaccttttataataatgtttgtaaatatagtcttctgcgcttttccgagcgctttttttcttctgtaaaatgtttataaggatcatatcccctagcacttacttctgaatctgggtaagctgggaaagctactgcgctaacttctaatagttttgcttttgtaacagttcgtagcatcaaatcatcatctggttcttggatttcttcgcttatcatgctaaacccaaacgaaacaccatctacatctccacgcttaatagatttgtaagtgtcattacctagagttgtatctggtaaatccaattcaaagcgtaagcccacggcatcctcgctcaaacgtaacgtattattctttgttcttcccagcactttagatgtatcatgagaccataaaaaacgttggtcatcattttgtaatgtttctgtgaatgctccatttttaaattgctcacgaaacttacgataatatcccataactacggatttcttttcccactttactgcatagcctataagtgtccgatttccgttatcatcttctctaatttcaatcttctgtgttactatttcccttgtttccgtcttgtccattatccccacctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaaactggaaaacctattactaagccatttccctttcagaatcataaagaaggcggacaagcactgttaaattggatggaccaatatattgagtctcctacag

SEQ ID NO: 1183 - DNA, 4267 bp, Bacillus thuringiensis
gtatggttgaccgtcttcaaaaaggagaaagccttcttcctcaccctgataaagagaaaagaagacaagatgagtactggatgtatatgaaagtaaaaaaagcgttgcaaccaattgaaaacacatttgaaatacaaatacctgatgacgaagtattttatgttatggacttctttattaaaaatcagcctgtgaaaaattaatcgaggccgtttttaaaaatatcgatcgtaacgtgagttatatcagcgattttcaaaatatatcggcgcaacccagattatatcagcgattttcaaaatatatcggcgtaactcagattatatcagcgattttcaaaatatatcggcgtaactcagattatatcagcgattttcaaaatatatcggcgtaactcagattatatcagcgattttcaaaatatatcgatttaccgacaataattgctaaaactagcaccttatataatgagaaaaggctgttccaacatatggacagcctttgcctctatttctttacttttctaactcgccctcttatttctcctcttttttgtgatttcgtatggacattaacatatacatttgcttgaataatttcttgaagtaaatgtacgaatgatttcccttgtaaaggtccctcaaaatcctctacattcactacaccagtaatacttccctcgttcaagctaatcccttgctccagtggaccatacaaatataaaacaacaggaccaatttgagtagacttccctaaatgaatttgacaagatgtaaccttttctatattttttagtattactctgtaatgcaatttcgttaaatcatcactaaaaataaactctgctaccccaaaagcttctgtatttacaggaggcacttccctcttacctgttaacctggcaaagaaatgtgttgtcataaggcattctccttatataaatttcccagcactacttctactactttatggtttaaacataatcatttatgactttttcaattttaattacaaagaaaagattcacaaaatctttacattgtgattgttcctgtagattgaaagtctcttgtataatgcacatagaaaaacattataggaggttccattgaaaactaacaaatacacttttcatacattattagagatttttctcgtctcatttaaattaggacttacttcattcggcggtcctgtcgctcatctcggctatttccaccacgaatacgtgcaaaaaagaaaatggatggatgaacgaagctatggagatttagtagcactatgtcaattccttcccggtcctgccagcagtcaagtcggtatgggggttggattattacggggcggtctattaggagctattatttcatggattggattcactttaccgtctgtgcttgttttggttttcttcgcctcattccttaatcagttcgatcttggaagtgctggctggattcatggactaaaacttgtagcagtcgctattgtcgctcatgccatatggggaatggcgcgaaagttaactccagatcgaaatcgtgcaacgattgcgattgtaactgccgcaatcgccttattatggccaagtagttggacacaagtcatccttattataatatgtggctttatcggttggtttttatatcgcaaccaaccaattagccaatctcaaaatataagagtacctatttcaaaaaagatagcagtttcttgcctcgtcttattctttggactattactactgctaccaatattaagaccgttctcttattacatcgctttatttgacagtttctatcgctctggcgcacttgtatttggaggaggacacgtcgtgctgccccttcttgaaggtgagttcgtacaaaacggaatgatgacgaaagaacagttcctagctggatacggattaacacaagcagtaccaggaccactatttacattcgcctcttatataggagcagtgttaaacgggacgcttggggcaataatcgcaacaattgcgattttcctccctgctttcttactcgttattggtgttttaccattttggaacaatgtgagaaaaatatcattcatacaaggcgcactacttggtgttaacgccgcagttgttggtattttaattgccgctttttacgatcccatttggacgagtacaattataaatgcttcagatttcgttttcgcttcgcttcttttttgcttactagctttttggaaagcaccgccttgggttatcgttatacttggagcttttggcggatatattctatccattttgtaaataaaaaacgacggcatgatgtagccgtcgtttttctattaaaacttcacaagttctatcccttcaggcaactcactctctgttaaaatacgcaattccttcacacgatccattacgtaagaagaacgcttcacaagctctggatcaatataagctggatgaaccataatttctaccgtttgttcaccttgtactctttcttttaacttcataaagtaatcttccgtcacaccatccgcataaaagtcactgtaaaatacatcagaaaatggatgcaccgctctatcttccccacaacgacgaattggaacattatatttagctgctaatctctcaagaacatcgtgtaagatcggtaatccgtgtacatgatgatgactatctaaatgagttggtgttaatccgtaagataggaatttctcaatttgagcagtccactctctctcaacttcttctggatttatattcccttcccttacaacactttgtttatgaaacgatccgtcgctacctacaagtgatggtacgtctccaagaagtggctcccctgctgttaatacgagatgtacgcctactccgagtaggttatactctttcgctaagcgtaccgcatgctctgttcctggcatattcatcatcatcgtcgttgaatttacaagtccatttatatgaccatcaataatgccgtaatttgtaccttctgtaagaccgaaatcatctgcatttacaattaacttaatcatcataatacctcctaatagaataaaaaaagcgggctaaatagcgccgcttttacttctctacctttttaaagaactgtggaagatactctttatgtgcttccaacatttcatctaaaatttgttttgcaactttatctgatggtacaagcggattgattgtcatagcaagcagcgccttatgataatcccctgtaacagcagcttcaattgttgtgcgctcgaatgatttaatttgttgtactaaaccgcgaactggtactggaagatctccaactgcaattggttttgggccttctttcgtaataatacagttcacttcaacagctgaatcatgtggtaagcttgcaattgttccgttgtttcgtgtattaacaggctggatatcacctttattattgtaaatagacgtaattaagctacatgctgcatcactataataagctccgccacgtttttctaattgtggtggtttaatatctaaattcgggtctttatataactcaaataaatcattttctaattgttttactacttctgcacgtgtacctttttcaacagaagcttctttttcttcttctaacatttcacgtgttttgtagtagtaacgatggtatggacatggaatcgcacgaagtcctcgaataaagtctggctcccagttaagcgctgcgatattttccatcgtaatttgtttttctggatctgtcacaagctctaacacacggtccattacacttacgccatctaagtatacatctagtccgtataccatatgatttaaacctgcgaaatcaacgtgaacacgactcgcatctacttcaagtaatcttgcaagacccatacgaattccgattggaacgttacatagaccaactactctttgaatatttgtataacgaagaactgcctctgttaccataccagctggatttgcaaagttaattaaccatgcattcggacagagctcctccatatctttacaaatatctaaaataacaggaatcgttctcaacgctttaaataaaccaccaggaccatttgtttcctgaccgattacatcatattttaatgggattgcttcatcttttgcacgtgcttctaataaaccaacgcgaagttgtgttgttacgaagtctgcatcttttaatgcctcacggcgatcaagcgttaaatgtacctcgattggtaaacctgatataatcaccatacgtttcgctaagttaccaactatttc

SEQ ID NO: 1184 - DNA, 9581 bp, Bacillus thuringiensis
atcccgattagactactgatcattcctattccactcatggtaccttttcctgctgtaagtaagttcccaatcattcccagctgcccgtaacctccgttattcccccatcccatgggacttatctgtcctccccatcctggagagtttccgaaaatacccccgttattggtattgaatttaaaagccttagctggcggcgatagtaaagctgcgagatgaccttgtgcgaacatccctgtatgattgaatggttgcgcccaggggaagggaggtttttgaaaattaaaacctgcatgacctggtaatggagtccaattagcagggtgaccttgtggtagtatctctgcataattaattggctgctgcccccaagagaagggaggaggttggggattgaaccccgtataattggctgatgaatcccaactaactggatagactcggtaactccaattctcaggaagcttcaaatcattcattacctcagatgtagttatttcgggctgtgaatataatgaaatttggttagtatattgttgcccatttccctttgaattcaaataccaatattggtccatacgcttattctcctcactttaaaaatgtaatgttagacttagcctatgtaatattcctttttatggatggttacataactagatctacaagcctgtatttaaaggaatgggtgcgtagtctttttgatttttctcgctgcctgtaaaattcccattgatgtaaagtttcactttattttagaaggggattttcagttgcttcttttttgtatttcagcctaatttaaattccgttaacaaacatttttataaaggtttaatcaacaaaaagattttaaaatggtatgttgagcaagtggaattgctaaaaagagaatatccattcgaagagtttggcaaaatactgtaagggtaatgttttcttgtgcaaatatgtaaacgatttaaacgaatcaatgaaatttataatgaaggggcaattaaatatatgagtgaaacattacataaaagaaaaccaccatatgtaatgcttgtaatcctttttattggggcatttgtttcatttctaaataactcccttttaaatgtagccttgccatcaataatgaaagatttaaacattcaagattattcaacgatccagtggctttctacagggtatatgcttgtaagtggtatattaattccggcctcagcatttttaataacgcgtttctcgaataggagcctatttattacatctatggtgatttttattcttggtactgccttagcggctgtagcacctaactttggtttattacttactggtcggatggttcaagcggcaggctcttcagttatgggacctttgttaatgaatattatgctagtaagctttccaagagaaaaaaggggaacagcaatggggatttttggactagttatgattacagctccagcaattgggccgacactatcaggttatattgtagagtattatgactggcgtttgctttttgaaatgattttaccgttagcaatcattagcttactgttagggatttggaaatctgagaatgtcatgaaacaaaacaaaaatgcaaaacttgattatctctcattactattatcttctgtcggttttggcggtttgttatatggattcagttctgcaagctccgatggttggacaaataaagttgtcttaacaaccttaatcataggcgcaattgccctaattgctttcattattcgtcaattaaaaatggatgagccgttattggatttacgtgtttacaagtacccaatgtttgcacttgcgtctgtaattgcaattgtcaacgcggtggccatgttttcgggtatgattttaacaccagcttatgtacaaaacgtccgtggcatttctccgctgagctctggactgatgatgcttccaggtgcggttataatggggattatgtcaccaattacaggtaaactatttgataaatatggtcctcggattcttggcatagtggggctttccattacagctgtttcaacttatatgttggcaagtctgcaaattgactctagtcacacacatattattcttatctacacactgcggatgtttgggatggcgatggttatgatgccacttatgacaaatggtcttaatcaattgccaactcgcttaaacccgcacggtacagctgttaataatacggctcaacaagtgtccggttcgattggtactgctattcttgttacgattatgaactctgtaacaaaaacaaaagctgaaagtttaatgtctcatatagatccaacaacctttacagaaactacgaaggcaatagtaactcagaaggctttattatctggaattcaatattcgttttatgtagcgcttggcatgaatgttgttgcactactattagtttttttcgttaaacgtgtagatacaagtgcggaagctgtcgagaagctaaatcggtagagaaaaataaaacgcttgataatgattccaacaagttttttgctgctaaggcgccggtatttaaagctggaaaagaactaaaagaagcagggaaataattatatagtaaaagaggacctgatgttcatatcaggtcctctttcattagtaacacggtatacttgcttatcgtattggtttaactaaactactgatttttcgaatactacaatcttaagctcgtcaacttctctatttttggggtgttttagaagaaaaatgaatcaaaataatcgtttttataaacaaatacaagagatgagatccgtttgcaatttctcataaacattacaagtttagattatcttttaacaccaacattaaaaggctccaactatatttattcgcttcattttaatttagtatttttctacaagttataagtctaattgccaagcttatacgtaatatcataatcatgaatagttagggaaaagataaaataaggtaatcaattacatatctttatcccaggcgattagttgctatttcctctttattaaatgggatatgttatttcatgcttttttgaaagggtgttttaaatggaaaaaaaagtatctgccattcctcagccgaaaacatatggaccgctgggtaatctcccattaatcgataaagataaaccgaccctatcctttatcaagatagcggaagagtatggtcccatttttcaaattcaaactttaagtgataccattattgtcgtttccggacatgaactggtagcagaagtctgtgacgaaacacggttcgataaaagtatagagggtgctttagcaaaagttcgcgcctttgctggagacggattatttacaagcgagactcacgagcctaactggaaaaaagctcataatattttgatgcctacatttagccaacgggcaatgaaagattaccatgctatgatggttgatattgctgtacaactcgttcaaaaatgggcacggcttaatccgaatgaaaacgtggatgttccggaggatatgactcgtcttacgttagatacaattggtctatgtggttttaattaccgatttaatagcttttatcgtgagacccctcatccttttattactagcatgacccgtgctctagatgaggcgatgcaccaattacagcggttagatatagaagacaaacttatgtggagaacgaaacgtcaatttcagcatgatatccagtctatgttttctttagtagataatattattgctgaacgtaaaagtagtggagatcaggaagaaaatgatttactttcccgtatgttaaatgtacaagatccggaaactggtgaaaaattagatgatgaaaacattcgtttccaaattatcacttttttaatagctgggcatgagacaacaagtggattgttatcttttgcaatttactttttattaaagaatccggataaattgaaaaaagcctatgaagaagtagaccgtgttttgacagatcctactccaacataccaacaagttatgaaactgaagtatatacggatgattttaaatgaatcactgcgtctatggcctaccgctccagcattcagtctctatgcaaaagaagatacagtgattggcgggaaatacccaattaagaaaggagaagatcgtatttctgttcttattccacagctacatagggataaagatgcatggggagacaatgtggaagaattccaacctgaacgatttgaagagctggataaggttcctcatcatgcttataagccatttggaaatggccagagagcatgtatcggtatgcaatttgcacttcatgaagccactcttgtaatgggaatgcttcttcaacattttgaattaatcgattatcaaaactatcagctggatgtaaaacaaacattaacgctaaagcccggtgattttaagattaggattctaccccgaaaacaaactattagccatcctactgctcttgcacctacagaggacaagctgaaaaacgatgaaattaagcagcacgttcagaagacaccttctattattggggccgataatctttcacttcttgttctgtatggctcggatacaggggtagcagaaggtattgcaagagaattagcagatacagctagtttagaaggggttcgaacggaagtggtagctcttaacgatcgaattggaagtttgccaaaagaaggagcggtacttattgtgacttcttcttataatggaaaaccgccaagtaatgcagggcagtttgtgcaatggttggaggaactaaaaacagatgagctaaaaggggttcaatacgcagtttttggttgtggagatcataattgggctagtacctatcaacggattccaagatacattgatgagcagatggctcaaaaaggagcaacaagattttctaaacgcggagaagcagatgcaagtggtgattttgaggaacagctcgagcaatggaaacaaagcatgtggtctgatgcgatgaaggcatttggattggagctcaacaaaaatatggaaaaagagcgcagtactttgagtctgcaatttgtcagtcgtcttggaggatctcctcttgcacgaacatatgaagcagtttatgcgtctatactagaaaatcgtgaactccaatcatccagcagtgatagaagtacacgacatatcgaggtatccttgccggaaggcgctacatataaagaaggagaccaccttggagtgctgccagttaatagcgagaaaaatatcaaccgaattttaagacgctttggattaaatgggaaggatcaagttatactgagtgcaagtggacgaagtataaatcacatacctttagacagtcctgttagtttattggaccttcttagttatagtgttgaagttcaagaagcagccactcgagcacaaatacgagaaatggtaacattcacagcatgtcctcctcataaaaaagaattggaagcattattagaagaaggagtttaccatgaacaaatactaaagaaacggatttcaatgttggaccttcttgaaaagtatgaggcttgtgaaatccgatttgaacgctttttagaacttcttcctgcgctcaaaccgcgttactattctatttcaagctctccactcgttgtacagaatcgtctgagcattacggtcggtgttgttaatgcgcctgcatggagtggggaagggacatatgaaggagtcgcttctaattacttagctcagcgtcataataaagatgagattatctgtttcattcgaacgccacaatcaaactttgaattacctaaagatccagaaacaccaattattatggttgggccaggtactggaattgcaccattccgtggattcttgcaagcgcgtcgtgttcaaaagcaaaaaggtattaacttaggagaagcacatctatattttggttgtcgtcatcctgaaaaagattatctttatcgtacagaactagaaaatgatgaaagagatggattaatctctttacacacagctttttctcgtctagagggacatccaaaaacatatgtacagcatttaataaaacaagatagaatcaatttaatttcgttattagataatggagctcatctttatatatgtggtgatggaagtaaaatggctccggatgtagaagataccctttgtcaagcgtatcaagaaattcatgaagtcagtgaacaagaagcaagaaattggttggatcgtgtgcaagatgaagggcgatatggaaaagatgtttgggctggtatatgactgtttcttaattagatacatattaactaataaacttctttcgaataaatttcactttattagtatcgtgtatttagatgaatagtgattaaccggactatttagtatctactaaataaaaaacaggacctgatatgcatctatcaggtcctgtttcacatagacattatacatcgatattttccacgcattatcaatgtttgtaatgtagttagccttttgagtcagctataaaatcagatattattttttcaatatcgaaaggagtaatccctttatccaaagaaaaaatgctttctgcttcttcgatgtcttgaacgagttcacctctagcttcaatatgtaatcggaacaagtcatataaattcggtttaactaaattagttaaagccttcccaactagtatcatacctttttgattagcctcgatggtattatcataagttagatctctcgtaagagacaaatctgtccaaatcaattttcgttcctttaagtctaaaataactggaatagagatttgggtgtcggcagtaatatccactttatcttgaacagtagaaggttcaaatatttcacctgaaccaggatattgacgaaccatccaaccagtaaagcattctggtaaatctttatacggttggtctgtgtaagaaagcaaagtcattactacatagcgtgcaccatatttcagcacagacggaatatcgaaatcaatgaattcagatgccccctttggtgcagaagtaatatctccgctatggtaggctttgaaattttttgaacgtaagttcgtgaaggatacatgttctttgtattgccaatcttcgtcgtacattgcagcagataaatcaatgtcaacacgtcctgtatgttgtccattcacatagccttctttccaccataggaaaaaacgaatcgtatctccttctggcaaatctactttacttcctcgagataatgtgcgaagcgctttgctggctgaacgttgagagaagggaactaagtgattttttaactgttcatccaaaaatacttttccgagacttggaagttctgcgaagcgattttttaaagtatcttcacacatttttacaatcattaaacaaatatcctctgagataaatggaagtgtattttcgatacctatagcttttgctacatttccctttggaaaaaaggtacgaaattcatttttatcatttcgatgcttaaaatgagctgtgagttgaagtaatacaggagtagaaacgtttcctattatacttagaaaatcttcgagaatattgaaaacatctgttgacttatcactacataaacggattaaatgatccaagcgtctggcaaattcccccgggcgagtttttaaaagattttttgctgtcatgatatcacgattcaacaaagctgcttctatttttccattaaatgtttcaactttaatgttgttgcgaagaatctcaaatgctcggtgggtttttgggaaacgagtatgatattctgctggatgaagaatttcacctaaacgaatccaacgttttttgtatcgaagcatatcttcggtaatgtttccgcattgctctaacaatcctaaaaggaagcgtctttctgctcggttaaacttcttgaatcggacggaggatgctaaactcacatcgccttcagataaagcaactgcaaggcgaagaacatcagttgctgttttaaaatactttgcagcagcatcggctgatatttttctgtttattaataaaaccccaattataaaagacatattttccttatgaggaattacattaggtagaaaacaggaaacatcttcagtgtgtgtaatagcccattctacatccgtcttatcagttgaggaaatagagctgtttgcactaatcaattgagaaatcatttgattgaaatcttcttcacttcctaagtcaataactttcaaatcaactctatctaaaagagggagtcgttcttctacttttgatacaggtaggcgcaacgtcacataatgaataatggcattaatgtataaatcagcgtcacttaaatccatcatttgttgcggaaagtttggatacataggagtaaactgaatatgtgctccaaccatttcttttaaatgttttaccaattctttgtaaaacgatgtgaatgcatcaaccgaaagtgtttgcaactcttctattaaaggctcggaaaaagtaaatcctaaattttccaagttttttaaaacagtggctaaataaatgttcggtagtttattttcttctctttttataattactttcaaacttcttcttatgtaaatagaatttttcatgagaacgccagctattcacgccttataaaagaggggaatagtctgactgtcctcctttcagtggtagatttttatttttatatgtataaacacactaattgtagaaaaatgcacagagggtacatagctattttttagtggaaaattagggatataacatttagttgttaagtggtaatttgttaattaagaaaagaaaacctctacatcaatggttgataaactaaagtttatgcaatcccaaagaagaaagaggttttatagtctaattatttttcatagggaattgacaactctaaaacaatttgaaatttctacaaagaaggaagaattgtcatagcctatgtgtttagcaggaaagtaacatccctatttggccaaagaagttagaaggaaggaacgtcatagcctgctttattagtatattctcttgcgaagagcaattcaagtatactgtctgattttttatttttttcttaaaggggaatgttcatgattatcccgcattaacgggcagccagattggtgagggtgattaaagtttcactttataaatagggagaccatcacatgccctttttataatgctattacggaaggatttttatttttgatatataataccatttatttaatggtataatatggtatgcgttctgtggaatggagttgaatgagtattataaatacaaaaggtgaaattaaaaaaacgaaaagaaaagtattactaactatacttactatgttagtaattataattggatttggatattggaaactttttagtttgcaaggtgttccaaaaggggaattaattcgaacagtgaaatctccagatggaaaatatctcatcaagacttattttcataatgcaggatcattaagtgcggatgctgttaggggtgaattagttaaccttgatacagattcagagaaaaatatatattggaactatccagatacagatccatatataaatgggtaaataagaa

SEQ ID NO: 1185 - DNA, 7916 bp, Bacillus thuringiensis
gactatagaaccaattacttcaattccatccagtacaagtcgtgggatgtttaagtccattgtttctactggtagccctactgcaactactttaccgcaagcacgtactgcatcaactgctgagttaaaggctactttagagactgctgttactaccgcagcataagcgccaccaaactcctcttgcacaattttatcagcaggaccttgagaaattggattgatagtcatatcagcaccaacttctttcgctaaggctaatttgtcgtcattaatatctactgcgattacctttgcaccaaatacatttttagcatattggatagctaagttacctaatccaccgcagccatagattacaataggttgactaggtttaatatctgatactttaatagctttatatgtagttacaccagcacaagtaattgatgatgcttgagcaggatctaatccttctggtacttttaccgcataatcagctgtaacgatacattgttcagccataccaccatccactgaataaccagcgtttttaacttcacggcaaaatgtttctctaccagttacgcaatattcacaacgtccacaagattggaacatccatgcaatacttacacggtcacctatctttagtgaagtaacatcatcagctattttcgtaacaatacctacaccctcatgaccaagaatacggccatcagtgttaccaaaatcatgattcgcaacgtgtaaatcagtgtggcaaactccacaatactctacatctactaacgcttcacctgagtgtaacggacgtaattctttgtcaatcacttcgatgtttgctttgctgtttttattaaccactactgctttcatatgtgatctcccctttagtgttttagcattttaatgagtttatctcacaactactttcttcactactttggctagttattctaccaaatttaagtgttcaatcatcattacatcttcatcataacatgacacttcataaacaacttgtgaaattatgaacaatatttgaattattacacaaatcggtctttattttaaatttttaaaaatgagagtttatcattgactataagtaagtcacatatttctaaaacaaaataaattaacaaacttctcaccgataaaaaagctcttcactcaatattttctacatgtaaacacttagtttcacagtaatatcctttgccaccaacataaactttttctattttatttttgctattggttgctaatttaactaatatttcagaaggcgagtgtaaagaataaccttgttcaaatacatagacttcttttttcaagtagtcctgttcataaaggtagcaagctaatgcaccgttcgaagttccagtcgctgcttctttattgatgtcgaatagcggagcagaatttctgcatataattcgattgtcattaaaagtatatagatgcatcccgacatcattataatacttgctgatttctttaattttttcaaaattaggttgcagtgcatgtaattgtgtttcgctttttataggaattaaaatatcttttaagcccgtggagacaatttgaattgggtatttattttctatatctttactatcaaaacagtcgatgaactcgtttggagatacaacatcatagaatatcggtttattttgttccatgaatatgatgtcatcttttatagtaatagtaagaacaccgctgttcgtttcaatcgtatagcgattcctgaaaagtttatttaaatgcatcagtatcgcgaaagagccaattgtggcatgaccacataaatcaacttcttcttttggtgtaaaatactcaaatttataatcagcaatttcagattctgatataaatgcggtttccgcatagcccagttgtttggctatttccattttttgagtagtggtcaatgtattctcaataaataccactcctgctttatttccgcctttatgatccttgctaaatgcacttgcaacataaacagatattttcataagacaccttcctcacttatagtaaattatagtatagaaagcactacatataaattccattggataaattatccctaaaataagaaacaaactatttttagcatttgaactctccaaaaatagtttgtctacagtctgaaagctcttcatttgaagagctttttttatattcgcttcatcgaaatcgtttcacgtatactttgtaaattttttagagtttcctcttgtcgctgcaacgacaaccctacatacaaagtatctaataagcttaactgtgctaatcgtgatgaacttgcttctgtgcggaattcagtctcacgtgttgatgtatataacgttatatcagcaagttgacttaatgctgatttcttatagctcgtaatcgcaataattttggctcctcttgctttcgctacttctaacgcttcaagtaatcctttattgctaccagaatgagaaataccaataacaactgaattttccgagagtaaacctgcccccataatttgaaaatgcgaatcagtatgagcgatacaagaaatacccgttctcataaacttatgatacgcatccattgcaataataccagagccaccatttccataaaactcaattcgacttgcttcttgtaaggctcgtacagcctgctcaagtgccgtttcattaagcaaatgtaaagtatcttgcagtcctgtaatatgcgaatgaaaaacttttttagcaacagttaccatactatcttctgctgatacctcttcatggatattttgcatcggtgtatgtacaatttcacgagctaatgtaatctttaaatcttgaaaaccttgcaaaccaaggtttttacataagcggaatatcgtagcttcggaactattcgtaacttcagctaattctgtaatagatttatgtacaacatcttgtggatgtttcaaaatatgttcggcaatacttcgcaatttcggtgataaaccatttaacgaagcctgaatctttccaatcccacttcttgtaccaggcatagcatatcctccccttccatcgtagctttatcctgtaaaaaccgattagttgaactaatcatcagtggggatggtcctccactgattagagtttcactttattgtacctaattatcgaaagaagaaaaacctatattagggattactataatttttaattgctcctatgtattctgtcatacgatataacagaattattcatgcttatgaataattctctccatgtttcactgcgtataatgcggcttgcgtacgatcatccacttccaatttagctaaaacgtttgaaacgtgtgttttcacagtttgttctgtaatatgaagttctgctgcaatctccttgttgcttcttcctttcgcaatttcgcgaagtacctcttgctctcttttcgttaacattgaaaaaggattttctacttccttctttactgcagaacgccccattaatgcaggtgttactttcgggtgaaaattcgcatttccttgatgtactgcaataatagaagcgacaagttgctcaggttgtacttcttttaattgataaccatctgctccagcttcaagtgctggtataacataatcttgctctgaaaaactacttaatataagtacctttattgtctcatcatattgctttagacgttttgttgcctcaattccatccattttcggcatcgatacatccattagtacgacatctggtctttctttttgcacgaaatgtaatgcctcttcgccattttccgcttccccaataatttcaaattcttctctcgttttcaaaaagaatacaagtcctcttcgaacgatatgatgatcctcaactagtagcagtttaatcttcaaccttattctccccttcaaatcggcaattgaatttctatttttgtaccctttttcagctctgttataatttgaaacgatcccttcattaactgaatacgttcctccatacttttcaggccaagtgctgattcccttacctgttcttgtataaatcctattccattgtcttctatgtaaaaatgtaactggttattttctattttcaaaagaatatgtaccttttcacacgaagcatgctttttacaattatgtagcgcctcttggctaatacgccataaaacttcttctatttcatcccccattgaaaccatcccatcaattcgaacttccacttgaactcctaataacttcccgtaattttgaattgcttctgctaatcctttctccaatccttcaggtcttaattgccaaattaatagcgtcatctcttgtaatgcttcttgtgataattccccaatataacttaacatctcttgcaattctctatcttgcgtcatattcagagtacctttcgctgttagcataatagaaaataacaattgttttactgaatcatgtaaatcacgtgcaagtcgatttctttccgctaccactacatatttacgttctttctcaactaattgaatacgttgtattgtcgttccaatttgaaatgcaattgattctaataatgctaactcttcctcagaaaaatgagtcttatgaggtgcagccacatttagtagaccaaatttttctgatccagacctaagcggaattgtcgcatgatgtgtaacatcttctgtctctccccaattacattcaattgcatcttctattcgcttacattcaataatattagtcgctttttccaatctcccatttacaaaacgttctacacaccaacagtttccttcacacatcggcttcttcttttgccacgtaagagcctctggtaaattttcgtctacaagcatactgtgctttccactttcatcaataaagaatatccaccctgtttgtaaattcattacttgtaacaatgtatgcaacactttttctaacatatcctgtaagtttgttgcttcatttaataattcagcaatttcttttaatgcttctaaacgacgcatctctttttcttcaaagttcattctcatcaccaactacaattataacattaagaaatttctaaattctataaataaaaaaagaaccgaattccttcagcctttctttatatcaatcattttattattgttattctatccaatgttggaagcagaatttttgttaacaaacgattctactttagctgtccgataaagattgtccaccatggatatgctgtaaaccttcagtagtaacaaccatattcgctgctggcatttgcacttgatttttatggaacatagacattaattcaaatcttacttgtctagaagtttcaaaataatcttctggctttattaaacctgtaatacaaaattcatagccaacatatttcaagttaggatttaagtctgtaacaccgacgtatttaaatggttcaacagcctcatcctctactctataaagagtttgattcaatttttcattgcatataacacatacttcttctaacaattccttcactcttgttggatcttcctgataacttaccgtgatgcgttcaattacacgcatccatcctttattaaaattttgtatcgttctaatctctccgtgcgggatggtaagtagttttcctgaccattcacgaatttgcataaaacgaatactaatctcttcaatagttcctgaatttgttccgttaaaagttacaaaatcaccaacccgaaactctttgtccgctaatcttgcaaagcctaatataacatcttttagcatctgttgtgcagcaaaaccgatgacaactccagctatccctgcacctgcaataatactttttatatctacaaattggctaattaaatatatgataagactgatgataatgatatatctaaaaatagatcgaattacactttgaatcgtttgctctatctcttcatcaaaaaagctcgatttcctaaaaaaccaatcaataatgcggtttattacaaatgaaataatgattagaacgaaagcaaatagtaaaaatcttaaaagtaaaaactctcttacataattaaaaaattcttccgtatacgttaataagctcatttaaccacttccttactaattaaaaaattcataatcgcctaagtttgttccagaaaaatctattatcctaatctaaaatgccgctacccttactatgtattttgactctattactaattcactttaaacagtatgtctagctgttctttttcctttccctttaaatataccctttttaataacctaagggggagcaaatcgtgaaatttttttatacgttaaaactttattcatctcattacgatttcaactcatttattcattaactacgtaaaaaaagagctgaatttatcagctcttttattcgatattaattgttgtcttactacttttttcttctttcaattttggcaattcaattgtcagtacgccatctttataatttgctctaacattttcttcctcaacttgtttaaaactaaagcgtcgagttacagaacctatagaacgttctttacgaatatatgtgccattctcatttttttcttctacttcattatgattagttgcttgaatcgttaatacatcttgttcaaaatcaacttgaatgttttctttttgaaaacctggtaaatctgctttcacagtatatttatcagattgctcatgaacatctactttaaaagtatccatgttcagtggcttcaagaaagcatctgtcatcccttctaataaagaaggcccaaaatcaaaaataccattttgacgttttgttatctctggaaataaattacgcatattttttcctccttattatttatgaatgaaagattatctctttctgcctttattataacatttggtcaaaaaaggtcaaagtttttgtttgaccttttttgatgtatattttaccaaataaaacacatgagatatttgacacctcttacatttataaagaggaatatatttatataataacgaatagtttatatgctcttatttttccttaatgaggttacctacaatggggtatatcgaagaaattagagaagttgtcggatcaagaccactcaatttattaggcgttgcggtagctgttttcaatgaacaaggacaaataaaagagaccttttttaaaggcctcttttttcacttcacttctgcatgtaggcatgacttaaaatgtccaagtgcatattcatgcccttgtgcattaaaagatgcaaccgccttttcataaacaacaattttaaaccctttattataagcatctactgctgtatgaagaacacaaatatcagtacaaacacctacaagatgaacttctgctattcctctttctcttaacttcatctctaagtctgttcctgcaaatgcactataccgtgttttatccatgtaatatacattctctgcatttttatatgtttcgtacacatcttgtaattcaccaaacaaatctcttccacttgtaccagctatattatgaggcgggaataactttgattctggatgatatacatcattttcttcatgtttatcaatagcaaagacaacgtaatctccattttcaatatattgcttcgttatatgtacaatttccttctcaatttcctgtcctggtttcccgcatgttaaagcgcctttctcagctacaaaatcatatgtataatcaatatttataagagctcgtttcattactatctctccttctcctgtttcacagtaaacaatagaaaatttgttattacgacatcgtatgtactattcgacatttcaaatgaaatacctacatttttcttgcaaaactcaccttaatccgagtttatcataaagtgaaactttaatcattggagagtttgttcatctccaatgattatcagccctcatcaatcgtgcatttacaggcagttga

SEQ ID NO: 1186 - DNA, 8076 bp, Bacillus thuringiensis
  unsure (1)...(8076): unsure at all n locations
ctctaaagagctcccattttttcatgattttttgcaaaatatattatatataatttcaggttcaaatttcaagttcaaaagaactcgtatcagacccttttgtttaatgggtcttacatattttcattaggcaaattccgagaaatcgtatgataaaactaaaaatgatgaggagaggatcagatggaattcgaatttttctttcaaattgcacttattttattaagtacaaagcttgctggtgatcttagtgttagattaggtcaaccttctgtactaggtaaattaattgtcggtatcgttatcggtccagctgtattaggttggattgaaaattcagagcttctaactcaattaagtaatgtcggggttattcttctaatgtttatggctggacttgaaacagacttagaagaattaaacgccaatcgtaattcttctttagcagttgcactcggaggtattattcttccattcgtaggtggttacgtttccggccttgttatgggaatggaacaaggaaacgctgtattcttaggattacttctatgtgcgacaagtgttagtatttccgtacaaacacttcgtgatttaggtaaaatgaaaacacgtgaaagtacgacgatgcttggagccgctgtatttgatgatattcttgttgttattttattagcattcgcaatgagcttcttaggcactgatgatgttaacttaacaatgattatcttgaagaaagtagtattcttcgcttctattattttaattggatggaaaggtgttccagcaattatgcgttggttgtcaccactgcgcgtatctgagtctatcgtgagcgcagctcttatcatctgtttctcattcgcatatttcggcgaactattaggaattgctggtattatcggtgctttcgctgctggtattgcaatttctcaaacaaactacaaacatgaagtagaaaagaaagtagaaccaattgcttacgctatgttcgttccagtattcttcgttagtatcggtatgaatattacatttgacggtattggcaatcaaatttggttcatcttagcattaacagtaatcgctgtattaacgaaactaattggttgtggtgttggtgcacgcatgactggatttgatgctaagtcttctgcaattatcggttctggtatggtttctcgtggtgaagttgcacttatcattgcaggaacaggactttcttcaggtctattggcacaagattactttacagcaatcgttattgtcgttattttaactacaatgattacaccaccaatgttaaaatacacttttggtgcaaaagataaagcaatgaaagcaagcaagtaagtaagtaagtaaatttactataagaataagaaaaggagattactatcttacaagatagtaatctcctttttcattttatctttaaacaattccattcgtttttaaccagttttcaaaaatagttcgtgcttcttcatcatcgatgtcattactaaatgaatatactttaataccatagtcatctatatattcacctagcttcattttctccactttttgtaaaaatcgtctacctcatagtgcggaagataagcatcccaaactggttcatttattcttttgtacgccgtcacttctaaatcatatccgtcttcataatatccgatatgataatgtttgttaggatcatatttctccattaaaagtcccctcctactaaaaaacaaaagcgagccttatattacagctcgctcctctctctatttattaaatacgttccatcgccgtcttcaaagttccaacaacaaaggcaatttcttcacttgaaataataagcggcggcgctaatgttaaaacgttattatatcctgctgtcgtcataccgtttcgtcctataataagccctttttctttacaagcatttacgacacttgcgattttgtcgttatcaattggctctttcgtctctttatcatttactaattcaattccaactaatagaccttttcctctaatatccccaacaagcggatgttccccaatttcatcttttagttgctctaataaaagggaacccatttgcgcagatcgctcaattaaattttcattttccataatctctaagtttttaagggctaatgcacaagctgctggatttccaccaaatgtattaatatgtcggaagaattcatactctcccttccctttaaatgcttcatatatttcttttttcacagctgttgcagataatggtaaatatgcgctcgtaatcccttttgccatcgtaataatatctggcttcacatcataattcataaatccaaatgcttttcctgtacgtccgaaaccgcaaattacttcatcactaataagcaaggcaccgtgtttttgacacgtctcatgaacagctttcatatagtcttgtggtggcattaatatgcccccgcctgtaataattggttccataataaaagcggcaattgtttcacttaattcccacgtcataacacgatcgacttctttcacacattctacatcataaatatgctgcccttcaatttcaggcatacggtaacaatccggtggtgttacgtgtaaaaagcctgaagcaaacggttcatattgatatctacgctgcgcttgtcccgtcgctgccattgtcgccattgtattcccgtgatacccacgataacgtgacataaatttataacgatgtggttcacctttttgcgcataatattgccttgctattttaaaagctgtttcgttcgcttctgaaccactatttgagaagaaaataacatactctcccccaagccactcatttaatttttcagcaagctttatagctggttcatgagattgtgacattggaaagtatgataatgtttgtaattgcttataagccgcttctgcgagctcctttcttccatatccactattcacacaccaaagaccactcataccatctaaatatctttttccttgtatatcttcaacccagcacccttcagcttttgcccctaccattgtactatttggactaaagggacgcattccgtgccaaacatattgctcatcttttgctaataattcatcagtttgcttcgttttcatcattacttccaccttccataacaacttatttttcacaaaagctgcgctggtgccatgatgacttaaatttctccctgctattttcattccacaaaattaagacaaatcctacttacaaatcagtaatatttacaagaaaatgacaaaagaaaaaagagcttttcttatctatcgaaaagctcctcttttatttaatgtgaagacgcatcactaataccgtgaccagtattagatttcacaagaatttcatcaaatttcgctgcatcttctttcttactagataaaacagttcctaaatatgctgcaagaaatccgagcggaattgaaataattcctggtgtcgtatatgggaatatcgcttccccaacaaaaatagcttttccagctacagggttccaaacattcggactcaacgctacgagaacaattgctgatacgagccctacgatcatacctgaaatagcacccgttgtattaaaacgcttccaatatattgtaaataaaatcactggtagatttgcactcgctgcaactgcaaatgctaatgatactaaaaatgctacgtttaatgtttgggcaaataatgcaagtatgatagataatatcgctactccaatagatgcataccgagccatagatacttgctctttttccgatgatttccctttgcgaatgatctcattataaaaatcatgagcgaatgctgatgctgccgttaatacgagacctgccactacagccaaaattgttgcaaaagcaattgctgatacgaaagcaaataagaagtctccacctaacgctttggctaataaaggtgctgccatattacccgctgggttcgctttaataatcgcttcatttcctacaaacgctgccgcaccaaatcctaagaaaatcgtcataatataaaatgcaccaattaaccatgtcgcatatacgacagattgacgtgcagtttttgcatcacgtactgtaaaaaagcggacaagtatatgtggtaatccagctgtaccaagtactagtcctaaatttaaagaaagtgtatcaaggccatccttatactttacacctggatttaaaaatgaatcttttaatggtgtagctgttttcatttgggcaaacatttcagtcacgctgaagttgaattttgcgaaaacgataacagaaataataaacgtaccggccataagtaatacagcctttacaatttgtacccagctcgttgctgtcataccaccaaaaataacatacaccgtcataagtgttccaacgattaatacagatgtcgtatattcaatccctaataataatttaataagtgcacccgcgccaactaattgtgcaatcatataaaagatagaaatcgtcatcgtattaagagctgcaactccgcgaacttttttcgcgtcaaagcgtgctgcaatcatatccgccaaagtgtactttcctaaatttctaagcggttctgcaacaagatatagtacaactaaataagcaactaaaaaaccgatactataaaagaatccatcaaacccagttaatgcgattgctccagctataccgagaaatgaagcagcagacatgtaatctccagcaatggccaaaccattttgccaaccagttaatccccctccagccgtataaaattcactcgcatttttcgtttttttcgatgcaaaataggttatgacgagcgtaccaagaacaataattaaaaatagtgcaaatgcagtagtattcaagttcagcccctccctttttgcatatcttgcaaaatttttcgggagatttcatcaaatgattctgcttttttgctataaatcatacatagtgcccatgtcataataaattgggaaaaagcaaatacccacgcccatgtaacgtctccaaatgcaggtgtattaagcacctttgaatacgatgttagaataggtaatgcgataaaaaaactaaaaaagaaaatactcattggaatgataaacttctttttcgtatttaataacaattgaaattcttccgactgaacgacctctgtataattcacctcattttgcaacttacgtgctgacgtatcgtctcgtttcattaaccgatcccctctcttacttaaaatacacttcccccttgcatacctaaagactaaattttataaatattcagaaacttatattcattttagacaatccatgcattcatgcaaagattttttgatagacatttttcggcaatttcccctaaatttttaatatactttttcaaaataaagtgacaccttacttatttatcctcattaagacaaaagcagtgcttaacgcactacttttgtctttttttccttttctaaattacgagccgtttcgcttaactcaacatcttttccatctttaagtgttccaaatataaaatcgaatactggatttgaaacaccaaaccaaaacttttcgtttttataatgatgtaatatatgttgtttttttagccatcttccaaacttagtgacgggacgaatcggtctatgagcaatataatgtttccattcgtaaacgagcagcataataatcattccgattccaaatgaaagtgcaatagtaacactttttgtaataccatatgctataagtaaatatatagtaaaactaggtatactaaaccatacaggtaaaaacaaaagttttaaatcatctggatatacgtggtgatcataatgcaatcttcttaacatttttaatagaaatgtgtttttaggtggctttatatggaataaaaaacgatgtgtcatatattcattaagtgtatagaaaacaatcccaaacatacatgctaacatgccaaaccacgtaaaaaattgcatttttaaaataataatgcaaataaatagaatgctatacataataacaatatcatgttgtaaaaagaactctttccccactttcttcatcttgtttccccctttttcaaaaaaacagccgcaacatatcgttacgactatttcttttctattcttattctattcactttacaaatttgcctgctgttctattgccgagaaaaaattgtttgatccaaatatattttgcttcggaataatatgttccactgcaaacactgttacttctcctctttgcacttctccaataatgagcccaaatatttcatgatttactgcaaacgtcggttgctttgtttgtaacaatcttgcagcattatgaaataccgcttcatatagtggatttctatcagtaatttcttttcggatttttggcgctaacgtaattataatttcttttccgtcaatagtggttcgatacataaaaatctccccttcaatcttatgtgaacaactgtaaagctttgtatgcaaaatgtatagagtaacctactaaaataatacctgctccggctgttatgtagccaagcgcttttggttttaataaagttcttccaaaatgtacagaaaaagcaatatttaaattccataaaataataccaacaataatgcaaagactgtacaaaaaagcttcttgtttcgttaccttcgtaagtaatgagctaagtgtacttccgtatataccaaaccaaaaaacaagatttaatggattggatatcgcaattaaaaatcctgccataaacgattgcttaaggccacctacctcttcttttttatattccatattcgattcgaaaattccttgttttacactttgaaatcctaaataaaataacaagaaaaaacccgtgcaatacatgaaggcttgtacatatgtatacataaacacagaagataaaccgaaataaatgagaagcataaataaaacatctgcagtcattccaccaattccaacaacccaagcgtgccaaaaaccacgttcaattcctcgttttaacatttcaatattaatcggccctactggcgcagctaatgatatacctaatacgatttgctgtataattgctccaaacatcgctctatcctttctactctctttattactagttaatgatataatttgaaaaaatagactagctttcgtaataaaatacccttttttatccaaaatatacaaaagagccatccagatgatggctcttatttttctatcctatgaagaaaaggacatttcccttttattagctctacatcgtctcctatgaaatattgtttccattcacgatgctctgggtcaccgtaatgactaatgttaggatgtttcggcaattgatcccacttttcaactcgctcacggaccatttgtcttgaatatgctcctttaggacgatctccctctaatccatcaaaaatagtgcgtggctgaaacccaataacgagagaattccctaaatgtctagtttttcgttgtttataagctggcgcatttccaaatgcaaatattggctcaccaccaaatgaaaattcccataaataatgatctggatcttcaggaatttgctttggccatgcttgattatcgttttcatgtaaatactgtagcactttccaaaaggaatcacggtaatattcgagtgattgttcttcacattccggttctacaaaaaggaaaaagccccttcttacaatcggcctctctttcattaactctaaaaaagataacattgtatgtggcaaatgactccaatcattatgagaaagaaatgaatagcgaagttcattctttttcaaagctgttaaaccgaaatanacatggaaaagttggttctaacacgacacttgaaaaaatctcaaattcttttgcaacccaatccggtatgtcggttctcgttctcatttcttcattatctaataagtaagacttattcattctttcacctcattatgtatagcattcaattaagaatattacatactcggcctgtcctatacctatttaaaaattcgactgaaaaattatttaaaaatacaaaacataaaatcgcttacttgactaaaatctcaca

SEQ ID NO: 1187 - DNA, 4822 bp, Bacillus thuringiensis
gatgtgaaagataaggcacgagtgaagttggcagaatggtttagttcggatatagacacaacatttatcgatcagaaattaggtcaataggtgaaatctgtcataaggtgacaggacgaacgtaagcgaggaagtgcattatgccatcaggaagaacgcatacgaaaataaacttaatatcccttccggttgttttgtttttgctcttttcgtatggattaacaaattttgattttttattaacttttgcaattggttttttagtaggtacttcatttttaacaccagatttagatacgtacagtaatgcttataacaaatggggtttcttacgtatattttggtatccttataagaaagtaatgccgcatcgatctttctttacgcatacgattatacttggtgatgtgattcgtattgcgtacatgttaatcgttttttctccatttttattactattaaatgtagtcgcactggatggtaatttaatagaaattgcgaagaagcatgaggttgaaattgtaacgttcttaatgggaattgttgtggcaagtacgctccacattatagcggataaagtgaatacgcgccgaaagaaaatgatgagaaaaaagaagaaacgcagaagataaagtgaacgaattaggaaaagggccccttgcaaattgtaaggggccctttttaaacaaacattctgaataaaattaagtcttacagcactctaatgcacttttacaacgctccagatgaatcaatcataagcatgctgattccgcaaatatgctaagacattcattgatccaattcccagtgttacgtctggatgatcatatccatcgcccgtaatccctacaataactacgcctattactgtagcgaaactcgtactgatgtgtgtacatagagcacgttccgcatgtggatttgccataacgattcccacaatccaaacgataatagggaataagataggggcaaatagtacactaaagtatgataacgcagctaatattttatttccgttcatatatatcacctcatgaataatttctgttgttatactattattatgcaataattttggcaaacttcctatcgatgaacattacaagaacgtgacgattttgtaagattttctgttaaataataaaattttcaaaaaaatcttttttaatagaaattgttatggtacagtataaatgaaagttgttgaaaacgttttcttgaacgtttttttattttaggcttaaaggtatgatgacctgatagtctattggtgaggttattctatttaaaaggggattctttaggggggtaactaactgttacgatttatttaaccaattataaccaaagttaattaaatatatcagtaagccctgctagtcaagtgattggctagtagtgagggttaactgcgggcaatccctaaagctgattgaactacaacgtgaccagaaatggtgagcgtgaatgtcgcgaaagcagaaaaaatcaatcagatcgtgcaaggttaaatcctaaacactagaacaatgggtcttccgcctcgaatcatctaagtcaaaatggataagatgaacgttcaacgactatctcgtataactgacgagagtacatcacaagcctatggtggtggaaaaatcctctatctctaaagagataaacatatagtctgcgctcatgtgaaaatatgagaagttcataagagaactggctaaggaattgcgcccttagttgaacgagataaatttaattaaatctatcaaacctcattgaatccatagaacgtatgtgctacattggatttaatgagctaagaataataatgaaattttcacgagttagtcaagtatcggaattaacaggtttgtatcctggtagtctcaggagaatgctggtggaacacgctacgattcagaagaacaaatctttcattaaaggagttacattctgatgatattggcgaagaaagtcagactgattccaacgcctgagcaagaacaagtgcttagaaaccatgctggtgctgcaagatttgcttataactattgtaaaagaatgagtgatagatactataagctatttggaaaatctgtttcacagttagctttacagaaacgatttacaaagatcaagaagcgaaagagatatgagtggttaaaagacattaatgcacaagttcccaaacaggcttcaaaagattttgatacggcgagaaaacattcgttcaaaaagtacaaaaatggttatcacacttcttataaatccaaaaaagatttaatccaaggattttatgccaattatgaaagactggttataggaaagaaagtcgttcatattcagtctattggagaagtgaaaacaagccaacaactaccaagaaataaaaaaccatccaatccacgagttacctttgatggtcgtcactggtggattagtgtagggttccaagaagactttgaatcacaagaactaacgaatgagtcgattggtgtggatgttggtttaaaagaactttttgtagcttctaatggtatgaaagaacgaaatataaacaaagatgctaaggttaaaaaacttttgaaaaggaaaaagtcagcgcaaagagatatgtctaggagatttaaaaaaggtgtgaaaattcagtctgccggatatgaaaaagcgaaagctgagcacctgcggttatctaggaaaattatgaatatccgaaataaccatatccatcaagcaacagctaaattggtgaaaaccaaaccaatgaggattgttgtggaagacttatctatttcaaacctgttaaaaaacaaaaaactatcgaaggcactttcctttcaaaaattaaacttcttctttcaatgtttgtcatacaagtgcgagaagtacggcattgcgtatgaaaaagctgataaatggttcgcctcaagcaagatttgttcatgttgcggagtaaaatacgaccattcagttcaaccagaaggacaatggagtataaaaatacgtgagtggtgttgtgtttcatgcaatagccatcacgatagagatttgaatgctgcgataaatttatcaagatgggtaaaataaatgcttgataataggaggtaacgatactgcctcgtgtggagtgttatacccctcgtccctttggggttgcgagaacacgatgaagcactaactcgtgtaaatttgattgaattgtatagatttagttaagtttatcgtatcggagagaacaatgaacacatggacacaagtttatgatccattcggaaacatttggatttcggcagcggtcgcacttattccgattatcttttttttcttagctttagcagttttccgcatgaaagggtatgtggcaggatttattacagttgtacttacagttttagtagcgttattcgcttataaaatgccgttcacgatggcaatggcagcgaccggatatggtttcttgtacggattatggccaattgcttggattatcattatgtcggtatttttatataaaatttctgtaaaaacaggtcaattcgatgtgattcgtgcatcggtattatcgattacgaatgatcatcgtctactcgttattttaattggattttcatttggagcatttttagaaggagcggcaggatttggggcaccagtagcgattacagcagcacttcttgcgggtcttgggttaaatcctttatacgcagcaggtctttgtttaattgcaaatactgcaccagtggcgttcggagcgatgggaattccgattacagttgctggacaagtaacaggtattgatccacataaaattggacaaatggctgggcatcaattaccgttcctatcattatttgttccattctttatcgtatttttaatggatggatttaaagggatacgacaaacgtggcctgcgttacttgtagcgggtagttcatttgcgattacgcagttcattacagcgacatttttagggccagaacttccggatattacatcagcacttgtaagtttaattagtttagcgctgttcttaaaagtttggcagccgaaagaaatttatcaatccgggcgagcaaatagtgaagtagcagtaacaacgacagcggcatcgatgccgaaattaacgtttggaaaagtagtgaaagcatggtctccatttatcgtattaacggttatggtagtcatttggagccaaagtttctttaaggcactatttgcttcaggaggggctttagaaagtcttgtatttaagtttgaaattccaggtctgcataatttagtaatgaaagcagagccaattgtaaataaaccaatgccttacgaggcaattttgaagtttgatgtattatcggcaactggaacagcgattttaattgcttgtatcatttccatgtttattttgaaaatgaatgtaaaagatgcagtagtgacatttaaagaaacgttaagcgaattaaaaatgccaattctatctatcggattcgtactagggtttgcatttatcgcaaactattctggtctatcttccacgttagcgttagcattagccggaactggtggactattcccgttcttctcaccattcttaggctggattggcgtattcctaacagggtctgatacgtctgcgaatgcactgttctcaaatttacaagccattacagcgcagcaagtcggcgtatctgaagtgcttctcgttgcagcaaatacaacaggcggtgtaacagggaaaatgatttccccgcagtcgattgcgatcgcttgtgcggcggttggtcttgctaaaaaagaatcggatttgttccgttttacagtgaag

SEQ ID NO: 1188 - DNA, 6575 bp, Bacillus thuringiensis
  unsure (1)...(6575): unsure at all n locations
atcataatattcaagaaacacatttaactattaaattttcccataattcttatagatggttttactctttaggatcttttttaaaaaataagctatacaatttaaaatgattttgaaaaaattagtagtttcttctttttatgttaataaattatacagtttccaaatataaagcaaaaaaaccaaacccctgtaaatgcttacaggagtttgctacaaaattataaggctttttgtcaaaagcccttttcattcgaattttacgaagcacctgcttcttcaaactcaacctcttctaactcgcctaaacgatgatactctgttaaaaccgcatcttgaattttagagcgtgtaccagaattaattggatgtgcaatgtcacggaactctccatctggagtacgtttacttggcattgctacaaataatccattattaccatcaattacacgaatatcatgaacaacaaattcatggtctagagtaatagaggcaattgctctcatgcggccttctgtgtttacgcggcgtaatcttacgtcagtcacttccatcttgtgttcaccacccttttctaaataagcgatatatttgtataaattccacaaattttctattttccctttaattttttaaaaatttttaagataaaaatttttaaagtagttgaatatagagattagtggaggttatcgcttacaaaaggttacttaactagggcgattacttcaatttcaacggaaacatctttcggtaattttgctacttgcacacaagatcgagctggtttatgagtagagaaataagagctatacacttcattcacagcattaaaatcatccatgtcctttaaaaatactgttgtttttacgactgtatcaaatgaagcacctgcttcctctaataccgcttgtaaattttgaaatacttgttctgtttgtactgttacatctcctgttacaagctccccatttgccatcaatggaatttgtcctgagctatagaacatgttatttacaataatcccctgtgaataaggtccaattgcttgtggtgccttgcttgtttgaacaactttcatacttttcacccttttattatttattttactctttaaaaatagtgtacgaaaggcagtttgtccatctattttataatctataaataaaataaaaaagatagagctatctgctctatcttttattccgcctctacaagcccttcatcaaatggtgcaagagaataattccctttttccacttgaatcgttttttctttcacatcaacttccgatagacgaattaatgatacaaaattattaattagtcgttcttcaatatctgtggattctactaatacaccaataccaacaacattagccttgaattcttctagcatactcatcataccttgaattgttccgccagctttcatgaagtcatcaataattaaaacattcgacccttctggaagactgcgttttgctaacgtcattgtttgaattcgtttagaagaacccgacacatagttaatactaacagtcggaccttctgttaccttattatctttccttgcaattacaactggtacatctaagtaatttgccactgcataagcaagtggaatccccttcgttgccaccgtcataactgcatcaattggttgcctagcaaaaacagaagcaaacaaacgacctgcgccattaatatggcgaggattactcaataaatctgtcatgtataagtaaccgccaggcaaaatacgatctgggttttcaaataagccacaaagctcatcaataattagatctgcctcttcttcacttatatacggtatatatttcactcctcctgctgctcctggtatcgtttgcaatgtgccgaccccttgttgttcaaacgtttgcttaataataactaaatcttcactaatggaagacttagccgattgatacctttcagcaaaaaaagtgagagatactagctgacgagggttttgtagcaagtaataagtcatatcgactaatcttgtacttcttctaattttcatactctcacctcaaatcacgaatattctaaacaaatcataacgtattatacgtctttattcaagcgtttctcgctctcctaataaacgtaccgcatagacttgttcacaaaatccttttaatccgttataaatgcgatgcattcgtgaatcatggtgtacaagtccaaatacagttggaccacttccactcattaatacagcatccgctccaaatcgcttcatctgtgatttaatacgggcaacttcaggatgcattccaaatgttacatcttctaaaacgttaccaacagtatcacaaattcctttataatcaccagaatttatgacatcaaccattttatctacatttggatgtgtaactcgatttaactttaaatttccatacacatcagcagtagatacacctatatgtggtttcgctaaaataacccaacaagaaggcggagtctttatatgctcaattttctctcctcttccagtggcaattgctgtgcctccgtatacacagaacgatacatctgatccaatttctgcaccaagctctgctaactcatcaattgtaagctctaaattccataatttattaagaccacgtaatgtcgctgctgcatcactacttccacctgctaatccagctgctactggaatcgttttttcaatagtaatagatacacctttttttacattaaacttctcttttaataatttcgctgcctgataagctaaatttcgttggtcgtctgggacataccgattatgggataaaatttcaatacggtcttctgctaattccgttagttctagacgatctgctaaatcaatggttgtcataatcattttcacttcatgatatccgtcttgtctttttcccagtacatctaacgacagattaatctttgctggtgctttcactagtagcttcaatctattcacccactctatgtactcaatcttttatcgtttattttaccataaatttatagtaagacgatgacacttccctaattataacgaaaagcattcagaatgaaactacttatgtaaaatgatggcaccttttagagtacaaaaagccgaggaatgtctcctcggctaccgtagcacagaaagtatcttacaactactggtttcgtttcattaattgctgttctgcaatttctatagcacgtttcaccatgttaccagcatctttcgcacgaattccgccccatccttctttctgaacaacatcataaaagccaagctcttttgctagctcttctttaaattggtttgacatgacacctcttcgtctactcaatgcagagtccctccttattttgctacggtatagttagtatgcaaaataatatagcttttcatttatgggaatatatgtaatgatatatggattataaaatgacctcattatgagggtctccataaaatgttaactctactgtctctgttaaaacatctgcataactataagatacacgttgcaacgcatcttcttgttgatccaattgtacaacaaaaacggaacggtatgtttctgctagtacacctgattgctccacagtttttcttcttccactatttgcttttaacataagtcgctgtccaagatggtgatctaattcgcttttaatttcatctaaacgttttgacatatacttcgctacacctcgctgtaatttagattgaacacttaaagcacgatatatctatcctaattattaaccgcgattcacagctaatatcatcctgcgtttgaatagatagaagaaatactatattgtaaaagtatcattacgtagtctttacgttcttacctctttttatccaaattcatttaaatccttccatacaaaaagcaagatacatatgtatcctgcttactcttcgtaatgttgaaaaggtaatcccgttcgtaaaatccctctcgtttcaattccacctagtcccttttcaccagtaattgtattacgtacgacatcccatacattgactctctccataaatgaagtaaaactaattttaccaactacatatacaggatctagtgcatgaatattaattctagatggtgaactagcgaaattggcccctgcacgaattagtgcctcaaaatgtgattgacatgccccagcaaaaataacaagttgatccaatgatggatatttttttcgcacttcacgaacagcctgtacaaaatgccttgaatgcctatatgccgctaaatctcccttcactccttttgattttgtatatgcatcatgccctgtaataacgagaatgtctgggcgaaagtgatctattaagtctactactttttcatgcatcaccgtttctttacaatgaataccttgaacaggaacgccaattttattatataaatctaagcacttgcgcaaatataaagggtctccatctatatgcaatacacgtcccggcatttgaaaataatttacctcacttgtgtatccaccagttgaagtatgttcatgcctttgtttcatcagtacataatcttgttgaaacaaacgatacgtgcgctccattgtttctttctcacgcttcaccctttttttatgttctctttgatctatactaattaaatcttcaagtggcgcatccgccaccagtctaatttcctctccaaacaatatagctatctcgccttttatttctataatacgaaaaagaatatccctcttatgagaatatcgttccactaattctccaacatgtaaaaccattctcctacctccaaactcattaggccatcttacctgtttttaaagtatgaatttagagagcgaaaggtgacaaaagggacagttcaacttgaactgtccctttcatattcttatgataatttatgaagaactaatgcattacttaatgttgcaaactcttcaatagatagcgtttcgcctcttcgctttggatcaattcctacttctgttaaaattcgatccaataactccttatctttcgggaaaccatttaaattatttgataaattattcattaaagttttacggcgctgtgcgaaacttgctcgtactacttcaaagaaaaacgtttcatctgtcacctctacaaccggtttaggacgctttagaaggcggataattgcagaatcaacgtttggctgtggtacaaacactgtacgcggtacagtcataactgtttcaacctctgtatagtactgaatggcaatcgataaagaaccatactcttttgttccaggtttagcagctaaacgatctccaacttctttttgcatcataacaacaaatccacgaactggtaacttttcttcaagcaatttaaataaaattggcgttgtaatatagtacggtaagttagctactaccattacatcttgcccttcttcaaattgctcattaaatacttcatgtacatctgcttttagtacgtctttattaataactgtaacattaccatatggcgctaacgtctcatctaaaattggtaatagtctttgatcaatttcaaaagccactacttttttagcacgcttcgctaattgctctgttaatgcaccaatacctggtccaatttcaattgcaccactttctgaaccaatttctgcatgatcgacaatacgatttaatacatttgtatcaattaaaaagttttgtcctaaactttttttgaatgaaaatccatacttttcaacaatgtcttttgtacgatttggcgttgcgatatccttcattttttttcctcctgtattacttgcttataagcttctgcaaatgattcctttgaaacttgaaacatctgtaatcgtttatgtaactgttttgcatttgtataaccaatctttaataacttacccattctttctctgcggctctttgccatttctccgcccactaagcctgcatcgactaaatcactccaactaatttcacttgtgtaagcttccatttcttcatgtatattctctagagcacggcgaatcgactcattagaagcatgttcaatcccaacaccctttttccttttagcaagcgcttcttccttcggtaaaaaagcatgcttacagccaggaaccttgtcagaaataatttttcgaatacgctctccaggataatccggatctgtgaaaataataacgccccttttttgctgcgctaatttaacttgctcaataacatgatcaccgattgctgaaccgttcgtttcaattgtatccgcatcaacagcacgcttaatcgcaactgtatcatctttaccttctacaacgataatctcttttattttcatgcttgcctccacactcatttcgtctctacttagtaaaacaaaaaaatgacgacttttccattattattttccccattcttatattttaaaaaatagaatagaaaaatctttgttctctgtccttattgtaacacttcatcattcacttttattttcttgattacttctactagnttttctcaaaataaaaaagaacaggtttcccccgttctttttattcaacaccaaataaaacttttgca

SEQ ID NO: 1189 - DNA, 7375 bp, Bacillus thuringiensis
agcaaaaggagtaaaggcaaaaatcccaatagttgaacctataaatgcccctaacacaagcctccatttgttaattttcttttttaacacggtagctgttaatacaagcaaaagaaaatcaatgcaggcgtttaacaaccaaacaacgtcggcgtaaacaaccaaacaattcacctcttttttcaagttgagactagtataatgcatatccaataggaaagtgtgtcaatttgcggaggtgtttttttgttattttgtgatttctagacataatctgtcggtaaaaaataaaagtacaaattcatagaatgatatactcttattttcaccaacaaaatataccaaataaaaaaaagacctgcttagcaggtcttttccatttaaaaaacaaaaaaggagcatgaaagctcctttttttatcgtctacgacggttacgtaaaaatgctggaatatcgatatcatctgaatctgaatgacgctcatgtacaactggctcttcacgcttcatttcacgttttacttcacgttgttttgaaggttgagctactggttgttgctgttgttgcgtgtggttcgcattcgggcgaataattggttttggtggttgagttgcaatgctatcatcaaaaccagttgcaattacagttacaacgatatcatcttttaatcaatcgttaataacagaaccgaagatcatatttacttctggatctgaagctgaagctacgatatctgccgcttcttgtacttcatataagcttaagttagcgccacccgtaatgttcatgataacaccttgagctccatcaatagatgtttctagtaatggactagaaatcgcttttttcgcagcttctgcagcacgattttccccgttaccagaaccaatacccattaaagcagaacctctattagacataattgtctttacgtctgcaaagtctaagttaattaaacctggcgttgcaattaaatccgaaataccttgaacaccttgacgtaatacgttatcagcttcacggaatgcttctaacattggcgtatttttatcaacaatctctaataagcgatcgtttggaattacaataagagtatctacattttctttaaatgctgcaataccagatgctgcttgcgtcgcacgcttacgtccttcaaaagtaaatggacgtgttacaacaccaactgttaaagcacctaattcttttgcaacttgagcaacaactggagctgcaccagttccagttccaccgcccataccggcagttacgaagaccatatccgcaccacgaagtgcttcttggatctgttctttactttcttctgcagcttttttccctacttcagggtttgcgcctgcaccaagtccacgcgttaattttccaccaatttgcatttttgtttcagcttttgatagatttaatgcttgtgcatcagtgttcacagcgataaagtctacaccttgtacaccgtgttcaatcatacggtttacagcattgtttccgccaccgccgacaccgataacttttatattcgctaattgatcttgagtagtatcaaactctaacatgtcgaaatccccctagaacctcatttttcgtgtccaattttaatcccataaataacggaatacacgttttacttttgacatcatgcggtcatcattttgattattattgttttgattacgagttttttgtttcgcgggttgctgttgtaccggcgttggtgctggtgctggtactggttcaaaatgctcttgcttttcctgcacatttttcccacgtaatttagctttttgataagaatgtttaattaatccaactccacttgtatattggggctcacgcacaccaatataatcaggagttgctacacgaacattttcatgtaaaatatcatatgcaagatcaagaacacctggcatagaagcaattccgccagttagtacataaccagaagccacttgctttactcctaacttacgcacttcatcttgaacaaacattaaaatttcctctacacgagcctctattatatccgataattccaactgagaatattgttctgtttgatcacttcccataataggaaccgtaaacatctcttcttcagatgctgtatcataaaaagcatgtccatatttcaacttaatttgatctgcattttctgttgaagttttcaacccaatcgcaatatctttcgttatatggtctccacctaatggtaatacgctcgtcgcttgtaactctccatctttaaaaatagataaagttgtagatcctccccccatatcaacaagggctactcctctatttttttcatctgaagatatagcaactgttgcagccgctaaaggttgaagacaaatatcaacaatttcaagacctgctttttctacacaacgaagtaggttatgtagtaaagttctcgagcctgtaataagtgtaccttccatttctaatcttacaccgatcatcccgcgtggatcgttaatctcgtcaagaccgtctacgatgaactgtcgaggtaccacatcaataaactcacgctctggagcaattgacacaacttgtgctgcatctagaacgcgtaagacatcttcattcccgatttcacgatcttcatttgaaacagcgactactccgtgacaaggaagtagctgtacctggtttgcattgacacctactacaacttgctcaatgtggattcccaccatgcgctcagcttgttcaattgcttttttaattgatcgaacagtctcgtctatatcaactatcgatcccttctttaaaccatttgattttacatttccaacaccaataatgtttaagctgtcattaaccatttcaccaatgatgactttaacattggatgtaccgatgtcaagactaacatatatttcattgctgttcattctttggcacctccttctttatttataccatacaactcaatatatggaacaacaatcgcaactttactatttataagaaaaatattcaacgtctttatacgtttcccttttttaaccctatatttttcttatttttatttagcattcaattaagaatatcgcagtaaactatgaataactgcttatcttgaaataattctatttccagtgtaaagtttaccgccaagtataagtctacactaagatgtactcatagaaaagtgaaacttgtaccaatactagtatgaatctaagaatttttacatatttttcatcaaatgaaccattcttctaaattcgtatacatataatagaacattcgtttcgttttttctgctataagcaacgaaaactaccattctattcttttttgtcttccgcacctaattctttcgtatatgcacctacttctaagtcaattaataccttcttacctggctcaattgtttttaaaataagtggataggcttccatacgttttgcgaaattttgaatcgtagtgctcacttcataaccttcattcatatataaagtaagatgatcttcattcgcatttgttggtgaatagcgaatctccgaaatagattttaaaatagctggtgttaatttttctagttcagcgattaactccttcattttctcttctttaaaaggttcgaaaatcggtgctgcaacaggaagttttccattaggtagtacatcaagcgtttttccattttctaataacggttgtagttttccctctttatttatataaccaatcgttaaatattcttcgatatgaatatcaatcttgtttggaaaacgtttttttacatttactgctttaatttcttttcgcttcgttaagttttcttcagctttatgtgctgtcactcggaaataacttgtatcatatgtcacgcctgaatccttcattacttgctcatccgtcatatagtgatttccaaacacactaatcttttttatattactaagcggagaccgaaaataaattaaaaagagcactaataaaaataaaattgatatgtataaaatcaatcgatgattaacattttttttgttttttttcttttgatttttcaattttggtacacgatcttgtagtttaatcactttactattattcatgtacgatccccctatgtaacataaagaacggcatgttcctcatgccgttcttatcttcttattataacataaatgataatgagcggaacgaataaccgttatcttccaatgatttctacttctgtgtgcatatctacatcaaatttatccttaattgtatgttttattaattcaattaaagacattacatcttgcgctgaagctcccccggtattaacaataaaattgccatgcatttcagaaatttgagctccaccaatcctataaccacgaagccctgctttttctactaaatctcctgcaaaatgtgggattggattccgaaatatacttcctgcacacggatgattccatggttgcgtttcacggcggtagtctttattattttgcatgctacgtacaatttcttcacgttttcccgcctgtaattgaaactccgcctctaaaacaataccaggacgtttcgtttgcaatacagatgaccgataagaaaactccagttctttattcgttaaccaggcaattgtaccgtcttcaaacagaatgagagccttcgataatacactcgatatatccgatttatgtgcacctgcattcatatatactgcaccaccgacacttcctggaataccgctcgcaaactccaatccagctaacccttgacgactaagtaaagttgacaatttaataagaggatatccactaccaactcttaccttatgtttttcgacctctaagtgatctaatccttctcctaaacgaataacaacaccttctatgccttgatcagatacaagaaggtttgaaccgcgaccaattacagtccacttcgttttgtattgctttactaactgtaatgttttttcaataccggctacatgctttggcacaattaaaatatccgctggtccacctattttcatagttgtataacgtgctaacggctcgttaactaaaacacgaccaacgtctgcttctataagctcatttactaattgttccatagacaatctcccccatattaagtctccttatgacaataatatgcagggcgttcacctaacgttatccctctatttacgggcagtacagctcctaaatcaaaattcggcgataacaaagaaattaggcggaatcaggatgtcagtaaacatccgattagtgaaagataataatcaacgagagagaatcactccccactaattaaagcctcactttatttttttacaagcttattcattacttcatacagcttatttgctgcatctggaatacctagttgcttagccgctagcttcatattttgtaatgtttgtgcattcaataaaatctcatcaatatcacgaataagcgtttcagctgttaaatctttttcaagtaacatttttgccgctcctttatcaacaactgaacgtgcattcttttcctgatgattatttgttacatacggactcggtattaacacacttggttttcctaacgctgttaattctgcaagtgttgttgccccagcccttgaaacaacaaggtctacaccagttagtacctctggcatattatgaatgaacggcttaataataacattgcttgggttccctttttgcttcacggcttccatcactttatcataatgtacttcacccgttacatatagtatttcgtagcttttgttcccaaactgttcaattgcttcaacgaaggcatcgttaatcggtctagccccacgacttccaccaaatataagtacagactttttaggaagagaaagcccaactgaacgtttccccttcattccattttgatccattacctctgatgctcgtggattacctgtcattaccacttttgactctggaaaatgctctatagctgcttcaaaacaaacagcaactttatcaacataacggcttaaaaacttgttcgttacacctggtacactattttgttcatgtacaatagttggaatacctaatttggctgcagcgtatacaactggtccacatacatatccacccgttccaattacgatatccggattaaaacgacgaatgtatcgtttactatcctgtacaccttttagaaaacgcattactgttttcacattatctaatgatatttttcgtttaaatccacttataacaatagattgaaatggtatacctgcttttggaacgattgtactctctagtccattttccgtaccaatatataaaaatctcgcttctggatttaacttttttatttctctaattaaagcaagagctggataaatatgaccaccagtacccccaccactcactaatacacgcactactaactcctccgcttctcttttcttatttccattatacttatttctatatacatattgcatttttacacacatacgaaaaaccctgtcttataaacagggtttagtagcgagaatggcgacttatatttaataatacacctactgccattaacattaatgtcaaacttgatccaccataacttaaaaacggcaaggtaatacccgtaacaggcatcagtcctgttacaacaccaacattaatcattacttgaatcgcaatcatcgccacaatacctactgctaaaaacgtaccatataaatctggcgctcctaatgcgatacgaatcccgcgccataataatagactaaataataataacacaaatgaaccaccaataaaacctaattcctcggataagatcgcaaatataaagtcagtttgtggttcaggtaaataaagaaatttttgtctactttgtccaagtccaagcccaaataatccaccaggtccaattgcaagtaatgattggataatttgaaatccactcccgagcggatctgaccacggatctaaatatgatgtaatgcgtttcattcgatacggtgctgatgcaattaaccctacaaatcctgctacaccaatcaaaccaaacattgcaaagtgaaagaccctcgctcccgaaatgaatatcataatgatacatgtcccaaccattaccgttcctgtcccaaggtctggctgtaacataatcatcccaaaagcaagaaacacaaaactaagggccggtaataaaccacgtttaaaagatgtaatcaatttttgccgttctgctaaaaactttgccaagaaaataatcatcgcaaacttcataaattctgacggttgaatcgaaaatgctccgattccaatccaacttcgtgctcctcctcgaacaagacctactccaggaataagaacgagaataagaagaatgaagcaaactagcaaaatcac

SEQ ID NO: 1190 - DNA, 10265 bp, Bacillus thuringiensis
ttttttgccatttccaaatcttttatttgaaaggaagtatgtttaatgaagattgatggtgtttttgaaggaggcggtgtgcgcggtattgcgcatgttggggcaatttgcgcgttagccgaaaaaggttatgaatgggaacgtgtagctggaacatcagctggtgcaattatcgcggcacttttagctgcaggatattcttgttcagagctaaaaaccattataactgatatcgattataataaatttacgaagaaaacctttattgacaaaatcccctttatcggaaaaggactaagtgcatggactactctaggtatatactctaatgtatttatagaagaatggattgaagaattacttcgaaaaaaaggtgttcatttatttactgatttaccggatctaaacaaactcaaaatcatcgcttctgatattagtaatggtaaaatggttgtctttcctgacgacttaccaaactatggatttttaaattatcgcttctctatcgctaaagcggtaagaatgagtagtacaatccccttcttctttgaacccgtaaaatggagaactccaaaatggaagcagccttgttatatggttgacggaggaattctaagtaattatccaatttggatcttcgattcacctaccgctcctcgctggccgactttcggatttcattttgtaaaagatgagattcaagctgaccctgctcactataacgagcctatttctatgttcaaaggactatttaaaacaatgatgcaagctcatgatttacgtcatttagataaggaatcaaaagcaagaacaattacaattccaacaggaacgattacaagtactaattttgaactgacgaaggaagaaaaagactggctttacaattctggttataactctgctaataaatttttacaagcttggaactttaggcaatatattgatgagtatagaaaaggaaatcaagaccgaaagacaaatcgattttttcgtcaacttgactcataatattattactttgcgtataaatacgagaacgtttaacaacttaatagtaaataagcctagtaaattcttatattactagacttatttacttcctatataatctcatacattgtttaaggatacgttaagccttcggcttcttctgcagttataactatgtaacgatttcccgttcttaatcctaacagttctgctttttcaatcgcctcttgcttcgtctccgcataagcagctaaatattttcctccattgatcatttggcaaattacatattgtttcattactttctcctcttactttttcattagttgtgcaagtttttttatacctatttcaatttcttctaacgttgcgtatgaatacgataggcgcaaaaattgatttgcacttctatcatataaagtacctgggtttaataaaaccttttcttgcagagctttatcaaataaactgcgatatgaaatgggtacttttatatgtacccatatataaaacccgcctgttggttcatgccaagttgctatttcacgaagatatttatctaacattagtaacataaaatctcttcgttttttcaattcacttcttacaaatcgcaaatgctcatcatatagaccatttgtaaaccactctgctgcaatttgctgggatatagtgcttgaaccataatctgtttgcatctttatgtctgacaatctttgaattactggctcgggtccaacaatccatccaattcttaaacctggactaattactttggacatgcttccaatatgtagtacgattccatttttatcataggcctttaaaggtttcgaactaggtgcatcaaaccataagtcttgatacactgcgtcctctataataggtaatccaatttcattacatatttccatcacttctattcgtttcttcgcattcatactaaagttcgttggattatgaaaagacgggattgtatataaaatagaggcattaaattgcttcttatatttcttaatatatgatgtatgtaacccgctttcatccattgggattccaattaaacgtactcctgctgattgaaaaacattaagcgaatataaataggatggtttctctaataagattgatgcccctttcgaaagaagccccatagaaataagttgcagcgcttgaattgctcctgaaacaattaatatagagtcaggagatacatatacgccatgctcctttaagtattcgggaaatcttttcccttaaataaagatttcctttcggctcttcatacccaagcgtcacatttgactttaaaaggttattcataatttctttcatctttttctcaggtaagagactcggcgcgagctcacctgttcctaaccgaattacatgtgggtaaaattcagcttgattaatctcttgaatagctgggagattcggataatgaagtcctgtttctacataagactgccaattaggcgggggtgcgtaagttgaaacattctcattattatttacaacaattgttcctttcctgccattcccttcaatatatcccttcgcaactagttcatcgaaagccattacaattgtgcttcgattcacaccaaatgtatgggccaaatctctttgtgaaggtaatttcgttccaacggtccattctccattaacgatcctttcttttatatacgtttctatttgtttatacagcggcgtcgctagagacatatccggtttccaaacgaatctttccatcatatcaccttatattctttttggttggtaacctccccaaccatatggatggatacaaattttcatttcttctatacaatatacactatcataatgaattaaaataggaggtaatatgatgagtgaagcaattattcatggtatcattcttgcatttggacttatcattccattaggtgtacaaaatgtttttgtctttaaccaaggtgcgagccaaccaaacatttggagggcagcccctgtagtattaactgcctctatatgtgatacgttactcatattgattgcagtgcaaggtgtctcccttgtactccttactttttcttggctaactaactcattatatataattggatttttctttctcctatacatgggctttgttatttggaaaagtagcccttccaacgatgtaacacaagaaaaaagtatgcccttaaaaaagcaaatcctttttgcagcatcaggtttgttattaaatccacatgctattttagacacaatcggtgtaattggaacaaattttattccaaacataggaagtgaaaaatgggctttcacacttgcaactattatcggttcttggaattgggttaaaagcttagccttaacgggggaattttctaaaaagactagactcaaccggaaagccaattttattattaaataaattttctggtctcatcatatggggtgtcgcactttatatgttaaaacaagttatttattcttaatgaacgaaagagaattgcatgttactcaaaacatcatgcaattctcttacaaattatgaagtaggttccggtttctgttttaccgcctttgcatcctttgctggtttaatccaaatgattgctatgacagcaccaatggcagcgaaaatactagtcaaataaaacacttcatggtccgcccctttcatgaaaaaagaatataaaggtggtccagctgctacaccgataaatcgcattgaactgtaaaatgacgtaactgttcccctttgctccttttcaattccttgtgtaatgagggcatctaaacatgggagtgccataccaatccctatccccataataacgagacaaagaagtagtaaataaatcccttttataaataaaggaatgatgactgatgcagctgccattaaaaacccaatatagatacacttcttcataacattttgattatctccaatttttttaccggccatatatgaactaagtgacagtacaagtaacgggatagcaagcacacaccctttccatataccatgaatgtcatactttgattccagtatagtcgacaaataaaagagaattccgaataaaataagcataataattgcacctaatgcaaaaatggcaattaaccatcttcctttttctcgaaacgtagacagaatagattttataaactctttaagtggtggtacttctccttcttgtttctttgcctttactagaacaagtaataaaacaattgatactacgcataaaattggaatcgcccaaaatggtaagaaccatacaacggcagcaagagcagaccctaaaatagggctcagcactttcccaaatgtattggatgtttctatgattcctaaacctgtactaacttgtttttcgtctttgtataaatcaccaacacacggtataacaactggcattgcaccagcagcaccaataccttgaatcgctctaccaatcaatatccaattgtagggattatcaactttccaagatacccaaccagttatcgctcctcctatagctgcaatcagcaaactcggaaccattaccatctttcgtccccatctatctgataaataaccagcaatcggtataagtagaatggctacgatagagtaaattgtaataatcatggatacttgaaacgatgaaatatgtaatttcttttcaatagtcggcagaattgggatgagcattgaattccctaatgtcataacaagtggaactgatgcaagcgcaattaaacaacagttttctttttttaacatgttggcttcgaaacctttcatcatatatttcttaccatataatagccccgctggaacgtaacttttcattccaccagggctattacatctttactacttcccattcacaacaaaagaaattggggaaattatagtattattcctattctttgaatccagttcacaatatatccataccaattaattgaaaaaaaagaaaggaagaatccttcctttctcctataaccttctacaattagcgagtatatccgccaccaagttgttgttctgccatcgctacaaggcgttttgtaatttcaccgcctacagaaccgtttgcacgtgaagaagtatcagcgccaagttgtacaccaaactcttgtgcaatttcatatttcatttgatctaaagctgcttgtgctccatgtgatgctaattgattagaattacgatttctagccattaccaatcacctccttatttatatataaattgtgttaaattcaaattaaaatacatggaaatttttggttattttttaccataaaaaaagagcctctaaaacgagactctcacatcatttcacattacgaagttactacttctaattttctatttattaatactttcatttcttcttttaatatctcttttgcattatgtccaaaccattctaaggaagcaaaaagatccgtacctctcacttcctgaataatctcatcataatttacaataccttcaaataacggaaccataccaatacgacttcctgctgcagcatatacattattaggttcaaacacatgcaaataatccgctgaagatatattcttaaaatggtaatgtagtgtccacggctttaatcgatggaaactgtctattggatctgcgccagactcccatatatggagaaaatcaagatttatttttaaattcggatgatttacttcttctaatagttctatagtagaaggcaatgtgtctgttagtgtattgggatgtgtttctaacagcacatacatattgtgctgagcaaacacatcacaaatcttacgtattcgctttacatactcttttctctcttgttccgagaagtccttgctccctttttgcccagcaaacgtgcgaattttattcgtattaaaccaattagctagtactacaagtatgttcacttttctctatcgttttttcaaaatctgctgataatgatatatctaagtaatcacttatcatcgtaatttctaagtttttatcctttagaaaagtcaattctcgttctgtcgtttcgcgttcttgtatatacaaattttgtgcatgagtcccccacaattcaattccttcaaaaccgttttcatatgcaaattgaacaatatcagtaaatgaaattaattgatgacgaaatgaaatggtacatagcgaatatttcatagcattaaactcccctatcttaaattcagttagcttattaaaaagttgcgacagactgatttgttttcatacctttccatgatagaaactgtctctctaattccttcttaatttgcagttcaattgcattcatttcatccagtttttcaataatcgatactagcatacctttattattcgtcattgccattttaattgcacgatactgtacatttgtaaatccttgtacaatatcctctacccgatcacaccaataatcaaattcttgctccgaatattgcaacgtttcacggaagtatgcaaaggcatgctcataactatatttacgaattgcaagtactggtatttgttttactgctgctacaagaccagaaagcgcatatccttcttcctcatttgccatttttacaattaaatttttcagttccatagtcagttcattgtcgttctttttgaatgtttctgtgaaataactagctactgtttcttgcgttggctccccaattccttctatatcaatgaaataacctccaccaaatgggttatcttgaatagagtgaagtactttttctctttccatatttccttcccaacgaaaatcaggatctagcatgaaccactcttcttctttctctgtttttgatatcattaaataatgtggaaacggtttttgatgaaatttattttccctctctggtaatagagacatatcaaccattacaatgacataacgattttccggcttgttttctactaattctaaaaacgtttctacattgctatctttatcttttgcatgatcataccattcgtttactttaataccgtacaatttttcaaaccaaagtaaataatgatcatggttaatgttttcagagtgatatgaaataattccgccttctgttatatcaaaatctccatcccatagtccaaaataaaatggacgaaaatcaatgtcgctacgcctttttataatttcacaaaaacaactcactaaacagtgcacttttattgaagtcatactctcatccactttcctaaaggttagttattcacatttacttcttgtaactcctccataaaatcaagcaaagatcctacagtaagaaatgcctttggatctacctcatcctctggaacgcatagctttatatccatttctatgtatacaataagctgtaacatcattaccgaatctatatataaatcttgatttaagcgcatcgtttcttctaaatgcgttacatttttcagttccattttttctatcataatgtctaacacggcattctttaacgcttaccgtctcatgttgtaacctgttccatctctagtaactttctacttacttttccagttttatttttaggaatttcatttacactttcaatttcatggggaactttataagaaggtaagtgctgaatacaccattctcttatttgtactggatcaacatgagagatcactttcgctttaactatttcgcccatgacaggatgtttccctcgatatacaattgcctcttgaacaccttccaatcgaagcatcgtttcttctacctctataggaaagacttttaatcccgaaacattaattacatcgtccatacgccccataaaatgaatgccacgctcagatttataccctaaatctttcgtgaagatttccttatcattcattttcacgacgatttcttccggtgcattttcatctgaacctatgcttatactcgcatgaggtagagggtttcctaaatctaaatggctcttcatatcatgacatatactaatacaacctgcttcagaacaaccgtattgctgcatcatatatgttgtcatttcttttagtttataaaatagtgcttctggcaagggcgatcctgatgtcataattttatgaaactggaacgttcctaatggaaaactccccataatgtgtaacataagtggtactgcatatataatatgtttctctgtattgcgaactatatttaatgcgaatttaggatttttattcgtaatgattacaggctggctccccctcttaattgctgataaagtaccacatattagtccgtatgaatgtgaaacaggagccataacgattggcacttcatctacttcacagtttaaagcttcattataagcggtaatttccgtatcaacttccgtccatgctctacgaattagtttcggttcccctgtagttccagaactatattgcaataaagaaggctcttctagtaaaaagttccctacttctaattttgtaaaatcgccatattctccatataaaattcctacacaatttgcacgctttgccattttaatagctgtttcttttggtgtatcttcatgtataagtaatactgatgatttcttttcttttaagaaaaacacaatcgtaataatatcgaatggatctttcagacaaagtgcaaatctatttccttctgcttctttaaattgttccatttcctcataaacttgtaatctcgattcaaaatcacttttgctatactcttgtttattaacgattagcataatttccccctgtaacagctgatttttgtttcataagttgtcttactctatacaatggatttggaacttcatgaacaagcgattccagatccatatataatcgacgtttcgttaattgttcagcatagaatgtaggtgcatataattgaatattttcaaatctacctttcaaatgtggatatattcttaaatgattttcaatttcttcaacaaccatcatccaaaaatgttcttctttcaatccatattcatccgcaagtacgaatgctaattctcctaaattaaacaggaatagtgcatctaacaccatctcttgcaaacattcaatgcgatccatttcaaagaaatcattcatttttccattcgcatatgttttatgcattttagtaaagtcgggacatttgtcaaccgttttcaaatatggacgataaaactcaagcccttcatgaaaatcctttaacgcaatacgaacaggcaccccttctttatggactagaatcatattttgtccatgtgattccagtgcgatgccatgctctacaacaagatgtataactggtattatcgctttttgaataagtaattgtagccaatccttcattccatatttattcaaccacgcatcaataattggtgtaccatttttctctttagcgtataaaccattaaaaggaattgcatcttcttgtgcatctaaatacttatgaatgctttcgcgccaaatacatcctaatgaaccatatatagcttttttattcgtgtcatacgttacactggaaaactcatttaacaagattaaacgtgcttcatccattaaataggcgtcattacttacaacatcatttaaccaatttgatattgctggtgcactcacaacagagtatggtttcagcgtacgaagtgttgaagtgttgagtaaattcatcgataatttaacgtacggtttctttggactcgtaatatttcttaatgttctcattgactgttgcgcgcaataatcgtcctcagatgttcctaaataaataataaatttcccctgtatatgatccgcataatttgaaatgatgaaattcacccactgccatgggtgaacaggtataaacacgtactgttttggattacatcccttattacgaattcgttccataaactcttctaatttacgatcgccaatctcctcttttaaaaggttgttatacatcacttcattctcataacctataaatgctaacttaaatatgtacattaacgcttgaataaatatgtacattttcaattggattctccatactgactctgaggtggttagtatgtatattaagctagatattcacacagaatttgaggttataagtctttcacccttgccgaattttagaagactaatggggggcttaaacatgcagataaataatagtcaagtagccagataattgtatgtggatcggcgggccatagataagtatttgaatggttctccaccataagggacaaaaaagaatacaaataaaatcgatacatattatgaagtgattgcagctctt

SEQ ID NO: 1191 - DNA, 4817 bp, Bacillus thuringiensis
ttttttagaaggtcttggttattggggaattatgcttggattaatgctagaggttattccaagtgaaatcgtattgtcttatgcaggctatttagtatcaacaggaagcattacattttggggcgctgtcgcgttcggtacaattggtggtgtaattgcacaactattcatttattggattggtcgatatggaggaagacctgttcttgagcgatatggaaaatatattttaattcagaagaaacatattgattatgctgaagattggtttaatcgttatggaactggcgttatctttaccgcacgttttattccggttgtgcgtcatgctatttcgataccagcgggtattgcgaaaatgtcacatgctaagtttattacgctaactacattagctgttattccgtggtcaattgtgtttgtatatttaggttttaaattaggaacagagtgggaaagtattaataaagttgcggggccatatgtgaaatactttgcacttgttgctattgttagtgcaattggttattttgtattaaaaaaaatgatgaaaaaaaagtgattacagaaaaggaatctatgtcgacgtagattccttttttattggcattttttcaaggatgaaagaatacgtttaatatttactatattgtggcatacatatagaaaaagggtgcttggaaaggggaataaagagaaatggaactccagtttcaaaatgtatatcaacaggtagagaattggtatgtgttggattcggagcttccttgggatgtcaaaaagttgagagaggatttgttttctcttattgaagtatgtaaaacgcccgttattttttgtgatacgtgtgatgcaaatgatgtgcttctatcattaggggaagaggaagaagagttcctattcccagtaggtggtttttatcataaagaaaagcaattaattttcgtttgtatgtgggaagagtatgatcaagttctcaaaacgctactgcatgaattccgccatgcgatgcagcataagagagatatattgtatgtgggaagtgaacggtacgaagagcggtggattgaaaaagatgcgaggaagttcgcggagaggaaattggatgaatataagagtagaaagttaatgtaaagcatagtggagaaatagcgctgtgctttttatgcttattaaaaataagtatttgacttttattaagtttagttctaaactaatgatatgaaacgagcgaggtgatgaaatgaaaacagaagatagactagggctactattatggtttcgtttgtcacgcttttataataagagtattcgtgagacgaatcagcatttgaaaaaatggaatatatctgccgcccagtttgatgtgttagctcaagttggaggatataatcgtttaacgcagcaagaacttggaaataagctatttgttacgaaaggaaatgtaacgcagcttttaaataaaatggagcagcttgagtggattttgcgtgaacaagagggtactacgaaatatatttctttaacagaaaagggaagagctttatatgaggaaatcgtcccacctcaagaaacgttccaagcagagaagtttcataatttaaatatagaggaacaaaagcagttattaacactattaaaaaagttacagtaagaaaaaattttaaaataaatctcgaattcgagatagtatgaggtgaaggatatgtttagaaaagttgatcataaaaatatgggcagagcaaatcatggttggttaaatacacattttcatttttcttttgccaattactacaatccaaataacatgaacttcggagcgttacgtgttattaatgatgatctagtagcggcgcaaactggttttgatatgcatccacatcgtgatatggagattatttcttacgttgtagatggtgctttaacacatgaagacagcatgggaaatcgcggaacgattgagcgtggacatgttcaatatatgagtgctggcacgggtgtatttcatagcgagcataatttaggcgatgaaacgctgcgtttattacaaatttggattttaccagaccgtgcagatcataaaccaaactatggtgagtttaaatttgattggagcaagcgtgaaaatgaatggttccatatggtatcttcagtagaaggaaatgcaccaattcaaattcaccaagatgcgaatttatattccttatcattagaggctggaaaagaaattcattttccagtgaaagaaggccgtcaattgtatcttgtacaaattgaaggaagcagtgtaatcaatggtgaaacgtttgttatgcgggatgcggcagaatctgtagaagaagatattcacattcaagcgaaagagcaatcacactatttagcaattgaattgaaaaaacaataaaaggtttatagaaaagaggacatccgatagatgtcctcttttttggattggaattatctgaaaaatgtttctcaaattttcggtagaggtatcggctgggaaaataagaattgtataaaagtgtcaaaaatctttatgggaatggggaatgttatagtgaaaaagcaagttatttcatcagcattagcgttaactgttatcgtcgggggatttggagcgtttggggcaacgacaacgaaagcggaagaacaaaaaattcaatatcatcaagaatttaaaacacctgcatacataggtgaagaatggaaagcaccggaaggactagataaaaaagagacggtctttcaatacttagagagtaagaaagatatgtttaaattagcaggaaatattgaaaagcattttaatatcgttggagaagaaaaagacgctgaatctgatacgacacatgtgaagctagttgagaaacataataacattcctgtgtacggttctgatcaaactgttacacttgataaagagaataatgtaaaagcattcttcggacaagttattccgaatttagatgataaaaatattcctgcagctgcaagcattactgcggaacaagcagaaacgattgcaaaggcagatattgagaaagaaattggtaaagtaaagagttatgacggtgtgaaaaaagatttgtttgtatatgaaaaggacggtaattactaccttgcatacttagttaaggcatcgatttcaaaaccagctccaggatattggcattattttgttgatgcaacgaatggaaatgttattgagaaatataacgctgtagataacattactggatttggttacggagtattaggtgctagacaatcatttgaaattgctcaagatacgaaaacaggacaattcaacttgtttgatggtaaacgaggacaaggcattcatacatttgatgcagaaaatatggacgagaactggtttaatttattctcacaatggcttggatatacaggagaagaagttgaaagtaaatctaagttcttcgaagataaagctgcagttgatgcgcatgtaaatgcagggaaagtatatgattactacaaaaagacatttaatcgtaactctttcgatgataaaggtgcgaagcttatttcaactgttcacgtaggtacagcttggaataacgcagcttggaatggtgtgcaaatgatgtatggtgatggagatggaaaaactttcattccattatctgctggacttgatgttatcggtcacgaattaacgcatgctgtaactgaacatacagcaaaccttgtttacaaaaatgagtcaggggcgttaaatgaatcgttatctgatattatgggtgttatggttgagaagaagagctgggatttaggtgctgatatttatacacctgataaacctggtgatgcgcttcgctctcttaaagacccagcgtctattccaaacccattaaaaccaagtgaaggttacccagatcactatagtaaacgttacactggaacagctgataatggcggcgttcatattaacagcagtattaacaataaagctgcatacttagtatctgaaggcggggatcattacggtgtgaaagtaactggagtgggccgtgaagcgacagaaaaaatttactaccgtgctcttacgaaatatttaactgcaaactctgacttcaaaatgatgcgtcaagcggcacttcagtcagctgaagatttatacggtaaaaactctaaagctgtacaagctgtaacgaaagcttatgatgcagtaggtgtaaaataataagagaaaagacctgacatcctagtcaggtcttttctttatcccgctatccgcaaatgatgaaatttccactttatttagtcgcgaatacctaatgcgattttcgccatacgtgacatacgttctttcgaccacggtgaattccaaacgacatttacttctatttcattaacttcaggtacgtttgttgataatacttttttaacgtctgatacgatttgcccagccattggacaaccgatacaagtcatagtcatcgtaatgacagcattattattttcatctgctgtaacatcataaactaatccaagattaacgatatcaacacctagttcagggtcaataacagcttctaaattggcaagtaatttattttcaaatgcttcttgtgacataagcagcccctcctacactttaatgatatcgattctcattataacggaaatgagcataatgtgcaggaaatgagctcgaaaaaatatccctcttcgcaagagggatattttttgaacatctcttctgttttaaaatgagacccgagctgatctaactcttcaactgttgatacatttttctagcagttactgtcatttcattcataacatca

SEQ ID NO: 1192 - DNA, 10228 bp, Bacillus thuringiensis
cttgattatgttcaaaaccattttgcatgcgttacgtaactgctcgctctgtaaataaagacccccagcactttcttacatgctgtaaaatcgcttcttctccgataatatttaaatacgtatcttgttgacctgcaaatgaagcatacggtaaatcttcagccgtcgcactagaacgcacggcatacgcatgttcatttccaaaacgtgagagataatgagttactgcttccactacatcagaagggatttctactgccataattacttctctaatcttcttactcatttcaccaatttgagctcgctcttccattttcaactttgttagttgctgcaacaaagcctgaagctcttcattttgctcgatagccttttcatatcctaccgttgtaacacaaaaaccttcgggtacttgtataccttgaatgtttgttaactcccctaaattcaaaccttttccaccgacgagcgaaagctgcgtgttttctatttcctgaaaatcgagaacgaaagaactcatataacatctctccttactatgcatgtgttcttgattgtagcaggagtcaatacgaataaacagtctatttcgaacttgatttacatgatataattaagttaggaagagataactatttttatttctccccctctaatccacttcaattacatctccaaacttaaacattctttgattatgaaaagcatccgtacaagtaatcgtcttatttaatggatttatattagctactgttatgtaatttttatatagatagccattctctaaaatttttatagtgtaatccactttcaataaaagtcaaaaaatatgttcgtcaattaaatcttcacaaatatttaatgcttataaattaatattcatctcatatataagttctaagaaatttagataaaaaagacattatttttgatgatctaaactaattgaaactttaattaaattatatatctataacaacatagagcaatgtcataacgaattgaaaccgaaagtttcttaaagtagaaaattcggcttcttttatatcgaaatttgcttagcgtatattttcgttaaaatgcgggtagtaccccatcgctattgagctaagctcatacaccatcaattatagtagaggctacgtgtaaagaatttaaagacccctcagggatcaatgaattcctgaggggttgcctacgtgatataacatatttacaattatgttacgtttaaaatacgtatctttttcatttaccttataaccaccctatttaagtttataagaactatgcttttgagataaaagtcattacttgttttataaactcgtaaccaaaataaccactaaatccgaataggactattgcggcaaatatagatactcttttaataaaggttggatttagaaaacgtctagtaaaatgaacaaagcttaataagatcatatcatgcataaagatacctaataaaatacctacagctattaatataaatgtagatgtacttgcattacctaatgaagaaactagaaccgggccaaagacccctatccaaaatacaatattagccggtgatatagcaatcataaaaccagataaataagctgataataaagatttattaggatcttctccatctatgttaacttccgactttgcttctttaatgctttctattccaataaacattaaaaatataaaacctaggagccacataactgtttctacccatggattggttaatacactagagaaccctagataaatcaggacgattaaagataaatctacagtcattcctcctatacctacaaaccaaccatgtacgaaaccatttctcattccttgtttagtcatttggactgtcatagcacctgcgggtattgctaaagataaacctaacaaaatatatgtgaaaagtgttataatcataaaaattctcctattataagtattgtaataatcaaaccctttttctttttcctcgggttcagcaaatagaactacagcacggcgacttttcacattacttctagcaagcatcaaaaactcataagaagataaatgcctaaaatcccataagatcctttacatgttcagcattctttttagatgttaatttttcaagtaataaaaacgcaacatcaaaagctgtgcctggatttgatgatgtaataatatttccatcttgtactattaaatcattttgtactattgcaccgaaattctttaactgctcttttcgtttactcgtcggatgactgtatgtggtagcttttttacctacaagaattccactttttccaagcgttaatgatgcaacacaaatactggcaataggcttctgcttggcataaaaatgttgaataacatgtaagaattctctactgtatgcatcccgataaaaaccagcctcttcaaatcctcctggaatagctagtgcatcaaattcatctaattgaatatcatcaaccgttttttccggtatgacagtgaaattccaagtacaagttaatttattccgaagaccaactgttacgacctcggttgatccatctccctcccatttattccagcctagtacatctgtaaatacactagcttctactgcttcaaacccgtcagctaataataataaaatctttttcatatcgtaaaccgcctccttctacccttattttatacaagtatagaaggctgataaataagttcaataaggatatttgattgtttttctttattttataaagaatttaagttattctattttataaaaaaaggttggataatttatggatcaaattgataaaaaaatcgtgggactattacagtcaaatgcaaaaatttcaatgaaggatttagcggaagcggttcacttatcttccccgtcagtaactgagcgagtacgaaagttagaggaacaacaaattattgaaggttaccatgcacatgtttctctaaaaaaaataaatcgtccaatttctgcacttatactgtttaaatcaacaaattgtaaatcattatctaacttttgctacaatcatccagatgtacttgagtgttacagagtagcaggagaaattagctatattgtcaaaatagcaacacattctgtagaaagtttagaacaatttattgatgattcaatgcaatatggtacgccatcaacgaatattgtgttatcttcttatgaaaaaaagataattactccttttattagtgaagaataaaaatacgggcataatcaattaactattgcttatgcagaaggataatttttgtatgttatattaaaaaataaagacgttatatttttttaaaaggagtgtaattacaatggatttttctaataaattagtgatcataacaggggctggaaatggaatcgggagaggaattgctttacattatgcagaggggccaatgttattttagcagatatagacgaaaaagcaggtgcaaaaacagttactaagatgaaagaacagggtaaagaagcacttttcgtacaaacagatggtaggctggaaacagattatttattcgtttaagggaggtggttaatcaaacatacggccagatagatattttaattaataatgcaggaaaagagttattcaagtctccttacgatatttcgctagaagaatgggacgatgtaattagcacaaacctaagaagcgttttcttgggttcacgggaagcagcaaaggatatggcgtataacaaagaagggggatctatcgtgaatattgcctctacaagggcgattatgtctgagccaaattcagaatcttatgctgccacaaaaggtgggatcgttgctattacacacgcgctcgcagcctcatttagcgaagctaggattaccgtgaatgctatttccccaggttggattgaaacaggagattattcaaaattaagtaaaattgatcatgaacagcacctatcaaagcgtgtaggaacaccagatgatattgcacgagcctgtctgtatttaacagccagcgaaaatgattttgttacaggtataaaccttgtcgtagacggtggaatgacgaggaaaatgatgtatgaggaataggcggtaatcaatcaagaaatacagattcgctatcaataaagcctactttatccaaggtgatttaccgaatcatcatgtgaatttgaaatacaattgaactgtttataaaaaagatgaaccggaatttcctatctctaataaagaagggatttccgtttttctttcggatgaaacatgtgaaaatgaataaaaaccatgaagtactcaatgcaaggacaccagctacactaagagcgttagttagataaaaaatagaatatatcattatagatagtaagagatattagtatcactgaacgggctgttaatagctattgaaaagcataatttaatcaatctcaattacatcacaaaacttaaatatcctttgattatgaaaagcatcggtacaagtaatcgcctcatttaatgaatttctattagaaactgttctgtattctttataaacctacgttaaaatattcagatgaaccttttattaactcataacccctcctcaaaaaatagtaaaaactacacttgtgaaatcaatattttctgtttgcactttatataaatcgatatgtctccaccttaatttttgttttttgtaatccccactaattcttttctcaaatcccccaaaatggatttgagaaattagggaactataatgtcgtattgaaacatattaagggggacaaaaggtgaacaaggaaatgaattatggaagtgattacaagtttattccagcaacttcaattgaaagtggtcacggcatcgaagtattacctgatttattttgctacacgattcaaatcgtcaacatatgttttgttgggaatccgcataccgatgattttgttttagttgacgctggaatgcctaaatgtgcaaatgaaattatctctgttactgaggagcgatttggtacaaatagccgtccaaaagcaattattttaactcatgggcattttgatcatgttggaggaataattgaactcattaaatattgggatgttccagtctatgcccatcaaatggagataccgtttttgactggacaacaaagctatcctgaaccagatccaacagttgaaggtggtatggtagcgaaaatgtctcccctgttccctaatgaaccgattgatttaggaaatagcgtaaaagcactacctatcgatggaactgttccccatatgccagagtttagatggattcatacaccagggcatactcctgggcatatttcattattccgagagaaagaccgaactttaattgctggggacgcttttgttacagtgaaacaggagtatctgtataaagtaataactcaagaacaggaaataagcggtcctcctcgttatttaacaacagactggaaagccgctaaagaatcagtcattaaattagaagaattaaagcctctagtcgctattactggacatgggataccaatgtcaggtgaattgctatcaacgaacctcaaaacactggttcaagaatttgataaaattgctgtacctgattacggaaaatatatagataaaaagatgcattaaatgcggaaatactttgtttattttcatattaatgaatcaaaatataatgcaaaatcaaaacaccaacgaatattaagtttaatatgaaaaaacactgtacttaggcaacatctctattataagaatggaactaccctttatgaataaagctcgatattccgcaaatactatccatagtataagcctgcttcttacccaggttgtacttcttaccattaaggggtgattaaaacgggttacgctatataaaagcataatccgtttttaatgaaatattgtattccatatacgtttaaacaatggaggaaaatgatgaaacatattgttgccttattaattaaatacacagcgataactgcagtattgctaatcatgctcagtatctttcaaggcatttcaattcctagagtattattaatttctctttttcttacgggagctgcctatttaatcggagacctcttcattttacctaaatacggaaatatgattgctacaatggcagatttcggcttaagctttttcggaacttggttactaacatccttgtttactaatttagatgctactcgtaacattggactttcttcatttatagccgctttaattattggtggaacagaagttttcttccatatttatatgaagaggctagtgctacgtaacgacgatgaattaaaaaatcgcaatcatattcaccatgataaatatgctatggagatgtcagaggaatatatggattcttccacagtaaataaatccaatcttgaggatacatctaaaaaataaaaaagtggccaacgccactttttatttttgtttattaagcttgatcggaatttcttacatgtaatggaggtggaactacccatccttttttcttacttaaacgtagcaacgttacacctgcctgcgcttttttcatatgaaattggccaaatagcatccctacatcttctcgaagacattttcccatcacctgactacatgtcacaagtccagctgctaatcctgcagaaacagcagcagcaatttcaacatcattaatacgtgctcccggaggaatgtcttcgatagatgcaactggtcgttctggaggagcaggcggtaaagcgaccccattaatctttaaaagagcttttaattcttctatttccgaattcatatcattttcaattaagccttctaaaaacttcttcaagtcttcatcacctgtgtgattcataaatacttgatgacttgcaattgcaccctgtgcagcaagaagatagctccaaatatcaaatacttcaccgtaatgtaacggttcattttgaggatttccacttaatatacccatttttaaattcctacctttcgaaaatatcataataaatattgatttcaatattgaaatcaaatttttaagtatgctttttcctgcaaaagattttctactatgcatggaaaacacctttccaacaccgcgtgtttattgtttaggaaagtagtttacaaattaaatactcaaagattatgaaagaagattatcaataatctttgagtgaaaatccatttactataaggttttttatttttatacatatacaaaagaaattgatttacatattcgctatattttacactaattcacttagcgattagctctaccaccaagttgttgttcagccattgctactaaacgttttgtaatttcaccaccaacagatccgtttgcacgaactgttgtatctgcaccaagtttgtacaccaaactcttgtgcaatttaatatttcatttgatcaagagcttgttcagcacctcgaactaacaattcattacgacttccactattattgtttgccatcttatttcacctacgatgtttttaatatgctacaaattatgaaataataattatcctttttatggaaattagattatgaataaaaattgatttttttcttaaagtagggcaaaacatataagaaagaataactgatataacatactttcataacaacactatgtatacttcctaattcccttcagtaaataaaagaaagatttctatttcaccaagagattaaataaaattatgttttgagacataatccaaaaggagatatgagatgaaagctgtaacctatcaaggaccaaatcaagtacaagttaaacaagttgatgatgcaaagttagagaaaaaagatgatattattgtaagaattacttcaaccgctatttgcggttctgatttacatttatatcaaggtaacatgcccttacctcaaggatacattatcggccatgaaccaatgggaatcgttgaagaagtcgggccagatgtcactaaagtgaaaaaaggcgatcgtgttgtcatccccttcaacgtttcttgtggacattgtttctattgccaacatgaaatggaaagtcaatgtgataactcaaatcctcattacgattctggtggatactttggttatacggagaaatttggtaatcatccaggcggacaagcagaatatttaaaagttccatttggcaattttactccatttgttataccggaatcatgcgagcttgaagatgaatccctactatttttatcagatgttttacctacagcctattggagtgtaataaacgcaggcgtaaagccaggtgatactgttatcgtccttggttgtggacctgttggattaatgacacaaaaatttgcttggatgcaaggtgctaaacgtgtaattgcagtggattacttagattatcggatgaattatgcaaaaaagattaacaatgttgaggtatttgagtttacaaaattccccgatatgggagaacatttaaaggaaattacacatggtggtgccgatgtagttattgattgtgtggggatggatggaaaaaaatcgcctttagaatttctggaacaaaaattgaaattacaaggcggaactctcggccctattcaaatagctacgaaagccgtaagaaaatatggaacggttcaaatgaccggcgtttatggtggcaattataatgcatttccactcggggcattttgggttagaaatattaatcttaaaatgggacaagcacctgtcattcattttatgccggaactatttgaaaaaataataaataaagaatttgatccaaaagagattattacacacaaaatcccccttgaagaagcgagctacggttatcaaatttttaataatcgtgaagacgactgtataaaagtcattctgaaaccttgaagctacaattcattattcttaataaaaagataagattacatttcgtaatcttatcttttttattaaatgctaagtatctatcccccattttcatctcacatctaaaatagttatttccaaaaactttgcattttgaggtagtaatttaaaagaggtgtacttcatggttttattataaagaagaactgattaatattatcaaaccggacaaaccgctacaggtataaaaactattaacaaagcatcttaatgtttatgaaattctttgttaatagtttctcttctccctaatctcctgcgagactatatttttcattaaaattacaagtaaaaatttgaaatgttttcaagcataattacaatattaaaaacatcctttcttttggttgtaaagaaaggatgtttttataacaggctttttggaaggttttaatttaatcctaattatattttttataaattctaaaagtacattctttatttttggtataacatacagaaattattttttgaacagtagacagctgcagaagctaagttaaagtgtcgattaattccctccatgcttaataaaatccctgttatgatttctaaaatgactacacagttgagtaagagccgtagtagagattttttgatttaaccataagttcctatgatacttacattttcgtttcattccaccagtttctatagttaattgattaagtgtatcggggatataactcttcgacatatacagacaatcttgttttggaagtattacatgatttgtatgctattgtaacaagacttgtatcgtttctcgcttttccatgtcttattgcgtttgtcatttcctcttgtaaacaacgatagaaagttctattcagtttttgtttaatagcattacgttttatatggtttcttaaaaaatttcagtgaaaaaatatattaattttgaagtgtacaaatagggagagtgacttcaactgtagttcccttattcacttcactctcaataaatacatttccctgatgtgtttcaatgattttataacagatcattaaccctaagccaatcccctcttctttaatactataaaaaggttctccgaagtatggtatacgttcttttggaatgccacacccttgatcgataaaacgaatacttaattgattattatcaagtatatttaattgaatgagaatttctcctcccatcggcatagattcaattgcattttttaatatattaacaaatacttgctttaattgatttccttcacatgaaatcaatggaataccagggttaagatcgattttaatttttatattattcatcattgcttgaggttgtagtagcattaaa

SEQ ID NO: 1193 - DNA, 5453 bp, Bacillus thuringiensis
gtctttatagtgtaattgtcgctattatccttgcaatatttgtttataaaatgccagcaacagtagctgtagcatctgccggattcggtgttttatctggattttatccaatttgtactatcgttatcgccgcaattttcctttacaaattaactgttaaaacagagcaattcaatattattcgcgatagtatttcaagcattacaaatgatcaacgtttacaagtattattaatcgcttattctttcggtgctttcttagaaggcgcagctggtctaggagttccagttgctattacagctgcactacttgtaggtatgggctttaatccattaaaagcagcaggtatttgtttagtagctaatattgctggtggtgctatgggtgctatgggtattccagttacagtaccagcacaattaactcaacttgacgcattaactattggtcgtcaaactgttcttattttacctttcattagtgttatcttacctttcttacttgtttcaatggtcgatggcattaaaggtattaaagaaacttggcaaggcattctatgaagcggtgtatctttcgctattactcaattcgctgtaacttacttcttaggcgcagaacttactaatattttcgcagccgttgtaagtatgatctctcttgcattattcttacgtgtttggcaaccaaaatcttctactaaagaagaaaaacaagaaactaaagtatcacatacattcaatcaaattttatatgcttggtctccattcgtattcttaactgcatttgtaacaatctttaacttaaaaccgattaaagctttatttgctccagatggtgcgttagcaaacttagtatttaacattcagttccctggtcttcataatgctgttatgaaaactacaccaattacaaaagctgatacacctttcgcagctgttttcaaatttgatgtattctcttctacaactactgcgattgtactagcaattatcgtttcacttatcgtttaccgcgtaaaaggtaaaatggttaaagaattaatgattgaaacaatgaaagaattaaaagctccagtatatacaatttgtagcgttatcgcgttagcttacgtagagaactactctggtatgtcatctacacttggacttgcattctcttctactggtaatgcattcccaattctttctccaatcttaggatggattggcgtattcattacaggttcagtagtttcaagtggttctttattcgcaccacttcaagcagtaacagcagaccagttaaacatcgtcccttctacactcgttgccttaaacgtagtaggtggtacaatggcaaaaatggtttcaccacaatctgtagcagttgcttgtgccgcagttggactagttggtaaagaatctgctctatttaaaacagcaatgaaatacagtttaatcttcttagctgttattagcttacttcaattaaacgctgtatttaatatcttttaaaaataaaacaccgatccaaatggatcggtgtttttcacattacatttctttattttttaataaagaagctccagcaatttcagggtgagtcatttcgaatggatctaaaataatatccaattcctcttctgtcagtacaccatgctctaaacataactccctaacagattttcctgtttcaatcgcttcacgtgcaatacgagatgctgcttcataaccaatatgaggattaactgctgtaataattccaacacttttctcaacatattgcttcagcaattcttcatttgctgtaattccttcaatacaatattcacgaaatacacggaatccattattcataatactaatagattgaattaaattaaatacaagcacaggctccattacgtttaactctaattgtcccgcttctgatgctaggcaaattgtatgatcatttccaattacttggaatgcgacttggttaatcacttctgccataactggatttactttacctggcataatcgatgaacctggctgacgtgctggcaattgaatttcagccaacccaacacgtggcccagacgccataatacgaagatcgtttgcaattttagacatgttcatcatacatactttaagtgctgcagatacttctgtgtatgcatctgtattttgcgttgcatcaactaaatgctctgcaccaacaagtgggaacccactaaacgttcttaaatgttttaccacctgttcaatatacgtaggatttgcatttaatcctgtaccaacagctgtcgctcccatattcacttcatataaatgttgacgggactgtttaattctttttatatcgcgcgcaagcactcggctatacgcttcaaattcttgtccaaggcgaattggaactgcatcttgtaaatgtgtgcgtcccattttaataacgtgatcaaactcttttgcttttttaagaaaagcagaatgaagttcctccattgtaataagaagcttttctaacatcataagagttgcaatatgaattcctgtcggaaacgcatcgttcgttgattgggccatgttcacatgagtgtttgggctaattttcgcatacgcccctttttcatatcccatacgttctaacgctctattcgcaattacttcatttgtattcatattaatagaagttccggctccgccttgaatagggtctacgataaattgatcatgaaactttccatcaacaatttcttgcgctgcttctgcaatttcatgtccaatgtctttagctaagtaaccagtatctatattcgcaagcgccgccgcttttttcacaattgccattgctgtaatgagtgatggatgaatgcgatatcctgtaattgggaagttttctacggcacgtaatgtttgtacaccataataagctgcacttggtacttctttttcacctaaaaaatctttttctatacgtatatccttcgttgctatcatttttatcacctatactttttcattctaaatccttatccaaaaaatccgccctctaaaaacacgagtatcattcagaagaatttttcagtatccaccttcactatatagtaccttttttgaaagcgcaaacatttatttttctgtatatcctttttattaaagtttatagaaaatcattctcctactttccttatttccactcgtttaatttgatgcatatccttttcaaggactttaaaataaaaaccgtgtttctcaataatatctccttcagcaacgatttgtttttgtaccataatccagccaccaattgtatctacatcatcagcaattaaatgtatgccaagcaaatcatttacttcactaataagcacttttccctctacgattttatagccttcacttacatgctctataggtggattctcatcttcatcgtattcatctcgaatttctccaacaatttcttctaaaatatcttctagtgtaacaatccctgctgtaccaccatattcatcatacaatacagctaatggaatgtgttttctttgcatttgtaatagtaaatcatgaattggaatattttctagcacttcaataactggccttgtatatggcataatcgagcactcctcgtcccgactaccatccatataacgaataaataaatcttttacattaaccatcccaataatttcatctttatcttcaccaaatacaggatatctcgtgtacttttcttgcgcgattactttaatatgtgtttcaaatggttcgtcctcatataagcctacaacttccgtacgaggtaccataatttcttttgctactctattatcaaattcaaaaatattatttacatatttaaattccctttggttaatctctccgctctcatagctctcagataagattaaccttaattcttcttctgaatgagctacttcatgttcagaagctggatttaatccaaatagaccagttacaaccctcgctgaaccattcaaagcccaaataaacggatacataactcggtaaaaataaataagtggcttcgataacaataagctaacttgttctgctttttgtatagcaaatgtctttggagcaagttccccaatgacaacatgtaaaaatgtaattactgcaaaggcaataataaatgaaactgtactggaaattgcaggtgagaattgcaattttaaaaacaacggctcgagtaaatgtttaatggttggttcccctaaccacccgagccctaaagcagtaattgtaatacctagctgacaggccgataaatattcatctaaatttgtagttacctttttagcggccagtgcacctcgtcttttttcgctaacgagttgatcaatacgactgctacgtaccttaataattgcaaattcaacagccacaaaaaatgctgttaacccaataagaatgactaccatcaataattttaaaatatccacatatgctctttagctttcttagctaaagttacacctccttttaaaaagaagtttcactttagtttcttcaattattggaaagcaactctatataaaatccaccaattttcaaacctcatacaattctaaaggtaaaccatcagggtcttggaaaaagacgaatttcttccccgttatttcatcaatacggatcggttcggtctcaacaccacattgatttaaatgcttcacagcttcttctatatttgtaacagcaaatgctaaatgtctaagaccggctgcttctggaaaacttttgcgctcaggcggatttggaaatgaaaataattcgatttgatactcttctcctacacataaatctaatttataagaatctcgttcctttctatatacttcattcatttctttaaaccctaatattctagtataaaaatcctttgacgtctcataattcgaacaaataattgcaacgtgatgcactctacatatattcatactctctctattcctttctttaccaaagatgcatattctcccttgaaatgaaaaacatatatagcagaatatctcttttagggggcttaccacatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggccatttttctttagtagggtaaacaggcggattaaaacctttgttattatacgggtgtttctctgtatcgcttgatataacagggatagatgatcttgaatcatcccaattgctttatattcgcttagttctcttttgtgcttttgcaacagaagttggcgcatcttaaacatcgtggaagaacatataaaaatggcaatgagt

SEQ ID NO: 1194 - DNA, 5962 bp, Bacillus thuringiensis
  unsure (1)...(5962): unsure at all n locations
tctcctttagagaagtatcaagaagatattaaggatacttttatatgacttaaagacggcagttcaatctattaaatccttagctgaaaaagatggaacgtggaaaacaactcaaacaggattaaagggagaattaagtagagtaagtgggagagctaatagactagcaagtatagaacctcctaaggagtatgattacttcaaagttcaattaagagacgatgcaagagcaattaaacaaatggtagaccaagcatttatagctttaaatgaaaatgatactgaaacagccaagttaaacataggtgctatgatagattatgtagatataatgtcttcaacattgaatgaaatacaaaatgtacaaaatggagtttaaaggggtatgtgccaaagaagcaaaatattgagatcggcaaattactagactcagaatcaataacaagtattttagctaactttgtaggtggaaaaacaaaatcagttgattatgatgacgaaaaagataaagataaagatgtagttataattaataaacttacattagttgttttagtcacctaatgcttccaaaatgaggatgaataaaacatttcaatagaaaagctgccaaagaaactaaaacctttctctggcagcctttatttatatatattaaagttatttattttcctctttctgaacatatacataagcatctttctgctctttatgtacatccaccttcgaattctctgcaagctgacccgcatttagcaaagaaaaaataatgagcgcttctagtgacatttcgttttaccactcctttctagttgttatacatttatcataccgcttacatgtgatttccgtatgaactcgaaaaggagattacaacaaaatggttacaagcatatgaatgcacgttataataaccataaaatgggaggtggattctttttgacaataaatcaaatggttcaactcggaagttcatttatgctatttattacttccgcactgatgagttggtatcaggggagtaatttaatagataatcctgatgaatggaaatatagcgctaagtttacaaattactttaaaggcaccgtttcaaattaccaagatatttatcaaatcgatttctttatatatgcggcaaaattttatccaacagcatttatcgttatgctagttagtttactttatatgctcatattaattctttatattctatttaaaagaaaagatccggcgatttaaatccatacataaaaaccccgaatcatagacttttcagcctacaattcggggtactatttgtttacattcgtttctaattagtaacgaattaagaaatatttcttcttaccgcggcgaatgattgtgaatttaccttcgatgcggtcgttttctgttacaacgtagtctaatgcttgtgtacgctcaccgtttacgtagattgcgccattcgttacatcttcacgtgcttgacgttttgatggagagattttgctttctacaagtaagtcgattaatactgtatcttctgcagtacgttctacagatggtacgtctttgaatccttgctcgatttcgcttgcagtcagttctgctacagaaccgctgaataatgcagctgaaattttaatcgcttgctctaatgcttcttcaccatgaacaagttttgtcatttcagaacctaatgctttttgtgctgcacgtttttctggcgcttcagctacttgcttttcaagctcaagaatttcttcatgagataagaatgtgaagtattttaagtatttaacaacgtcgcggtcatctgtgttaatccagaattggtagaactcgtaaggagttgttttctctgggtctaaccaaattgcgccgccttcggttttaccaaacttcgtaccgtcagatttagtaactagtggaattgttaaaccgaatgctttcgcatcttcttctgatttacggattaattcaagaccagctgtaatgttaccccattggtcactaccaccgatttgtagacggcaattatgttgctgatataagtttaagaagtcgtatgattgtaaaatcatgtaactaaactcagtgaatgaaataccagtttctaaacgagatgctactgtatcttttgctaacatatagtttaaaccgaagtttttaccgatatcgcgtaagaatgaaattacatctaagctaccaagccagtcgtagttgttagccatcgttgctgggttgtccacgttttcaaactctaagaagtttgaaagttggtttttaatgctttctgtgtagtaagcaactgtatctttcgtatttaatgtacgttctgcttttttaccactcgggtcaccgatcataccagtaccaccgccaacaagtgcgattggttggtgaccagctaattggaaacgacgtaacattaatactggtaacatatgaccaatgtgtaagctatccgctgtcgggtcgaaaccacagtataatttaacgctttctttttctaataattgctcaaggccctcagcatctgtttgctgattaattagaccgcgaaattcaagatcttgtaaaatacccatatcctacatactctcctttaagttcattactggcgtgaaggttgaaaacataaaaaaatcgccccttcaaataagggacgattttgattatcgcgttaccaccctagttgcaggcaaaaaagcctaccaccttatttacataacggcttagcaccgtcttttcccttttgaataaaattcaatcgaaaaaagatgctctaggggcgtaattcgcgatcatctatgtgctgattttcaccggccatcagctctctaaaacagggaaatgatcactacttctccctttccacgctcaattattcatatacttttctttataccatcatttatataggcatgtcaaatagaggtcaggtttcccttcttgtcaatcctttacaacaccataaagagtatcgtaataagagaaagaattggaaccccaactaataacgatacatgaaacacaatcgataaatcattcccaatggtcgcctccacaggatctttcgctggggaaccaagaaacccgattaatcgatcgaatcgacttaccgtttttggaaagtctggtatttctacatgatcactatctaaatgttgctttaacttatattcactcttaaagggattttcgctcaatttcgtccacctccagcaattgtttcaatttctttatcccgttatgaagtctcgatttcaccgttccaatcggaatgtttaatatctctgcaatttctttttgctgcatgtcatgataataagaaaggattaggaccgctctttgctcttctggaactttcaaaattgcttctcttactgtgagccgatcttcgtgagaaaattctttttccggaatcggcactaaaaatggcaaaagcgtacgccacttttttctcctatttaatttattaatcataagacgataaccaatttgaaataaatacgtttttattttacctttttcaagttcatacatatgtttcttacgctctagcgtcaaaaacgtatcttgcacaagatcgatacttaattgttcatctcggttaaatcgatataaaaatgtgtatagcgctggtttgattaaaacatatagtctttctcccgcttgtttatctccactttgatacgcaagcatgagctcctcctcaatcccaatctgcgccatgatttttgatctcctttattccttttaacgttaatgaaatacgggaaattaaatatgcaatcgcaataaaaatccacaattgtgattgatttgtaaaaaattgcacatatgggttttgaatcgtaaatcccatagtaactaaagtatttaacgcttgcacacatatgcatgcatacaacgcaaggcagatagaaatagtgtcaaatacattccagcgaaaatacacttttgtttttgtaaaatcaattttatatccatttttccgtactatatgttttctatcaaatggaataatgattgaaaacataacacccattataactccagctgtaagcattgatactctatatccaattggtatcggtaagaaaagaccacaagaaaatacaactataattccaattacagcaaaagtaagaagtaatttattagacatataaaagcctccctcatctattctttcataaatgtatacagacgaggaaggcacttcgttcaaatattattttagtttttttataatctttgcaggattcccgccaactactacattattaggcacatctttcgttacgacagcaccagatgcgatcaccgcattgtctccaattgttacacctggattaataattgctcttccgccaatccatacgttatcgccaattgtaactggttttccgtattctgatccgcttatgcgctctaccggatcaagcgggtgcgttgctgtataaatgtgaacacctggagctaacatacagttcactccgattgttactggacatacatctaaaatggtacagtcaaagttcgcgtaaaaattttcacccacatgaatgttatagccgtaatcacatctgaaagaagattcaagatgaatgttatctccagtcgttccgaatagttcttttacgatttcgctacgctcttttaattgtacttctggcgtttcatttaattttctcgttaatatacgagcttgctccctctcttgaactaaaactggatcagctggtatgtacatttcacctagtatcatcttttctttttctgttttcatcatactatcccctttaacttatatatataagttcatgatatcataaaaaagaaaggcctgaacatttttcgttcagacctttctctcttaatcttccatcgttgataagtcacctgttggtaagtttaactcccacgcttttaatacgcggcgcataattttaccacttctcgttttcggtaatttatctctaaattcaatttgtcgtggcgctgcatgagctgctaggcctttctttacaaattgacgaatttcttcttttaattcatcagatggttcgtatcctgctcgaagtgcgataaatgctttaataatttcgccgcgcaccggatcaggaataccaattacaccagcttctgcaacagcagcgtgctcaattaatttactttctacttcaaacggaccaacgcgctcacctgacgtcataattacatcgtcaatacgcccttggaaccagaagtatccatcttcatccatataggcagagtcacctgatacgtaccaatctcccggcatgaaataagattcatatttttgctcgttattccagatcccacgcatcatagatggccaacctttcgcaattgctaagttacccattgtgtaaggaggcacttcatttccttcattatcaacaatcgctgctttcacacctggaattggtttacccattgagcctggacggatttccatacaagggtagttacaaataacttgtccacctgtttctgtcatccaccacgtatcatgaatacgaagtccaaatgcgttcataccccagcgaattacttctggatttaacggctcaccaacgcttaatacgtggcgcacttgtgataagtcatattttttaattgcgtcttgtccagctcccattaacatacggaatgctgttggtgcgctgtaccaaaccgtcacaccgtaatcttgcagtgcttcataccaagcttctggactaaagcgtccacctaaaataacgtttgacgctccaactaaccacggtgcgaaaataccgtaagctgtttccagttacccagcccgggtcagcagtacaccaatatacatcgtcttcttttaaatctaatacccacttcgccgtttgatagtgctgaacattgcgtttngcgcatgaagcacaccttttgcttaccaagagaaccagacgtgtaatgtagaata

SEQ ID NO: 1195 - DNA, 4794 bp, Bacillus thuringiensis
  unsure (1)...(4794): unsure at all n locations
tataaaaaaccgccgataagaataaaaaacagtgcaatataaaacaaaatgttgacaaagttcaacaaaaattgagatgaaatgaggaatgcgccaatactagaagcaatcatcgctataaaaattagtatacaagtatgaaaaaaaactttattcaaaatattcccctccgtcaaaatattactagaattattatactataaaagcctataataagtactaggattaattttttgaaaattatacgcaattaaaggtctgattttaagatgatggtagcaatgttaatgtatccctttacgaaaaatttaaaatataaatattttattaaaaattttaacaaaaaaacaaaaaactatattcacaattgttatattatatgtataatgaaaattgtagaaacttggagattattctttcaattctactttttaacaagtgagggtacaggaagtgcaattaggggaggcaacacaacatgaagaaaaagataccgttattacttgcatcaactttaactgcaagtatgttgcttagcgcgtgtagctaccaaaaagatgacgcaaaagcaaaagggaaagagaacgctacgagtagtagtaacggaaaacagattcttaatttaacagagttatctgaaattccgtcaatggatgcatcattagcatctgattcttcatcttctacagcattaaataatacgatggaaggtttatatcgtattggcaaagaccaaaagagaatgcctggagttgcagaagatgtcgaaaagctagatgatgggaagaaatacatatttaaattaagaagagatgcgaaatggtcgaatggggaacctgtaacagctaaagactttgtgtattcatggaaaagagcagtaaatccagatacaaaagcaacgtattcatacattatgttcgatattaaaaatgcagagaaaattcataaaaaagaattacctgctgaccaattaggtgtaaaagcgattgatgattatacattagaagtagaattagacaatcccgttccttactttatcgatttaacagtttatccagtattttacccactaaatgaaaactttgtaaaagcacaaggtgataaatttggtttagaggcaaatacaacattatataacggtccattcgttatgagtgattggaaacatgaacaaagtttccaattcaagaagaatccttcatattgggataataaaacggttaaaatcgaagaaatcaactttaatattgtaaaaaatacagcaactgatgtaaatttatatgagacaaacgcgattgatcgggcggctttaacgtctgaatttgttgataagtttagaaaaagcccagagttccaaacaagaaaagaggcaggggttgcttacttaagatttaatcaaagtaatcagtacttaagtaataaaaacttaagaaaagcaatttcaatgtcctttgaccgtgataacattgcaaaagttattttaaataacggcgcaattggagcttacggatttgttggaaaagatttcgctgaaggtccaaataaaaaagatttccgagctgaaaatggaaagctagttgaaacaaatccaaaagaagcaaaaaagctttgggaaacagcgaagaaagagcttggaactgataaaatcgaactagaattcttaaactttgataatgaagatgctaaaaaagttggggaattcttaaaaggtgagatggaaaagaacttaccaggtttatcaattaaaattaaacagcaaccattcgcacaaaaaaataaattagaagattctcagcaatatgatattgcgtttggtatttggggaccagatttcccagatccaatctcatatttagatatgtttgttacgaatggttctcaaaataaaacagggtattctaatcagaaatatgatgagttaatcctaaaagctaaaacagatacaaaagatttacaagctcgctgggacaaccttctagaagtagagaagatgttaattaaagaggatgcagttatcactccaatcttccaaaaaggttcagcgtatgtagtaaaaggtgccgtaaaagatattatcccaattaactatggtggtaaattaacttacaaatgggcatctgttgaacaaaaataatcttttttttccatcgtttacaagggtatatgcctatgatgggcatatgctcttattttaaaaaaataaaagtaagaatattttaaactatcttattgcttttgagaaaaacggggaggtgcttgactatgggacgttatgtattaaaacgtttcgtgtacatggctttgacattatttttaattactacaatgactttctttttgatgaaattacttccgggttctccgcttaaaaaccaggagaagctatcaccggcacaaaaagaaatcattcttgaaaaatacggattgaatgatccggtaccagttcaatatgcacgttacttaggtaacttagcaaaaggtgatttaggggtatcattccaatatgataaccgcccggtaacagacatgattgtggatcgtattggaccatcagcccaattaggtttacaagcgattatattaggaacatttatcggtttaattttaggtattgttgccgcacttcgtaataatacgtgggtagattatagtgcaacagttatttcggtactcggaatgtcggtaccatcattcgtattcgccgcattactgcaatatttcgtaggggtaaaactaggctggttcccagtagcattctggaaaggaccagagtttactgtaatgcctacaattgcattatcgatgggagttatcgcgacaatcgcacgtttctctcgtgcagaattaattgaagttatgcaagccgattacattttaacagcgaaagcgaaaggaattagccaaggcgttatcattgtcaaacatgcacttcgtaacgcgttaattccagttgtaacaattttaggaccaatggttgcggcattaattacaggaacacttgttatcgagcaaatttatgctgtaccaggacttggggaacaattcgttaaatcgattactttaaatgactatacagttattatgggaactacgattttctatagtgcgatcttcattttagttattttcattgtcgatattttatacggaattattgatcctcgtattcgtttagcgggagggaaaaaatgatgaaagatgtacaaaaattatctccagatttatttcaacaagccaatcaaaataatgttgataatgaagtcattgcccgtccaagcttaacgttttggcaagatgtaagaagacgtttattccaacataaaggtgcgatgcttggccttgtattgttagttatcattgcgctattagcgatttttggaccgatggtaagtaaacactcgtataaagagcaagatttaggtcgtgcgaaattaccaccaaaaattccagttattgaaaatgttcattggttaccatttgacggtacagatcaatatggtgttgaccaatatgaaaaacgtgatattaaagagtacttctggtttggtacagatgaccttggccgtgacttatggacaagaacatgggaaggtacacgcgtatcattatatatcgctcttttagcggcagcaattgacttagtaattggggttgcatacggaggtatttcagcattctacggcggtagagtagataacattatgcaacgtattatggagattattaacggtattccatacttaatcatcgttattttaatggtaatcattatgggatctggtatttggtcaattacacttgcgatggcgattacaggttggatagggatgtcgcgtattgttcgtggacaaatcttaaagttaaaaaaccaagaatatgtattagcatctcgtacattaggtgcaacaaatacacaattaattgtgaaacatttaattccaaacgtaatgggacctattatcgtaatgacgatgtttacaattccatcagcggtgtttggtgaagcgttcttaagtttcatcggtttaggaattcagccaccatttgcgtcactaggttctcttgtaaatgatggttataaatctattcaaacgtatccgcatatgatgttcatccctgcggttgtcatcagtatattaattttagcgtttaacttaatggcagacggattacgcgacgcgttagatccaaaaatgcgtaagtaaaagaggggagaggcaaagatgaaaacattgttagaggtaaaagatttacaagtctcctttgatacacatgcaggtgaagtacaagctgtacgcggcgttacttttgatttgaaaaaaggagaaacattggcgattgtaggagaatctggttcagggaaatcagttacttctaaagcgttaatgggattaattccgaatcctcctggacgcattaaaaatggtgaaatcgtatttgaaggtcgtgacttaacaaaattaacagaaaaagaaatgcagcaagtacgcggtaaagatattgcgatgattttccaagatccaatgacatcattaaacccaacgatgacaattggaaatcaaattatggaaggtctaattaaacaccaagggatgagtaaagcagatgcacgtaaagttgctttagagttaattgaccttgtaggtattccaaatccagaagctcgtttaaaacaatatcctcaccaattctcaggtggtatgagacagcgtgtagttattgcgatggcgttagcttgtaacccgaaattaatcatcgccgatgagccgacancagcgctagacaataaaattc

SEQ ID NO: 1196 - DNA, 10637 bp, Bacillus thuringiensis
tcttctactatctctatacttttagtaaccactttaattaaaagcacattcatgtattcacactcttattaattctgatttgcgaaatatttatacaagctttatgatgcaattcctgtttcactattttcagtaattttttcactttttctaaacaaaaataaagctcctatatatagtaacgcagtaaaactacctataagtataaaattgtgagatattgcaaataacattccagctattgccgcaccaatcatttgaccaatgtacatagaagcatttgcaagcgccgctcctgttcctcttgctacactagacatgttttgtaagtgcctcatcattaatacaaacaaaattcctgtcacaaaaaataaagcaaagaacaataactccaccaatacaatgttctttacatgaggaagtaatacatatagcactgctgtaaatataattccaccatagaaagaaaggttataaccaattttatttacgattctaggaccaaaaatattaccaattaaatttcctaatcctaatacgagcatagctgtacctacttcatgaacttgtaagccaaattgaatggaaagccatacaccaaaaaatgaaaatgcagcaaaatttccggtttgaaaaacaaagtatgcaaaataagaaagtgaaacctttgaatctgtaagtaattgtttataacgctgtaaaatcgcttttttatttccacctatatgaaccgactgtatttctggtaatacaacataaataagaatgacaagtagtgctgataatataccaatgaaatagaatggaattgtataatgtatcgttgctaaataagctcccagtggcagccctaaaatttgagagattgataaccctgctgttgcaacaccaattgctttcacaatttgcttcttctctataagaagcggaatagatgcccacacttgtggagatacaaaagctgcacttacacctgctaaaaatctaaatgttagcatccataaaaaactcggtgcaattccacaaaaaaacgtacttattgcaaaaaaactcatacctagtaccattactttttttctgtttaatccatctgatataggaccagccacaagcgcaaatccagcataccctaaagcatacgaactcaccatccatcctgacaactcagttgaaacatgatacacctgttgcaatgtcggcaacagtggtgaaattaagaaagtatctgtaccgatcataaacattatcataaaaaatacagctagtactctgttcatttagaccttctccttatataaacagagggtactctccctctgtttaactaatcttctaaaatagattggatttctttcatgactctttcattcaatgcaacatctaccgctttcacactttctcttacctgctctgcccgctttccaccaggtataacagtatcaatcccttctttatttaataaccatgctaacgctaaatgagacacttcaatatcattttctttagctagcccttttaacttattcactttcttaaaattactcttatatgtattttcttcaaatagatttacattttgacgccaatcgacttcatttaatttaaaatcttctgtatattttccgcctaatattccaaaagcaagaggcccatatggaataaatgaaatacccgcttctatacaatacggcaacagttcttcctcagctgtacgttctaacatattgtatggagattgtacaacatctatatgaccatgttgattcgcctcttttaattgttctatgtttacgttcgatattccaattgaacgaattttcccttcttcttttaaatgagtaagctctccgattgaatctatgtaacttgtttcaggatttgtaaagtgtaaataatataaatcaatatattcagtctgtaatcttcttaagctattttccacagcattccttaaataacttggttcattgttaatataagtttctccatttaacaacggttgaattccaccttttgtagcaagtataaacttatgacgttttccctttaatacttctcctactaattcctccgatctacccgaaccatatgaatctgctgtttcaaaaaatgtaatcccttgctgaatagcttcttctactaatcgcgatccttcttcgtcattcacatcagcatataaattatgtccccctactgcatttgtacctaaacccaactttgaaatatttaatcctgccttttgcaattttatatacttcattttttctccccctatatttctattgttcgaatatattcgaacaatagaaatataccactttgtatgttatagtgcaaatatcttaacttatacaagtaggtgaaatatgcgtacactctatcatccaaatcgagaagaaattcaattttcttctgtcttatatgcacttagcgatcaaattcgtttacaaattgtaaatatgttactagagaaaaatgaacaatcttgtggtgctttaaacatccctgttgcaaaatcaactttatctcaccatttcaaagttttacgtgagtcaggtgttatgtacacgcgccttgaaggaacacaacgtttcatttcaattcgtgaagaagatttaaatgctagattcccaggtttattacaagttgtattacatgcgacagagccatattaaaaaaacatctcatattcatatgagatgtttttttaatatggctattcttttaataaatctattaatccattcccttcagatgtacgttcgtaccctaaaggtacagttcttttaatgagttgtgcatatatttccggctccgataactttcgaccgtattctttctcacactgtttaatgagcaaggcgagcgctccagcaacatgcggcgtcgccatggaagttccacttagcacagcatattttccttctggatacgtagataatatttcatcacctggcgctactagatcaatttcttgatttgaattactaaaacatgcaatcttccgctctaaattaacggcaccaacttcaattacctcggagtacgcacccggaaagtctagttcctctgtttcatcatcgcaatctccattatttccagcagcacatacaacgagaacatcctgctttaccgcattttgaattgcttcatgtaattctggaacatcttgcggaccaccaagtgacattgaaataattctcactttctcttgattcggccctctccaatttacagcataatgaattgcctcaataatttgctcataacttccagaaccatctcccgctaaaacttttaatactaacattttagcaagtggtgcaactcctaatacaccgacaccattttcagtcgcggcaatcgttcccgcaacatgagtaccatgtccgttattatcaagatacacatttggatcagcttcataatcttttgtgaaatttcttccgccgataatacgatcttttaaatctatatgattagtatcacaccctgtatctaatacggcaacgactacatcttgccccttcacactcttttcccatacttgcggagcgtgaatcagttgtacacctggtggaatttcatttacttgttctaccaccttatttacggtaaacggaatcaattgtatacctttttgtttattcactgtactactcatcgtaatccctcctgaaaatgtattattttcatttcagaccacttttgaatacgtgtaaatgtaacattcgttttattctttttgttttccttcttttcaaatatttctcaacatcatttactacctctataatacttctttattttccctatgatttgtaggaagtaacaacccgagtcgttcaactaataaccaaaataagaggaccaattaatggtcctcttacagtcttttaaaagaatgatatgtatttgaaaaataatataaattaagactaaacctcactcttgtttaaaaacttttctatttcttttactaaatattccgctccctctatgccaactgtaatatttccatttgctaatgtaatattctgccctgaaacatcacctgtgatttggcaagcattgtaaggttgatatttttgtaaaatgattttatctgcttctacaaaaatttcaagcggtgatttgatttgaattcccaatacatcgcgtaattctttagggataacaattcgtcctaattcgtctacttttcgaataactcctgtagctttcatatttctccccccttactctctattaattttttcacctcgctttttccattttatcactttttgacaatacttgcctctttttagaaaattttgtactcgagttaaaaaaacacatttaatgcatacgtaatctctctttcaattgttttacataacgggatcttataagtaagaagtatacaacttgaataactatgaaaatacttaatacaactgtattttctttaaacaatgagtactcaaacatttgccctaacgccgttaaggctactgctccatgtaatgttgcaacaccaattggaacgaagaataaaagcgccaatcgaattgtaactaccttcgataattccctacttgtcaatccaactttacgaatcatttcgaacaaacgaacatcatcctccaaatcggagaataaacggaagtaaaggaaacttcctgcgcaaacgaaaaatactataccaataaagaaacctacaaataaaatcggtcctgcaatttgtaaactttggttttgctcgtactcttccgcactaaacgttgaatattcttgatacggtttaatttgatgcgtaagctctttaccaatttcaatctcatctttcgttctttcagttttatacatataatcttttgtctctataaacccatcttgtaatgaatcatattgattattagagattacataaacatttcctcttaatattttccccaatgaagatgaagtaacttttttcacttttaaattttcattcatattaggtaaagtaatttcttttctttctttcatcgttggccctggtatattagctgacaaaaatacaacttctttatttgctacagtattaaatggttctcctgttaactttgcatatttcttatagtctgattcttttataaaaatggcgcttcttaacgactgttcctccgttttctttgtcgaaatattagtttttgaagctgctatactatgtttctttaatcctttgtcaatcatttgtatatgctgtgattcgttactattcccttgcttagaatggtaatgaaacgaaatcggtctctccattatccctttcgtcatggatgcgaagccaactaatgtccctattgcggaaaatgctacagtagaaataatggttacaataaagaacattcttgcgttatctctcatgcgatacgctaaatctgataacgtaataatattagtctgtgtccaataaaaacgtttactttttttacataatcgaataataaagacactcagctgcttgtacaacaaatacgtcccaataataactaccgttgtaacaggaatcatcataataaataccattgctccatgtgatagaagagctcctacatagccagcactaagcaatactactgctaatatggaagaaatgattgatgctttcggttcaggtttcgcctctgccgatcctctaaacaacttcataatcttatttttacgaatcattcctgcactaaacaatgatatgatcataaataaaataaaaaacataatactcgttacaacaattgctttcatcggtatgtaataggataaggagatatctagtttcaatatcatcggagcgacaaatagtaatacccctgaaaataacatacctgaaagaataccaaaaataattgcccctattccaatcataatattttcaaaaaagattagacgctttaattgatatttcgtcatacctaacatcattaaaatccctagttcacgctttctcgtttttaaaaacattcccatcgaatataaaataaagaagaatgtaaataagtaaataatagactgtgcaaaagacatacttacgaatacgtactgacctaattctcctgcacttaatgccggatgaaacgcaaaaaatgaatacacaaaaaaggccataattgcaaatgcactactcaaaaaataggctgagtatgtccgtctatttcgggttacattccgatatgctagttctctaatgttcatattacttctccgcccttctactatctatgtttttatattagtaaagtgcggaaataccttccatcgattcaaatgacaaaaaccttacatttttgaaaggtttaaaaaaattgcttatacgtagtactttatttataatgactacattcatattcatattcatacacacatcctattgtatattcgttaattttgcgaaataataaaggatagaagtatgtaccattatacatataaacttaattaccgctttaatatgaataggaggaaacataatgacattacaagaacagattatgaaagcattacatgttcagcctgtaattgatccaaaagttgaaattcgtaaacgagttgatttcttaaaggattatgtaaaaaaaacaggtgcaaaaggatttgtacttggtattagcggcggacaagactctacattagcaggacgcttagcacaacttgcagttgaagaaattcgtaacgaaggtggtaatgcaacgtttatcgccgtgcgtcttccttataaagtacaaaaagatgaagatgatgcacaattagcattacaattcattcaagcagatcaatctgttgcatttgatattgcttcaactgttgatgctttttcaaatcaatatgaaaacttattgggtgaatcattaacagatttcaataaaggtaacgtgaaagcacgtatccgtatggttactcaatatgcaattggtggacaaaaagggctacttgttatcggaacagatcacgctgcagaagctgtaacagggttctttacaaaattcggagatggtggtgcagatttattaccattaacgggattaacgaagcgccaaggacgtgcattattacaagagttaggtgcagacgagcgactttacttaaaaatgccaacagctgatttattagatgaaaaaccaggtcaagctgatgaaacagagttaggtattacttatgatcaattagatgattatttagaaggtaaagcagttccagctgacgttgcagagaaaattgaaaaacgtaacacagtgagtgagcataaaagacaagtaccagcgtcaatgtttgatgattggtggaaataaattaaacataaaaaagaagctaatcttcatttagcttcttttttatatgttaacgatatacccctactcttttctccaataaatcttgcaggcaatcttcatgttgtttacaaaataacggtggcatgtcgtctaacgggaaaaacttcaaatccagcgtttcatcaccatctacttttttgtcacctccaactattgagaatgaaaagaacatcacaattgactgagccttgtctccatttggatatgattgaaaatattttgtatacactccaataagctcatttatttctacatcatacccggtttcttctttgatttctcggattgcagtttccgcagctgattctcctatctccattgcaccacctggaaatccccaagcgttaaagtctcctcttttttgcagtaatacttctccttctttattaaatacacaaccaccggcaaagtttaagaaaacataatcatgtcctactttttcacgtaattcttttatataattggccattctctttccccttttcatacctcttctatcgctatttcttatctttttcaagcaattcaatgattcgatctagcttctggttcatattaatcacgtggtgtttctttgcagcactgctttgtaatactcttctaataaacaaagtaaatgatatgaaaaacaaaacgataagtccgattactaaacaagtatatatcaatgtaaaaatattactttcgaacaagttcattccacattcacatccttatccatttattctatcacacaattcttaatattcaaaagcaatcaattaataaaaaaagcaccttttacagatgctttttcccattgcttaatacgtaaatgtaattgtcgctaatgaataacccgccaatgcactgtaaggcgctacttgataagacacacgctttgcaccttttggccaatttatttcatttaatactttctttatatcttgcatcgttccatccatggactgcttatatcgcacttctactttttctggcttggctgcaaactgttgctgcaactttttcttaaattcattataattttctgctccgtattctgcagataagtattgtaaatttgtttcttttaacatctgctcatatacgacagtttttgagctaccagcttttattttatttgttaattcaccaaaataacttgtagttgccgctggatatttgctacgatcccattcatgatctttacttaactgttcgtcagacatattaaaatatgagtaagttacacgccctgctttatctggtactggatcatcaaatgtagtatctaggtgataccatttgttttcaatgttcactaaattccacgcgtgagcttgtccatttcctgtgcctgttacaatatgattttgaatacctgcctcttttaacaactcatacgttaataatgtatatccttggcaaacggcagaacgattcgctaatgcttcatatgctgtatacgcttgataagacgtatcataagacacatgcttaacaacgtaatcgtgaatagcttttactttctcatgctcatccatccctagttttacaattgatccaacaattgatttcgcctgagcttttacatattgagtttgttcttttgattcacggtattttacttgcagtgtaaacgtatagtcccctggcattcctttaatagaatatctagtagacgctacattatattttacatactcatcagcatctacaattttattaaactcaccatacaattgatccataatatttctagcatttctatcttttgttttatatgtgattgtaatattctcttctcgattatcaatctgtttttttaattcttttctgaaatcatctaataactttacatctgattgtgctgtcactgtagtcggatttgtagctgcataagatacagatgacgcttgtaagcctcccattactatagttgaacaaagtgcggcagctgtcacatacttacttgtctttcccatcttgtcactccttatattctataactatacgaaaaagtatcgtatagtttcagagtatacaatactttttcgtataggtcatatgagattatgcatattaactaattcacataaaaaggttgttctttttaaaagaacaaccttttttcattagcatgtttgtaatacgcagcatgtattttcaaaacgttgatttttcaaatcttcattactaatacagaaatatagcatccctagttctccccaaaccatattacaatttttatgatctgaatcaatttggaataaaagagtcatttgctgcgggtctactcccatatattctcccgtctcatataacacttcttcttgtacagagaatggctcaccaaacatttgatggttatcgtagttatccggaattagctcttcaagtaattgcaagaaacgatctgaatcagcctcatcttcaatgaaaagttctggtaatttgtatgtcagttcaaaagtaattgcacactggttatatttcgcttgtacttcatttcctcttcgtaattgctctacaggaacatcataataaagtacacccccagcctctgttagcttcacattttcttcaaaataattttcaatgcaaaagaaatacagcatccccgtcttaggaagattgtgatccataccaacgttttgtaaatcacttaagttaaattgcgcgataaattgtagtggatttcctttatgctttggatattcaaataaagctggtaaatcaggaactcctcccattttcgaactacctatcgcaacagtttcctgctgctttggcacaacttttatacaaggaaatacagtattaataagttcctctttcaagtgtgttagttcatatttatcaattaatacttcaatttttttattcataaattctccttacatttacatacttatttatatcatagtacaaagattatacttcattctttacaaaatcaacaagcctccaaaaaacgggcttatccttcgtacgcgaacaagtttaaaaaagcatactatacattgttcctacaaacacgatagttctttagttcttccagtacattttcccctcgttcatttttatttttaatataaggaggaattccacatgggttacggatatagttgccgcggttacggcggcagctgtggtggttgtggttaccgaggcttcgctttattaatcggtttattcatccttctaatcatcatcggagctagctgttggggcggctttgtaggctgctagtgaacttaaaaaccattgtgaaaaagcacgtacaaaacgtgctttttt

SEQ ID NO: 1197 - DNA, 8454 bp, Bacillus thuringiensis
aagaattaaatgaaacaggtgtaacttgtattagagatggaagatgtgaaacagtatatccatctgttttaccgatagaaagtatggtagcgcaaaatttagattatatatttattgctgtgaagcaatatcatatagatgacgtactaccgtttgtggaaggggcatcatcattaatctttttgcaaaacggaatgtcgcatcttcaaaagatgctgaacatagggagtaaaaatatagctgttggtattgtagaacatggtgcgaaaaaagagggagggcatatcgttcatcatactgggataggggtaacaaaatttggagtggtttgtggtcaatctatacattttaaaaaaatattcaattattttcctgttgcttattttccagttcaaatagaaacggattgggaagagattatgcataaaaaattagtagtaaatgtatgtatcaatccgttgacagcactattgggagttaagaatggtgaattaatcacgaatcgttttttttatcaaatgatggagcaagtgtttcaggaggcagcatttcttattagaggagaaaaagaaatggtatggcaaatggtacgaaatgtgtgtgaaggaacgtctcgtaatacatcttctatgctagcggatgtaagagcgagtagaaagacggaaattaatgcgattgttggatatgtattagaagaagctaagaaacagcaacgaccagttccgacacttcaatttttgttcgatgcaataaaaggtttagaaacaagagtataagtgttattctttgcttttacgtgaaacattgactacaatgtggattggtgagagaactggatacgaaaggaagaattatatggagataaaagaaatctctgttccgcaacaaggtattgtagcggactatatgaacggtaaaaaagagatacagtcatgttttgattatatgttaacagaagatgcttttaaacaacgtttacatgatttgcgtgaaagggagtttttccgccaagatttagtagcgcatttattagaatataatacaaaattacaagcgggagaatctacacttcaaaatgtaaaagcgcttggagatgaaaatacatatgttgttatagctggacaacaagcggggttattaactggaccgctttatacaattcataaagttatttcaattttacagcttgcaaaggaaaaggaagaaagtttaggagttaaagttgtccctgtcttctggattgcgggtgaagaccatgatatggatgagattaatcatacttttgtagcgaaaaataaaaagatgaaaaaaactattttttatgaccgtaatccgaaaaaggcaagtgcttctgagtctgaactttctgttgaagattgtagaaattggattgaagagatttttaaaacatacccagaaacaaattttacaaaagatgtattaaaatttgttgatgatgctttgaaaaaatcgaatacgtatgtagatttctttgctcatcttattacgaaaatctttgctaattctggtttaatccttgttgattcacatcatcctgaattaagaaagttagaaattccatttttcaagcgaattataagtaagtataaagaggtacaagagggccttcgtaatcagcaggaagtaattaaagaactaggatacaaaccgattattgaaacgaagtctcatgcagtgcatatattcatggaaatagataatgaacgagtattgcttgaagagcatcaaggtaagtttgttggaaaggatggggcgcattccttttcatacgaagagttgattgaagagatggagagaaatccggcacgttttagtaataatgttgtaacacgtcctcttatgcaagagtatgtatttcctacgctcgcatttattggaggtccaggggaattagcttattggagtgaattacagcaagtattccatactgtcggttttcaaatgccacctgtcgttcctcgtcttacaattacttatgtggagagagatatagcgacagatttattcgatctgcaattgagagaaattgatccgtttttaaatgatgtcgataaactgcgtgaaaactggttgtttaatcaaatagaggaaccgattgatgatcattttgaaaaggcgaaaaaagaaattgccgatattcatacatctttacagcaatttgtaaagaaaatagagccagggttaggtgcgtttgcagggaaaaacgaattgaaaattaatgaacaaattgaactgttggaaagaatgttgaaaagaaatgttgagaaaaagtatgaggttcagctaaataaaatccgccgtatacaattcgccctttgtccattaggtgcgccgcaagaacgtgtgtggaatgtatgttattatttaaatcagtttggtttggatttcgttgatcgtgtaatggaaaaccctttttcttgggacggaaaacatcatgttataaaactataaaatcttgctctttggagcaggattttatttttattccgttgaatttactgtgaagtgatttttttctgaattatcaatcaaaaaaatgttagatatggcaattgtgttggatacttaaatatatgacaaaatagcacaaaatgtaaacgtattattcgctttttcgacagttttttatttaaattcccgcaaaagatgataaaatttagtatataataaaagaaaatagcgatttgtatagtatgttgcctttgttggtaagttaaatgagtcgttctttcgtattatttcattctctaagcgtgaaatatgtgtttagaggaagggatacattcaacataattaattggaaaaagagtaggtgcaacaatgtttaaacacgtaacagtgcttttaaaggaaacagtagacggcttagatataaagccagatggtacatatgtagattgtacactggggggaggaggacatagttcttatttattatcccaattaactgaaggtggaaaattaatagcgtttgatcaagatgagatagcgattcaaaacgcgaaagaaaagttctcttcatacggtgaacagtttataacagtaaagagtaacttccgttatttagctgaaaaactgcaggaaataggtataacagaagtagatggtattttatttgatttaggtgtttcatccccacaattagatacaccagaacgaggctttagttatcatcatgatgcaccgctagatatgcggatggatcaagatgccccattaacagcgtatgatgttgtaaatagctggtcatatgaacaacttgtaaggattttcttccaatacggtgaagagaaattttcaaaacaaattgcaagaaaaattgaagcttatcgtgagaataaagctattgaaacgacaggagaattagtagagctaattaaagaaggtattccggctccagctcgtagaacgggtgggcatcctgctaagcgagtgtttcaggcaattcgtatagctgtaaatgatgaattaaaagtatttgaagaagcattggaatctgctattgagatggttaagccaggtggaagagttagtgttataacattccattcattagaagatcgtatttgtaaaacaacgtttaagcgaaatagtacaacgccacaattgccgccaggattaccgattattcctgatgaatttaagccgaaattaaagcttattacaagaaaaccgattttaccttctgatatagagctagaagaaaataatcgtgcgcgttctgcgaagttgagaatcgctgaaaaacgataaaagggagagagaggtatgactaatttagctgtaaagtacaaacaacaagcgcaagaagaggtgcaaattcaaacgcccccacagcagatggctaagccgaaggttaaagcgaaaattacaagaatcgaaaaactgttgtatgtagcgtttattggctttttattgtatgcctgtgtcgcgtttattggaaataaagcaggcctttatcaagttaatgtagaagcagcgacgatagaagaaaaaattgtacagcagcaaaaagaaaatcaagaattacaagctgaagtagagaagttaagtcgctatgaacgaatcgctgaagttgcaaaaaaacacgggctagaaattaatgcgaataatgtgaaaggcctcaaataaggcaataggtgtgaaggaacgatgaagaagaatatgactaaatttcataccaataagggagcaggttattttatgatatttttcctcctgctctttttgctgttattagcccgatttttttacatacaatcaacaggaacagttcataatcaggatttagatgcacttgctaaacaaaagcatagtaaaaaaggagttcttgaagcgaaccgaggaaccatttatgatcaaaacggtcatgtgttagcgcaagacgcaaactcttacaaaatggtagctgcactaaaaggtgctaactcagttgagaataaagaagatactgcaaagaaaattgcaggagtacttggaaaaggcgaagaggatattttagcttctttaaataaggaaggtagaagtcaagtcgaatttggaacgttaggcaaggatttgacgaaagaaaagaaggaacaaatagaagcgttgaagttgccgggaatatcttttattacagaaaatgcaagggtgtatccaaacggtgattttgcatcttacgttataggtcatgcaaaaccaaatgagaatggaacctcggtaggtcaatttggcatagagaaaagcttggataaatacttaagtgcctcgaacggagaagtagcatatacaggtgatcgtaaaggtgtgtcccttgatgggggaaaagttaatgtaaaggcacctaaaaatggagataacgcttatttaacaatcgatcaacgtgtccaaagttatttagaagacgcgatgaaagcagcaagtaagcaatatgagccagaaagtttaatagggattgttgcagatccgaaaactgggaaaatattagcgatgtctactaaacctagttatgaccctaatgatcgtcaaattaaatatttctttaatgacgcaattgccaatgcatttgaacctggatcaacaatgaaaattttcacgttagcggcagctattaatgaaggtgtgtacaaaggccaagattattatcagtccgggacatatcaagtcggaaataggaaaataaaagatcataacggtggtgctggttggggctctatcacgtttgatgaaggggtagagcgttcttcaaacgtagcgtttgcaattttaggagatcaaaaacttggtccagaacgtttccgaaaatatattcatagttttggattagatgaaaaaacgaacattgatttatcaggtgaaggatcgaatacaattttatttgatcagcaaatacaacaagtgacaacagcttttggacaaggttccactgtaacaccaattcagcttgtacaagctgcaacggccattgcaaatgatgggaaaatgatgaaaccttatgcaattgataaaattgtagatccgataacagacaaagtaaaattagaacataagccagaagaagtaggaaaacctgttacaaaggaaacagcagcgcaagtaagacaattattagaacgtgttgttacatctccgaaaggtacagggacagcttataaaattgatggatattcagttggtggtaaaacaggtacagcgcaaattccggatggaaaaggcggctatatgacagggagacagaattatatattctcattcttaggtatggcaccaatggacgatccacaacttgttgtgtatgtagctgttaaacagcctaaattaaaagatgatgagaacggtgcacaaccgttagctgatatttttaaatatgtaacaaaaaatagtttagagtatttaaagattaagccaaatgaagttaaagatccgaaaaaacatctgaaagaacaacaaactactgttccggatgtaaatggtaaaacgatggctgaagcggggaaagcgattgataaagcaaaacttcgtccaatcgtactaggtgaagggaaagtacagcaacaagtaccaaaagcgactgaacaaacattaaaaggcgaccgagtcttcttggtaggagataagcctacaatgccaaatatacaaggatgggcactgcgtgatgttatgaatttagcgaagacattacagcttaacttgaaaccttctggtacaggatacgtaacagaacaaagtgtggcggaaggaacattattacaacctggtacagaattaggtgtcacactcgtaccgccactcgaaccacagcaagaagcagaaaagccgtaatggtaaaagagaataagttctaattaaataagtacaagcatatattggaacaagctaggcgtaagggaggcttgttccaatatgcgtgtatcaaatgtaacagttagaaaacgacttatttttatacttatatcaggtatacttattttcacgattatcgatattcgtcttggatatgtgcaattttttcttgggaatatgttaacggatcgtgcgaaagattcatggagtcgtaatattacttttgaacccgaacgtgggaaaattttagaccgaaatggtgtggaacttgccacgaataaaagtgctccaactgtctttgttgtaccgaggcaaattgaaaaaccagcggagactgcagagaagttagctgcagtattaggtgtggaaaaagatgagatttataaaaggattacaaaaaaagaatcgattgtaaggttagataaaggcggaaggaaaatatcacatgacaaagcgaaagaagtacgaggattaagtctgaagggcgtgtatatcgcagaggattctatccggtactatccgtttggaaactttttatcacatgtattaggttttgcaggtagcgataaccaaggtcttatgggactagaaaaatattatgataaagagctaaatggggacaaaggtcatgtgcgtttttttgcagatgcgaaaggacaaaggatgcctaatgttggtgatgatttcaaaaagccagaagccggtttaaatttaggattaacaatcgatgcgcgtattacaaggattatggaaacagaaatgaatattgcggagtcaacttataatcctgacggtatgattgcgattgcaatgaaccctaaaaatggtgaagttttagggatgtctagtcgaccgagttttgacccagcggattttcaaagtgtctctccagaagtgtataacagaaatctacctgtatggagtacgtatgagcctggttcaacatttaagatcattacattagctgcagcattgaatgaaaatttagtagacttagagaaggatacgttttatgatgatggagcagctgaagtaggtggagctagattgaaatgctggaaagcaggaggtcatggcagtcaaacgtttttagaagtcgttcaaaactcatgtaacccgggatttattgaacttggtgatcgccttggtaaagaccgattatttaaatacattcgtaattttggttttgggcagaagactggaattgacttgcaaggtgaaggcagtgggattttatttaatttagataaagttggtccagtagagcaagcaacaacttcattcggccaaggagtttctgttacgccgattcaacaagtagcagctgtagcggcggctgtaaatggtggaacattgtatcagccgtatatagctaaggagtttattgatccgaaaaataatcaagttggtagtaaaaagacacctgttgagaaaagaaaagttatttccaaggaaacttcagaaaaagttcgttgtgcattagagaatgttgtagcgaatggttctggtaaaggtgcttatattgatggatatcgcgtaggtggaaaaccggatactgctcaaaaggtgaaggatggtaaatatttagagaataattatatagtatcttttatcggatttgctccagcggatgatccagagattgttgtgtatgtagctgttgataatccaaaaggggttacacagtttggtggagtggtagcagctccgattgtcgggaatatccttcgagatgcgcttcctgttatgggagtgaaaccgagaaaagaacaagttgagaaagaatataaatggggcgatacaccaactgtggaagttccgaatttaattggaatgaaaaagaaagacttacaaacacaactcgtcgatttgaagcttgatataagtggagatggagagaaagtaattaaacaatcaccagaagcgggagctaaagtaaaagaaggctcaaaaattagaatttacttcgggaattaaaggtaacatagtacgttttatggtacaattggtggaagtgagttctttatagaacagttacttaatttgagacagtaagtgtctcattcataaataggtcagtagcacttacctccttatataggaggtaat

SEQ ID NO: 1198 - DNA, 8290 bp, Bacillus thuringiensis
taaagagcacccctaaatgtaagccctttctttattgctgagtatagtatataacaaaaacactatataaaaaagcctaattgtaaaaacaattaggctttttttaagaacttttttcttgtacatcattaatgagcacttctctcggtttactaccttcatacggacctactacaccattcatttccattgcatcaattaggcgagcagctcgcgtataacctactctaaacctacgttgtaacatagaaacagatgctgtttgcatttccactacaagttgaaccgcttcatcatataattcatcttctacttcctgcttcgtatcaggaacatcttgcggaatcatatcttcttgatattgtgctttttgctgtccaataacatattctacaactctctcaacttcatcatctgataaaaatgcaccttgtacacgtacaggtttcgatgcaccaattggtataaacagcatgtctccacgacctaatagcttctctgcaccaccaccgtcaagaattgtacgagaatctgtttgagaagatacagcgaatgcaatacgtgatggaatatttgctttaataacacccgtaataacgtcaactgacggacgttgcgttgcaataattaaatgaataccagcagcacgagccatttgtgctagacgcataatcgcatcttctacatcagacgaagcaaccatcattaaatctgctaactcgtccacaattactacaatataaggtaattcgggttgtttcgcttctgattgactattatgctcttttatataatcgttgtatccttcaatgttacgtgtaccactatgagcaaacaattcataacgacgttccatttcactcacaacttttttcaatgcttgcgatgctttcttcggatcagttacaactggcgttaacaaatgaggcacaccattatatacatttaactctaccattttcgggtcaatcatcattaattttacttcatgtggttttgcacgcattaaaatactaacaataataccgttaatacatacacttttcccgctacctgtcgcaccagctacgagtaaatggggcattttatttaaacgggctagtacagcttcacctgtaatatctcgaccaagaccaattaacaacttctcttccggatgattattagccttagaatcaagaacttccctcagcgttaccatcgaaacttctgagttcggaacttcgatccctacagctgatttcccgggaattggcgcttcaatacgaatgtccttggcagctaaagcaagggctaaatcatcacttaaactgacaattttgcttacctttacccccatatcaggatacacttcatattttgtaactgcaggacctctatgtacttttgttactttcgctttcactccgaaactttggaatgtacgttctaatttacgagcattctcataaatttccgcattttcatttgtaacttgcttattctttggaaattttaatatatcaagtgaaggaagcttgtaatctttattttctacattggaaaattgcataggaggtgcttgcgcttcactctctaacgattcaacaattttttctccacgctttttctttggctcttcaattggcggagtctcttcaataaacggtgaagtaatcaaatcttcttgctctacttcaattcgtttatcctcttcttcatttacaggataattctcagtgaaattcgaaataatcggaggatcaattgagatttcttccatcggctcaataatttcttcttgttctgcagcacgtttgcttcttgtgcttcttgttgtttttttcttttctgtttgttcagccgttcttttagctctccaatctttataatccccttgcatcacttgaaattgacttctaagaattctaccaactggcgctaacacttctccaatatgcttatttgttatacaaagtataccgagaataactagaataataccaatgatataagctcctacttcgtcaaataagaagtaacatgttgcgaacataagcgcaccaaacataccaccacctaaatgaacgctatctggcccctttttcatttcaagaaagaagttatctttcgtactcacaataacagaagtattttgcactgctccatcttttgtaagaaggttaaataatgtaatatgactaaacattaatatcgccaatacaattaaataaaatccaattaatcgtttatttaaaaggttcggccatccgcgttttataacaaaggaaaccgataaagctattacacctaacacaccaattatgtaccactcaccaaagaagaagcgaaaaaataacacaaacgattttcctacaacgcctagctgtaaaatcgtaatgattgaaagtgcaaaaagagttaaaccgacaatttcataatacaaagttggctttatcgtacgccttgcctttgccttcgtccctctttgcttttgttttgccatttcttcacctcgcgttctacatataaataaagctcccctcaaaatgctctatttatatgtctgttttctctatttttcaggtctttatatcttctatttttacacttcttgtaaaatgctaaataaacagaagaaagcagcctactcatggctgctcaaccgtcttgttttttatattataccatagcttctaaacaaaatccttctttttgctaaaaggttattttctgaccgggctcaaactctaaatagtgaagtgggtccgtacttagcacacgtacaatagaataacatccatgttcctcttcagaaaccattaattccacaccatttatatttacaactttttgactttcacattgtgaataatcggccggatacacaagttgctctggcataattgtatataaaatcattgtagcattgtcccttctgtactatcttccgcacgaacatctattaattcgtttaattttcgaattgcatttccaataccgccgacatcatctataagaccgtactttactgcatccccaccaattacattcgtcccaatatctcgcgttaaatttcctttcgcaaacataagctctttaaaacgatcttctgttactttcgagtgcttcgtcacaaaacgaatgactctttcttgcatcttatccaaatactcaaatgtttgtggcacacctatgacaagacctggtaaacgaattggatgaattgtcatcgtcgcagtttccgcaataaacgaatagtcagtagaaccagcaatcggtacaccgatggaatgtcccccacctaaaactagagatactgttggttttgaaagtgaagctaccatttcagaaattgctagcccagcttcaacgtcacctccaaccgtatttaatattaaaagcaaaccttcaattttcggattttgttcaatcgcaacaatttgcggaatgatatgctcgtattttgttgttttattttgcggtggtaattgaacatgaccttccacttgtccgataatcgttaaacaatgaatacgtgattcattcatctgtggtacatttgtctgtccaagctgttgaattttttcgactatcgaagcctcttttccagcttcttttggctcagcttctttttcttcatttgtatatcgatcacgttctgtcatttcgcatcccctttcactcgtatataactattatttcttaagttataaatttcattcgatagggttaaaaagaaaaaagatcacccataagggtgatcttttttatacttccataataatcggtaaaatcataggttttctctttgtctcttcgtacaagaactgccctaataattcacgaatattttgttttaacattgaccattcaattgaatattctttaattgactgctcaacaatcatacgtacaatctctgtagaacgttcaattaacgcttctgattcacgaacatatacgaaaccacgtgaaatgatttctggaccagagataattttcttttcatctttaccaagcgttacaacaactactagtattccatcttgagataacatctttctatctcgaagaacgatattaccaacgtcacctacacctaatccatcaattaaaacattaccagcttgtactttaccgactaagttcgcttcatcgtcaccaaaagcaattacatcgcctttttctacgataaagatattttctcttgtaatacctacatcttcagctaaatatgcatgcgctttttgcatacggaactcaccatgtacgggtacaaagtactttggtttcattaaatttaacattaattttaattcttcttggctaccgtgacctgacacgtgaacttttctttcgccgtaataaacaacttcagctccagctctaaataacaaatcaataatttttgatacagatatttcattacccggaattggcgaagcagcaatgataacagtatcacctttacgaattgaaatttgtttatgtgcttgttttgccattctagatagagcagccatcggttcaccttgactacctgtcgttaaaatagctacctttttctctgggaagttgtctacttcttgtaatgaaataaccataccttctggaacatctaaataaccaagacgtcttgcaatgtctactactttcaccatactacgtcctactaccgctacttttcgccctgtttcagcagctgcatcaaatacttgttgaatacgatgtacatttgatgcaaatgaagcaacgataatacgaccttctgcgccatagaacactttagagatttctacaccaacttctttttctgaacctgtataacctgggcgctctgcgtttgtactatcagataataagcaaagtacgccttcatttccgatttgcgccattttcccaaggtctgctccactatttccaattggagtttgatcgaatttaaagtctcccgtatatacgactgcaccttttgatgtatggaaacaaacgccaacagaatccggaatactatgtgtcgttccgaagaatgacaccgttgtagtgttaaattctactgttgaatttgaatcgattgtttttaggtctacacggcctaacatgcccgcttcaccaagtttttcttgtataagtcctactgttaatttcgttgcatagactggaatagataatttacgaagtacatacacaattccaccaatatgatcttcatgaccgtgagtaataaataaaccttttactcgctcttgattttccactaaatatgtaatatcaggaataacgatatcaattccaaacatttcatctcccgggaacattaaccctgcatctacgataaagatttcagaatcaatttcaacacagtacatgtttttcccgatttcacctactccaccaagagcaaatactttaacagactcattctcttttctcttcatgttgttgcctggtttaaaaatcttgcaaacactgatttcactaaaattgcagagacaccaggggaaactctacaaccaccatattttcaccgtccaagacgaatgtccttaccgttatgcgatatcatgtccttgtttattttttaaaccaggtttcacctctctttcattatataaatcaaatatcttattcgatatgatatgaaaatttaattaaattataatttttcccaattttgctaagcatacccgtactaagctacttagccatattatacctgatacaagaaatagaacacaagttaaatcgtgcgaaagaaagagtaaaagaacggaatgacaacaaaagtatcgaaggtatttcctttatatttacttcgattttatactccatattattttgaagaactagccatacatatgctaaattcatttcataatagggagtttcaagatttatttttctagaatccaacaaaaacacttacaaaatggagtttttttatgaattacgtcaaatttgaggggatttctctaaaaacaaacaccgtagtttattacgtttattccataatatctatcattttttgactcggttaaaggagtacgattattttcttatacacataatgaagaagcgattaatattcttataagaacacatataggtgagaaaacgagaaaaagatttgcatataataaaaaatgacctagttctacactaggtcattttttattaacgagggatagattgcattacagattgtaacgttactctttcttcttctgttaatggaagaagtggtaaacgtacagaacctacatctaatccaaccatttgtaacgctgtttttactggagttggacttggcgccataaataatgaatcagttactcttacaagtaattgatgtaatttttgtgccttcttaaattctcctgattgaaatgctgtaatcatttcttgcatttcgtttccgataacatgagaggctaccgaaacgatacctttcgctccaactgccatagctggtaacgttaaaccgtcatcaccgctgtataccgcaaagtcgtccgctgttttttcaatgatttctgtcattgttaacacatcgccgccggcatctttaatagcaacaatgttttctatttctgataaacgaacaactgtatcaacggagatttgtacaatagatcgtcctggaacgttatatagcataaccggaagcggcgtgctttcagcaattgctttaaaatgctgatacattccttcttgactcggtttgttataatacggtgctactagcattactgcatccactccaacttctgttgcctttttagttaagtcaatagaagcatgcgtattattgctacctgttccagcgattacgggcactcttttatcgacaacagatacgacatggcgatataacgctactttctcttctgaagttaatgtaggagattctcctgtcgttcctcctaccacgattgctgttgtaccgttatcaattaaataatttaccaatttcgttgtctttgcaaaatcgatattcccgtttatatcaaacggtgttaccatcgcggttgcaattgtcccaaaatctatcatggtctcactccttattgttccagttgcttttcttttgaaagctcaaacgcactatgtaatgcatttacagcctccactaaatcaatttcttttacaagaacccaaattgttgtatgactatctgccgattgcaggatttgaatgcctttttccgctaaagctgtaacgatttttgcagtaacccctgggatgcctgccattccagctccaacgatagatactttcgcacaatgttctgtcacaattggctcatatccaagttgttttagcacttcgacagcacgagctgatacattatcatttactgtgtaagctacaccagtaggagaaatgttaattaaatcaacactaatgccttcgtttgccatttctttaaatacatgctgctgtatgtcgtatgccgtttcttttgcaagtactttaatttgcgttacgttcgatacgtgggcaatacctgtaacaggacgttcttctacatcctgcccttttgtagcaccatcgtatgctgcaataagagtaccttcactttcagaatacgtagaacgtacacgaagtggcacttttgcatgcatcgcaatttcaactgcacgtggatgaacgactttcgcaccttgataagccatgttacaaatttcgttatacgttacagtttgaagatgacgtgcatcttttacaatacgaggatccgcagtcataacaccttctacatcagtgaatatatcgatatattcagcatgaagtgcaacacctaatgctgaagctgaagtatcactacctccgcgtccaagtgttgtcgtatcaccttttttcgtttgcccttgaaatcctgtaacgacgattacatctacattttctaactcttcatgtatacgatcgcaattcatttcaataatctttgcattcgtaaagtcatcattcgttacaaaaccagcttgtgcaccatttaatgctgctgcttttataccgttctcattcaacatattagagaaaacaattgcagagattaactctccgcatgataataataaatcttgctcacgtttagaaatagtagattcctcttgatttacaagacttaataacgtatccgttgcatatggttcacctttacggcccatagcagatacgacagtaactactttataaccagcagctaatgatttttttatatgatgaagcgcatgcttacgttcattgtcatcacgtactgatgtgccaccaaatttttgaacaattattttcatattttgcacct

SEQ ID NO: 1199 - DNA, 6771 bp, Bacillus thuringiensis
tcttcttgacgtaatttccacgctagttgattgtttccttcatctaatgcataagataatttcggtccattttgaagcgcgcaatctgttaagccaccagttgatgaaccaatatctatcataactttatcttgtaaatcaagatgaaatgtctctaatgccttttcaagtttataaccaccacgacttacatacggcataacttgtcccttcaccgtaatctcagtatcttgcgagattttctctcctggcttatcaagtctcatctcatttgcatatacgagtccggccataatggcgcgctttgctttctcacgcgtttctataagtcctcgctctactaatagtacatctactctttctttttttacgctcatttgttacgcccttttttgttttgatggaatcattgtatgaatacggtctacaacagcatctgtcgttaaaccaatttcttctaataattttgttacacttccgtgctctatgaagcggtctggaatacccattcgttcaactaatgcactatggtaaccattttcagatgcaaattcaactactcctgttccaaaaccaccgattaaacaagcttcttcaatcgttaaaatcggtatattctttcctagaagatcatgtaaatatgcttcatccattggtttaataaagcgagcattcactactttcactgaaaccccagctttttcaagacgctcagctgcttccattgccattggtattgtcgtaccaaacgttaaaatagctgcttgtgtcccctcttttaacgtctcccacgtaccgattggaatcgcctttaattctttatccatatgaacgccaagtccattaccgcgagcataacgcaatgcgattggtccatcttcatattgcatcgccgtataaactaaatgttgcccttcattttcatctttcggcatcataagcaccatattcggcaagtgacgtaagaatgagatatcaaatacgccttgatgcgtttcaccatctgctcctactaatcccgagcgatctattccgatgaaaacatttaaattttggcggcatatatcatgaacaacttggtcatatgctctttgtaaaaatgttgaataaatcgctaagaatggcttcattccttgcgttgccatacctgctgccattgttgtagcatgctgttctgcaatacctacatcaatcatacgatctgggaattctttttggaatttctcaagttttgatccaacaggcattgcaggtgtaattgctacgatacgctcatccgctctcgctagcttaagtactgtttcactaacgacagcactccatgctggtgcaacttctttcggcttaacgaagtcacctgattcaattttataaggtcctgttccatgccaagttccaataacgtcactctcagccggtttataaccttttccttttttcgtaataacgtgaacaagcactgggccttttgttttctttgcatattgcaacgtttcgaataacttttcataatcatgcccatcgactggacctaaatatgtaaagcctaactcttcgaaaaagacaccagatactagtaaatatttaagactatcttttattttctctgctgtcgcagccactttcccgccaactgctgggattttctttaatatatactctaattcatcttttacccagtgatattttcctgcggtacgtaaacgaccgagcacattatgaagcgcaccaacgtttggtgcaattgacatttcattatcattcaaaataacaatcatgtctgttttttcatgtccaatatggttcaatgcctctaaagccattccgcctgttaaagcaccatctccaataattggtataacatattctttcgttttctttaaatcacgtgccagagccattcccattgcagccgataacgaagtcgagctatgaccagtttcccatacatcgtgctcactctcgcaacgtttcgggaaaccacatagaccttgatattgccttaatgtaccaaactctttcgcacgtccagttaaaattttatgtacataggattgatgtcctacatcccataaaaatttatcttgcgggctatcaaataatttgtgcagagcaattgtgagttctactacacctaaattaggtgcaatatgtccacctgtttgagagagctcttcaattaaaaacttacgaatatcctcactcaatccctctagttcactgatagacatatctttcaaaaaactagggttttgaatttgcgttagatccacatggatcactcactttcatttcataatctgtcaacatgtcaaatattataaaaaacatttacacaaaacaagaaattctcttttctatttttcgtcttgtcccgctattaaccagtctattgcgccctaatcctattataaaccatatttctttaggcgatgaaaaaaatagccgctaacacgaagtgataacggcaatgtaatctacatatatttttgccaataacaagaaaagaaaaaccttttcctacatttatatcataaaatgatgaatgactcaacaaatgaaaacgctgttatattagttattacgttttgcaatcaaatcacaaatagatagtaaatattcatcttgtaattgcaaggaactaatcgcaccttttgcttctgcaattgtttcttctaaaatatcctttgctctatctacagtaaacaacgttgtatatgtgctcttttcattagaaagatcgctaccaatcggttttccaatctcttcttcagttccttcgacatctaaaatatcatctcgaatttggaaagctagaccgatatatttggcaaacgtaagcaacttttcttcttgctcttctgtcgcatcagaaagtatcgcacccgcaagtacagcaaattcaagcagttttccggtcttatgtttatggatgtactccaattcatcaatcgtaaggcgtttcccttcagcttccatatctgccacttgtccgccaaccattccttctggtcctgctgcttttgcaagttcaagtacaagtcttacttttttttcggcagaaatttctttttgctcatatgccataataacttgaaaagcatacgtcaataagccatctcctgctaaaactgccatcgcttcaccaaatactttgtgatttgtgggctttcctcttcttaaatcatcatcatccatacaaggtaaatcatcatgaactaatgaatatgtatgaatcatttcaagagcacaagctgcacctactccaagatttctttctttcccaaacgcttgtaatgttgcaaacaaaagtaacgggcggagacgttttccacccgcttccaaagaatatgccatcgcttcacgaagtacatttggacattgtaattcatttgcatagcttacaagtttttcttctacgaaagttttactttctttcaaaaaagtatcaaaagcaatcgtcactatgcttcatctcctaaagcagtaaacggttcaagctctccatcttccccaagaataactgccatttgttcttgtacattcttcagcttctcatcacaaagcttagataattccataccttctttaaaataagaaatcgcttcttctaaaggtacgtcaccttgttctagcttagaaacaagatgctcaagttgcgaaattgcctcttcaaagcttaatttattttccattattcaattcacgctcctctatgcctgatacgctacaatctagtattccatcttgtaattgaactgaaacagcatctccaaggcttacatctttcacactttttaacacttgcttctcttcatcatatacaagcccgtaccctctcatcattactttaagcggacttaacgcttcaagtttttgagcagctcttacaaaggcaaattctttcgtttgaagtaacgtttgcatttcacgttgtaattgcttttgcaacgtttcaacagctaccttcgtttgcataattttttgagatgggtggtgcttctctaaataaaatgaaagttgctttaactgattcacctttttatcaatatagcgctctttcgctaaaacaagctgttctagcgctctatctaattgctcttccttttgctcatatacttgtcttggataacggaacgcatacgatttttgcaacacttgtagtttttcttcttttttatgtactaactctctcattgctctttgcaatctcagagttctttgtaataccttttcttgtaactctataatgttaggtgctgccagctcagctgctgcagtcggtgttggcgcgcgtaaatctgcaacaaaatctgcgattgtaaaatccgtttcatggcctactgccgaaataataggaatttcactcttaaagattgctcttgcaaccatttcctcattgaaagcccataattcctcaatagaacctccaccacgaccaacgattagtacatctatctctcccatttcattcgctgtacgaatcgcttgtacaatcgagggagccgctgactccccttgtacaagtaccggaaatacaataacattcccaattggataacgacgtttaatcgttgttataatatcacgaatcgctgctcctgttggcgacgtaatcacacctattgttttagcgtaaggaggaatcgcttttttataaacttgagaaaaaagtccttcttcttctaaacgaacttttaactgttcgtacgctaaatgtaaattcccgactccgtcaggctgcatgtcttgaatataaatttgataagaaccactcgcctcgtaaacagagattttccctttcacgagtaccttcatcccattttcaggtttgaatttaatattacgattatggcccgcaaacataaccgctgcgattcttgcattttcatctttcaatgtaaaatacatgtggccacggctatgatttttaaagttggaaatttcaccttttaaccaaacagactgcaaatgcggatcatattctatttttgtttttatatagcgtgttaacgctgtaacggttaaatattgcttctccatttctctctcctcatagccgactcaaattatttacaaacgacacctgcacgtttggcagattcaacagtattatgaagaagcattgtgattgtcattggaccaacaccctttggcacaggtgtaatgtaacccgcaacatctaacacgttgtcaaagtcaacatcaccacaaagttttcctgtttctaaacggttaacaccaacgtcaattacaaccgctccttctttaatataatccgctgttatcattttaggtcgtccaacagctacgattaaaatatcagctaacttcgataactctttcatattttgcgtcttagaatgacaatatgttacagtggcattttcatttaaaaacaattgtcccactggtttaccgacaatattacttcttccaattactactacatgttttccagaaatatcaagatttgtttcttttactaattctacaataccatgcggtgtacatggaaggaatgtatcttgtcccgtcatcatacgtcccacgctgattgggtgaaatccgtctacatccttttctggtgaaattctttcaatgatagctttttcttcaatatgttttggtaaaggtaattgcactaatatgccattaatacggtcatctccatttaagcgatcgatttcagcaagcaaacgttcctcagtaattgtttcaggaagttcaattagctctgagtaaatccctacttgttcacagcctttttcttttcctttcacataagaacgagatgctggatcttctccaactaaaataactgctaatcctggtacaataccttgctctttcaacttcacaacttcttctgttaattgtgctcgttttttctccgcaacttcatttcctttgatgattactgctaccattttaagattcccccttaaagaatttacagtgtatcttttatattagataaaacgccgttaataaaacgacgagattcctcatccccaaatgtttttgcaatttcaattgcttcgttaattgttacgttgtgtggaatttcttccatgtacttcatttcatacacagctacacgtaaaatactgcgatcaacaatactaatacgctcaagcttccacttttttaagttttgacgaatcgcttcatcgattgcttctttattttctacaaaacctactacaagtgactctagaaactcatttgtttcttcgccttcatccagcgtgttttccactgctactttcggttctaattcacctgtaatatccatttggtataatgcttgcattgctctttctctagccgtcctacgtttcattgtaactctcctttatgcttcaagtctttccttatactttgttatattattataatttataagccgtcaattcacttactcttacagttttcattgattttccaaccttataatacaatgataataacacaatttatcgtttcacacacgggttacaaggctgaaaaataataaaaagattaacttcaagttccatatcttatcacaatgtacgttttttggaaaaacgacacatttccttgtttatttcttattttttgaaatagtataataattagagggttgtaatttgtgaagaaatgaaacgataaaaaagatgcctatgttactaggcaccttttcattcttacactggttcgatttctggtttttgtggttcgaatgttacgccaacgatgtgaacattcacttcttttggctcaagt

SEQ ID NO: 1200 - DNA, 8387 bp, Bacillus thuringiensis
gcagaaatatttatgggctaaacataaacacttttcaataagagcaaataatttttgaaggggagatttttatgaccaatgaggaatgttatccattaagccatccgcagcgaagaatatggtatacagaagttattcattctgataaaggaatatgtaatttaagatttttatttaaacttcatcggaaaatgaactattcaaaattaaaccaagttgtgaatcgcgttatcagtgaaaatgacggtctgtgcattaggttaaaagaaaatgggcatcaggaaccgaaacaatattttattaaacatgaagaacaagaatttgagttttttgatttcagtaatgtggagaatacaaatttgcttgaggaatggattgagcagaaaacaaaagaaacgtttacattatttaattccaatttatactatttcgctttaataaaattaaacgataatgaatgtgcagtctttggaaatgttcatcatattattatggatggtttatcaattcaaatatttactgagcagattgcaaaatattattatgacatgcataacgagaatgaggaaggcgaaattaaaaattcatatgttcaatttctgaccaatgaacaaacatacttgaatagtagtcgttttcaaaaagatcaaaaattttggttagaggaatttaaaacactgccatctatgaccgggttgaagccttataatacgtaccaagttagtaccaaagcatcacgtgagacgtttatattaacggagcatttgaagagaaagatagaaaaattttctgaagattacaattttggtttatacaccctttttgttgctgctttctcgttgtccatgtatcggtggacctcatcgtttgatattggtttaggaatggcttacggcaaccgtatgactaaaatggaacgaaaattgattggaatgatggtgagtacagttcctttaagaatggatattgatccagaagaagaagtactttcatttattagtagggtgtccagaaaacaaagtaaatcattaagacaccagaaatatccatttgatttgttattaaagcagattaataaagagaataacagtaatgtgagacttttcggaactacgattgattatagggatcgtgatgaaagtggtgactcactatggattccaaaccgtgaagaagtacaagattttgcagtgcatattgaaaatctaattgatatagactctttacatgtacatattgattatcgtgaggagctattttctaaggaagagataaaacgggtttttaacgtgatgttagcgataatggaaaacacttttgaaaacccaaagcagaaggtggctgaaatagaaatcatttctgaggaagataaaagaaaaagtttagttgagttcaacaatcctaaactggatgtcccgcctcaagtaactattcatgaaatgttcgaacggcaagcgatgatttatccaaatgctattgcagttacgtatgaaaaagaaaaaattacttataaggagcttaatggacgtgcaaaccagttagctcattatctgcagaaaaaaggagtaggacctgatactttagttggactgtgcgttgaacgttcccacgagatgattgtaggtattttagggattttgaaggctggtggggcttatgtcccacttgatccaacatatccagagcaacgacttcaatatattttagaagatgctagcattcagttattcgtaacgcaagaaagtttaaaagaattgaactggttaccagaaaatgttgagtcgatttgcctggatcgtgatcaagatgagattgggaaagaaagtaagactttgccggtttctagtgtcggtcccaaaaatctggcatatgtaatctatacttcgggatcaacgggaaatccaaagggcgttatgatagaacatcacaatgtcattcggttatttaaatcgacggattgttggtatcagtttaatgaaaaagatacttggacgctttttcattcgtatgcatttgatttctcagtatgggaaatttggggagcgttattatatggtggaaaattagttgttgttccgtactggattagtcgatcacctaaggatttttatcaattattggtggaggaagaagtcacagttctaaatcagacaccttccgcatttcgacaattaatacaagtgtgtgaacaagaagataagaataaaaatttgcagctgcgttatgtcatatttggcggagaagcgttagaacctactagcttgttaccgtggtttcaaaggtatggggagaaaaaaccacagttaattaatatgtatggaattacagaaactacagttcatgttacatattatccaattactttagatgatgtgcagcatgtttcaagaagtaatattggaaagcggattcccgatttagaagtgtatatactagacgcttatcaacaacctgttcctataggtgttgatggtgaactttatattggcggggcagggcttgcacgtgggtatttaaatagacctgaattaacagcagagcgttttatatctcatccatttagtagtgatctgaaagcaagattataccggacaggagacttagcgaggtatttgccagatgggaatctagattatcatggaagaattgatcatcaggttaaaatacgtggtttccgaattgagattggggaaattgagtctactttacatacatatgcatatgtaaaagaggcagttgtaattgtaagagaagatcagccaggcgataaacgattagtagcatatgttgtaggagatggaaatgtagatgcgtggagagaatatcttaaagcgaaactaccaagttatatggttccttcgggatttgtggcgatggaagctattccacttacaactaacggtaaagttgatcgtgaggccttacctatgccggaggaaaagcagattaatagtgaatgtgttggccctcggaatagtaacgaacaaatactaactaccatttggaagagagtattaggtgttaaaaaggtgggaatctatgataatttctttgaaattggtggcgactcgattctcagtattcaaatcatatctcaagcaagtcaagtggggttaaaactgactccaaagcaaatgtttgaatgcccaactatcgctgagctggcacaagtggctatagaaacgcagggagtacaagcggagcagggaattgtgataggtgatgtgcctcttactccaattcagtgctggttcttcgagcaagaacatccacatacagagcattggaatcaatcaatgcttttaagagtaaaagaaagattggatgtgaaattactagagggagcgatattaaatttactgaaacatcatgatgctttacgtttccggtacgaacagttaccaaacggaacgtggagacagagaaatgaagggactgatgagctgtcagtactccatgttgtaaaacggaatcaagttaatgaaaaagagtggaataaaataatacaagaagagatgaatattcatcaagctagtttcaatttaattactggtccgttaatgaaagtagtgtactttgaagataacttgactgaaaatgatcgaatattctgggtgatacatcatttagtagtagatggagtgtcatggaggattctattggaagatttacaggtggtatataaccagatgaaacaaggtcaagaaattcgcttacctgcgaaaagtacatcttttaaagaatggtctgaacgacttcagacatacagtgattcgggtatttcaaaagaagtaaaggattattggaatgaacaagtagaaaaagaaacgatgaaaattccaatggactatccaatacaagaaacgacagaagaatcgattgatcaagtgacgaggactttaggaatagaagaaacacaagcattgtttcacgaagttctagtcactcataagacaaggattgatgaggtactattaacggcattaggacaagctatcgtcgattgtacaaatcagcaaaccgtttctattcatctagaaggacacgggagagaagagatgattgaaggtattgatttatcaaggacagtgggctggttcacgagtatttatcccgttcatctcaattttcaaggaactcagacacctattgaagggttaaaggcagtcaaagagcaattgcgtcgaatcccaaatcgcggagttgactatggcattttacgttacttgaataaaggattacttccgttttatcagcaaaagccttcaataagctttaactatttgggccaatttgatcaggtgttttcaagggactctttgtttatgcaagagacaggatttacatttttagatcatgctccagattccaaaccatctcatctaattgatgttatcggaatggtgaaagatgaaaagttacattttatttggatgtatagtaggaaacagttttctaaattaaaaattcaagtgatagcagatggtatgttgaggcatcttcgtcaacttataaataaaccaacaacagagtctgcttttacggtatcagattttgctgatgcagaggatcttacggaagaaagcttgagcaaagtattacttaaattaacaaagaagagggtgtaaaaatgggagacgttattgatatatatggtttatcacctttgcaaaaaggaatactgtttcatactttatacgatcaagatgatgaacattctttttcctatattgtacaagtaggtttcttgctcggggggcaattggatgttgatacttttgaaaaggcttgggaatatgttattaatcgacatgaggttttacgttcagtatttgtatgggaggaagtagaaaagccactacaagcggtttaccaacgtcttccttttactattcatcaagaggattggagcacctatccacatgaggaaagggtgaagaaattacaacagtttttgaatgtagatcgtagaaaaggatttttattggatgaagcaccattgatgagagtcactgcgatcaaagaagcaaaagaggaaacgagaattatttggacacatcatcatattttgctagatggatggagtgtgtcattggtctttagtgaagtgatggaagtttatctcaagatgataaagggagaattattgactcttcctaaatctcttccttataaaaaatatatccagtggataaataaacaagatcaaagtcaagcagaggaattttggaaagaagaattaaaagggttctatgcacctacgccattagcaatggaaagaaaggatcaaggacaagagaagggctatggagagtgtgtttatcaagtatctgagaaacttactgagaagttacaagagtgggtacgaaatagtcgattaacgttgaatacgttagtacaaggtgcatgggcttatttgatgagtaggtatagcggtgacagtgacgtcgtatttggcgtaactagcgctggacgtcctactgatttaatgggagcagagaatatggtggggctatttattaacacattacctaccagaattcgattaacggataatacatcagtagtagattggcttcgtaaaatacaaatgaaagaaatggaacgaagacagtatgagtataattcgttgatagatattcaaggctggagtgaggttccgcgaaatagctccttattccataccttgtatgtgtttgaaaattatccaattcaaggtgagagaaatgatgatttaagattactagatgttacaagcacggaacaaacaaattatcctttaacactcattgtaatgcccggtaagaaaattactttaaagttgatgtatgatcgaagctattttaatgaagaaacaataaatctgattcagaatcacttattgcaaatattaattcagatgacgaagagcctagattcaaaactatttgaaattactcatttaacagaagaagaacagatacagttactagaggaatggaatcatactcaatttaattattcggctgaaggcatgattcatacgatgtttgaggagcaagttaaaaaaacaccggaagcaatcgcggctagttacgaaaatgaacaaattacctataaagagttggagaagcgtgcaaatcagctagctcattatctacaaaagcatggtgtaggcccagagtttctagttggggtatatatggaacgttcattacaaatgatgatagcgttattaggtattctaaaatcaggagcagcgtatgttccacttgaccctacttatccagagagtcgacttcgatatatattagaggatgctggaatcgaagtactagtgacggaagagaattctaaaaatttgtttgtatctgaaaatatagaaacgatttgtatgaataaagattacactgcaattgaaaaagaagaatcaaccccatgtataagtggtgtaacaggagaaaatttagcgtatgttatgtatacttcaggatctacagggaatccaaagggagtaatgattgagcatcattcagtaattaattatctagaatggatgcaacataaatatccgctttctgaaaaggatgtggtcttgcagaaaacgccattctcatttgatgtctctgtttgggaattgttttggggcattcacgttggtgcaagtgtatctttcctacctccaggtggagaaaaagatccttctattatagctgaagtgattaaacaacatcaggttactatagttcaatttgtaccttcgatgttatctgttttcttagaccacttcaatcatattgaattgaatatgaattgttcgtccgtacgccatgtattttctggtggagaagaactaagttcagggttggttagacgatttcaacagaaatggaattatagtggacaagtgaaattaaccaacttttatgggccaactgaagccactatttatgtgaatgcatttgatattcagcctaatcaagaatttgtttctattgggcagccaatacagaacacgcaattatatgtattagaccaaaatcaacgcttgcaatcaataggaattgagggtgagttatatattggtggtgctggtttagcacgtggatacttaaatcgtccgaatcttactgctgaaaaattcgtttcgcatccatatcgatttggggaacgactatatcgaacaggagattcagtaagatatttaactgatgggaatttagaatttataggtagaatggaccaccaagtcaaaatgcgtggttttaggattgaattaggagaaattgaagcgactttagaaaaatgttcgtttattaaagaggctgtcgtattagttagagaagatcgtccaggtgatcaacgattggttgcatatgtaataagcgatggaaataccgaggagtggagagagtatttacaaaaacaattaccaaatcatatgattccagcgcactttatagatttagaacacttcccgcttactccaaatgggaaaattgaccgaaaggccttgccagcacctgatgagcaagctattgaagatttaaatgtgctacctcggacgccatcggaagagcttattgcctcggtttggagtcaagtgttaggaacagaaaatattggcattcaggattccttctttgaacgtggtgggcactcactacttgctactcaaattgtctctagattgcaagaaatgttccaaattaaaattccattacgtgaacttttcaagcacgatacagtggaagcattggcgaaacgagtggatcagttacgaaaagaagataaaaaacgagaggttgctcctcttgtacctatgaaacgagaagaagttatcccactttcctatgcgcagaaacgtctatggtttattgatcaattaatgccaaatagtgctatgtacaatattcatgcagcgtgtcgcttaacaggtaaatggtcaattgaagcattggaggtcggatggaatcaattgttggagcgtcatgaatcattaaggacgacaattctagaacaagagggtgaaccttttcaacaggttcaatctcatgtgttcaggcatattcctcaaacgaatctaacagatctttctttggaagatagggaaagagaaatgaaacgccttattcaaaacgaggcggaggaaccatttcattttggacaaggtcctctgattcgaacacgaatattgaaagtggacagggaagaatgggttctcatttgtacgatgcatcatattatttcagatggatggtcaatgggaatcttacttgaagaatggatggctttttatgaaggagcactaaccggaaaaccagtggaattgaaggagttatctatccaatatgcagattttgtcatgtggcataaggaatggcatacagaggagagtttgattagca

SEQ ID NO: 1201 - DNA, 9973 bp, Bacillus thuringiensis
cccttcttacttctctgtctaaaagactggagtcttcatggttacaaacttattcaaatgctaatggatatcggcttttcttctgttgaccaaggtaatgtttatagaacactacgcatgttagaaaaagaaaaccttatttcttctacttgggatacaagcgatggagggccagcaaaaagaatttattctttaactgaatatggagagcaatatttaacaacatgtgcgacttcttttgaacattatcaaaatatgttgcgaacgtttttcacgttatacaccaatgcattctttccattttctacttctccagaaaaggatgaaaaggattcttcatcttcacctggtggtacagcagagtaatctgcgttcacaatatgcaaaaaaacatttgggggtcaaacaatggaaactaaaccatacgaattagtcgatgcattttggaaaaactggtctcaatcactttcccttttctcttcagctgggaaacagttagagcaacttactttagaaacattaaaacaacaacaagacgctttgcataagttaacatcaggagtagatgaactagaaaaagaactacaacaactcactgctcagttcaataaccaatatacagattacgtgaaacaattaactggaaactccttaaatgatcaaattaacgagtggcaagacaaatggaaagaactttctgctcatatgcatcagcttaccgtttctcctacaaaaacttctttgtcaattcttacacaaacaagcggtcaatttgaagaaacaacaaaacaatttattgaacaacaacaattacaacgtgaagaggctcaaaaacagttagagggttttttggaagagttcaagtcaaaacagttggaactcgcaaaaaagttcgaggaaaactcaaaaaatctatttacttccatcaagtaagaaaaatgtgggagctaaccgcagcacaaacaaaactctttcttcctcctactacatcaagatggctaacatttttcgatatggaaaagaaggaggacaaaatgaatccatttcaagaagcacaaactgttccggagcttcgctatgatgagattcaagtcggtgatcaagcatcccttacaaaaacaattacagatgaagatgttatcaattttgcaaaattgactggagatgtgaatcctattcacattttagattcttttgcgaaaacgacaatgtttaaagaacgtattgcccatggtatgctcgtttcgagttttatttctaccatccttggaacgaaactcccaggcaaaaatacgatttatttatcccaaaatgtttcattccgtgcccctgtcaaaatcggtgatacacttcgcgttgtggcagaggttattaagaagcgtgacgataaaaaaatcattacgttgcaaacaaatatatataatcaatcggatgatattgtcgtggaaggtacagcgacaatactaaaaaaagagtagcaaatttgctactcttttttctatccaataacttctaatcacaccgattacttccgcgtatgagcacgccggttccacataaaataacagtaccaattcagataagtacttatctggactggattactcataaggatgtgtatcatcatggcaaaaacaaacaaattactagttccaggtgctgaacaagcacttgatcaatttaaatatgaaattgcacaagaattcggcgtaagcttagggtctaatacagcatctcgttctaacggatcagttggcggtgaagtaacaaaacgtcttgtttctttagctcaacaacaattacgtggataataatataacatatggcttagaggcagatattctctgcctctttctatttttcacatacataatcggactttttcacatactagtaagagcaaacagaaaggaacgatatataacatgaaacggattaacattcgtatgagtcctccccgcgttcttactttgtcttttatcatgttatcaattataggtacatgcttattaaagcttccaattgctacaacaacgtctatttcatggctcgatgctttatttacaacagtttctgcttgtacggttacaggacttggtgttgtggacactggaaaagtatttactttgtttggacaatgtatcattttaacgcttatacaagttggcgggcttggtattatgagctttgctgtcttaattgcgattatgctcggaagaaaaatcggtcttcaaaatcggattttactgcaacaagcattaaatcaaacgaatataggcggcgtcatccgtcttgccaaagcattatttttattctcttttacagtcgaatgtatcgctactttaattctttcttttgattgggtaccaaaatacggggttaccaaagggatctattatagttttttccattcaatctcagcctttaacaatgctggtttttctgtgtggagcgataatttaatgtcccattctcatagcattattgtcaatttcgtcatttcctctctcatcattttaggtggaattggttttacagtgatcgtagacataaaaagaaagaaaaactttaaaaaccttacactacattcaaaacttatgctctcttctactctaatcatcaacattattgctaccctttttatttttatattcgagttccataactccctttctatgagagggtttaccccatttgaagaaggaatggcctcttatttccaagcaatttcaacgcgaactgccggttttaatacagttgatatttctacattgtcaaaaccttccctgctattaatgatgctacttatgtttattggtgctggtagtgcttcaacgggtggggggattaagttaacaacatttttaatcatattttttggcgtatttaaatttttacaacaacaagaagatattgtcgtatttaaaaaatccattaaagatactctcattgtcaaatcattaaccattactattatttctatttcatttatcttttttgctattttaattttgagtattactgaacgagtttctctattgatgagtgctttcgaagtattttcagcatttgggactgttggcctcagtatgaacttaacaccccacttaactataattggaaaagcgattattatttttatgatgttttttgggaaaatgggtcctttaacattggcattttcatttgctcgtaaaaagaaccgaaaaataaaatatccgaatgaagatattttaacaggttgacacccggtataaattatccatataatgagaatacaataacatatctccaaaggggagtagcgtccaagaatatatcttggaaacaaagtcgtcattacgtagaacttagttcttccggctttgttggcatttttattacatatgtctagcaagacctttgcctattaacggcagaggtcttttttgcattcatttccagattctcccaaagttaataggcaggagtatggggaaactaaatagtggggaaattcttcacttatttagaagttatagagatgagaggagaatgtacatggatgtatcattattattggagtatggttgggtattactcatcctaattgcacttgaagggattttggcggctgataacgctcttgttcttgcaattatggtaaaacatttaccagaagaaaaacgaaagaaagcactattttacggattagcgggggcattcgttttccgatttggatcgttatttatgatttcgttcttagtcgatgtatggcaagtgcaagcaatcggtgccatctaccttatgtttatcgctggtaatcacttatttaaaacatatgttaaaaagaatacagatgaagaaactgaagaaaaagaagcaaagaaaaaacaagagaacttttggtggactgtatttaaagttgaggttgctgatatcgccttcgcagttgattcaattttagctgctgttgcactagcaatgactttaccaaaaacaggactaggtacaattggtagtcttgatactgggcaattcgttgttatctttgtaggtggacttatcggattaatcattatgcgatttgcagcaactgctttcgtacaaatcttaaaacgtaaaccagggcttgaaactgcagcattcttaattgtaggttgggttggtgtgaagctagcagtttatacattagcacatcctgcattaaatgtaattccacattcattcccagaatccactccgtggaagcttacattctggattgtattagtcggaatcgcagttggtggttggttcttctcaaaagaagtagaagtaaaagtggaaaagaatttagacgaaaaagcgctgtaattacagcgctttttctttttcctttcttcctcgcaatgtccagaaaaaattccattatactaccttttgtaaacgttttcttaatgtatgtatgtcctttttgtgaaacattgcacaaacttattgaaagtaagaacaattccatgtactttattcatataaggagtatttatagaagatttactaaaggagcgtattactcatgctagaacaaggactagattatgttgtcaaactggctaaaagcaaaaagaaaatactagatacaaacccaatgcaatatttcattcgtgctgcacttgctggtatttatatcggttttattattgtactatgttttaaattaggtaacttttttcacattgcagattcaccagcaacttatttagccgcttctatgtttttcgggattgctctcgtacttattatatatggcggtgctgaattgtttactgggaacacaatgtactttactgtcgcaactttaagaaaagaaacaacgatttctgatacacttcgtaactgggttgcttgttatgcaggtaacttagccggcgcattattctttgccttactattttacgcaactggaatttttgaagcaattgatcacggtcacttaatgagtaaagtcgttgaaggaaagatgaatacacctacgatgcagttattctttaaagccattttatgtaactggctcgtatgtcttgcttgcttcttaccttctcaggttaaaggtgacacagcaaaaataatggtcatgatgctacttgttttcacattcttcttatctggttacgaacatagtattgcaaacttatcactctttgctttatctttagtttcaccgcatcctgagacaatttctttttcaggtgctattcataacttaattcctgttacaattggtaacattattggcggatcagtatttgtcggtatggtataccactacttaacaaagaaaacccctgaagttcaacaggaagaaactgaaatcgcaacagctcaacaagaagagattattcctttacaagcccatatgaaacattaaaaactccaaagttttactttggagtttttagcttcccacgtatttaataacaaggtgaggagtaatttctccttcttcctttcccttatccattctctgtttcatcttgtacataccgatgacatcattcgtatgaaagtgaatttcatttacatataacccctctgtacaaaaagcttctacaaaatccagtccatttttcgctccccatcccatattaaaatcaagagaaagaatattcacatcataatcctgaaccatttgcaaagcacattctactgtagttgcgggcacatacccgaacgggcaacttctttgatcatccatatatacgttcattttcgattccctctctaatttgaatatgcggccaatacataacatattgccccgagactaataaaaggaccaaatggaattggctttcgtacttctatactgtttaatcccgataccaatcccgaaaaaacaaagactaaaacaagatgctaaaaataaaacgataaaaactcctttcactcctactataaatccaagtaacgaaagtagttttatatctcctccgccaagcccttctggatatatcttttgcatgcaatataacaaaataaatataacaccactaccagctatactatctgtccaagtaactaattgtacaaaaacactttcgagaatgagtaaaaaggcaaacgaaattaaaatacaatcaggaattaacatatataagtaatctgtaactgaaataataagaagcagcgaaaaaagggataaaataataataagctctcgttctattccaatcatatacactgtaagaagaaatatacctcctgttatacattcaaatgctacatacataattggaattttcctcttacaattcgtacaacagcctctttgtatataaaatgaaatgatggggattagttcttttgtccttagcacatatttgcaataatcacaatgtgaacgcggggtaataatagaagcacctaatggaaccctcatcgcaactagcataaaaaaagaaccaaacaccatccctgctaacagtgcatataaataagtgaacatcccttcctctcctttcccaaaaaacatagcaaaaaaaggagagaacttctacttcatattatcctttattctactaaaaagcaggccatttcctggcctgctttcccctcttttatacgatgaaataaactgcttttaatggtccatgtactccgacaacaagattcatctcgatgtcagccgagttacttggccctgtaataaagttaatacaagatgccgctgtctccccattttctacgcgtgagttcatatcctgaactgcttgtgtaatacgaggcacaagtgtttcacgtggaataatagcaaaatatacagtcggtaaaaagtgtaaagaacgcccttgacctttatgactttgtacaacaattgtaccagattcagctaatgtataatcactaaatgcaataccaatattcgctttttcagctaaacgcatattttcgtcttttctctctggatcccatacatttacttcaacatctcgttttggaagttcttctttaaataaagatgttaaaccatatgcatcaaaacgcgcatctgctgataataaaataggtcccccgccgttttccatgattactttttgaaggtcttcacctaaacggtcgtttgtcgtttctactacagttgtatgaatgtttgtacattgctctttaaacacttctagtaattcttcttgtgaataatcttttaacgtttctatattcacattacttttccatactggacgctctacaccttctgttttacgcgcgcgcccaagttcttttgcaatgttatctagaaaggcatcacggttttgaattaatcctgtcattatttatccccgcctttcttatgatctttataccaatcacggaatcgttctttacttggagctgggaattcacgaatatccgtccagtttttaagtggtccaacaccttttgatacacgattaccagatgtaaatggactcattgccgctggtgccatttttgaacccattttatataaagcagctgaagaagcacccatactaaacattttcatagccagtttttctgcaagtggtgcacgaccttcttgctcaacgatgacttgacgatgttttaataataaatcatgcaatggaatttttactggacaagcttctgtacatgctccgcataaactagatgcataaggaagctctttgtaatcatcatatccacctagaagcggtgttaataccgcaccgattggtcctgagtaaatcgatccatatgaatgtccaccaacgtgacgatatacaggacatacattaacacaagcagcgcaacgaatacattgtaatactgaacggaattcagatccaagaatttgagagcgaccattatcaacaacaactaaatgaaattcttcaggtccatcaacttcctcttcttgaattggccccgctactgttacataacttgttaatttttgacctactgcactacgacatagtaaaccaactaaaacatctaattcttccattgtcggaaccatacgttccatacccattaccgctatttgtgttttaggaattgacataacaagatctgcattaccttcattcgttactaaacaaagagagccagtatttgcaacagcaaagttacaaccagttacaccaatttctgcatccataaatttctcacgaagttgtttacgaacaaactttgtcatttcatacgggtcatcagaattttcataacctagcttttctttaaatacatcgcgaatttgcgttctatttttatgaagtgcaggtgcaataatatgtgaaggtggatcgttatctacttgcaagatatactctcctaagtcactctctaacacttcacagccaatctcttcaagcgcatggttcatactgatttcttctgttaccatcgactttgattttactatcttttttgcctgcttcttttttgcaacgtcttgaatatactttgctgcttcctctttcgttttcgcaaagtacacgtgtccgcctctttttgatacattttcacttaactgcattaagtaataatcaagattttctaacgtatgttgacgaatttgttcacctagttcacgccactcttcccagtttcctagttcatctgcggcttttaagcgattcgtatataaacgcgtttgtgcagaagatactgctccgcgcataaacgaatcttgaattccatcaccaacgcgatcattaaattttttctcactgattttcatagacatagcttatgttcccccttcatgagcgactattcagtacctcagcaatatgcattacttttacttcttttcctaaacgctcaatacgtccgccaatgtttaacaaacacccacaatctgcaccgattaaataatctgcacctgtttccattacactatctactttttcgtctaccatttgctcagaaattggagtcatcttaactgaaaacgttcccccaaacccgcaacaattttgcacgtttggcaaatctctcacagttaatccttttacatttgataataaaattcctggtgcttcttttattccaagcatacgtgtcatatgacatgatttatgaatagtagcgacccctggtaaacttgcaccaacatcagtaacctttaaaacatccacaataaactgtgtaaattcataagttttatcagcaactttttgtgcacgtttagcccactttggatcatctttgaaaacatgtggatactcatgaaacattgtcgcacaagaaccagatggcgtaacaatatattctgcatcttcgaaagtttcaatcatatgtttcattgcttcttttgctgcttctacatggccgctattataagcaggctgaccacaacaaacttgcgcttctggaaattcaatttcacaacctaaacgctccaacacttcaaccgttgctttaccgacatttgtttcaaacatatcgactaaacaagtaacaaataaagtaactttcataactattactccccctttttacaacttcaccaacaaacatatggtcatcagatgacttagcagagaagaaataggctcaaccatggcctatcctctccctcttctaaagaaaacgcttacttaacctttctctattttatcagaaaattaaatttttaaaagattaaattacgaatttatatcgtttttacctgtgacaatatgttctacatttgttaagtgatctagcattgcttgctgcgctaattctacatcttgttttaacaccgcatcatatataacttgatgctcttctataagtcgttctgatgtcgtttgttcaccatataaaataatgcgtcttgattcaccaatcgtttcagcaatcatctctgaaacatgattcatgagttcaagcaaaatgctattatgcgaagactctgcaattcccatatgaaattgaaaatcggctttttcgccagccttttcatcttcatgctctttgccatttcatctaaccaatgtttcatattttggaaaatatcttc

SEQ ID NO: 1202 - DNA, 4729 bp, Bacillus thuringiensis
ttctccaaattttttttttgtgttattcactagccttgtgatctatgcgaatatcgtcatcacctttactgatgtattctaatttcgctttcaattctgccccttgctgaccatctgatttaatttcttttgagcggttcagctaataagaaaaatacccaattaatgctgatgcgattgcgataattaatccaatttcaactgtcataattcccctcctttttaggcaataaaaaaagaccagctattgctgctcctgctctgtttctgtgttattttcattagttggtgttggcggttcttgtggaggatattcacctgtaagtttaaaataatcatttgcacaaatgttccgtttaacaactcctaagttcaattcatataatttggctccacaaccacataactcacatttcgttaaaaccctaaaaccaatagttccgtcagacatgtcccgccacacctcaactttactcgtatcattggaaacccctgcattatctaacatgtcagcaggtacttgtataaagactcctgtttccgttcgttttacgtctactattcttcccatataaggaagcgtttcaccttcttgaaaaggcatcatatagttaatatccatgtttaatccttcctttctatccaagtgcgttaaatttccaaccacttggagtactcgcataaaaacccggtccagcattaccgtctgtaaaacgaatatgaccccactgttggaatccaccgccacctaagttaattccctgcattgctcgtatattcctaaagattttaacttctttttcagtacttatatcaaacgtttgtccgtctggtgctggagatatattattattcacaccacctacagcaagtgcgttaaacggctgaataccatctgctctttctgctgcagcacgatcccaattatacatagatgcatatttgccactgtatagcgttacaccacttacacaaatcgctgtcccttgtctcatgtcagcattagcagaacaaactttaataatcaatgcatgttgttgcggaatatagtttgttggcactttgaaagtaaaagaataccttctgatttctccgtagaatgtagacggctcaggaaagtccatcttttgttcactcaatatgtcgtaacttacgttgtctcggaatttaacgcagcatacgtgtattctcggttttcctgtcttacgcacgccatttatcatagcagttctaaaatgagctgatgctgtatattcgttaccaggatgtataccgttattcacgattgcttctggatagttatacatatctacccttgcggcattcaccatttgctcgtaatcaaatatatgtgtattcttttctattacgacatttccccaggacttccaagtaagaccgtatccaccttcaaatccataataatcgttatgtccaatgtttttctttgtaacactagaaaagtcgggatctgctattaggtttcgtcttgatactgcagttgtttttgtgccccattcgtcttggaataggaagtctagcattttaacagttacaccatctttatcaatggttatcttatcaccatcaattctaataagattcgtatcaatgccttttgcagttaaccatttcaccattgtatcagcattaatattcagtttctcagcatcgattgtaatcttaccaggtgacatattaatagaagtaataataccgtcttttaaaatttgtgctaagatcccttcatctaatacctgtaacttcgattctgttttctttacataggcattataggtctcattaataaaactttcctgttttttggaaatgatagtaacgccttcttcattagtagcgatacttctttctaattcggttacttttttatcgtaatctttagttgctaccctattagcaatatcttctatcattttgtcagcatccgtttgatctttcggatgtaaccaaaattctgtagctatagtgccacgttgtaacattggtgcggcacaccataaacgcccatttcttgtaacgtaataacgccatctcacaaacgctgcattggctggcgctttatctgtacatacagcacgaatccatgtatgatttacaaccttgatattcgttctagctgttttaatgcgagtttttttgtcagcagtccaccattcaatttcaataaatgcaccgccactatcaataggtgttttcccatcagtattgaaatagcctgatgcaacaaagtcttcgttaacctgacactcaatgaattgacttgtaagtccccaccaacgatcttgagtctggccagtaacggtaattgcgaatgtactcatacctttgtattttaaattcgtatcaacagatccagttgctccattaccactattccaaaaccaatatttctgtcctaacttaaaatcagcatcacgcaactcgtttacagtacctaaaccacctacataattctcaacatcttttatttctacttttccttccagagcttttgcagtagtttcccaacccgctttagcttcttgtaattgcgtaccttgtttggtttgtatttcttgtatactagtaacattttctttaataccatctgctgttttctctacagtagtaacacgctcgctaaaatcaacttgtgttttttctaccgttttgatactttctttgattccatccacacttttctcaatctcggttgttttcttgttgaattcctcattcgttacttggtcttctggtgccggtgtccatgcggtaggtactgtgccaacttctaatttaggcttttcaattaacacgtctcctgtgaaatcacgtcctaaagcgtaaactaaaatctctttaataggcttatccattactacagcactcgctgtaaatctttcctgtttatactgtttacctagtgttagacggttttctacacggcagctaggataagcaaatgtattgtctgtaaaagtaattttcacttcgaaaccaacccatttattcgttgtaccccatgcagtaaccttacctgtaaataaaaaactcatagcaatattcttgccctgaattaaagtaaccgcatccttagctacaccaaaataggtatgaggcttattttctccagtcttcactgaatgggatttagtagctgtttctagtaatagatttcggataccaatttccgtattatcaactttcttttctacactagttaacttttcgatgatttccccagctttttcttctatttcagtagttgttttctttagatcatttgttgttttctgtacctcagagattttctttattgtgccatcggaagtctctactactgtatttaatttctcagtgatctcaccgttttttttcgttaacgagtcaatagatttagtaaaaccttcgttggtttgtttcatttcagagacagttttgtcaatttcaccttgagagttttgtacatttttaatagttaaagaaacttcttgaaggttttctgttacttccttgaattgaccagcagtttcattttgcgcttcttccactttcttatttaattcttcttttgtaagttgaatatccttattaacctgctctagtgtatcttttttaattgattccacatcaggaataagaagctcccaacctttaccgttccacacttttagaacaccaggtttaccgttactaatatctcgccatatcgtcttaccaattttaagattcgttgttggtggattcacagcctcgatgatttctactgtattattcttcaagttttcttgaactttctctgctaactctttcgctgctttcgactctttctgtgcttcatttacttttttatcagtatcttgtacaagttcttctaatctatctaacaattctttatttgctttatttcctaaagtagcgcgaatcctattgtacatttttcttaactcttcgttcgcatcagtaatttcatgataatcaccaaacacgtattgatcttgtgaaggatcagtatgtgattcatcaccaacgattgcccttgcttcaaggtataacttaggtgtgaatcctgtatctttgattcggattgtatcgccctcattaattagttcatgtgctagtccgaaaatacgtccaatcgattgcgcttctacttcgtatgaaacagaagatacacgttttgctagctctgttttcataagagtcagtaaacgttctggtgtgatgttttcttctgtttccggagtatagaaaccaaatttatgctttccatgttcattccaccgttggaacgcatcattatcaacaatgtaaggaagtccgttattgatactctcaattgtgataagtttatcaccttcatctcgtacaaaaccgacaagtgctgtgcaaatatctcttgagtgctcaatacgtctaacaccaactaaatcttttcctagcactacttcttttccagtttcttggccacgtttccttatcatatctacataccagccagtgatttgagaacctactacttcgacacgatattggatttctaactcaaataaagtagcgattttctttaaaaaagcgagcggatctataaattcatcaatagtcattgtatggaatgaaaaataatcgggtttttcccacgtttccactttgaattccgtagagcattatctattaacgttttaactgtttctctatctatgcttagtggtttatgaacccattcttg

SEQ ID NO: 1203 - DNA, 6453 bp, Bacillus thuringiensis
atgacatctttcaatacgtacaaattttatttaaatggagaatggagagaaagctcttcaggagaaacaatcgaaattccatctccatacttacacgaagtaattggacaagtacaagcaattactcgcggagaagtagatgaagcaattgcatctgcaaaagaagctcaaaaatcatgggcagaagcttctctacaagatcgcgcaaaatatttatataaatgggctgatgagctcgtaaatatgcaggatgaaattgccgatatcattatgaaagaagtcggtaaaggatataaagatgcgaagaaagaagttgttcgtacagctgacttcattcgttacacgatcgaagaagctttacatatgcacggagaaagcatgatgggcgatagcttcccgggcggtacaaaatctaaacttgcgattatccaacgcgcaccacttggtgttgtattagcaatcgcaccgtttaactacccagtaaacttatctgctgcaaaacttgcaccagcattaattatgggtaacgctgttattttcaaaccagcaactcaaggtgcaattagcggtatcaaaatggttgaagcactacataaagctggccttccaaaaggtcttgtaaacgtagcgacaggacgcggttctgtaattggtgactacttagtagaacacgaaggcatcaatatggtatcgttcacaggtggtacaaacacaggtaaacatttagcgaaaaaagcttcaatgattccacttgtattagaacttggtgggaaagaccctggtatcgttcgtgaagatgctgacttacaagatgctgcaaaccatatcgtaagcggtgcgttctcttactctggtcaacgttgtacagctattaaacgtgtacttgtacacgaaaacgtagcagacgagcttgttgacttattaaaagcgcaagtagcggaactatcagttggatctccagagcaagatagcacaatcgttccattaatcgatgacaagtctgctgacttcgttcaaggtttagttgacgacgctgttgaaaaaggtgctacgatcgttatcggtaacaaacgtgagcgtaacttaatttacccaacattaatcgatcacgtaacagaagagatgaaagttgcttgggaagagccattcggtccaatccttccaatcatccgtgtttcttcagatgaacaggcaattgaaattgctaacaaatcagagttcggcttacaagcaagtgtcttcacaaaagacattaacaaagcatttgcaattgctaacaaaatcgaaactggttctgtacaaattaacggacgcacagagcgcggccctgaccacttcccattcatcggtgtaaaaggttcaggtatgggcgcacaaggtattcgtaagagccttgagtctatgacacgtgaaaaagtaactgtattaaacttagtttaatcttataaaaagaagctgatctataaatagatcagcttcttttctatataaatacttccaaaaaacagcgtatttcgttctacttccgatttggttttccaaatcgaactaaaacatgccataataattttaattcctgaagcacttcttcataagttccacgatcactccaagataatggattgcatttcaaatctactacagcagagccaattatatttgcatcgatacaatgattccgtgcaatgcgtcttgctaaagatggcatttttgaacctctaaaatccattggaacttcgtctaccataagtacaaaaccgatgtgccaatacaaatcaatcgcatacttcaggcaaatttcttctaaaactttccctacatccgtacccttaaatgaaggatctgcaacaagcgcctccacgtcttctttaagagaaatctctccatgaatctgcgcttcaatataatgattaagattacgggctggctctttgcttactaaatctataaacggccttttcaggttagctagtaaatgattaattaatattgttggcgtcaaattcccttcaccaattgcaaaatctcttacgaatgtctcttccaaaagagcagctaaaatcatatcaaactcctcataagtccccttttctttcggatcttgatgcgaatctaaatatgtatatgtagagcgcgaagaaacttttggagataagagaaaataacatgaaccaaaacgcggagccggcccatctggatgtaacattaaatttagcgctccgtattttggccgttgatcattcgttacgccttctaattgatatgcccctccaaatattctcttttcccaaaggtcacgttcaccaccagggtaagcagatacgcttccattagatagcaatgtttcaaactgacttttatatactccttgctcaaacagtgcttcagcaacacttttcatattcgaatctagtctgtctggatgaaagtgtaaagcaatccttgcatgagattttaaattagcgacagcttcttcaaatatttcatctgtaatatttgacattttaagtatatgattaattgttgctttagccccacgtttttcgttctctgcatattttgaaatatactctaaagcaaataattgagaccttgataattccataatcaaatctcccctttaattgaaatgcctttaaacacttcaattaaaagcttattctttccttcttatgaaacgaacctcatttattaaaaaaagtaatttactaaatcttaattatgtatacacgcatttttcataggcaaatgtacacattctacagaaatttgataccctagccatcgctcagcgatatgttcaaatgataaaacagatcccgttgtaaaaaagcgatgcttcggattcagattgtcagacaaaattcctttgtgctgtaaaatagtacttaactctatcgctgtttcttctgcagaactaataatcgttacagcctctcctaactcacttttaatcacaaactcttctctataatctgattattactatatccattgacggataaaaattcatttgttactcttaaagacgttaatttaatatttaaatcctcattcgtatctcggtgaggtagaggttgcaatcattaagagtatcatttcaggagatgtagtggcattgatgaaggaatgagaaaggaatggttgccgaagtaagtcgtgtccaccatgcacgcttgctgggtctgcatttaataagtgcagaactgtcacaaacgtttcgtttgtggagagctatcgagaggtatgtcgtgggtttcttataagatagaaagcatgtagcggcagattacgtgctttttttgttttgtttgggacttctcttcctgactcaggaagacatacatatctcctcgcttgacttggttatactaactttggaggtatttttctatgcaacaaaaaaaatggggcttttgggtactaacagctttcgttgtcggtaacatggttggcgctggtattttcatggtaccaagtacgttggcacaaacagcaagcccactcggtgtcactttagcttggttaactacagggtttggtgttttaatgctagctcttgttttcggtaatttagcaattcgtcgtcctgatttaacgacagggccacaaagtcatgcatatgctttattctcaacaccaaaaaagaaaaaaatggctggcttcagtatggtatggggatattgggttgcaaactgggcaagtaacgttgccatcattacatcatttgcgggatatttatcactcttcttcccaattatgaaagatacgcgactactattttcaatcggctcgtttaacgtagaagtcggaaaactaattacatttacgatttgttccatcttactttggggaactcatattatattaacaaacggtgtaagcggagctggaaaactaaacttcttagcaacaacaacgaaagtaactggattccttttattcatcgtcgttacgttatttgcattcgaagcttctaagtttggacaatggtacacaccgatgattgataaatcaggtgcatcacatggtcttctttcacaagtaaatttagctgctcttacaacgctttgggcgtttatcggaattgaatcagccgttcttttatcaaaccgtgctgtttctccaaaaacggtaaaacgtgcaacagttgcgggattacttattacagttgcgatttacttaggaattacaattttaacaatgggtgtacttcacgttgataaattacaagcttctgaacgtccattagcagatgcactaaacgctgcaatgggtcacggcggcgggaaattgatggcattacttgctcttacttccctgtttggttctatcttaggctggattttattaagctcagaagtaccttatcaagcagcaaaagaaggtttcttcccttccttcttcacgaaaacaaataaaaaaggaagtccaatttactcattacgattaacaaacattatgtcgcaagtattcctattctcaacattatcaggaaccattgcggaagcttatacattcgttattaccgtatcaacactggcctacctcattccatatctcgtttcaccaatcttccagttaaaactagtcgcaactggtgaaacatataaaaatgaaatgcgggcaagaattacagatggcatagtcgcagttatcgcactttgctacgcactatgggttattaaaactggcgcatccgatataaaaacgttccttctcggaattggtttattcgtaattggatttgctttctatccattaatgaatcgtgatcagaaaaaaaataacgaaaagaaaaacgggcaagttgcataacgcaatttgctcgttttttcttttgtaaaacatatataatagaacaaagaggtgaaaaacatgtcaatcgaatcgctatggagcagtcgcttccaacaacatattcaaaatatcattacatactttgcacgtatgattaacggtttactatatagctttatctttatttcatgcgttggtgcatattattatgctcagtttctaaaagcatctccttctaaaggaatatctttaataattataacgattgtacttacattcattataacgagatgccctatacgtacatttattcaaaaacctgatgctgtctatttactagcactagaagagaaattaacatcttatttcaaaaaatctcttctatacaattacatcattcagcttttcccattgttatttacgttccttattctcgttccacttgctatgcaatcattgcaattaacggtacctttcttatgtacaatctttatcgtgttaatgattatgaaagcctggaacatgtacatacattggatgtggcgtgatagtcacgaaaaaaatatatggctgatcattcgtattacttgtaacgccctaatcatttacatgctgttttattccgcaaatgttctcatattgggcggactactcttactacttgctttcctacttctatatacgaaaaaacagcctacaaaacgaataccgtgggattacataatcgagcaagaagaaaaaatgaacgttcgtttttatcaatttgctagcattttcaccgatgttccgcaactgaataaacaagtaaataaaagaaaatggcttacaaattggattgaacctttattacataaaaaacgagcaactttcttctacttacatacactagcatttttacgtggaaatgattatttcggtatatatattcgcttaggattgatcggtgctttcgccttatatttcataccaaatatatacgtaaaaggcgctatcgcttacatcgttttatatatgatctctatgcagcttcgttcactatggaaatatttttcgggaaatattattgtagcattatatccgattggtactgcagaaagaatgaagcaatttcttagcttaatctttatattgctaagtattcaactcattgtattttcgagtgttatactcattgctacaggtcaatttttacatagccttatcattatgattgtcgggttactctggatcaaatttattattgtaccaaaaacgaagcaaagaatttccgcattttaacgaaaagaattatcttaaaagccaaggagaaaataaattttctccttggctttttatttttcctcctcaaacaagaaccatttaaacaaccggtattttatgatttttacatacaaagacgataatacatgtttacgacctaataaaaagggtatctattaattaacagagtaaaggagggtcctatattgtgaataaaaaaacggaacaattgaagcatcacgttactgacaatcaatgcaaacatgctttaacaacaaatcaaggggtaaaaatagctgaagatgaattttctttaaagatgggcttaagaggcccaaccttaatggaggattaaaacatttcgtgagaaaatgacccattttgatcacgaac

SEQ ID NO: 1204 - DNA, 8299 bp, Bacillus thuringiensis
tgtttacaaaggtttacttttccataatgcagaaataatatatttcaaaaatgcagccgcttttttatcaaagcgtttattgagtccttctggactcataagagtgcctgtgccggcgtgtaattgactgcatagtcgaacgagagaatcactcgctgtacgttgactgacccagatacatatggtagctaattcatttcctgaaaactttcgttttctttttacaaaacctaattctttagcgagttcttccaaaagagaaggggttaaatgacgatacagctcttcagaaaatagttgtaattcatcttgaattgaaagattcataaaaaatgtcatcctttctagctagctttttagaaagaataacgttttttgacacttgggggtagtgcaaattcttaagttgatgggcatgtgctacaatcccaaagaatacttcttttaaaagaaattattttattattaatccgacatttggagagaaacttcttggtatattcccttatcttgcagttgcagtcttaattggctttactttgaaagagcaaacttcttcagctacattaattacgggaaattgtattgcttttgtatttgtactgattcgtcatacaatcgtacgaatgcaaaacaaagagttaactaaaacattaaaagtgtttaataatcaattagaacaaacagtatctcaaagaacaagggatttaataaataaatctaatgatttagtaaaaaatcaagagagatttaagtcattatatgagtatcatccggatcctattttaacgattgattcaaacggtatcgtattaaatataaaccaggctggaagtatgttattaggaaaagaaagtgctgtattgatagggaaagagtgcttctctatttttttagatgaagataaatctgaattggaagcagctataaagaaagggaaacgatgtagttcatcttcactacagttacgtgtgaaaaataacaatgagaaagatatactcttttggtatgtcactatagttcctattatgatagaaggacaaacctttgggagctatgtaatggtaaaagacataacaaggatgaaacaacaacaggaagagataaattaccttgcattccatgatacggtgacggagattggaaatcgtatattcttccaacaagaattagatagatctattaagcgtgcacaaaaaacacaggataagtttgggctcctgtatattgatttaaatcgctttaagactattaatgatacattgggtcattcgattggtgacaaggttttaaaagaagttgccaaacgttttaggacatgtctgtcaccgactattcctctagcaagaataggtggtgatgagtttgcgatcattgtccataaccaaacagagcaacagctattggatttgtgtaaaactctatttcgtataactgaagaaccatttgtagtaaatcagcatagtttttacttatctcttagtataggaatagcagtgtatccatttggaggaataaatactactacacttttacaacacgctgatatcgctatgtatagcgcaaaggaaaaaggtaacaatgctgtttgtatgtatgacgagacattatctcaaaaagtaactcgtcgattacgattagaacaggatttaccaaatgcaattgaaaataatgagttgtttttattgtatcaaccacaaattgatagtaaggcaggtaaggttattggtgcagaggctttaatacgttggcaacatccagagcttggactgatttctccttttgagtttatacctatcgcagaagaaacggcgcagattatttcaattgggaagtggacgttacagaaagcgtgtcaacaactgaaagaatggcattctgcgggcttttcaaatctaaagatggggataaatttatcagctatagagtttgaacagaaagattttgttcaaaccattatatctaccatagaagagataggagtacctgctaattcgattgatttggaattaacagagcgaatagcaatggtagatgaaaaggaaaccttatcgaagttaaaagcattaaaatcatatggtgtacatttatcaattgacgattttggtacaggttattcttcattagcgtatctgcctctttatccaattgatactttgaaaattccaagagaatttgttaataggattggaacttctactgatggagatgaaattatacaaaccattatttcacttgctcatactttaaacatgaaagtgatagcagaaggggtagaaacgaaggaacaattaacagtgttacaacgtaatgcatgttatctaattcagggctattactacagtaaacctgtaaatgaagatgaatttattggttttttaagtacaatacaaaatgaataagtgaaaaatcagtatatgtatgaaataaagtgaaaagacgatctatccatatggatttgaacgtcttttcactttattttcagtagttatgcagcaaggtttcagcctttgaaagtaaaataagtatctatattccttgtatttagggctaatgggatatgaggtgaaagttgcttcttgtgaaaccgcattagggacagctcgtatattcttaaagcaatttgaaaaagcggaagaacatttcaatcgttccattgaccttttgcaaaaacataatgaagaaaaattgattttaatagtaaggcataatctaggactattatatgcaactcaaaatttatctaaattagcaattcgtcatttatcagaagtcacagagaagaatattgcccattttaaagcagtgttcttacaagcgcgtgaacactataagctaagaaaaacaaatattgtaaaagaacttattgaaaaaggattagcagtttgtatggaattaggaaatgaagagtatgtatatcatttcaatattttacgttctcttaatgaagatgaagcaattaaactcttagaagaagtgaaaaaagtatttcttacttcgaaaagcaaggtttatgggatttcgtagaagaatatgcagatctaaaaaaggaagaaattatacaataatcacatgctatcatttttaatagctaattaacaaaaggactccaattatggagtccctttgttaatgggataatgctttagtttatctaattataacaatatttgtaaaaagtgtaaaggggtcctagtttggagggggaattatttaatcttttttatttaataaagggatgatatttagttatctgcgcttcttaattatgttttttatcacaatttgaagtaaatttcagttaatcttatttattttataggaattataagttatactaaaagtaggtgcaaaatgtaccatttgaaaaagagtgcattgcaaaaaggaatccgtaaaggattccttttttgtttcttttaaaatgaagcaacgttctaattatctctttctttttttatgaatgaactaccaatgtataaatttaaaaggtatttttggaaaattgccatattcctgtaacaaaacaaaggtatgttatgtgtgttaaatataaagagaaagaaggaaaagttgtgaaaaaagttttgccaattgttgcgttattaggcatgatgagttttggagtacaggaaatgaatgtaagagctgatacataccacaagggcgattcaaaaattagtttttgggattcgaaaagaaagggtactaatttcatgaatagtacgtcattacctgaaaactataaaagtgcaaaagaagctaatattgaatatgtacgtttagcacctgataaatgggtaaaagataaagattttctatttgaggataaaccagatacttctggaaaggattttctgataggtaatgcagataactatcggggattagtaaaggaagatctagaaaaattaaaggcggatttagatgccgcacaatcacaaggaatgaaagtcgttcttacaatgttatccttacctggtgatcgatggcgccaatttaataataataagaatgacgacagaatatgggaagaagagaagtatcaagaacaagcaagtcaattttggaaggacctcgctctggaactaaaagatcaccccgcggtggttggttataatattataaatgaaccacatccagaaacagctaaaaataatagatataatgatttttggacggaagattacgagaaatggtatgcaaaagtggagggaacgacagcggatttaaacagattttatgaaaaggtgattaactccattcgtgaagtagaccaagaaacaccggttattttagattcaggtttatatgctactccatgggcctttaaatacttaaagccagtaaaggataaaaaaacgctttacgcatttcatatgtatgaaccatatgaattaacgagtcaaggtgaaaagaaaaataaagaatatcaatatccaggattagtaaaagtaggagacttagagaaacctgtaatgtggaataagcagggattagagaaatttttgaagccaattcaacaatggtctaagaaaaatcatgtaccatctaatcgaattattgcagaggagtttggaattaaccgtactgttccaggtgctacccaatacatgcaagatcttatttctatctttaaccaaaaaggatggcataaatcattctatgcattccgtgaagacacatggacagggatgaattatgaattgggaacagaaaaaataaaatgggatgaagagggtaaaccgatgcgtcaagataattcactctgggatgtaataaaaaaagatttacaaacgcgtaaatagtttagaatattaggcttaaggactaaatgtaagcatctaattcaaatagaattagatgctttttatttcgaaaaaagatggagttgaattaaagattccatcttttcttttgcataaagagtaccaatcaggtttatttacaacgaaaaataagatttttagagaatagcttagaaaaaaattgtggaggttcaaacaaatgtggtcacaattgtttaaacctttaaagtaaaaaaaatttatgaatttttcgtgagatcccaacctttaaatgttgtaatttatttacttatttctccaattggatatatttctctaattggatggaagtttagaatacagaatcaaaacataataggctgttatcgatgagtttatcgtaaagttgttatttaatgtgtcatcaaataacatttatatacaataatacataaagaaaaggagatatttatgaaaaaatatagagtaatagacacaatttaaatagtatgaatagtttagattgtaaaaacatggagaagaaaacaaaaaaacttaagagtactaaggaaaaatgagggagataatatggggaataattcaaaacataaaactagaaaaatacttgcggccactgctacagtaactatgcttgcgactggaatgattttttcatcggatgtctttgcggagcaaaaggagcagcaaaaaaatttatcgacatcattgcaaaaagaaaagtcagttaaatcagaaaatagaacatttacagtcccaggaaaaggggatgttgaggtactgaaacaacaggaaagaaaaagtatggcatttagtccatatgaaccaactggtttatatgcaaagccaaatgaacaaataacgattaatgtagaaggtaatcaagatattcaggtatatattggaacttattcgtatgatgcttcttggagagaagattctaagataaaatcatttacattaaaacctggtataaacacaatccaatctccaagtggggggatgatttatttttataataaacaacaagggggtaccattcgaacaacaatcacaacaggtggaacgactacgcctttctttgaactaggaaagcatacgaaacaagatttaataaacatgctggaccaatatcctaatgcacatgcagtggagttaaaaggagaacgtgtattaattacggccagccttgcacgtgttaagaaatatttgttgggttctaatacagatcctgtacaactcttaaaaaagatggatgaagctactcgaattcaagacaaagtagctggattatccgaagaacaagtagataaacattatgttcattacgtagaagaaaatcattctcccgattattatatgtatgcaacttcttatcgaacagcatatgtaggagatgcaatccaatacgtgttagatattaataaatttataacagatggttggggcccttggcatgaggcaggacatttgagacaacaatcgccctggaagttttataatatgacagaagtacaaaataatatatacagcctttctgtagaaaaagcatttaatcaaccatccaacttagagaaaagtggaatttatccaaaagcatttcaatatctagaacaagtgaataaaaattatgatgaaattagcgatgtttttgtaaagcttgttatgctttggcaactacagttagcgtatggagaggatttctatcctaaattgcatcaattgtatagagacatgccttcaggtgaacttccacaaactgatgataataaaaaacaattatttatgatttcagcatcaaaagtagccaaacaaaatttgattcctttctttgagaagtggggattacgtccaaataacgataccattcaaaaagtagctgcattaggatatccaattttaacagcagagatttggaagagtacggattctaatccaattaaaccagatatgcctaatgtaaataatattttagaaggaaaccagtttgcatggtcgctgaaagggattagtgatttcgagtttgctaaaattaatttcaataaatcgacagaagaaatgcaagtagacttaaaagcaggcgtaccgcatcattattttaatgaaacatatgcgagtattaaagtacaaaatgcatcagggaaagtagtatacaataaagacatttatggaaataaacaacaaaatgctgaatcgcaaaaagtttcagtcaaagtaggagattatattgagttgacacacctagaaggtgtgcatagagctactttaataaatgtagacagcagtaaacaagaaagttttggaaaaaaagtcatgtacgaagttacaaaagaaggcttgaagattgtagaaaaaatgccagaaacaacggttttagatggaaatcattttaggtggtctttaaaaggatatagtgatagagaaatcgcaaaagttgattataataggacaacagagaaaatgcaggtgaatttagaagcaggcgtaccacattcttactttaatcagacatatgcaagtattacagtaaagaattcaaccggtaatgttgtgtataataaggaaatagtgggaaacagacaacaaactgctgaaatccaaacggtgtccttaaaagcgggggattacattgagtttacccatatagaaggggaagcagtaaaggaaaagacacgtgctacacttcttaaccttgagaataataaacaagaatatataggcaaaaaaagaacctatcaagttacttcaacgggattaaacaaaatagattaacatgaagaaccttctaattattcgttagatgcaaatagtcgttcattatgaacggctatttggtttttatttaaagaaaagtgaaatgaaaatactctctcttttgtatatactctccttgctatcaactgctatatttgtttatcaggggggattttaaaaatgtgcttgagaattgataaatgtttaagtgctatagatttgagaaaaaagaaacagaatagtaaggtatttattgataaaacccctcttccgttacaatattttacatatttggtatgatgtatatgagttctatgcatattaagggaggaatgggaatgaagaggttcataacacgtgcaagtggtaatacaatctcaaaaaagttagttttaatgatgttgccgatggttttaatgatattgatgattacaccatcgaatgatgtatcggcagcaaatctatcaagagcaggttcactaaaaggcgtgaatttatttaatggaagttggacagttgctatacaggcagcaaatttacaatatgtttctgctgagccatcgggtaatgtagtagcaaatcgtaatgcagttaatgaatgggagaaatttgaattaattccgactggggaattatatacgtttgctttaaaagcaaaaagtaatggaaagtacgtttcgtttgagccaaacggtagagtagtagcagatcgtacatcaattggggcatgggaaaaattt

SEQ ID NO: 1205 - DNA, 8786 bp, Bacillus thuringiensis
ggatgaaagaagagatggtgtatggggataggagagagaatgtgaaataacctctttatttagatcgggatatataataaaaaagcattgctcttgtgcaatgccttttttatttggttcatataagagttaaataattcataacatatttcttttgtcattatataccttttttgtcagcttctatttaatgtcattgttccgtgtttatagtttcacatctatgatgcttttggaaacatgtatccaccaccttaatgcatatttatttccctacaaaagcaaacttcaattttaatagacgtgtaaaaatgaagtaacttatggtagcgaataggaaaaatccaacataataagacagaagtgcatctcgtccgcctaatattctaccaccaagtagtccgaagcatagaacagtgcaaattatgaaccatttttgcaagttaggaaacaatagtatttttccactttgttcgtttggtgtacgtgtgtatagaaaggttgctattgataaaaaggtaatgatgtaagcaaatggtgttaatagtgtccaaggagaaggtacagaaatacgctccgtaggattgtcctgtggtacactagaaagtttattgccatagtcatcaaatgtttctatcgggtggtaatcataagtaatagaaaaatattctaatggtgaaatgatacctatatgttgtaagtactcatgagtatggtgctctatttctcccattgcatctacagaccattgtgtgtgtgaataaatgaatccggaaattaacaatccaaaaccgtatggtaaaaataatagaatgatagttaaaatactttgagaaaatatatgtccagtaagagtcccgataaataaggcgaatgtataaatagcgataagtacaaccgtagcatatagaaagtaactatagaacggagcaaaggtttgatactcattgtgaaacgacatgttctttattccgtacatgctaatccagcaaacaatttgtactgtaataatattcaaaacaccaagccaccattttgttaaaaaaatatcctttcgtttaaaaggcatcgagaatagaaaatcagttgattgattattacgttcccatccaattaaaagacaagcgagtgcaattagagtagctccttgaaagaagacggcaccatcagatgtctgaaaatagtaggagtagtaatatgcatagtcaccaaacttcatttttgatagttttagttgcatttgcgcttcttgataatatttataaggtagttgatataaactagttaaccaaaataatagaattatatattttccttgcttccattgcctcatccataaagctttatgaaacatgtgaatcctcctcaaatgtagtgataaaaatatcttcaagtgacattgttaattcttcaataagtataggttgctctttgtaaaacttctcgagtgttgtagccacatttccctcaattaagattgtatatacttttcctgtttggtttaatattttaatattgcttaagttttctagcttttgaggtaatgaacgttcgtaagctacttgtatttttgcaaatcgtgattttgcatcgtctagtgatgtaatagacgagatagtatggccttttaatataataattgtatctgcaatttgttctacttcatctaaatggtgagtggagatgaaaatggtaatctctttttctgcaacttctccaacgagaaactgtaaaattttccttttcacgataggatcaagtccatttgtcggttcatctaaaatgatatattctgcctttgtagaaacagctaaaatgatggcgagcagtgctttcatgccttttgaatagctacgaattcgtttgtttggtaagttaaaacgttctaacagttcatagaaatgtgtttcatcaaatgcggtataaacttctttataaaactttacgatttcttttatcgtatagccgttcagtatattagtagaatcaggaacatatacaattttttgctttatttcaggaaactgatgaatgtttgtatcttcatatgtaacagttccctcgtctgggtctaaaataccgaccatcgttcgcaataaagttgttttccccgcaccgtttcttccgagtaatccgatgatactccctctttgcaatgtgaaagaaacattgtctaaaattgtttgactatcaattgttttcttcaagtttgtcactttcaacatccgtattccctccaatctctttatagtatgaatctatccaatcatgaattttatctttcgtaataccaagataagaggcttctaatagtaattgatgaaattgcttttcaaccatagcgattttcctttcgtctaatgttggggtaatcgattgggatacaaatgttccttttcctcgtaacgtttcaataattccttgtcgctctaactcttgatacgctttactcactgtatttggatttataacgagtaaagaagcgagttcgcgtacagaaggaagtttatcacttggagccaacatgtttttcaatacgagttcttttatattttgaacaatttgttcccatatcggagtgttgcttcttgggtcaagttgaatatgcaagagcaatgtctccttcctcatatgtattaagtgtactactgtgagtaatacacttaatacaatataggggacgaatgtatttgtcaactgaaaatgttagaaaaatttggtattaaaaaaaggtaaattggaaaaaataggtctgatatagaatggagggttagtcatgaagcgagtttttggaatacttgtttgtttcatgttattgctttctggaacttcagtgagtttcgcacaatctgagaaaacgaagcaggagaaaacagaagaaacaacaccgaagttagcggaacaagcgtcgtcagcaatcgtaattgagcaagatacaggtaaagttttatttgataaaaacccaaatgaaaaattaccacctgctagtatgacaaagattatgacaatgcttttaattatggaacaagttgaaaaaggaaaactaaaactgaccgataaagttagagcgagcgaacatgcagcttcaatgggtggatcgcaaatctttttagaacctggggaagagatgactgtaaatgagatgttaaagggtattgcaattgcatctggaaatgacgcatctgttgcagtagccgagcatatcgcaggttcagaagaaggatttgtaaatatgatgaacaaaaaggcgaaagatctagggctgaaaaatacacattttcaaaacccaacaggtcttccggccaaagaccattattcgacagcaaatgatatggctataatggcgagagaattgatgaagtatccacttattcgtaaatacacaggtaagtacgaagattatttacgtgaagatacggataaaaagttttggctcgttaatacgaataagctagtacgtttttatcctggcgtagatggagtaaaaacaggttttacgacagaagcgaaatattgtttaacagcatcggctgaaaaaaatggcatgcgtatcatttcagttgtcatgggagcaccaacatcaaaagaacggaacaaccaagtgacgaagcttcttgactacgcatttggtcaatatatgacaaagaaattgtatacgcgcggcgaaaaaattaagacagttcaagtagggaaagggaaaaaagaaaaagtagatttagttgcatcagataatgtttctcttcttatgaagaagggcgagaatatggacaaggtaaaacaagaagtaattgctgaaaagaaagtaaaagcaccgattaaaaaaggtgacgcgcttggtacacttgttattaaaaaagataaagatgttttattaaaacaaacaattgtagcaaaagaagatgttgctgcagcgagctggtgggagttatttaaaagaagttttgggatgttttcaacatcaaaatagcggcaaatattttgccgcttttctattcgtatgtaagtgaataatgctgaaaggtttcactttatgacgaaatagttcttcttttgtcagcaggaaggattcttattttgtatcacgaaaatctttatgtatgtgaataagtaaagtttgagcataaggaggaaatcgtgtgagtctttccatgcaattagaagtaaaacgtgacgtcctatgtgtgagactagagggtgaattagatcatcatacggctgaagagttgcgaacgaaagtaacagatatgattgagacacatggtgttcatcatattgttttgagcctagagaacttatcttttatggatagttctggtctaggtgttatattaggccgatataaacacgtaaagggattaggtggagaaatggttgtttgtgcaatttcaccgcctgttaagcgtttatttgaaatgtcgggcttattcaaaatcgttcgcttagaagaaagtgaagcgcacgcgctcgcgacgttgggggtggcatagatgagaaatgaaatgaaccttcaattttcagcattaagtcaaaatgaatcgttcgctcgcgttacagtagcggctttcattgcacaactagatccaacgatggaagaattaacggagattaaaacagttgtgtcagaagcggttacaaatgcaattattcatggatacgaaggaaatgcagaaggtattgtttatatttctgtaattttggaagaagcaatggtgaaactcacgattcgagatgaagggattggaatctttaacttagatgaagcgagacaacccctttttacaactaaacctgaattagagcgttccggaatgggatttactatcatggaaaattttatggatgaagtagaagttatttcaaacgaatctttcgggacaacaatccatttgacaaaatacttatcaaatagtaacgctctatgcaattaaggagaatagcctatggacatagaggtcaaaaatgagaagaagaaacctcagttaaaggaccacgagctaaaagcgttaattcaaaaaagtcaagatggagatcaacaagcgagagatacaatcgttcaaagtaatatgcgcctcgtttggtcggttgtacagcggtttcttaatcgaggatacgaaccagacgacctatttcaaattggatgtattgggctcttgaaatcggtagataaatttgatttatctttcgacgtgaaattttcaacatatgcagttccaatgattattggtgaaatacaacgtttcttacgtgatgatggatcagtgaaagttagtaggtctttaaaagaaacaggaaacaaaattcgaaagatgagagatgagctttcgaaagaattcggaagggctccaacgattaatgaagtggcagaggcactagaactaacgccagaggaagttgttctagcacaagaagcgagccgggccccttcgtctatacatgaaactgtatatgaaaacgatggagatccaatcactattttagatcaaattgcagatcaatctgaaacgaaatggttcgataaaattgctttaaaagaagcgattagagaactagatgaacgagagcgcttaattgtatacttgcgttactataaagatcaaacacagtcagaagtagcagagcgcataggcatttcgcaagtacaagtttcaagacttgaaaagaaaatattaaaacagatgaaagatcgaatagacgaataattgtctattcgatttttttatgccgttaataggagagagatgttaatttttgcaaaaattaacagaatttattgataatttagtcaatttaaaatataatccaagtatgaacttgtcataaagggggaaggaaacatggaaacgaggcaacaatggggaacgagagctggatttatttttgcagcggtcggatctgccgttggattaggaaacatatggcgttttccttatacagcgtatgaaaatggaggaggagcattctttttaccgtacttatttgcattattaacgactggtatttcattgttagcgtttgagtttgcccttggtcatcgtcatcgtggttcagcaccacttacatttttccgtattagcccgcgtgccgaatttattggatgatggcaaatgtgcgtaacatttatcgtttcaacatattatgcagtgattattgcttggtctatatcgtatacatactttgcaattactggagcatggggaaaagacacgcaatcatttttatttaaagagtacttacatgttgcagataagccagggcaatttggaggacttgtaccggaagtattaattccattagttctcgtttggattattgtgcttggcgttgcatttaaaggagttaaaaaaggaatcgaagttgttaaccgtatatttattcctttattagttgttatgttccttattatcgtcgttcgtgcagtgacgatggaaggtgctatgcaaggactagatgcattctttaaaccagattggagtcgtatttttgatgggaaagtatggcttgctgcttatggtcaaatattctttagtttatctttagcatttggaattatgattacgtattctagttatttaccgaaaaactcggatacaacaaataatgcctttattactggatttgccaactcaggatttgaattattagcaggtattggggtctttgcagctcttggatttatggcgaataatatgggagtaccggttgataaagtagcaagtgctggcgttgggcttgcgttcgtagtatttccgcaaattattaatgaattgccgatgtcaccgttgtttggtgtattatttttcttatcgttaacggttgctggaatcacatcacttatttcactcgcggaagtatgttttgctgctgtgtctgaaaaattcagtttaagtcgggaaaaaaccattggaattatgggaacccttctcgtgttagtttctcttgtatttgcaacacgtggtgggcttatgttcttagatgttgtcgactatttcgctaataatttcggattaattacaattgcacttgcggaagtagtgacgatagggctcattttacgtcgtttaccagtttatcaaaatcatgcaaactttgtatctgatattaaattaggaacgttttggagagtaagtttactcgttattactccgcttatgttagggtatatgctaattgatggtacaatccaaaacattaaaaagaattatggagattatccgactgagtttgttgtaacgtatggttggtcgatagcagcagccttccttatcgttgcgctaattattagtctaaagaaatggaatgcacaaatacattcggattctgccaagcttgaaaaagagtggaaagatcgaggtgtttcataatgagtggatcagcaattatgatgatggttattggaatagtagtcatttggggagggcttgcattaagtattgcaaacttatttaagaaaaaggcataagtaaaaaacatctgtaccgaaatggtgcagatgtttttttatgaaaaaattgtattagaaaaaaattcaataaccatactacaactacgaggaagagtgaaggggtgaatgaaagttggaacaaacgatttatattaaaatgcgcaatcgtttaaaagtttctcctacttatgaagtaaagctgggcgatgttgctcaacttgccggagattcttccgtagttgagttgttacaaaatgagatagtttacaaaataacagcgcatgataagacgcatgttgtaattgatgttatgaaagtaattgagattattcaacagaaagcatctcatctacaaattaatttactcggttctggacaaactcttgttgaaattatatacgaaaaaaagaaggcacacccaatttttttcgggcttgtatggctattacttttcattggagcggcccttgcgatcatttatttccatgaagatgtaagtatgcaacaagtacatcaacggttatattacatgattactggagaatttaatgcgcaaccacttttatttcaaattccttattctttaggtcttggtttagggatggttttattctttaatcatgtatttcaaaagcgaattaatgaagagccaagtccgctagaagttgagatgtttcaataccaacagtcacttgatcagtatgtaatcgttaatgaaaacaaggataatatgaaacaacttaccgatgattgagtatggatttgttattttaattggtttagctggagggattgcggtaggtagcggatatgtcgcattttagctgtacttggtgtaataccccgtttagcccaattaacgagaagtggtaagcatattcaatattttgagtgggcagttattgcaggtactttaacaggggcttggtgcagtttgaaaaacattacatttcaaacgtcgcaatattggctcgttatattagggatattttgtggcacgttcattggaatgcttgctgcggcattaacagaggtgttaaatgttctacctattttagcgaaacgagtaggggtagagggcaagattattgttttactcgttgctattgtacttgggaaagtaataggatcgttgtttcactggatttatttcgtaaagtaggaggcagtatataaatgacaagtcagaaattgaaggatgattacataaataaagtgaaggagtatcatccaaagccaaactatttactaaattgtatcaaagcatttcttgtaggtggactcatttgcacagttggagaagcattgatgaaattttatatacattattttcactttagtgaac

SEQ ID NO: 1206 - DNA, 4331 bp, Bacillus thuringiensis
tcatcctctttatgaaatataaattgttgtacacttctacttatacaagcatcaatataattataccagttttgtaaaattatccataaaatacacaaaaaaaaaatccgtaaaggcaaagcccttacggattttttcacttcatatcggaaacgtttaaacggttcacggcacgttgtaatgccatttctgcacgtttaaagtcaacatgtgcttgtttatcttgcagacgttgctcagcgcgacgcttcgcttcatttgcgcgatggatatcgatatggtttgcttcttcagcagatgatgataatacagtcactttatctggacgaacttcgataaagccaccgcttactgctacataatcagtgtgtccaccatttttcagacgaactgcactaatttttaatggtgcaacagttggaatgtgacctggtaagatccccatttccccactctctgcttttacacttaccatttctacttctttttcgtaaaccggtccatcaggagttacaatactgactggaaatgtcttcatacttcgtccctcctaaggccttacgccatcattttcttcgcgttttcaataacttcttcaatgccacctactaagcggaatgcatcttctggaaggtcatcatattttccttctagaatttctttgaaaccactaactgtattctttacaggtacgtaagaacctttttgacctgtaaactgctcagctacgtggaagttttgagataagaagaattgaatacgacgagcacgatgtacaactaacttatcttcttcagataactcatccatacctaagatagcgatgatatcttgaagctctttataacgttgtaaagtttgctgtacttgacgagctacttcataatgttcttctcctacgatttctggagaaagtgcacgagatgtagatgctaatggatctacggctgggtaaatacccatttgcgttaaacgacgctctaagtttgttgttgcatctaagtgagcgaacgttgtagctggtgctgggtcagtatagtcatcggctggtacatataccgcttggatagacgtgatagaccctttatttgtagatgtaatacgctcttgtaattgacccatttctgttgcaagtgttggttggtaacctaccgcagatggcatacgaccaagaagggcagatacttcagaacccgcttgcgtgaaacggaagatgttatcgatgaacagaagtacgtcttgtccttgctcatcacggaaatgctcagccattgttaaacctgttaatgcaacacgttgacgtgctccaggtggctcgttcatttgtccgaataccatcgcagttttcttgattacgccagaatcgctcatttcgtggtataagtcattacccttacgagtacgctcacctacaccagcgaatacagagataccaccgtgctcttgtgcgatgttgttaattaattcctgaattaatactgttttacctacgccggcaccaccgaataggccgatcttaccacccttaatgtaaggagcaagtaagtctactactttaataccagtttcaagaatttctactttagtagataattcttcgaatgcaggtgcttgacggtgaattggatcacgatgtacatctgcaggaacctcaccatctaagtcaattgcatcacctaatacgttaaatacgcgaccaagtgttacatcaccaactggtacagagattggtttaccagtatcttctacttctgtgccacgaacaagtccatctgtggaagacatcgcaactgtacgaactgtatcatcacctaaatgaagtgcaacttcaaatgttaagttaatacttccgttttcgttgctttgttttaccgtaagggcgttgtagatttctggtagctttccgccatcaaacttaacgtctacaaccggacccatgatttgcgtaacgcgccctttattcatcgggttccctcctagctttcttttaattagccaactttctacgagcagctagcttttaattttttattggtttatagcttacgcgactcttttgacagagccgcttccgctttttattgaatctagctccagcggttagaatgttcggtggcttcgctttttcctacgaggcacaaatcgcctctacgtcaaaagctccatccccctctcattctgaacgaaccgcttccgccttttaatactattctaacgctgctgctccaccaacgatttccgtaatttcttgcgtaatcgctgcctgacgcgcacggttgaatgaaagtgtaagtgaatcgataacttccattgcgttgtctgtagcactcttcattgctgtcatacgcgctgcgtgttcacttgctttaccgtctagtaatgcaccgtacactaagctttctgcgtattgtggcaatagtacttttaaaatttcttcttcagaaggttcgaattcataagctgtcgtcggtttgtcagacgccacatcagtaagcggtaaaattttattttccgttacctcttgtgaaattttacttacgtaatggttgtagtagatgtacagctcatcataagcaccatctgcgaacatcgcaattgctcgagaagcaaggtctttaatatcagtaaatgatgggtggtcagataatccaactacttcatcaataatgttaaagccgcgacgttttaaataatcacgtcctagtcgtccaagcacaataatagaatattggtttgaatccatattatgacgttcacgaattacgttacttactgtacgtaatacgttactgttataaccacctgctagtccgcgatcagacgtaataacgatgtatcctgtacgctttacaggacgcgcatttagcattggatgattaatccctttgcttccttgcgcaatgctcgctactacttcttgaatcttttccatatacggaacgaaagatttagcattttgctctgcacggtttaacttagatgcagataccatctccatcgctttcgtaatttgactcgttttctttgtcgagttaatcttcgcttttatatcgcgtaaagatgccacaggttttcaccaccttttttccggaagttggcacgattagtaagaatcctcttcctaatctacgttgcaagatattcttgctcatgattgaaggaaaagaataggtgcacctactcttttcctttacatgacctttagcaatctcagagcccgagatgccttttatatatactatctagctccagcggcttgaatgctcggtggcttcacttcttcctacgaggcaaacaccgcctcttcgtcagaagctccatccccctcacattcagaacgagccgcttccgcttttattattcagaagctacaaatacttttttaaatccattgattgctgctgcaaatttgtcgtcatccgcaagtttcttagttgtgcggatttcttctaataagtcagtcgcattagaatctaaccaagcatggaattcttcttcaaaacgagtgatatctactactgggatatcatctaggaatccacgtgttaaagcgtaaagaatgataacttgtttctctacacgtaatggtttgtgtaatccttgttttaatacctcaacagtacgagcaccacggtttaatttcgcttgagttgctttatcaaggtcagaaccgaactgagcgaacgcttctaactcacggtaagatgcaaggtcaagacgaagtgtacctgatactttactcattgctttaatctgagcagatccacctacacgagatacagaagtacccgcatcgatcgctggacgtacgccagagaagaataggtcagattgtaagaagatttgtccatccgtaatagaaattacgtttgttgggatgtatgctgatacgtcccctgcttgtgtttcgatgaaaggtagtgcagttaaagaaccgccgccttttgcatcacttaattttgctgcacgctctaataagcgagaatgtaagtagaatacatcccctgggtaagcttcacgacctggaggacgacgtaatagtaatgacagctcacggtaagccgctgcttgttttgataagtcatcatatactactaatacgtgtttaccattgtacatgaactcttcacccattgttacaccagcgtaaggagctaggtataataatggagctggttgagaagcagatgcagttacaacgattgtgtactctaatgcaccgtgcttacgtagtgtttctactacgttacgtacagttgattctttttgtccaattgctacatagatacaaatcatatcttcatctttttggttaatgattgtatcaagtg

SEQ ID NO: 1207 - DNA, 4587 bp, Bacillus thuringiensis
tgtgaacattttaaaccgtgattgtctgttagatactgccataacactcgtttgtagtagaagatttgtttagaatcactagataaaagagctgcaatcacttcataatatgtatcgattttcgatgttttattttttgtcccttttggtgtaaaaccattcaaatacttatctatggtacgccgatccacattcaattctctggctaattgacttttatttatcttcatttttaagttccccattagttttttaaaatttggtaagtctgaaagacttttaacctcaaattctgtttgaatatctagcttaatatacatactaaccacctcagagtcagtatggagaatccaattgaaaatgtacatatttattcaagcgttaatgtacatatttaagttagcatttataatactattttggagtcatagaagcggatgcacctcattagctaattggttcttttttcaaattggattatttactgaagcaaagaaatacaatgactttattcattactatgagttctgggtgtataaaaacagtacaaattacattcaacaattacaaaatagtcttctagaggctaaaaaaaatgtttgtaaacttgtacgaaatccttatacaagagctgtcagctcatttttattacttgctgacaatccatatgctagcccacaatgggagagcatccgtcattatttttataatgataaatatagtaatcaaggaatatcatttaaacaatttttatattacgttcaggcattcggttccaattccctatcattagatatacattttagtcaacaatacgtccctggtgaagaaaatttcattcaatgctatattcctttagaagattttaatacacaaatcaccaagatggaacacatgtacgatttgatgaaatcccctttagcacttcttacaaattcagatcatcatcgcgctcacaagatgatttatgcaggaagctatgcagaacttagcattacagatccaggctttccccgatttccaacatacgaaagcttttatgataaagaaactatggatttagttacagaaatatacgcacaggattttgaaatgtacccatacacgaaagggatattttaagtctatacatttttccacgaataaaagctgatacatcgcatagcataaagtgaaactttaattcgagtgggagttctctccaactaattattcccttctcctaatcgtaattttaagagatacctaactttcacccatttcctttaatttcgccgattgttgacgtgtatcatactttccatacatagattgcatttattaacataggagggatatcgtgtggaaatcaatttgaaacacaataatgggtactgcgttatttgcgaaaagaaagctacatttatagagcataatgattggcttagagatcattatttatgttctacatgtaactctataccaaggcagcgagctttaatccatgctttacatacattttttccaaaatgggattcctataatattcacgaatcctctcctggaggaattacgactcagctactattaaaaaactgtaaaaactatacttattctcaatactttagaaattatcctcttggccaatactttcaaggtattagatgtgagaacttagaagacatgacttttgaaaatgaatcttttgatttattcattactcaagacgtttttgagcatgtaatgacgccaaacaaagcctttaaagaaatagaacgagtattaaaacctggcggtgctcatgtatttactgtcccttggtatcatacactcacaaaaactgtgcaaagagcaagaatgaataaagaggtgattgaatatattgaagagcccatttatcatggaaaccctattgatgagaatggatctttagtaacgttcgattgggggcaggatatgattgaatatatttatacacatgcaaacatgtatacaattgtttttttacaaaaggatagatcactagggttagatgctgaatttttacatgttttcattagtaaaaagcaagaaaataaagtttaatcactatataattcggaggtttaacaaatgaataactttaagttaggaagtgattttgatcatcttgttaattcactatctgatgccgaacttctaaatttatttatacaaagttgttcacaaacaacgataaatggggttcccgtacctatgtttcctcctgaagaaattcaaaaacaatttgtaggtgcttcttatgaacatgctctttacgaagcatatttgttttatagccatataaaagaatacgcccaaaatttaggagttcccttgaataaagaaagtaaagttttagacttcggatgcggatggggaagaattatacgcttcttatttaaagatgcctctgatcaaaatttacttggcattgatgtcgatcctgcgatgatcacactttgtaatgaaacactaggaagagggatatataaaacagcaagcccacatccccctgtagattttattagcgacaattcattagatatcatattcgcttattctgtattctcacatttatccgaagcaactgccgaaaattgggtaaaagaattttcaagagttcttcgccctggtggaatcttcatcgcaacaacacaagcgcgctattttcttgatttttgtcaacaatttcaagaacatcctgaattaattcaaacaggatggcataaaactttatctcaagcttttccagatatacatcgcgccatctcggattatgaaaacggcaaatttgttcatagccctactggtgcaggggatgctagaaatagtagtttttacggagaaaccgttatacctaggacttatattgaaaatcattatgagaaatatttaaagctacaagacttttttgatgatgtaaatcgattaccacaggccctctttgtccttcaaaaaatttaattcctttcattcaacgtaataaatttcatgacgaaaagtactttctatttcagatatatatcaaattacctaatactctcttattaagtaagcttaaaaaatccaatacataccataaaaaaaacagtaaacagataacatatctcttattttaaaattgcttcaccaaatcaagaataacttcccaacacttgaactacgaaaaacacgagggggatataacttgaaaataatcgctttttacttaccacaattccatcaaattaaagaaaatgatcgatggtgggggaaaggatttactgaatggacaaatactaaaagtgcacgacctttattttcaggacattatcaacctagggaaccttatcaagatttttattacgacttaactaccccctccgtaagaaagtggcaagcaaaaatcgctaaagcatacggtatatatggtttttgttattatcattactggtttaaaggaaaaagactattagaaacaccctttaatgaggtactaaagatgaaagaacctgacttccctttttgtctttcttgggcaaatgaaccatggacaaaatcttgggatggtctcgataaacatatattaatgcctcaagactacggagatatatctgattggaaggaacactttgattatttattacaggctttccaagatgagagatatatttatatagatgataaacctctattcattatttatcgtccaggacatattcctgattgtgaaaaaatgcttaattactggaatgcattagcgcgagaaaatggtttaaaaggtatatactttgctgaaacattaaacagttttccactacctaatataaatggattcgatgctagcattcagtttgaacctttctatacaattgcccatgatagctcttcagacataaataaggtaatatatgattctgatatgcaattaaacgtttgggactacgataaagtatggatgtatatattacaacgatcgctcccaaagaaaaaaacatttcctggtgcttttgttgattgggataatactgcacgacgtaaaaacgcgaatagcagcatctttgtaggttctacccctgaaaagttcaccatatatttaagcaagcaaattcatcggacttactctttttataacagcgagtttttatttattaacgcatggaacgagtgggcggaaggaacttacttagagccagataaaaaatatggattttcttatttagaaggggttaaaaatgcaattgatagaggtatgaaagcatacaaaaaagacgagtcattctgactcgtcttaaagttgcttggcgacgtcctactctcacagggacaaggtcccaactaccatcggcgctagagagcttaacttccgtgttcggtatgggaacgggtgtgacctctctgccatcatcaccaaactattgaaggcatattccttcaaaactagataacattgcttcatattatatggttaagtcctcgatctattagtattcgtcagctccacatgtcaccatgcttccacctcgaacctatcaacctgaccatctttcagggcaccttacctgcttacgctatgggaaactcctcatcctgaggggggccttcatg

SEQ ID NO: 1208 - DNA, 9596 bp, Bacillus thuringiensis
actccacctcttctgattcaatgctagttggcttttctccaccaataatctcacatccaatgaaaatcttatatacatgcgtcgccgatggagatggttgatgtttttctttatcaaatatagctagtaacttaaaatgatctacctcatagccagtctcttcgaaaacttcttttgctgcaacttcggttggcgtataaccgacatcagcccatccacctggcaatgcccatttcccatcgcttttttctttcacaaataataactcttcattttgaaaaacaacagctcttatatcaactttaggtgtttgatagcctgtctcacttgcaaataatttctctacgacttcccaatctgttttcgtgtaatgtgacatcattgaaatagaaatatctcgtaattgctggaaacgctcaatatcatacacatccttagaatacgttaaacccgcttgagctatagattgtatttgttttacccaatcaatccatttaatcgtcatatatccgcatccccattctctatcaaatatattacttcattttcattgatacatctttattatacaaaaaaaaagagattgataacgtttcaatctctttcaaaattaatccaattcatgtaagtggtcttgtatatactttcttctcttatttatatattcataaatcatatcagcctcttgatcaaatgtttctaatttttctttcatgtatggatcttgtagtaaatatggacgaatcaattcacacaacccttctactttcggcctcataaacgaaactgtaaattgatcttctaatatttcttctaaaatacttcgatactgctttctaaatacaggtatgtctagcaatcttgcactcaacgtattatacccttgaatgcgaatatattcatgattaagcggtctcccttgtacatctcgcccccaagtcgcatcataatcccacggtataacttcaaataaatttgtttcatcgttatgatatagtgcatagttatgaacaaaaccatcaaagttttgcgtaaaaataactcctgctaaccatcgtaaatatttatctacatgtagaaacttcccaatttctttttcataggcttccctcgtcaaagtattcgcttgaaatacaaattcactcagttgttcttcactattttcattcgaatatttaaattcataacccgcaaagagctctgtcttaacatctttatctcgttcactcattaatgaaaaattcgcatcatcatctatcgcataataaatagaaccactcggtaatcctctattttttaaaaaattttcatcaaccgattctaactgtaagtacacaccttgaatttgaccattaatttttataaatacatgttgtgattttggcgaaagtacaccaatatcatgaaaaaaatctaaagataatttatttcttatgagagacggatccataaactccgaattcaaatgaaactctttcgcaccttgaaattttttaggcttataaaacataacatgataagactttttctcaaattcccgaatatgagctcctcggtatacgatatcaatatcatacttcttttttccataagttaattttgctggcactggactatctgaccaaatgtcctttttcaattccactaagtacattggatgaacaaaaaaatcatatgaaggcagcatgttttctcatcccttctcagttctcttcattcaatgtatgcgccttgtcttgtccatacatccgcaatcatctatttatataaaattacactcttgtcctgttcagaaagatgcctacatacatatcatgttaaggaaaaagaataccttttcactttaatacatgataaggaggatttctatgaaacgtgatattagaaaagctgtcgaagaaatcaaaagtgctgggatggaggatttcttacaccaagatccaagtacttttgaatgcgatgatgattgcactacaaaaatagagtgtaacgaagattgtaaatgcccaagaacaagatgtactcgcgtgaaacattgtacgttcgttacaaaatgtactcacgttaaaaagtggacatttgttacaaaatgtactcgtgttcgcgtgcaaaaatggacgttcgttacgaaagtaacgcgtagaaaagaatgcgttttagttacaaaacgtactcgtagaaagcattgtacattcgttacaaaatgtgtacgctttgaaaagaaattttactggactaaacgatgttactgtaaaaaatgcgaattcttccctaatggacacggtggctcttgcgacgattcgtgtgatgacggaaagaaatggaacgattgcaaagatggcagacataaattcccatcttgcaaaaataagaaattcgatcacttctggtataaaaaacgtaactgctagtttttataccacccaaaaaaaggccgttttgcggccttttttacatttattgaaagtgacttatatctgcaaattgtttcactttaccaataccctcttcaaattctattatgctcaaactggcactatgcataaatggatcatcccacacattttctatttcaattcccgcgaaatgccctacaagtaattttgctgctgccgcatgagacacaatcaatatattttgtcctttatgcatctctaaaagaagctgcatcccttcaattactctttcataaacggcctcaaaattttcgcctgatgttgactgaaaaagatgtggctcattccaaaacagatgtacttcttctggaaattgcttttctatatccgcgattgtttgtccttcccatatacccatgttgatttcatagaaatgctcatccgctataatgggtatatcacgttccccctttattaactctgccgtatgaagtgttctttcgctcggactactatagatcgcatggattggtaaatctttcattcgatttcctaattgtttcgcctgaactataccattttcagttaaagcagaatttttccgtccctgcattcgcttcgctacatcccactctgtttcaccatgccttgttacatatatagttgttttcatttcttactccccctcaccatgttggtcgtaattcccacggttcaactctccctacaatccactccgctcgtttactttcaatcctttttataattccatcagctatctcttgatgagtaagccaccttccatatgtatcttctaaaataaaacctaaaataattctatgataaatacatcgcgtactccctattttttgtgcaggcatacgtgatgctttactacctaaaatatgaaataaactctatgttttagacgacaaatctagttctttacaaatatttgatagtgcatgctttgcacttgtgtgtacccatgcaacaactaatgtgatcgggccatttttcttaattgtacttttaatagctagctttacatcttcatcattatgataatctaacgaaaggcatgtaatattttctggtgcagaactcattcgcttaacattttttaatttcacttcatctcgtccaataatagaaacataaaatcctttctcacaaagccacatagaaactttctttagcattcctgtcccaccaattacaagtgcatgcaaatgctatccctccctaataaaatgtcatatgaggtttctcatctctataataatttaaacggtcttgcagtgtccctgagtgaaactcaaatttatgaccgtcaggatcaacaaagtatatagattcgcaatctcttacatcacgttctcttccttgtaaaatatgaacatcattttcttctaatcgctgtattagacatttaaagtcttcttgttcaacagaaaatgcaatgtgcgtataagattgatgaatctcatttctcggaatatgcgtctcttcattaagcgctatccatactccacatatgttaaaataagctaattttcttcctttaactaataattctccttctaatactttttcataaaacataatagagttttctaaattagataccgaaaaacaaatatgattgattcctcttaacaactataattcctccttatacaaataaaagatgagcgaaaattcactcatcttttattatactatttttttgtaatatatgcccatttataactgaagtccccgccaaacgtatggttagcaatgccttttacaaatggcttctctaaataagctgtactttgttggtacgtaggagaaattgctgcgtcttgaccaattaagattttttcagcttccgcaagtgcattccagcgtgctttatcatcttttaatagctctccttttgatttcgctactaaatcatcatacttcggattagaataatccatttcattaaatgagcttccagtaacaaacatatcaatataagtcattggatccggataatcagggctccatgcagataatgagaattcatattggaatttcttttctaaatctagcttctgcttgtatggttgctgtttcaaattcactttaataccaggcaagtttttctctagttcttccttaataaagtcgcctacttttttacggctaccgttatcatcgtttagtaattcaaccgtaattgtatcttgaccaagctctttcttcgcttcttcccataatttttttgctttctctgcgttatctttactatcacggaagtttttatttacagagcggaaatcttttccatccggacctgtcgtgaatttttcaggtactaagaaatatgctggcaatgaaccgtcatttaaaatgacatcagcaattccttttttatcgtatgctaaatcaatcgcttcacgtactttttggtttttaaatgttgcatttttttggttaaaacgtaagaaatatatgcgcgggtctaacttcgttttaaattcatctggtttattctttttatatttatcaacaaattcagaagttaaaataactcgatctgcttgatcactatcatataaatttactcccgtgcttgtttccttcacaatacttacattaatttcgtctaactttacagtatctttatcccaataattaggatttttctttaactgataattttgttcatgtttccattgactcattgtaaatggtccattatatactaatttatctgcttctaatccgtatttatctccttgctctttcacatatttttcatttaatgggaaaaatatagggaacgacgtaagctcaagaaaataaggtgctggttgctctaattctactaccaacgttttatcatccttcgctttaacacccagttgatctaatggtaattctcctttatttactttctgtgcatttttcacatcaaataaaatgaatgcatattctgccgctgttgctttatctaatgtacgttgccatgcatatacaaaatcttgtgctcgaactggatcaccatttgaccatttcgcatcacgtaattcaaatgtatatgtctttttatcttcactaatcttcacatcttttgccatacctggtgttggtttattatctttatctagacgatataaaccttccattgcatttacaaatacacggaaagatacagaatccgttgatttagatgtatccattgaaggaatttcagctgtttctagcaaatttaaaacttgtttatcggccattcccttattcgattctttcttcgttgtcgaagccttctcaccattcccacaccctgcaaccaatacactcgtcgttaacgcaagtgcagcaattgttgttgtctttctcttcattcttccttcccccaatctatatgtataagttaaatcctatataatatattttattatacaaaagattctgattattttaaatatttattttaacaaacatagaaaaaagcgatcggaaatttctttccagccgctttcttgaatagcatttacttgtaatccatcctctatatcaaatggattttgaactttaaatatttcttccattagcttcaaaaactcttcttcagttttagattcaccattaaccataaatgagtatggttccacttcacctaatttataatcgacaacaaattgaatcttcaccttttgtcttggcgttccggtgttatatccttggaattctactaattctaacccttccgttccacgataatatatccaacctgaattttgaaaataattttcgaaagattcacctattgaaaagaaaggatattcataaagcgagcttgtacgaaccttttgaataacgtctcgatcagtcggaaaaaagaaatgactaaaaaatatgctagcaactgctaaaatagtaacaattgtcgctcccattttgctcgttccgccgctatcattgattagatagttttcaactgatttatcttttatttctcttgcttttattcggtatatacgtctttccgcaaattgatagtacaatccatttgcaaaaatccccattccaaacagaataaaaatgagtaataaaaacgtaagaggcaccatattaatgattggcaacgctacattaaatcccatataatacgaaaatgcatcacacgctactaataacaacataaataaagcagctggtacataatacttacgatatcctagccagcctatattgaaaatagcagcccaaccattccagctccacctagcaatccgcttattctcaagctcccatttccttttgtaatacggatattgtctccctacatatacttctagttctttatctattaacgagctaccttcatcttgttcattatccaagtttcgctgacaacttgcacaatttaactgttcctcctcgcaaggttgcccacaatttatacatttcaaaacaatccctcttcccatccatacgtcatttcaaaataccttcgtgttttaataaccactctttcctccataaaccaccagcatatccaacaagctttccactcttccctattacacggtgacatggaacaactattgaaattggattccgactatttgcccctcctattgcccgtacagcttttgtatttccaactttctctgcaatatctaaatatgaagcacttacgccgtatggaatagtataaagtgcatcccatacatttttttgaaatgctgttccctccgcagacagcgcgaccgtaagctctattcttttccctttgaaatattcatctaactcatttatacattgttctatcatttcatttttattttcttcttgtcgttcatcaacaaatataacagacgtaattccttcttgattcgctgtaatttcaagcaaacctacttcgctttcataataagcctggtacatatgccatcctccaattcagttcatattagtcattgtaacacgaatatacaaaatttttcgtataagcgttttattagagaaacaaaaaagagaatgatacaatgtaagaaaattcaatctaggaggctattggatgaattccgaacttttttcaccttatacaattaaggacgttacattaaaaaaccggattgttatgtcacctatgtgcatgtattcatcggaaaacggggatggccaagtaacgaatttccatctcattcattatggaacaagagctgccggccaagttggtttagttatgattgaagcaacagccgtgttacctgaaggtcgaatttcaaataaagacttaggcatttgggataacagtttaattgaaggcttacataaaacgactacttttatacatgataatggtgcaaaagctgccattcaactcgctcacgccggaagaaaagcagaactagaaacagatgcgttagctccttcagccattccatttaatgaaacaatgaaaatgccaatagaaatgagcaaacaccaaattaaagatactgtattagcttttcagcaagctgcagtacgatcaaaacaagctggatttgatgttattgaaatacacggtgctcacggttatcttattaatgaatttctttctccgctttccaataagcggactgatgaatatggtggttcacctgaaaaccgctatcgtttcttacgcgaaatcatcgactctgtaaatgaagtttgggacggaccgttatttgtccgtatttcagcaaatgattatcatcctgacgggctaacggttcaagattacgttcagtatacaaagtggatgaaagaacagggaatagatttaatcgattgtagttctggcgcagttgtaccagcacatattgatgtgtatcctggttatcaagtacaatatgccaaacatattaaagagcatgctaacattgcaactggtgcagttggattaattacgaccggagtacaagcagagcaaattttaaataataacgaagcagatttaatttttatcggacgtgaattacttcgcaatccgtattttccaagaatagcggccaatgaacttggctttgaattgcaagaacctcaccaatataagcgagcaccaggaaaaattcatacgaataaataaaaccgagaagtcattcttctcggttttatttattctatcgttgtaatttcatttgaattataagtatggatacccgattcttctcgcagcgcggttatatacatccctttcgccacatctttagctgaaattggtttatattttttgaaagctcctttaaagataaacggaataatacgagataacttttcagccattcgttcgccgaaacgaaattcttgtcgatttcctactaataatgatggtctaaaaatgtgaataccaccaatcactaacttttgcaattcttcttccatttttcctttcacttgtgaataaaagaagaatgatttaggattcgctcccatagaagacacgacaaggaaattttgtaccccttgtttttcagctaaacaagcagctcgtaacgtatattcataatctacttttttaaaatttgcttttgtttttgctttttttattgttgttcctaagcaactaaaaacatcatccacagcaaagaactctttatattcctctaataccgaaaaatcaacttgtttctgctgtaacttctcatgttgcaattgcattggctctcttacaaaaatagtaaccgaatcgtagtaatctgattcaagtaatagacgcgttatctcttgtccaactaaaccacttgcaccaagtattaacgctgttcgcttattcatatatgcatatacctcttattttacttttctctcctttagtaaaatacaacctttaggagtttcctgctcttattttaccacaagtaaaacactatgcgtacgcatagtgctttactcactcttttttctcatctctctcttgtaatttcgttattgttgtagcgtccccatgcccatcaacttaaggatagaaactctacggttttccattaattgaaatgaacaaacttttaaacagtataatcctcttaaaaatgagcatacgaaataaaccctaacgggtttcatttttttcttatgcagctttcttttgttttctcaatccattatactcatagacaacacccataatatcaaagatagttttcttctcatatcgatgggatttccggcaaaattctttagtag

SEQ ID NO: 1209 - DNA, 6560 bp, Bacillus thuringiensis
ggatctcggcttgtaatttagtggttacgcatgttgtctccccctaaattccaagttgtccaaaaaagaattgatatcataggaggatacgaaatacgtaaataaaattaaggtatgtatttggaggtttgcacattccctgcgttagcattaactaacaggttcgaagggtcggaacgaagtgttccctctcagcggcatggctcccccagtgataacgagattctttatttgctattgtttattgtaagcgaaatggatgagaatggcaaacgaatacagtatgacaataattgaaatagaattgtagcgaaatgttaataaatatgaagcaaaagggtatagtacaagagaaattgggtgtggtataatttttttgaaaataattatcattctcttctgagggggaaggttatgagtttagtagatattaaaattggagagaaagtgttagtaaaaagtattcagtctttagatcagctattaaagcgtagactagctgctttcggtcttgctgaaggaagcgaacttcgcctgaaacagaaagcgatgtttaaaggtccttgtacattggagtgtcgtggacagttaattagtattcgtcattgtgacgcgaaaatgataaaggtggaattagcgtgaataaggtagctttgctagggaatccgaatacagggaagacatcattatttaatgcacttactggttcttatgagtatgtaggaaactggagcggtgtaacagtagaaaagaaggttggtaaattaaaagatagacaaggaacattaattgatttaccaggtgtttatgatttaaatccagtttcacgtgatgaaggtgttgtaacaaactttctattaacagaagaatttaatcatatgttaaatatcgtagattcctcgcagtttgaaagaaatatgcatttaacgttgcagttacttgaatttggtaagccagtctcaattggtttaaacatggttgatgtggcgaagcaaagaggaattgtcattgatgtaaaacgattatcagaactattaggtgtaacagtcgttcctgttgttgcaaggagtggaaaaggctgtgaagaactgcttacgactcttaaagaaaatgacaaaaaagagaaaaagccattccttatttcatatggtgtacaaatggatgaaggaattggagaagtaattgctcttttagagacagtgaattacgagcatccgagatggttagcacttcaatttttaagcaataacgaagtagtagaaaaagaaatgaaagcattaccaatttataaggaactcatagccattcgatctcgcttagaaggaaaacttgattgtacgttagaagagcacatttacaaaactcgtgaagcgtatattgaaaagttaaaaacaaatgttatgaagcatgagaaagaaggaaaaattcctttttcagaaaaaattgatagattaattacacataaaattttaggacttccaatctttttagcagttatgttttttatttttcaggttacgtttacgtggattggtacacctttatctgatatgttagatgagttttttggtggccagcttacggattgggtgacggctggacttacaagtattggagcttctcattttattcaagcactcgttacagaaggtattattgccggtgttggtgctgtattagtattcgtaccacaaatctttgcactattctttttcatttcattattagaagactcagggtatatggcgcgaattgcagttgttatggatagaattatggagtttttcggcttaaacggaaaagcttttattccgatgattatcggttttggatgtaacgttccaggtattatggctgcgagaacgattgaacaggagaaagaacgtttacttaccattttagtaacaccatttatgtcttgttcagcacgattacctgtatatgcattatttgcgggcgtattcttcccgcatagtcaggcgactgttgtattttctttatatgttgcagggattgttcttgcgttattagttacaaaaattatgtctcttacgattttgaaagcggaaaagtctattttcgtaattgaattaccgccttaccgtgtgccacaagcgaaaacattatggctgagcacgtgggagaaaggaaaaggatttgttcgtaaagctggtacattcatctttggtggttcggttgtcatttggttattaaactatgcaggtccatcaggatttggtgttgatatgggagacagttacttagcgatgattggtggatttatcgcaccgctattcgcaccgctcggctttggaacgtggcaagctgcagcatcccttttaacaggatttttagcgaaggaagttgtcgtttctacaatggcaattatttatgcagttaaagaagatgtgcttggaaatgtaatgggagtacattatacagcattatcagcttatgcatttatgttctttattttattatatgttccgtgtttagcgacggtagctgttattaaacgtgaaacaggatcagcgaaatggacgattttctcagtcgtttatccactcgtagttgcttatgtattaacgctcattatatatcaagttggatccttactcggattctagaaggagatgtattacgatgatggtcaatattataattggagctatcatttttggttatgcagcatacacgttagttaattttgtaaagagaagtaaaaagggaaaatgcgcagcatgttctttaaataagtcatgtcagtcgaaaacttgtagtccagatatggaacaagttgctcataataaatagaaaaaagctttgcgaatgtcgcaaagcttttttgttttactttttaatttttacaagttgagaagcttcgacgccgttgtaaccagggaattctttacttgggtctttatcaaattttaatacacctacagatttttcatcaccttttacattgttgtaagttgcgtcatcgacaatcgcatacatatctgtatatgcacggccacttccgataattgtgttgccttcatattttaatttcgctccatcaagtgtagcattttttactttttcttttgcaaataatacaccttgttctgttgttatagctggtaatttatcaagtggtttcgtgttgtctttttcatcaactttgctaagtaactcttttttcactagttcctcaccagttttcttatccattacaagaacttttttaccatctaatgttgtcattttcattttatagaagtctttttctttcacttcttttttgtttttatctgtaatttgctgaacttgttcttctgagccgtacagtacaaaaccgttcgctttctctcctaataaagaacaacctgataatgctccaagtgaaattgctgctgctaatccgattcctactaattttttcatgatgatttctccttttatatgttttatattaaatacaatttttgtattattgcttacaagtgaagaagcttgtttgttgcttctggtattagtgtataagaaatattagaatgcaactatcgagttagcttacagtaacattacacttatgtaatttagtgaaattgcacaaaagtaagttaatttcaaagaggaataatgagaatatattagaaatacaatattgtatatagaatgtcatattataatggatgtattttggaaataacatgtaaggacatattagttttgttataataaacacataggctgtaaaaatgaatattctttactgtaaagggagatttttcagttttccaagtagtgaatttgaaatatgaggtatatcataggaggaatttagatgtctgtatttaaacgattaagagatttaacaatgtcaaatgtgtattcgttaattgagaaagcggaagatccagttaagatgacggatcaatatttacgcgatatgcaagcggatgtacaagaagctgagaaaagtgtagcagctcaaatcgcgcttgagaagaaattcaaaatattatttgaagagcaagaagcacttgtgaaaaaacgtgaagagcaagctcatatggctgttcaagctaataacttagatcttgcgcgccgtgcactagaagaaaaacaaaatgcggagcaaaagatgaatgagtataaagcaagctatgagcaaaataaagctgctgctgataacctgcgcctaaagctagaagaaatgcgtaagcaattaaatgagctgaaaaataaacgtgagacacttgtagcgcgtgtaaatgcggcgaaagcacaaaagaatattaatcaggcgatgtctggatttgattcaaactcagcaaaagctggtttaagccgtatggaagagaaagctcttcaattagaggctgaagcagaagcgagcggtgaagtttataagaaagaaaaatcattagatgatgaattcgcaagcttaaacaaaaattctgctgttgacgatgaattagctcgtattatgaagcagtatgagaaataatatagaatagagacaaatgaaccgacatgtctaaatatattcatgtcggttttctattatatttagaggaggttttgcaatgacatggacaaatgtattagccatgcttgtatggactggagcgagtgcagtacttttatttgcaattatgtgggttgattcaatttttacaaaatacaatgatttaaaagaaatcaaaaatggaaatacagctgtaacaactcgttttattatgaaattatttgcacaagggtacattttatctcaatcaattacgaaagcaaatgacttatggcaagcacttcttgcatcagcagtttctttcgttattttattagtggtagaaatgtttatcgaattcgtattaaagaaaatgtctggtcttgatttagaagaaggtacgaaagaaggcagcgttgcacatgcgatgttagctggatcattacatattgttggtgcacttattttaggtgcttgtttataaagagaaaaggaggggtaaatcatgagtttatttaaacgaattaaaaatataatgaaaagcccagagccaccgaagccggaaaagagtcttttaacgttagctcctggcgatatgattgaagtgtcattagttatgtatgaattaattgggaaaacgagtatgcattcgcgtaaggaaattgttttgacattgcaagatggaaaagacattcgttatttaaaaattgaagatcgtgaaaatacgtattacaaattatatacaccaattgatggtcgcttagattcaattgatgaaattccgacgacaattgaaatggatgataccgagtaccatatggaagaacaatataacggacgtgttgttgtgatgggaaaaactccattctcagcttcagaagaacagtacgtatgggaattccaatcagacaatcgaaaattattgcgtattgaatggcaaaatggtcgcacaatgatgtatgagggagaagcaatcattcctgctgatgtacaaattataagagcaacgtaagggggcgtaatcatgtcaaaccgattgtttaccatgattaaatcgtttgtaatccctatacttgctatcgttatattacttgttgttgctggttatgccttatcaggttgtcaaggcgggcagacaaagtcgattcaagaccgttatccacttgaatctgttgccaaggaaggtaaacaagaatcttacgtgtatagggccgccaatcggtcagttcctgaagtagcgaaggaactcattaacgaaagagaaccgaagcaagcatctaaagaagacgaaaatcaaatgttcctcgtttattctgataagatttataacctgcaaaaggataaagagaaaccatctgatacgttaattgaaataagtaataaagaatttgtccgtcaaaattaccaaccgtccttcttgcaaggatatattatgggtagcatattaaacgatatattcggttcaaaaagatcatcatccggtgattaccgaggatataatgacagacaaaatcatcaaccagttattccagaaagaccacctacaaaagaagaaaagaaaaccccacctccaattacgaaggaagggaaagggtctatcattaagcgaggcgataatgtagattcgaaaccatcagtaggtgataagggaagtattactgaaaaaggaagtaatacgacgcccccaccttctactggaagcaaggggaaaattacgaaaacaccaggcggttcaagcggatcagatgtgaagccaaaatcatctattaaaacgccgccaaggaatacatctcctccgaaaacgagggtcggtggttcaggaaagattacgaagagaagatagtgtagaggccaaaaagtggaatttgctttttggtcttttttcgtgttatgggaattaatccctttcagttggtacgatttaggcataagggggcgagtaaaaatatatcagcgattattagaatatatcgaccacaactcaaaatatatcagcgattattgaaatatatcgacttaccgacaaaaactgacaacgatagcaacttaataataaaaagag

SEQ ID NO: 1210 - DNA, 6511 bp, Bacillus thuringiensis
atagggaacgattggaaaaaatctaggatcttcatttgagcaaatcgctttcatacgttagaatagatatgttacatgaaagaagcgaacacggtaaactatttcatattgtgcggagttgataaccatgacaaaacaaacagaatataagcgcaagcccgaatggttgaaaattaagttaaacacgaatgaaaactatacaggcttaaagaaaatgatgcgttctaaaaatcttcatacagtttgtgaggaagcaaaatgtccgaatattcatgaatgctgggctgtaagaaaaacagcaacatttatgattttaggtgcggtttgtacacgtgcttgtcgtttttgtgcggttaaaacaggcttaccaactgagcttgatttacaagaaccagaacgcgtggcagattcagtagtacaaatgggcttaaagcacgttgttataacagcggttgcacgtgatgatttaaaggacgggggagcagctgtttttgctgaaacagtacgagcagtacgtcgtaaaaacccattcacgtctatcgaagtattaccatctgatatgggtggagtagaagaaaacttaaaaatgttaatggatgcaaaaccagatattttaaaccataacattgaaacagtacgtcgattatctgaccgagttcgcgctagagcaaaatatgaacgttcattagagtttttacgtcgagcgaaagaaatgcagcctgatattccaactaaatcgagcattatggtgggcttaggtgaaacgagagaagatttaattgaagcaatggatgacttacgtgcaaacaatgtggatattttaactcttgggcaatacctacaaccatctaagaagcacttaccagttcttaaatattacccaccagcagaatttgcagagcttaaagaaattgcacttagcaaaggatttagccactgtgaagctggcccacttgtgcgttcttcttaccatgcggatgagcaagtacgttctgcaaaagaaaaaacagcagaagctaaataatgaaaaaagagagctaacgattagctctctttttgtttatactctaaaacggtatttggacatgttaataaaatcttttttaattcttctgtggataattcaattgtaaattcaggtacaccaggtgtaattaaaattttatcgtacgtataaatagcgttatccacaataattgttacatcgtgtgaatatccgaaaggagccacacatcccggcgtacaaccagttttgtctcgcagttcatcaggagaacagagagataagcgttctcctgttagttctttcatctctccccggttgagccttgtgccctctaacgtaaaaaatacgtaataatctccagactttgattttaaaaataagcttttacttggagtgccttgtaagccgagtctctcacgtacaatccgatctgtctcataatcgagtactggttcgtgttcaaatttttcataagaaacatttgttttatgtagtagagcaagtacatcttcgtacatatggagtgatacccctttctattattagtacagtttcttctcgtggcgtcaactgaatgttttggaaagggatattacttagacgatgcttcccataagcgttttatgatacattgttcgtcgattgtaatttcgtaaatatcaggattcgttaaagttctccattcattaaagccaatcgtatgattaaaatgctttaaaatgagcgtaagtaaattgccatgtgtaacaagtagtgttgttgtatggtttaattgtaaaacgtcttgaataagcgatatggcacggtctgttgcttgttttgttgactctccgcctgaaaaggcaatatctatatttgtaaaagtagattctagtttttgcatccaatcatccattggaacgttgctcaatatgcgttcagttaatcgttcatcttcttggatagataagttagcttggagcgcatagggccgaatggaatcgatagctcggacaaatgggcttgaaataatatgatcgatttgtagatgattttctaagagaaatgtagcaagggtatttgcttggtcttttccatcggtcgttaattcagcatcacgtttttgcccagttgctgaacaatgtcgtattacaataattttcttcataattcatccccatctttcaagttgacgctatatacttcgacaaatgtggaaataattcctttttcttgtaaaacggcatatggatttaaatatgtggaaaagtaatgtggataatgaacatttgaggtgcaatcatgaataaaatgatatgtattgtagttagtctttgttttttttatacacttgtccacaacttatgcagagtcgaatcaaaaagtaaattatccaagcaatcgaaataagtcatttgtgagtgaggatattttttataaacagttagataagaaaatttataaagaatacaataatgcagcatatagtgttcgaaaaaaatcttatttaaagaagtgcccgatgaagaattttctttcctacaaaaaacagccgtgggttgtcggagtagtgtgatgcttcaagatttttttgttcatcctgatcgccaagtttatttttttgcttccttttctcaaaatgaagtagaagagtttcataaatatatcgttatagatgcagaaacaaagagggagctgcaagaaggaaaaagctatcatcattgcgacaatccataaaaaataaaccaccaatcggtggtttattttttactccggtacactcattaatttcgctttcattttgcgaataagaacgacagcgccaattgtacaaagaagtgtaattccttctgcaacgaagatattgattgtttttgtttggtaaagggccgcgaaaaagtctacaaatgcgtggaatagtatagcgtatactaggaagatatatttcttctgttttactgcgtataaaacaagcattgtaaaggcaatttgaagcacgagtgccataattctttctaagctaccaaggaagtataagtaggcaggttgctgaattaacatgtcctgtaaaatgctcagctcgggtttttgttcaatcagtcgagcgaagctaccatcgttaatagaattagcaaagattaatgcttgtaatgcagaaaaaccgccaattaaaatagattcaattccgccgtgaccaattccataagcgaagccatctttatattctagatatttttttagtaagaagaagaaggcaacgaagcgtcctaattcttcaaaaataccagcagtcaatccgccataaattgcgaagacaaacggattttctaaaaatggagcgattgttggattaccgcgcataaataggtggaatggtgtttcaagaatttgagtaaatccgataaagataagaacaccaatgccgactactttccaattcatattatattttttacggaaataaacgagtacaataattgggaccagaatcgagacaatgagttgaaagatgatgctggcaattacagtatttgaaaccatactttcaccgctttctaatatatgtacataactattatgcatcaaatataggagagatgaaactttttaagataaaatgaatttacttattgactctaacgttgcgtcatactttatcgtatgtactaagggggagatacaaatgacaatgagagtaaaagaagtagctgatttagttggaattagtgtgcgcacactgcatcattacgatgaaattgggttgttaaccccagacgagacgacagagtctggatatcgtctgtattccaatgaaaatttagagacattgcagcaaattttgttttttaaagagcttggcttccctttgaaaaaaattaaagagattatcatgagtccatcatttgatcgcgaagaggcactagagcttcataagaaaatgcttcttgaaaagcgtgctagattagataaagtgattgcgacgattgataaaacaattcagcatacaaaaggagagattgaaatgacgaacaaagagaaatttgaaggattcgatttcagccataacccatatgaagaagaagcacgtgaaaaatggggagatgcagctgtagataaagcgaacgaatatgcaaaaggtatgtcaaaagagaaccaagaggagtttaatgctatttatagaaatttagcagcgcttagacacggagcaccagattctaaagaggcacaagaagcaattggagtgtggtacgattacttgcaaaacttcggtgcatattcattagatgcttttaaaggactcggtcaaatgtacgtcgctgatgagcgcttcacgaaaaatatcgataagtttggtgaggggttagcgcaatttatgtgtgatgcgatggaggtttatgcgaatcgtaataaaaaataaaaagtaaaacaggtggagattttctccacctgttttactttttaatcatatcattcaaagtctgatctcccgtattgttcaaatgaggatttttactcatttcacgttttagcatatcgaggctttgcgtatattctgtatcatttaatgcgccagattgaagaccttgaatttgggaaatcaacttttggtctgttgatacatatcctttataatagcgagggacgatggacaaagcagctctatatacttgatccgctacgagttttggatccgttgtgtttgcacggtatacaacaaatacttcatcatcggtaacgagcgtagcagcgtttgtaacgtcaggaagtttgactgtcatgcttgtaatcatttcagcgactttctcacggttaatggcccctacttgtttgttagacacttcatgcttttgtttagatgaataaccgactctcgttaatcgtgtatttgtattttccgtatgatacatgtcgtttttgttggaaacaagaacacggcttccttcttcacgttccatttcggctttattcgttgattggcagcctgcaaataaggaaagagtgaggagagagagtataatttgttttttcacgatgtatcacctccttctccatagcatgcactaattttcaattttttgtatttgaaattgttggttgttatgctttgtgatacgataaaaagaagaatgcttagagaggaagttaatgatggagcaaaagcaagagattcatgctacggtgagcattaataatgtgcagtacgaagtaattaaaaactttcgtgacggttttagtgaagaagcatttaaagagcgctatgcagaaattttaaataaatatgattatatcgttggagactggggatatgagcaacttagactgcgcggattctttgatgatagtaaccagcgtgcgacatatgatacgaaaattagtacgttaacggagtatttatacgagtactgtaacttcggttgcgcacattttgtattacgaaaagtgaagaagtaaaaaaactcttacgattgtaagagttttttttcgtagcagttataccaattgtgaggaggctgtttacttgaaaaataaacagcacctcgacaaatataatgattcttttcatacaagcgcaatgaaacgggattgccagtgaaagcatctaatcgtatgcccgtatagtcttttcgttttgcttcattttcccaaaaggataaaagtactttgctatatccttttccttgggcgaaaggatggatgacgaaagaatggacgataagaaagcgaccgtgtgtttctgaccaatcaattagctcatattctggagattgccactcattcaacacaacagcaccaacgagcgaatcatgctcaaataggcagtagagttcaccttgttctaagtgataggcaatatgttctcgagtcggatatgaatcatcccattgataaattttcttttgtaagagcgcttttttacattctgtatacattgcatctaattcgtctaataaattcatcgtaccttttctcacatttagcatgagactcccccttataaacaaattgaaatagaatctccttcagatagtattgtatttggcttcatttgttgtccattcaattgaatatccccatttttaattttatccacaatgagtgtacggctccagtcggaaatatatgtggataaggctttatcgatgcggtgggaaccgaaaacgatgtctaatacgatcgtgattttagctatgccgttttctttatgttgcataatggaaatagtagtagttgtttcggcttgatcttgctgcgtcatatcgactgtttcaacgtgatcagtaaatgatttataaatacgcagtttttgattccacgtatgatctttcggacatttataaatggcaaagcggtatatgttttttccgttggcgttatgcctacgaatattcgtgtcagtaaataaggtagtgcgtctgcaatttttacaatacttttcgattgtgttttgctcattttcatataaactccaagaaagttgtactttctgcatttttcttcacctaatatagatagtggcaaagaaac

SEQ ID NO: 1211 - DNA, 6780 bp, Bacillus thuringiensis
tgttcaacatgcttaaagtgccccagccagcctttcaaagaactgaatgacttcttcaattgtttctagcggatatttctgcaagggtttctaccagaccagtataaaataccatctaaatcgttgccgattaaatcaggtagtaattcttcacgtagcaattcataagcgaaggcgttcaatgaaacatcttctaaagatgttgtatcgattgtatttttactcacaatattcccctctttctatagggagtattatataacatttcacatttataaaaacagatttttctttaggaaaatctgaatatataagaagaaaaaaagaattggcaaattatatgcaaattatgtatacgttttcttgacgcttcgacaaaaataggagtaaaatgaacttggtatcaaattatgctgaaatatttcgaataattttttcagtttttcttatgccaatagtgaaaaaacattattgtcataaactaatctgaaaacagcagtcaaacattcaaggggggtaatggggacatgaaaggccgcgagtatacgtttcgtaagtggcactcattaatgggggtcatcccggttggtgtctttttgacgcaacatttaattgtaaacaactttgcaacacgaggagcagaggcttttaacaaagctgcaggctttatggagctccttccattccggtatgcgctagaaattttcatcatctttttaccgatactgtaccatgctatatatggcttatatattgcatttacagctaagaacaatgcggtttcttacggttatttccgtaactggatgttcgttttccaaagaatttcaggtatcgttacgctgatcttcatttcttggcacgtctgggaaactcgtattcaagcaatgttaggtaaagaggtaaactatgatatgatggcagatattttaaacaatccagctatgtttgcattctacttagttggtgttgtttcaacaattttccactttgcaaatggactatggacattctgcatcagctggggaattacagtatctccacgttcacaaagaatctctacttatgtaacattagctattttcttaggtttatcttatgtaggtgtgagtgcattattagcgttcatcgatccacagctagcaaaccagtaaggagtgggagagcatgaaagggaaacttatagtagtcggcggtggcttggctggcttaatggcaacgattaaagcggcagaagcaggagtaaatgttgaactgttttctttagtaccagtaaaacgttcacattctgtatgtgctcagggcggaattaacggtgccgtaaatacgaaaggtgaaggggattctccatggatccactttgacgatacaatttatggtggggacttcttagcgaaccaaccaccagttaaagcaatgtgtgaagcagcacctggtatcattcatttaatggaccgtatgggtgttatgttcaaccgtacggaagaaggacttcttgatttccgtcgatttggtggaacgcaacatcaccgtacagcatttgctggtgcaacaactggacagcaattactttacgcattagatgagcaagtacgtcgtcacgaagtagcaggacttgtaacgaaatatgaaggttgggatttcttacgagctgttgttgatgatgaaggtgtgtgccgaggaatcgttgcacaagacttacaaactatggagattagaagtttcggagcagatgccgtgattatggcaacagggggccctggtatcattttcggaaaatcaacaaactccattatcaatacaggtacagcagcttctgctgtatatcaacaaggcgcatattatgcaaacggtgagttcattcaaattcacccaacggcaattcctggagacgataaattacgtcttatgagtgaatctgcacgtggtgaaggtggacgtgtttggacatataaagatggtaaaccatggtacttcttagaagaaaaatatccggcttacggaaaccttgtacctcgtgacatcgcaacgcgtgaaatctttgatgtttgcgtagagcaaaaactaggtattaacggtgaaaacatggtgtacttagatctttctcataaagatccaaaagaactagatattaaactaggtggaattattgaaatctatgagaaatttacaggggatgatcctcgtaaactaccgatgaaaatcttcccagctgttcactattcaatgggcggactatgggttgattataaacagatgacaaatattccaggtttatttgcagcaggtgagtgtgattattctatgcacggtggtaaccgtcttggtgcaaactcactattatcagcaatttatggtggtatggtagcaggaccaaacgcaattgagtatatgaaaggtctttctaaatcatctgatgctgtttcatctactgtatatgagcaaaatgaattaatcgaaacagagaaatttaacaatattttaacgatggatggtaacgaaaatgcgtatgttcttcataaagagcttggagaatggatgacagataacgttacagtagttcgtgaaaataaaaaattattagaaacagatgcgaaaattgaagaattaatggctcgttacaaacgtattaacattaacgatacagcaagatggagtaaccaaggtgcttcatttacacgccaacttgcaaatatgtttgagttagcacgtgttattacaattggcgcatataaccgtaatgagagccgtggggcgcattacaaacctgaattcccaaatcgtgatgatgcaaacttcttaaaaactacgatggcaaaatttgagggagaaggaaatgcaccagcattccattacgaggacgttgatatttcgttaattaaaccacgtaaacgtgattattcttcaaaacacgatgtagctgctaagggtgaagagaagggggataaacaacatgtctgagaaaacaatccgcttcatcattacgagacaagacgggccagatgcgcaagcgtttgaccaagagtttgaaattccatatcgtccgaatatgaatattatctcagcacttatggaaatccgtcgtaatcctgttgattcaaaagggaaccaaacaactccgattgcatgggatatgaactgcttagaggaagtatgtggtgcatgttcgatggtgattaacggaaaaccacgtcaatcatgtacggcacttatcgatcaattagagcaaccaattcgcttaaaaccgatgaagacattcccggttgtacgtgacttgcaagttgatcgtagtcgcatgtttaatgctctaaaacgcgttaaagcgtggattccaattgatggtacgtatgacctaggtccaggaccaagaatgcctgagaaaaagcgtcaatgggcttatgagctttcaaaatgcatgacatgtggtgtttgcttagaatcatgtccaaacgtaaacagtaagtctgactttattggaccagcaccgttatcacaagctcgcttattcaactcacatccaacgggtgaaatgcataaagcagatcgcttacgtgcaattatgggagatggaggactagcaaactgtggtaactctcaaaactgtgtgcaatcatgtccgaagggtattcctttaacaacttcaattgcggcattaaaccgtgatacaacaattcaatcgttcaaagatttctttggtagcgataataactattaataaatattgcctcttcatatcgaagaggcaatatttataactttatttttctgtttattctgtttatttaaaggtgaaaaggggagataacaatgaagaggatttcttatattgaagactttgagcaatgggaaagtggtttttcgttttacaaccctgtaaaggttcgttttggtgaagtagatatgtttggacatgtaaataatgtcgttgcttttacttattttgaagaagctcgtattgcgttgtttaaagaacttggatttatgcaagagtggacacatgcatcatcagaaacgatgatcgttgttgcggatttacaatgtaattttattaagcaaatatattttgatgaacagctgaaggtgtatgtaaaggcaggatcggtcgggaattcttctttagatttacattatatggtgaagaatgcagcaggagaggtttgtttagtaggtcgtggaatgatggttcaagcgtcgaaaaaaacaggaagaggcgaaccatggcctgaagaatggaagaagaaattactacaataatagagtgaaagaaaaataagagagcaatttgctctcttattttttgtcttccatcgcttcttctaatgttaagtgatgtttatataggtatgtagcgtatggattaccaacgtagcgtaagtgccatggttcatatgcatattctgttgtatctgttttatcttctaagtaacgaatgacaaagccgaattcatgagcgtgttctgcgacccattttccttctgctgtctccccgaagataggctctaattgaaatttagctgattttgaactaatatccattgctaaacccgtttggtgttcacttgtaccaggaattgcgcttaccgaattagcttcggcttttccctggcgtctaacgtatgtatcatgcaacgatttttggcgtttgtatgaacgataaccagatacagctgtaagatcaagcccttcttttttcgcagctttaaacatgttttcaagtgcctctgcagcatcttttcgcagcaatgttttttctttatcttttggactaataaatggtacatttggtctcgttaagtcttcaggaatgtatccatctggtagttttcgatgtttattaattaagacaagattagatttgggatttgttaccactgaaaagtcattgtctattttctttgcattatgatcagcttttggaaaagcaggaatctcttcttttttatggttattatgcttttgactttcgacagcttttgcttcattatgtagtggtgttttagaaccaaagtaagcgaaagatgtgatcccgattacaatagtagtggcagaaataattattatctttttcatgatgccttgtaatcacagtcccttcttaataaaatgtgtaatgtttttttattataaatctagtttgttggaaaaggaatataagagtcataacgtaatagaaatgcaaagaaaatgtcagaaaatgtgtgaatttgtagtatttttttatataattcatttcttatctttcatgaaatgcattttttatgtaatatatatacataagaagatgtagcgattatcgagaatagagaacttcttgtatagactgggagtgaatgggaatggattttgcaacaattattggacttattttaggatttgtagcagtggtagtagggatggtcgtcaagggcgctgacataacagccttattaaatcctgccgcagcattaattatttttatcggtacatttgctgcagtatgtattgcatttccgatgaatcaactaaaaagggttccaaaactatttaaagttctttttggttcaaataaaaaggatttaagttatgaacagttgctagaattatttgttcattggacatctgaaagtagaaaatacggtattttgtctttagagcaacaattagacaaaattcaagatgaatttcttttgcgcggtatgaaatttgtgattgatggcgtatccgcagaagatttggagcagattttggaatctgaattagaggcaattgaagaaagacatgcaaagggagctgctattttttcacaagctggtacgtatgcaccgacattaggagttttaggtgctgttatcggtcttgtagctgcgcttggtaacttaactgatattgaaaagttaggtcatgctatttcgggtgcgtttattgcaacgatttttggtattttttcaggttatgtattatggcatccatttgcaaataagttaaagcaaaaatcttcagctgaaattgagaaaaaacgtttaatcattgattgtttattaatgttacaagaaggtacatatccgtttattatgaagaaccgcattttaggtgcactttctgcaactgagcgtaaaaagctagaaaaaggagcagaaaaaaatgcggagtaagaaaaatagaagaggcaaaaagaaaaaacatgatgagcatatcgatgaaacgtggttaatcccatattctgatatgttaacgttgttatttgcattgtttatcgttttattcgcaatgagtagtatagatgctgcgaagtttaaacagatggcagttgcttttcgaagtgaattagctgggggaacaggtaacaaagaatttttaagtgatcaaaagccaaatgatgaaaaagaattatcagcaagtagccttgaggcagaacaagcaaaaaaacaagaagaagctagagctaaagaaaaaaaagagatggatgaattgaaagcattacaaaaaaagattgatcaatatattaatgaaaaacaattatcctcttcttttcaaactaaattaactgaaaagggattaatggtgacaatattagaaaatatactgtttgattcgggtaaagcagatgtgaaattagaatctttagggattgcaaaagagatgtctagcttacttgtttcagcgtcacctcgtgaaattacagtatcgggtcatacggataatgtccctattgccaatgcgcagtttgcgtcgaattgggaattaagtacgcagcgggcagttaattttatgcaagtattactgcaaaataaaaaattacaa

SEQ ID NO: 1212 - DNA, 7963 bp, Bacillus thuringiensis
aataaagggttagaattaatagatgcaagcatcggttccttatttttcttcttccaacctattgttggatcattacttggctggctcttattaaatgagacattaaatagtaacttttttattggcggtattcttattatatgtagcgttttaattactacttttgaaaagaaataaaaagcaggcagagattcttagtctctgcctgttcgcattattggatcttgatcgtgaaaaccaatacaaatcggtatattactttgcacttcactacgtacacttataaaactacacagcgttttagcaattaaatataaagttacaccgactgctttttcacttgtgtcaaagccatttccattatacatatctgctaattctacagaccccggcccctcaatattatatgtccattcagatgcccaatcatcgtcctcttcttcaagtggaatatattcctcacaaatataaaactgactatcccattcgttatcaaggtcatactcaaaataaatcgcttttgattcttcattagtagccatttctacagctgcatccaaacctactcgaatacttttcttatatgactctaaatcaattgctttaattcgttctgcatattctgcagacgctaacatgctacaaatttcaaaatacttcgcttctatttgctctactgctaacgaaaagacatcctcttgcatctcttctaaatactgaaatatatccacactaaacactcctcactctttacgcactccaatgcgatggacgggataacattttcggtaatttcgtatgcttatcccctttcgctgcgttaatttgaacttgcgtcagaaaaatactatttgtaaaatcagccccgcgaatatctgcatctcttaaatctgctccgataagatctgctcctcttaaatttgctccatttaagttagccgcaattaagtaagcaccccttaaatttgcaccttgtaaatttttctttttcaaatttgctcccataagatctgctccgcggtgaatgattcgtttcttacgtgcagtattcatttccttccatactaattcgctcgtttctaaaagaagaatgttcacctctgccctatgcattggaacatttattttcattaactcatctggatttaaattcgaaagtcgctctgtctcctcaattgcggtctccagctctttatgaattggctgtgttgcctttaaaagaatcgcttcatttaaataccaaagcatttcatgaagttgatgtataaccggaaaagcatcgtacatttttcttgcatgctttgcatctttccgccaatcaatccctttaaacgtaccctgagaaatcttctgcccagcaccgaaacactcaaatactgtacaacctttataaccttttcctctaagatttttatgtatactacatttaaaatctgattgtaagttagaacatggtttaccaccatctttattcactgcaaaatctaccgatgctgcgaacggtaatgcaacgcaacatagaccgaagcatttttcgcagtttgcttttaaatgatcattatgattagtcaaaatctataccccctgttgtcttttgactatttcataatattccaactgtaataaataatcaattttaaaataaaccggcatctttcgttccaattcataactttatcattcgatttcctttcaattgaaaaggactatttctatttaatgaattataattaaattataaattttctaactaaaaggagacttattatggcactagaaatgaaaacaaactgtcaaatttgcaatcaatcgctcgaacaagattctgaagcatacatttgtgtatatgaatgtacattttgcgcaccatgtacagaagaaagacaaaacgtttgtccaaactgcggcggcgaattagtacgtaggccgaaaaagaaacaataaaaagcaaagcgatatcgctttgctttttattgttttctgagtatatgaaattatatcgaacacaacttaaacatttaaaaacttcacacaaacaggctctggcacagcaacatcagattgtaaaagtgttaactttcctgtagattcatctcttgaaaatagcacaagattatgtgacttttcatttgtagcaacaagaaacttttcagtaggatctaatacaaagtctcttggccaatttccttctgtagatgtatgttccacaaatgcaagctcacctgagttttgatctacgctataaacagcgatactattatgaccacgattacctgcatatacaaagcggccgtcagaagaaatatggatagcactgccttgactattttcatcaaattgttctggaagagtagaaatatactgtaattctgtaaaggatccttcttccgagttatatgttagcgcaataacctctgaactaagctccgtcattacataagcgtattttccatttggatgaaaagcaatgtgtcttggtccacttcccggattcacagacaggctattcacttctattaatgtactatcttttacttcatacgtaattattttatctatccctaaatcaacgcccactacatatttttcatcaggagtgtaccccgcgtaatgtgcatgtggtttttcttgtctttctttattcggacctgaaccttcatgtgccataatagatgaagcaggatttacagttccattttcttcatttatttcaaaagactcaatcgttcctttatggtaatttgctgtaactactgtatgatttccactatcaacactaatatgacaaggagaagccccttctactacttgtctatttttcgcttttagttctccagtatgactatcaatggaataagcagctacaccgccagattcggccttccttaacaacagaatagagatattcattatttcggttaatcgttacatatgtagggttatccagcttagcagtaagtgttacattaccaattttttttgcttccgtgtctaaaataaacttatatattccttcgctattttctttcgtgtaagtcccaacatatccgataaactctttgttatccttcattttcataaccctctctccctatatttttcgttcatcatactttttaaaatattttatgttgaaagagtatcctaaaaaatcggagtacctctttatacgttaccatattttcttggtaaatagcttttaaacccactttttttgatacgctgctatactttcatattcttcttccaattgacgggacaagcggatatagattggcgttaaatctttatatttttccacactttccatgtttggctcatgatgaaaatctgcacctaccatttcagaaactacggataatgtatctatttcacctaaactatataaaccgaggattgcagctcctaagcaagagctttcgaaactttccggaacatatacgtcttgatggaaaatatccgccatcatctgtctccaaagttccgaccttgcaaaaccgcctgtcgcttgaatttttttcggttcgccaattagttcttttaaagcgagaagaactgtatataagttataaattactccttctaaaacagcacgtatcagatgttctttcttatgatgcaatccgagtccaaagaaagatcctcgcgcatttgcattccataaaggagccctttcccccgctaaatacgggtgaaataataaaccgtcagatcccggattcacttttgctgctatttcagtaagcacctcatatggatcttttcctaagcgctttgcaagttcaatctctgaagtgcccaattggtcacgagcccatctgaaaatcataccgccgttattaactggtccaccgattacccaatggtcttcagttaacgcataacaaaaaattctaccttttggatctgttacaggacgatttgttacagcacgtatcgcaccgcttgtaccaattgtaacagccacaacgccaggatctattgcatttacacctaaattagatagtactccatcactcgctcctactacaaaaggcgtagaaacaagtacattcatctctttggcaaactcttcatctaatcctgttaaactgtgcgttgttggaacaagctttgaaagcttttcatctgtaattcctgctacatgtaaagcctcttcatcccactttaaagattttaaattgaacattcctgtcgctgatgctatagaataatcaattacatattctttatataacttgtaaaaaacatattctttaatagaaatgaatttataactttttgcgaataactctgcttgctcattctgtagccaaactaatttcgaaagtggtgacatcggatgaattggtgtcccagtacgaagataaatttcatgaccattcatatcattctttattttctccgcccagcttgcacttctattatctgcccaagtgatacatctcgttaacggctttcccttttcatctacagcaatgatactatgcattgccgaactaaaagagacacaaagaatatcattcggctgtacactacttattcgtacagtttctttaatcgtatttattactgcatgaaagatttcttctgggtcttgttctgctgtttcaggtgtaggagaatataaaggatattcaattccatgactagcaataacagatccatcagtagaaaatagaactgattttgtactagttgtcccaatatctacaccaatcatatattttgagctcaccatctcttcctcctaacaaaaatccctacagtgtcctaatcatataagaaccataaaaatatatttattttatctattcataacgttatgtgctaaagttgtctctctcaattcatataaaaatatccttattttaaccaaacatatcgagtagtaaaacgcctccaaaagcgataaatgaaagtaacgtttctaatactgtccatgttttaaatgtttctttcactgttaagcctaggtattcttttaccatccagaacccagcatcgtttacgtgagaaaacattaacgctcctgcacctgttgcaataacgagtaactctaagttcacacctatcgtattttcaacgattggcgaaacgatacccgctgctgttgttaaagcgactgtcgctgaccctgtcgcaattcgaattaatcctgctactataaatgctaatacaattggagatagagctaaatgctcagacatttgagcaatagcattccctacaccactatcgataagaatttgcttaaatccgccaccagcaccaataatcgcaacaattgaaccgattggtaataagctatcttctgttaccttcttaatagcctttttatcgataccttgacgaaatccaagaaaataaaacgctgcaaaacatgcaatcaataacgcaatgataggactaccgattaatgtgacaatcttcatcaaagtagtagacagtggaacatacggagccgctgcagctaaaaccattaacataactggtaacaatataactaaaaatgaaactcctattcctggtaatttcgttgattttgtatttacacgaatcaattctggctcattttcaggaattacacgtttgtgaatccatttagcgaatataggacctgcaataatcgctgcaaaaaatgtaataatgagtgaatacaatagtaccttcccaaggttcgctttataaataccaattgcaactatggcccctggatgcggaggaacaaggccgtgtacgacagatagcccagcaattgctggtaatgctatcaataaaatattttgtttcgttgttttatgaattgaaattactaacggcagtaatattaaaatgcctacttcaaaaaacaccgggattccaataataaaacctgcaattaacatcgcccatggtaagttttttatcccaaaggatttaataaagaactctgccacttgcattccagcacctgactctgccatcattttccctaaaattgtacctaatactaaaatacctactaaatgcccgagaacactgccgactcccgtttcataagcactcactattttatccattggcatcccagacataattgctaaaaacaaacttgcaatcgttaaactaataaatgcatgccatctccaccacgatacccctaaaataacaattacgattgataataatgtaatcattaaaaggtacatattcatacgcagttccacccctttatgtaaaccctttcaaaattgctatacaattaagagaacctatatagttctttcatgagtaagaatttatatatcgatatacaaatcatcttcacaaaataataatttatacaaaaagaatctcccttatcagagatacatgttaactcacctctctgataaggggatttctcttccataattataatgttattgtgataaacgcttcgcgcgatcaattttcccttttttaaaagtgaatgacactttcttctcttgctgttttcacgtagtaagactacaaactcagtatccactttaaacgatgaagttacttaggatttgtcttctcatgaaaaacaactttcggaaagcaccttcactttcataacattataatttaggcgctttcgcccaatcagcagcaaatttctcaataccttggtctgttaatgggtgcatagcaagttgttcaattactttataagggattgttgcaatgtgagcacctgccatcgctacacgagttacatgatctggatgtctaacagaagccgcaataatttgtgtatctagttgatgaacatcgaataattcagcaattttagcaactaatagtacaccatcttcagaaatatcatctaagcgacctaaaaatggagaaacgtacgttgcacctgctcgagcagctaaaagtgcttggttcaccgtgaaaataagtgtaacattcgttttcacacctttttcagtaaggtagcgacaagcttctaatcctgctaacgtcatcggaagtttaattgtaactttttcatcgccaccgttaattttaatcagttcttctgcttgggcgatcatctcttcagctgtaacagcatctggcgttacttctgccgaaacagattcaactttaggaactgcctgacaaatttctgcaatacggtcttcaaatttaatgccctcttttgctactaaagaaggattcgttgtaacaccagctaaaactccaagtttatatgctttttttatatcctcaagatttgcagtatcaataaaaaatttcatgattaattccctccagtttttaaacgttgatgagttacatgtttaatatgcttatcccgtaaaagcccgatttgtgtggaatgaagcccctacttattaaagtttcactttatttcttttctactgcatgtccgccaaattcattgcgcagagctgctacaacttttcctgtaaatgtatcattgtctaatgagcggtagcgcattaatagagacattgcgataacaggagttgctgtttgaaggtctaatgctgtttctactgtccattttccttcaccagaagaatgcataacacccttaatctcatccagttttgcatctttagaaaatgcattttctgttaattccattaaccaagaacgaatgactgaaccgttgttccatactcttgatactttttcataatcgtagtcaaattcacttttttctagaatctcaaatccttcaccaatagcagccatcataccgtattcaattccgttatgaaccatttttaagaagtgaccactaccagcttttccagcatataagaatccattttctacagcagtatcgcggaagataggttcaacgatgtcccaagttcttgatctcttccgatcatgtaacaagcaccattacgagcgccttccattcacccagagtttctgcatcattaagtgaatgccatctttctttaattgctcatatcggcgggtagactct

SEQ ID NO: 1213 - DNA, 10060 bp, Bacillus thuringiensis
gtggtgacaaaagatgaatagttatatgttattatttattttcgggataattttagctaattactcacaaatattattaaaaaaagctactttgcaacaatacgattctagaataaaagaatatgtgaatccttatgttattatcggctactctttatttgtaattaacgccggattaaatgttatcgccatgaagggcatggcattaaaacaagcatcagcattagaatccttaagttatatcatcatattaatttttggttggtatttcctaggagaaaaaataacgaaacgtaaactcatcggcaacatgattattatcgttggtgtaatcgtttattgtatccaatagtaaaaagctccgtttatcacaaacggagctttttactattgacctaaattttgcactttatctttcaaatctcgaacttgatctaccgtctgcataagctcagagtttttaaattgctctacatccactttgccttcttctatctttgtcttcgccgtatcaattaacgtatttaacttttcgttatatccgacgatttgttgatgaagatcctttgctacatcaggtggcgttaattcattgaatgcgggtatatcttgtttaatttcactaagcttcgtttctaattcttttcgagcctcgctatcattaacggccttttctgctaatgctggtgcatcatttgcaaatgcacttatttcatttacatagtctgtcgccttttgagcataatctatggagttctttccttcttccactattgaacatcccattaaaccaattgaaactatgaatactaatacaattgattttattttcattttagacccccttcgtccttataattgtctgtaattttctctatacataacttctagctaaattgtttatagcctttttcaaatagctatttaccctcttacatgccctattatcgttacaacatctatttctatatgcacgcttataatatcttcaattatatccatatacccttgtcctatagctgttccatagtgtaatgtaagccccttcttttcatacactgactttggcactgaaaaaataaatctcctcaaatttctttcatcagctggttccataattaaaacaatcccatcctcatcaaacatatacgctcgccctccaactttacattcactatggctcagtattgccttggtcagcaaaatttaaaacataataagttaagatacactctgctctatcataaagtgaaactttaattagccctcaccagtcgactctttatcggcaaatagcgggataaaaataaaaagcattcattcttttttgttaagaataaatgctttttaaaaaatcaatttctaactctaacatctttttttgacgaggttttactttccttacgggaactccagcgtaaatataccaatcatctaaactctcttttaccatactcatcgcgccgactgccgtaccttctcctacaattacatttggaaaaataatagaattagcaccaataatcacatgtttttttaaaataactttttctgctttcacattcctatattgattcgggacggttggccccattaatgtatttccactgaaatcatcaagtactgcatatacgattgttttagctgagatgtttgcaaaatcatgcatttcaatcccaacttcccctccatataacgctgtatacgctgatatgtgcgaataacttccaattgtgattttaccacttaaaatgcaaaaatcatcaattcttacatgattgccaactgatatagcactcggattatatatacttgcttttttactaaccaatacatttttcccaacagataaaaatccaattttctttagttcttcttgactataaaaactattcatctaccgacaccaccttctgctctaaacagattacaatttgctctactagttctttcgtcatcccttcccataaaggtaaacttacgattcgttttgctattttattcgtttttgttaaatctgtcgacttatagtttttaaaaagaacttgttggtggcaagatggtgaaaagtataatctagcttctattttctgttttttcagttcttcaattacttgtatgttgcgaacttcttctggacaaatgataggcataaattggtgaataactgcttctgtcttttggactttccacccttttttcattaacccagtattttgtaacaactgtttataccattcagaaatacgggtacgttcttttaatttttgatcccacttttttatagtcgcaatcccaatagctgctgcgtattcagacattttacaattaaaccccatcatcgtacattcacgatttttatcaaatccgaaattccccattcttttaatacgttgtatatcttcttcgtttttactatatatgagccctccttcaccaattccgaatggctttgttgcatgaaagctatatacgatcattccactaaaatcttgaccgtaatgcatccctccattcattaatccaaatcccggcgccgcatctacgacaaccggaatccccttcttctctaattcttcatattcttctaagttcatccatgatccaaaagtggcgtacgggacaacaatcgcaacctcttcttttaattcttctatcttatccaaaagtacggttttatccatataccaatcatctattgaaatatcaataaagtaaggttccaatccacaccaaatagcggctaaggcagtcgcagggaatgtaaagctaggcatgagagcatactttccctttcttcttttctttagttgaatagccgccattaaccctaacgttgcgtttgctactgttgtaacagctcccctgttttgaaaaaatgacgacataattgtttcctcaaaacgttgatttataggtccataattcgtatatatgtgagatgtatcaatttccttcaattcgtccaaatactcacttacaggtacagttgaagcacgtaaaaaaggaatattctccatatctattccttcctatcattttcggacaatatagagcatatctgtttcagataatccaaatttcctagcacttttcattccttgtttttccgctatgttatataattctaccttaaatcctgcattcattaatcgttgaataaatcccgattgattgtaaattctcacatgatcttcttgaccaaaagctaatttcctcaattgtggtgttacaattaattcattctctataataaaatctacattcattacgattggtacttgaataattccccatccatttggctttaacactctatataactctcgcattgctttgtcatcatcaggaacgtgttctaatacatggctacataatattacatcaaaagtattactatcatatgtaattcttgtaacatcaatttccttcattaatggatcctttggttctaagtcaccacatacatacgtaatatttttatactcgttaaaccaatctcttaactttgcttcaggtgcaatatgaagcattgtatagtttctatttaacaagtccgtttccgtttcaatgtacgcacggtacaatctttcacgatccatcgaattacaaactggacatatccctgtatctttattccacatttcaaatttatatttcggaaaatcataatgtgctggccaaggtgaaaatttttcaaattgttgattgcaatattgacaataacaacattctttctcgaacatatgagcaactaacttgtttaagcctttttttatcttttcattataaatttgatctagttcgccatttcttactgcatccttaactataaatcccgcattttctaaacaataagataaactctctttatactcactttcggagcttaaaaacccactattatatgcatctataattaattcaatccactcttcaattgtcattaaaataaaatgcatttgtttttgattttgtccactatgctgtctaaaataactaagaggttcatgtatataaactacttttcctttcctcatcatatctagccaagttgcaatgtcattaatagcagaataagcctttcctttaaaatatccaaacttcccgtcaaacaaattccgattaaacaaaacagttgtcggctcaccaactacatttttcaagttttttaacatataattccctaattcttttccttcaaaaagtgtagtttctttcgcgattttcatatttaatgttgaaggtagtaatatctctccattctcatcaatcagttcacgatatgacgtcacaaatgaaatattttctaacgccaaaaagtatttcatcattctctcgatcttttcatgatgaaataaatcatcatctaataaaaagtttatatagtccccattcgcaagttctacacacttattaaagttttcggcaactaacggcgtttcattttttacatatgtaatacactcatattcacgtaagtacggttgaatcatagcattgacttcattatttgtactgtcgtcagaaataataatttcaatattttcatatgtttgattcaaagcgctgttgagtgctaattccaagtaataaggtctattgtatgcaggaataagtatacttactttcggtaaagaagaattattatttatatgttgttttttcttttctatgtttattttcttcgctctaattttttggcaatagtctaatgtatataatattgatgatggaactatccttcttgcataatctagaaaattagttatcgctttatctaactctttttcagtggataagaaaccatattgttctcctgctataatactgtgtgaaaaatcttctaacccatccatcattttattagattcatttaactgttgatctggatgtaatcgaaagtaactaagtgtctctgctatatatacagcttttcctttacttaataaagataaccatgaagctatatctacgttacataaataccgcctcttatcaaaaatcccaaacggttcttgtaaatcatttttacgaaataaaactgttgtcggttctccaatataatttttttgatccacaattaccttatttcctaattctgttcccgctataatggtatcctcttcaaataaacggacagtcgaataaatatgtcgtagctctttccctttatcatcaatgacttgacgatgagatgttacaagcttaatttcattatctaaatcatcgaaaaaatacttcatcattttttcaattttattcacatgaaatacatcatcatccattaaaaaatttatatattcaccgttcgcttcattaaataacattagcgcattttcaaattgtccgagagttgatctattttttatataaataatatttgaatgatcacataagtatttttgtaacactttttctgtttcatcattcgtgctgtcatctccaactataatttctatattagggtacgtttgttctaacacactacatagcgccttttcaaagtaacgaggacgattatacgtaggaattaatacacttaccccggaagttgctctaccacctcttcagttctttaatacgagttctcattttaactctctcacctcttcgcatattatttatatacgcgacacaaaaatcacattactttaactgtatggagcctatatacttttatgcaaacatgaaacaaattatcatacttttcgttcctgaataaacatatttaataatgcggacattttatttgcaccttttttattcatatgatcactatcataaaaatcatcgtcacaaaataatggcgaatcaaatagatctatgatttgaaaagaatattgagtttgaaaatcatttataactttataaaaatcttcttttaattttttactactacaattgaaataatgtgaagtaacagggaacacaacaattagtggctttatatcattttttaacagtaaatctaaatattttttaaaaatcattttattttcaactaaagtatgagggtacgacaatttagcatgtgaagctgctcttattttcccgtgttcttcaaaaggaatgtgaagaggagtggtattccactcagcatttatccaaggcagtatcaatgattcatcttttagttcatctaataaaatatattcaaaatgcaaatttaaaatagaaagaagtggtttcggagtatttagatgtgagaatccatcagtgggtagaggagagtgaactacagtatgatgaccatcttgaaacaatggataatatactttgtgaattctatatgattcggaggataacgacatatcaaagtaaaacgagaaataggctattcttattaaccaatattgaaatgaatgattgtttgataaaagttgtgacgctattaaataatcatagtatagatcttgcgatggaagtgttaattttattgacttttttgagagaagctccgtacttatgccacaatgcggataagacaaaccggtagcaaacaattcatacgtcggatcactctttgcttttttcatagaaatgtataaagacataagatccggatttatttgatagatagaaattaatttatccttccattcatacatgtattttgttaaattaataatttttgaactttgcacgcccctatttatcaagtcatttgtaagtttttctgcgtcccctctccaaatgactatatattgaaaagaactttctatacgaacaacatctgaaacgtccgcaacatgaactattgttttacatttatttttgtctaacgtatttcgaatcctatcccctgataattcatcacttaaaacaatgattttatattgttccttcatgtacatcccctccattatatgtataatatgaaattcatttttaattcgtaacaatcatatacacctgcaatctaacaaaaaaaatagctccaccattaggcgtagctatttttacaattattgcttattcaaattatattcctttatctaactcataaagtttacgatacttttcattttctttcagaagttgtttatgactaccttgcatgacaatttggccacgatcaaggaatataacttcgtctacatgttctattcctacaagatggtgcgtaatccaaataaccgtcttttcttccgttgcagaaaacattgtttcaattaaagacaattctgtttttggatctaaaccgatagtcggttcatcaagtacaataattggtgtttcttgcataagagttctagcaaaagcaaccctttgtctttccccaccagaaaaccgctttcccatttcatgcatttttgtttgtaatccgtctggaagagaagtaacatgtgaagctaattgtgctttctctaaagctttccatatctcttcatccgtcgcctctggtttgccaattcgtacattatttccaattgtcgtatcaaacaaatgcggcttttgatttaatacagaaatatatttagataaaagattcgtatgagctcgttcaccatttagtacaacttggccatttactgggcttaacgcccctgttaacaattttagtaaagtagatttccctgtcccacttctccctaaaatagcaattttcttccctgtttttatttgtaatgatacatcttttaatacaatctcattactatctggataactatacgatacgtgattcagttcaatatctacatgttttggttcaatataatctttctctccatgcaaatccgtttcatcatgtaaaacactatcactttctacgccattaagacgatgggtagattctacatacgacggtattcgatcgatggcatctgcaataggaataagcgcgttcgttacagataaagtcattaatacgaaagctgcgataactgtaggagcaatttgttcacttgccgcttcattcccagtccatatgatcatcgaaataactacaatacctactactaattgaatgatactgtcccgaatatgataccagcgtttcactctcttttcgatttttaacaactgatcattttgttttacatactcattaataaattcatctttacgaccacttgcttgccaatcagataatccaaaaacagcatctgtcagttgttgatacaaacggtttcttccttgctttaaagtaacatgatgtttcttcatcaaaagtaatgatacaaacggaagaagaaaaacgataatagctaacatacaacctacaataagtgcaaaaacaaaatcaaatgcaccgataacaagtacgaagatactataaacaactagcgctaatatgctaggaaatattgtacgtaaatataggttttgcaaatgctctatatcttcggataacactcctaacatatcacccgtttgaaatcgagaacggaaaaataacgcctgtggttctactattctatatagcctcgttctcattttttctaatatacgtagtacgacatcatgtccgactaagcgctctatataatgaaatacagcttgccctatactaaacgctcttgttgcaacaataggaacatatacagccattacattttctggtctaagggcagattttgagattaaataacctgaaataaaaagtaacatcgctcctgaactaactccaagaagaccaaggaaaatagttaaagtcattctacctttattttgttttatataaggtttaacccagttactcatttctctcccctctcttccctatgaaaatgtaatgtctcattctctaaaagttcttcatacgtcccactttctttcatttcccctttatttaaaataagaatatggtccatttgtttcatccaatgtagacggtgggttgctaaaaatactaactttccattaaatagacgtaacatcgcttgctttatttcaaattcggtttcaatatcaagatgtgccgtaggctcatctaataaaatgattggttttttacttaaaagcgcacgcgccatagcaacacgctgttcttgtccgccacttagcatacgtccaccttctccaattctttcgtgcatcccatttggaagtgatgtaacgagtgaacgaaggccgacttcattaataactctttcaacttcttcatctgttgcatttgtttcataaaaacgaatgttatcctttaatgaaagcggaaaaatataaggttgctgcggaatataagcgatatttttttgccaatcttcacgagtagatccatcaacttctacaccatttactaacatctttccactcgaaggagataaaaaacctgctaatacgtcgattaacgtcgatttgcctgcaccactttcaccaataacaccaatagcaccgttaccttcccaagtaaaattaattccttctaatatagccttttcagattcagtattattaactttgatgtcttgtaatttcaagctactagaggcattccatactatatcttcatttaaatctttcttttgtattcctttttgttgttgcaaaatctcttctatttgctccatcgcaatttgtccatctaatgtcgcatgataatttgctcccacttgtttaatcggcagaaaatattccggagctaaaatcaaaattgtaagggctggtaatagtataatcgttccatctattaaacgtatccctaatccaactgccacaaacgcaattgataaactcgtaaagaaatctaatgcaaaagaagaaagaaaagcaactcgcaaagtacgcatcgttgcttttctataccttttacttactttttcaatctttccttcgtgctgttcacttttccctaaatactttaatgtttctaaaccttttaacgtatctacaaaatggttcgaaagtacacgatatatctcgtactgactatctgccattttttgcgctgccaatccgagaagaatcataaatatgatcacgataggaatcgttacaactaaaatgattccagactcaatatctagcgtaaaaacgtatagtacaattagacctggaacgatgctacttctaatcattttaggaatctgtaattcatatatgttttaaatttctc

SEQ ID NO: 1214 - DNA, 6769 bp, Bacillus thuringiensis
ataagggagagaaagaaatgatcaccatatgggtaacttaattattcgaatcgtgttaggggtaacattcttcatgcacggtttaacaaaattccaatcaggaattgacaatattgcagggtggtttacaagcattggtttaccaggaggacttgcatacggtgtagcaacatttgaattagttggaggcctattattaattctaggtttaggtgtaagatatattggattattatttgcacttgttatggttggagcaatcgtaaaagtgaaatggtcagctggtttattgggagatggaaaaaatcctggtttcgaattagaacttgcattattagcaatgggtgcatacttatttgttgcaaaagctgatggttttgtagataatttcttaaaagaaaaaatgtcaaagaagaactaatttaaatggggggctaacaagatgagttttcaacttcatcccgatacaacactggatgttgttcatttatacgtatctaatgtaaagaaatcactagagttttatacggaagtactaagtatgaaggtgctaaaagaagaaaaagcagtcgttacatttgggaatgaaaatgatgaaccacttcttatcattgaagaaaagaaagaagcttttccgaagcaaagaggaagaacagggttatatcattacgcaattttattaccaagtaggcaggatttatcgaatgttcttcgtcatcttgtagaaatggtatatccactacatggtggggccgatcattactttagtgaagctctttatttagctgatccagatggaaacgggattgaaatttatcatgatcgacaaaaagaagtttggcgtgatgagaatggagagctcccatttgttagtaacccgttagctggtgaagaattattgcagcaaggaagtacatggagtggatttccagctggtactgtgatggggcatattcatttccatgtagctgatttagaggaagcgaaacgtttctatgttgatggtcttggttttgaagtaacaatcccagctcgtaatggagcgttgttcgtatcagcaggtggctatcatcaccatatcggtttaaatacatggcaaggtgaaggggtaccaccgcaaatgccaggttctgttggtttgaaatatttcacaattgtattagcggatgaaaaacaaaaagagcaagtatgtgaaagcttaaaaaatattggtaagattgctacgtacaaagatggaatattacaagtcgaggatccatttggacattgtatccatttccaaataaaaagagaagcctaaaaaggcttctctttttattttcttataattgcatcatcgttatgcaaaaaaaaggtcatcaaattgttttgcaagctcaaaatctagtttcgttaaaccttttgcattccaagatgacaaagtaataataactgctttatactggataaggataaatggatggtgattatgttcttctgatagtttggcggcttcagagacaaattcgactccttttaagtagtcggaaaacatatattttcgttcaatccatttctcatcttttaccatccatttatctaccttcaataattcctcgtgaacttcttcttcagttaatcttagcatcatttttcacatcctttattggaagtaacgcaagaccattgttaataaggcgtgttacagcttcgtcagttgtgaaagtagaaagttgatgtagtaatgctgcagatgtttcatgccctttgttatgctctaaaagtaactctaatacttcaaggcgcagcaaccattctttcgcataaaatttatttaatacttcttgaattgctactaattgatcgatatgcgcgtcgtgtaaaatcccctcacttcgaatatctcgaactgtttgatacatacgctcgagttcattcagtacaagcggagcaggaatttcttgaacttcttcatccattgggaaaaatgctgctgcatctgcggcacctgggaatactgaagtgatttgtgagccaacagccatatcaaatgcgccccatgaagcatcaaataaaacgcgggcgttataagtaactgtgcaatcgataaaggaaataagagcaattttcttatcatttttcacaatatctgttactgttccttttacatgaataccacttgcaaaagtaaactcagcgatagttccaattttaattcctaatgattgtagttgttcgtctgtacaattttctaatgcaatattttcagtaagtaatccaatcggtgttccaaatccgtcactgtgtacagaagtagaatgattcgctaactgtttattatgaagcgctaatgccgttggcgaatttgttcgcatgtaaattaattcacctgcatcgttttcaattgtctcgctaaatgtacctgtgatttgtaatccactatttagctcagctgttgcatagttctcagagcgaattgctttttctaaaccttcttttccacctgttttaaaggccatcgttttagaaaatgtttcaagcgcatctgttaattcttcaaaggattcacaaacaaatagttgtggttgcatttttgttacgtcataagttgtccctgtacatgcttcgatagaaaatggaaccttttctacagcgtctgttaagcaatgtttgctttcgccaacagaagaaaggagaccagcaccatatatctttggatcatctatatttccgatcaatccatattctactgtccaccagaaaagacgtgaaatttgttcagcttccgataaaccagaaactaagttttgtttttcaattacagcattttcagcagccttaacttcatcaggagtagaagtagggctttcttttactatcgttaatgtacgaacagcttcaaatgcatcatgttcttcttttgtagagaaagcttttgcaccaatttgcccaaaacgtttcacatattttgcatatgtaggatcaagtaaaatcggtgcgtgtcctgcggcttcatgtacgatatctggagctggtgtgtactcgatattttctactttccggatatctgttgcaatcggtagtaatccgtgtccttgaaaatcgaagaatgctacgccaggaataagtccgtcaattgttacagcgccccagccgcttggtgccaaacactcattcatttcttctacttttggaattgcatctatattaataccagatgattgtagtccgttcacataggctggatgagcaacgtcttttaagaagctatgattttgtctcataatgtaacgccacacagcgtgattcaccggtgtgtattgatcataatgttgtgtggatacaaatggttttaaatgcgatggaatttctgttttctttgtcatttagacatcctcctttttttcaataaaattgaatatcgatttcgtatagcttgtatcaccccctttcatttttttgtaagcgcttataaaattttatcataagattcggaattatttaacatatgtttctgtgataaatagaaaaagcccctatcggaaaatccgataggggcgaaagaatcgcggtaccaccctatttgtaagtgaaaatatacttacatctcaattaatgataacggaaaaattccgtcttttcctccatgcataaaagcattacgaaaaagaagctccagaattgtaattcatacttatatatgtgctaatttccaccgaccattagctctctgtaacagggatataagatactactgcgattctttcaacgcgtatatatgaaattgtgtaagaggatggatgcaaaaaagtccctatcggaaaatccgatagggacgataaaaatcgcggtaccaccctatttgtaaacaactaattgtttaccactcactttacgataacggaaagatccgtctttctcttcatgcataaaaagcattacgggaaagaagctccagaattgtaattcacgcttgtatatgtactgattcgcaccaaccatcagttctctgggacagtgatataagtcgctactagcattccttcaaagccgatatataattcgttaaactaaactatgttttgtattataaaactatattaaaaaaattgtcaacaaaaattttttatcccgtgttaatgagcagtaaaattcctacctcaaaattcggtgggagaataattgcccgtaacccccgattggtgaaggctaataatcagtggggatgaacaaaatctctactgattaaggtttcactttatttcacttctaaattaacagttaaattagaggtattgccagctgcatcagttgctacaatgtgaatagtatttttttcttcgtgtaattgagtgcgatcgaaataaatgtcatagcttttctcccaagggttcaggaatgcctgttcccatacaccatttccgttaatttcatattgcattctcactggaataccaggtgctttttttagctcagcatgataagactgagcattactattttgtaaatctggagcatgctgaatattactttgagcagcgagaggtgcatgttgcaattctacaattactgatatttcttttgttgttttcgtttcaacattttgagcaattttatgttctccccactgttcaatcgttgtttttaattgtggactaaattgcttctccttttgtagtgattcagcatgagcgcttaaagctccaaaactagaaaagacaagcgccatgcttaatagtgtagatgtagtttttttcattgatactccccctaataaaaagtgacaatattcagaaattaaatcttacattttagttataacttataaatataaatgttggctaaactatactttcaacataattcataccaatcctctatgaattgaaaatttcttgggaaattttttctgattatgtcgaatcgatatttttcacatattgtaggaagaaagtgaggaatgctatgagggaaatggagtgatggtatgaaaaggctaatagtaagtggtagtgtagtgttgtttatgtttttgtgttctatcactattactagcgcagaaaataatagtgtgaaagttgcttttattcgtcatcataacctttggattaaagttgaggggaaagaaaaacaacttacaaaaggagagaacataacagggccaaagtggtcacatgatggagaatggctggcatatgtaaaagggaagaaacaaaatattcttgagttatatcggctgaaagatggaaagaaagttacgccgtttcactcagaagcatcgaattatcaatggtcaccaacagaaaatataattgcatttatatttacaggtacattaaatacatttgatgtagaaaaaaagaatgcagattttgaaaatgtatcggctggtgtaggggattatgcatggtaccccgatggaaagaactttcttgtatcctctgaagcgcacttacttccaacaggatggacaggggctcagctatatgaagtgcaaaaagatgcacatatgaatcctcacaaaatgaagcatttgtatgcattgccaaatcaacatgatgatttcctagcgctagtagcaagtggctttaagtggtcaccagatcaaaagtggatttcatttttagcagtaccgacagcttcatggtcagctgatagtaatacgctttgcttagttcgtgcagatggcagtcggtttgaaaaagtagatcaaatgttactaaacgcacaatggtttcaatgggcaccatcaaaaaatatattagcttatattgaagggagcggaagagttgcattagaaaataagcatttaaaagtaaaggaattgccagcacttcagcagaacatatttacgccgaaaggatatgttgattgggattttgtatggaagaacgatagagtaattatcgtttcacgagcaaaggaggcagggatagaaactccaccagaaaaaaggccactaccatctttgtatgaggtcgatagtacaagtaatgcacagcatcaaatcacaaagaaaaagaacaagcaaggggattaccacccgatcttcatgaagaagagtaatcaattaatttggatacgttcagaccgtaagaaagcggatgtatggcttgctcataaagatgggaaacaggaaaagaagtggattgaaaatatagatgtaccagcgtggtattatgagaaatggaattgggaaaatgtcatctcggtgaaataacaataaaaaactgcctaaaagatcattttaggcagttttttattgttatttatgcgttttatttggcttttttttcgctgggtttccgttcccttggcgctttctattttgttcatcttttgcttgtttttcatgtagtgtatctaaaaattcattcgagtatataaatgctaacttaaatatgtacattaacgcttgaataaatatgtacattttcaattggattctccatactgactctgaggtggttagtatgtatattaagctagatattcaaacagaatttgaggttaaaagtctttcagacttaccaaattttaaaaaactaatggggaacttaaaaatgaagataaataaaagtcaattagccagagaattgaatgtggatcggcgtaccatagataagtatttgaatggttttacaccaaaagggacaaaaaataaaacatcgaaaatcgatacatattatgaagtgattgcagctcttttatctagtgattctaaacaaatcttctactacaaacgagtgttatggcagtatctaacagacaatcacggtttaaaatgttc

SEQ ID NO: 1215 - DNA, 7684 bp, Bacillus thuringiensis
atcggtttcttcaaaaataacaattcagaaatagcagtagaacccgctctggaaactacaacacttgccatatttagtatatgcggcaactcgtcgcctatatattcaaattgcatatacccctccatgccaatagatgggtctaccttccctttaccacatatatgaataatattaaagtttaatagtattgtatctaaacattcccttaccatatcatttatccacttagcaccttgactcccacccataattaataatactggtttatcttgctgaaattcacaatatcttcttcctcgtaatacgttacccttctcaatttcttcccttacaattggtcctacataaaccttcttctcattacttacattttctcctgtctgaggaaatgttgtgcatagctttgtagcaaaaggtaatgctattttattggcaagtcctaatgtgctatctggttcacgtataattataggcacacgatttaaccatgctcctatagctacaggaactgaaacaaatcctcctgctgaaaagataacgtcaggctttgttttcttaattaatttataactttgtaaacaacctcgtataattttaaaaggatctttaaaattttcccaatcccaatatctcctaagcttgcccgttgaaacactattgtatttaacattttgcactaatgatttttcaattccatttttggatccaatatactcgactctccagcctttctctataaatttaggaattaatacaatattaatcataacgtgtccggctgtaccgcccccagtaaaaagaatcgttttgctcataacttatacccacctttattattaaaaatctagctttatatttaccttttaaatgtaaataaaattattattttttatataaatctttaactccacctctatatcttgtaaaagatctttaatgagttcataaaaatcatttccatactcactacactcgtattgagcaaagatttgaatcacatatctagtttccgtctctaatgctgactttatttgattaacccttttttcttctacatacgcttgatatttatgtattgcctcataaagacgcaatacatgcgcttcttcatctctccaatccaacgcatcaacaattgaaagaaatagcgtattttgattatctattatttcataatcattcatatattttttacacccttttttgtttttcattgcatgcagatgtcactacacttcgcatactcaagtacatcttttaatgattgatgaaattcaatttctgggatccaacctaacctttttatttcctctattgctaaactctcatttgagtcgctcccacttttctctgtttcctctataaaaaaatttagctgtgttaattctttatattgttctagtacatttaacaaagatcgttttactcctgatccgatattatattgttttccatttattccatctcgtaataacacatgatacgctttaatcgcatcacgtacatctagaaaatctctactatctttcaaactgtttacttcaataatggctttacttctacctgattctatatctatcattttctttgcgagaatcgaacaaatgccattcgattcccctggaccaattaagtttgagggctttgcaatgataatatttgaatccattaatcctccccaagcctctgcaataataacttgcatcgttttacttaaactatatggatttgaaatttttatttcgttcatactatctgcttgcaaagcagatcctataactaatgttctacaatgcgaggcttcttgcttaattgcttctaataaatataatgttcctattacattaacctctatatattcaagggcagctgtccaagattctataaccgaattccttcctgctaaatgcaatacgtagtctggctttatttgtttcattaccttcattacttcgctcttattagttaaattacaagtaataccatttctaattttttctccatatgcacgattttgaaacataggaattacatgaaagccctgctgtaaaaaatagtggcaagcatggcgtcctgtgaaaccatttgcaccagttattaaaaggctcgcattttttttcatcgcaaaaaccctccttttaatagcatttgtttcacctcatgttttgcaagtaaatcttgttgagaactaaaactcttcacatccactagaggatagcttgaataatattgttgaagtccttgtataggaatagtcggtagtaccacaaaataattttgatcaaaacttatacttgttttactctctacctcagatagaagcatttcacttaatttttcacccggtcttatccctacctcttttaccttaacattttcttttccggaatcttcaattaatacttctgctaaatctgttattttacatgccggcattttcataacaaagatttccccgcctctaccttgagatacggctttaaataacaacccaacagcatcttcaactgttaagaaaaatctagtcatattcgcatcggtaatccctacttgtgaagattttttaatttgttgtttaaaaagtggtactacacttccactcgttcctaaaacatttccaccacgaacacaaatgaattttgttttcttcgtttgtatattcgcatgaaccattaatttttcaccaattgcttttgtcatcccatacgtatttgatggatcagctgctttatcagttgaaacatatataactttttcaacttgcatctgtatagaggcttcaattacattttgcgtaccatgtatattggtttttatagcttcataaggataatactcacatactggaacatgttttaaagctgcaagatggaacacataatgtacaccttggcaagcatagactagttgatctttatcacgaatatctccaataataaattttaacctatcatcatttataaactgttgctgcatttcaaactgaaccgtttcatttcttgaaaaaattctaatttctttcggtgatttttctaatagttgttttataagttcatgcccccacgaacctgtaccaccagtaattaaaattattttatttaacattcttcttcctcctacgaaacatctcaatttaaataatatttattgaattattttcaattgattcaaatcataatcgtcgtttgttacatttaattgacaaaataaaaaaacagaaactattaaacgtagtttctgtttttcatttcatctcacaacagtaagattttttatactgtttgcatgataaataaattccttgtaaaaaaacaccgctcatttatttcttatactcgtaataaaataaatagaatgattcatagccaataatcatatttaaatttatgaaaaagggaggtaacggaatggaccgaagcaattcaaatcatacatataacggaccttccaaagcactgcctctctccctattcgacgtaaaaaatgaattgaaacaaaaaagcaaacttattccttctgacaccatgtataaattaacgaaagaagaacaactcatcatcaacaaaataaaaatacaaacagaacaactaaataaaaataatgttacaagaacacgcgcatactaccaattttacattcaatatccagaaatacattgggcactgcttgggcatatggtatcacgtaacggcggttggaatatgactgatttaaagggcgatttatatacgagaattttatcagagaaagatcaattcatatttttttcttttttagaaagagggaattggcttattttccaagatgtataccctcaatttttactttacgaacaaagtgtaaagagatcacaaaagttatttcaccttctccctcacctaaatgtttctacatttatggaaacgatgtggaaccatttttggaaaacaggtaacaaaaaaactttagcaattgcaactattattaatgaacaaaactacttagaaaaaagagtaattcaaaatgtacaatttaaaaagactgtactaaatagtattggatttaaactctttgatttctttcagtttaatcatatccttttcccattctacgaaaatgataagaaacaaaaagtattactatttggtgatacaatgaaacatttcacttccttacatgaacggatattaattggaaaaagattgtactcattattatttcgagatacacatgttttatctcaaataataagctgggctcaacaccatccacatacaggatctaggaaagattactggccccatttattttcaagtgtaaatgaatctttttcccgtgagttttataagcgccgaattaagaaatgccagttacgaaatggctcttatcgtatatacagccctgcactcatctatgcatggcgagatatgaagcatgaagaagttgacagtgaagattggtttaccgattggcaagttgtaaattacttagttgataaggaggaaaatataaatggacaaattacagaagactactgcaaaacactcgaaaaaattgaaatcgccattctcgcaaagaaaaatgtcctcctccgagaagaagaatgagtttctagcattagtagttacaatctttctctcttctattattgcaacttgcttagatgccttttttgttcataaacaaatatattcctttccggctaggcccttctcatccacattttcggttaatatagcttttacattgttcgtactgccgattttaacagttatctttatacacatttcaaaaaaattatctaaagtttctagaatttcatttattatttcaatcggtatttgtgctagcctttttgaacagattgctgaaagtttaggtttatttgtacatagtgcgaattggaaccatacatattctttatttggttatataatttttcattcttttatttggaacgtatataattggataaaaaaataaagagaccattataggtctcttcttaagcatactcttccgttattactaatggtgtcaatgtttgaaggcttttagagcgtaaacgataggcaacgactttcttcttatattgcttaatgacatcaacatgttcctcatagctatatagcgaaaatctaatctctttactccctttcttcgtatcaatgactattggtgtcccttctccgtgcggcgggaaataatgtttatctaaaaacaacgcctcattaaattcatgaataacttgtagtttcatttctccctctatattttttccatctatcgatatagaagtattttccgcctcaagcttttgatgcaattcaaatctactaataattgattctacaacagaagtgggcatgctagaaactaatactttaatagctccaaaaacaaataatgtaactataaaccatgttgtcattgttatcatctccattacatttaaaaaataaatttcgttccatacggtattagtatactaataagtattccagttacaatcatcgttaccgaaccgatagtcgcttctttctcgccttctttcactaaacgactcacaccgataatatgtgatgcacagcccattccaactccttttccaatcgtacttgttatacggaaaaacttaagtactgttggtccgatcatagcacctgttattcctgcaacaactacaaaactagaagtcatagatggaataccaccaatttgatccgctattgaaagggcaattggcattgtcgctacctgtggtaaagtagttaatataagttccttatctatatttaaaattccgccaatcactacattcatgctcgttacagccactatacctatcactactccgattagtatcgatgaaaaatttttcatcagtatctttcgctctttaaatagaggtatggccaatgctacaattgcagggctcaataagcttgaaagaatgtttcccccattttccctatactcatgatgagaaataccaaaaatcaaaaataaacaaatcataattgccgtaactgttaacactggtaacgtaaatgcaaacgtaaattttttatatagctttgtcgccaagaaataaattgctacagtaataataattaagaccatttgaatcgtgcaccttgtcgattttatttttttgatgtgactaataattgacttatataccctgaaacaatcaaagttactacagtacttgcaactactaaaaggaatataatacttcccttactgaaaagaaaagacccgtattccatgagccctgttgtcgaagggattaaaaataacggtaaaaatacgattaacttttccgaacctaactcaaaccattctaacggtaaaacgcgagtggaaaggagcaggaacagtattaacatccctattaaattccccggtattgatagatggaatatttcctgaatccacgtacccactaggctaaatacatatagcacgcctacttgaagtaaaagcgtcacgtacttcatttctttccctcatttcactatcacacatccatattatgaaatctcatttagcgtgtcggcaaaccgtttaattccaagttgaatttgttctatattcgctctaccaaacgtaaatcgtatatattcatttttcgaacctaaaacactgcccggaacaaatgcgacaccattccgtatagattcacctaataagtgatattcatcaaactttcctgttactttacaccatacatgtattccaccctctggcacgaaacattcaactcgttctcccaatgttccttcaagctctgcaattaattcatctcttctttgcttcaattgtccacgaagtatcgtaatatgtgtatggaaatcctttgattctaaaaattgatttgctacccactgcgtaaatacactatggccaaaatcaacttgttgctttgcatctgctaaacgctcaattacgcgtgtaggaccaattacccatccaatacgtaatcctgatgcaacaatttttgatagtgaacttatataaagaacatttccattttggtccattgattttaatgttgggttcacttctccattaaaggagattaaactatacggatcatcttctacaattggtataccgaactcagaagacagttctaaaatttttttacgtctcgctaatgaaagcacagtacccgtcggattctgataatctggattcaaaaataccatacgaatgcgatgctttttgtgcaaatcgattaagtcatctggattcattccatgctcatcaacaggtaaatgaaatatgtttaaaccggccgatttaaacattggaagcgaaaaacaatacgaaggatcttcaatcgcgatcgcatcgccaggttttaataaacattgaacgataagattaagcgcctgttgtgctcctgacgtaataagaatagagcttgaatctgcttcaatttgtttatattgctgaacatgtgctgcaattgtttttctcaacatctcatttccaagtggatggtcataaccgaggttttccataaatgttttctccgacaaaattgttcgaaatctatcacttggaattaattctggtgacagttcaccacttgctaaattaattaaatcatctttttgtgtttccgttcgaatttgttgaacgagtggtaaaaaggtaaagcgatccatcctccacgtacctaccccagttc

SEQ ID NO: 1216 - DNA, 6303 bp, Bacillus thuringiensis
atcgtaaatgacatgctgaagaagtgtttctttttgcatgctgaagttagtatgtaagtgtgatgtttcggagggagggaaagagaatgtcaaaaacagtcgttcgtaaaaacgagtctttggaggatgcacttcgccgttttaaaagatcggtttctaaaactggtacacttgctgaagcaagaaagcgcgagttttatgaaaaaccaagtgtaaaacgtaagaagaaatctgaagcggcaagaaagcgtaaattctaagagagggtgtaagttatgagtcttctcggtcgtttaaacgatgatatgaaacaagcgatgaagaataaacaaaaagaaaaattaaccgttattcgtatggttaaggctgctttacaaaatgaaggtattaaactgcaacatactcttactgaagaagaggaaataacagttttagctcgtgaagtaaaacagtataaggactccctccttgaatttaaaaaagctggtcgtgaagaccttgttaataaactgcaaagtgaaattcagattttaagcgcatatttgccagagcaattaactgaagaagaactagttgatgtaatcaagcaagttatttctgaagttggtgcgacttctaaagcagatatgggtaaggtgatgactgctgttatgccgaaagtaaaaggtaaaacagacggatcacttgtgaataagctggttatccagctattagcgtaaaaaaacgtctcatttcgtatgagacgtttttttattgttcttattaaggagaaacgctatattgcttaaaaagggtttctataagtgatagaaacccctctagttaaagtttcaatttattatttccttgtataattccgattctacacctattcttacttccttgactaaaacttctttcgcaaataaaagctaagtaccgaaccttctgaaaatcagattgaagttttatagcttgctcttcagcataatcctcaaaggtaacgaaagagattctaactattttagattttgcatcagttgcataaaatggccggatattactgtcgataatttgttttataacattcgaaatttcttgactaaagccaatttactttcgtatttcctcatttattaattcattttttaatgaaccctaatattttttgaaattcatataacaaccatctataaaatattcttacttacaacgtaacattcagagtggagaaattttctttttttttgattttatccctcattaacgggcagcccgattggtgaggggggattaaagtttcactttatctcatttgtccaataaatgacaactacttattctatggtcagtatgtcacatccagaacgaattgtaacagtttttttcaagtttctaacttctcgctaggctcaatttcttaatgtaacttgtactgatatcctgtaggggcgcatattcttgtattaatacttctattattaaaggtaacatcctctgatccatcattgtcctgacaaatatgatttcatatagcgactgttttaattaacatgatatgaactcttacagaatatagttatgttagtgaagtcgttataacacgataggcacttgtgaagaaatacatatatatgggatgagagggggtctttcgagatgaagaaattagaacaaatgaaaaattggttgacaaaacaagtagacctaccagtggatgtattaatggatctacctcggattactcttgttgggcaaatacatatttatatagaaaatcatcgggggttattagtgttttcagataaagaagtgcgattacttttaaaacacggtcaattattaattaaaggacaatcctttgttattaaaacgattcttccagaagagcttttgctcgaagggataattgagcaagtaacatttttagaaaatgaaaaaaaaggtgattgaagtgaaacttccatttgtgaagtttttcttctttatcctgtaaaagttccgttgatagagactgattacagttttactcggtttcattttagtacgagctattttaatgtttcaaataaaaagtagtatatctacttttagaaaggtagtgaaggtggtaaatgaaaaataaatggtttataaagtggcttggatatgtaaaagtgcgaattgaaggtagaggagcggaacggtttgttaatgaatgtgtacggaggaatttattagtttgggatgttaaaaagatagctgatgaaacgttagttttttgtatgttgttacgcgatgtgaaaaaaataaaaccaatttatagaaaaaatgaatgtaaattatattttattggacgttatggttttcctttttggaataagcgtttaattaaaaatagtggatttttaattggttttttaattttcttttttggtgtgattgcaatgtcaaatatggtttggaaaattgaaattacaggagcaaaacctgaaacggaatatatattgatgaaagaattggataaaatgggtattaaaaaagggaaactacaatttcaaatgccgaatgtagaagatgtacaacgccatttgacagataatattaatgccattacttgggcgggactagaagtaagaggaacgacgtatcattttaaaattgttgaaaaaaacgaaccgaagaaagaaaaggaacaaaggccgcaaaatttagtagcaaaaaaagaagcgattattacaaagacgttcgtagaagttggaaagccggttgtactgaaaaatgatcatgtagaaaaagggcagattctcgtatcaggaatatatggtaatgaggaaagtccgacgattgtttcagcgaaaggtattgtgtatggagaaacgtggtatacatctaaggtggatgtcccgttaaagacgcaattccaagtgtatactggtaatgtatacaatgaacattttcttaaatttggggatacgaaaataaaaatatggggatttcagcatgataagtataaacgctctcgtactgaaagtgtaaaacatgatgtgaaattatttggttttacactgccgattgcatatgaaaaagatgttgtgagagaagaggaagaagcgaatcgagaatatacagaaaagcaagcgctgaaagtagcgaaagagatggccgaaaaagaactaaagaaaaaattggatgaacatgctatgattgtaagtgataagattttgagtaaagaggttgaggcgggtcaactaaaggtcacattgcattatactgtggttgaaaatattgcagagccacaaccaatatccgaatccgatattcaaggagactgagtaatggcagaacaattagtagaaatgaaccaaaaattggaaaatactaacgaagcaatcgctctttttggagtcaatgatgcacatttaaaagtaattgaacgagaactgaatgtatcgatcgtaactagaggagaaactgttcatgtatctggggcagttgaaacggtgacactcgtagaaaaaatcttacagcaattacttgttgtaattcgtaaaagtatatcaatttcagagagagatgttgcgtatgcaattcagcttgcacaacaagggaaaattgctcaatttgaagagttatatgaagaagaaattttcaagactgcaaaaggtaaatccattcgtgtaaaaacaatggggcaaagacgatatattcatgcgatgaagaagaatgatattgtctttgggatagggcctgcaggaactggaaaaacatacttagctgtagtaatggctgtgagggctttaaaacaagggtatgtaaagaaaattattttaacaagacctgctgtagaagctggagaaaatttaggttttttaccaggggatttgaaagagaaggtagatccatacttacgcccattatatgatgccttacatgatattcttggacaagaatatacgcagcgtatgatggagcgaggagtaattgaaatcgcgccgcttgcttatatgagggggcgtacgcttgatgattcatttgttattttagatgaggctcaaaatacaacgggtgctcaaataaaaatgtttttaacaagattaggttttagttctaaaatggttattacaggggatccttcacaagtagacttgccaaaaggggtaaaatcaggactatctatagctgctaatattttatctgatgtatcaggtctgtcatttattacattagaacaaacggacgttgtgagacatccattggtgcaacgtattattgaggcatatgataaaatggaatgatcctatttgtcaggatcatttctttttgtatgataaggttggcgaacgtcatattttttactatcatgaaagataaggaaaataaactataggtactagtgtataaaatgttgcctcaaagtatcgtttggtagaagaaatgaaagctataaatagtttcactttatttctggagaggagaaggtattgaaatcatgtcaagatctcaagaaatttctaagtggtttcgtaatttacaacattcgaaaaaactaagttggatttcttacgttgtattaggagcagtgctgttttttgcgcttatgaataatgtaaaaccagagcaattagatgttaatatgtattctattgcgaaaaagacaatccattctcctataaaaattgaagataaagttacaacggataaaaagaaaaaagaagccgctacaaaagttgaagatcaatatacatataaaagtgagtataaacaaaacaaagttgatattgtgaatgacgtttttgctaaagtggatgaagtggtgcaagagattaaagctgttggaccggatgatcaaaaaaagatgactgatgctgagaaagtggagaagttaaaaaagaaactacccgctgacttaacgaaagaattatctgattcaaacttactaagtttgattaatgcagattcgagccaattagtattagcgaaagatgctgcggtcacagcgattaatagtatcatgactgagcatattaaaatggacgaattgaaagatgcgaaagaacgatatgtaagtgagatgaatagtgttaatgttgataatggtttaaaagagtcaattaaggcgctaggaagatatgcaatttcagcaaactatttttatgacccgatcttaacgaaagagaaaagaaaagcagaggaagatttagttccacctgtttatattcttcaaggacaagttcttgttagagaaggtgaaacaatttcaagtgatgtgtataatcagttgaaattagttggtttgttagaaaaagggaacggctttcaaccttatgttggattagcggtactcattggtgtgttactatactttatgcataaacaatttgaattatttttaaagagaaaaagagaagatagaccgtatgttttagcgtatattacaattttgtctatcacaatcgtcttaatgaaaatcattagtttgtttcaaaaacttgaatacgcggggattgcatatgttgtcccagttgcgatgggaacaatacttgtaaaactaatgattggtgatcgatttgtctttttaacgagtatgattttttctgtatgcggaagtattatgtttaatgaaggagtaacgagtacattaaattatagtgtagggatttacgtattgttaagttcattatcggttagtattttcttgcgagaaaaaaatcgtcgtacaatgattttacaagctggtatactcgtttctgtattaaatgtagtcgtattggcggcgctcttattattacgtaatgggaatttttcgcctcttgaaattggtacgcaattattaatggcttcactttcagggattatatcatccgttttggctatggggattttaccatatttagaaagtggacttggaatcgtatcaagcatgaagcttatggaactatcaagtccaaatcatccgcttttacgcagaattttgttagaagcgccagggacatatcatcatagtgtaatggtagcgaatctttctgaggctgcttgtgaagcagtcggggcaaatggtgtattagcgcgtgtaggggcatattatcatgatgtaggaaaaacagtacaaccgcaattttttattgaaaaccaaatgggaattgaaaacccgcatgataaattagatcctgtaacgagtaaagatattataattgctcacgtaacggatggagtaagaatgctcgaagaatatcatattccacaagaaattattgatatcgctgggcaacatcacggtacaacgttactgaaatatttttattataaagctattaaagaagataaagaaaaatatacagaaga

SEQ ID NO: 1217 - DNA, 5599 bp, Bacillus thuringiensis
tttcacaagaggtatcactttggactgctgggggcgtaattggaacaacttggggccaattaaaaattattattccagtcatttcaattagtatctttatcgctatcttactagcaaaaaaattgacagttcttagtttcagtgaagaagttgctattggactaggtcaaaaaattattgttattaaaaccattctatttatcattattatattacttgctggtgcgtctgtagctcttgtcggaaatatggcatttatcggcttaatggtacctcatatggtacgtccaattgtcgggccagactaccgatttgttataccaatgtcagcaattactggagcttcctttatgctacttgcagatacagtcggacgtactattaacgctccgtacgaaacaccagttgccgctattgtcgcaattgtagggctgccattcttcctattcgttgtacgtaaaggaggaaaaacattctcatgatgcaatctattctaagaaaacaacgtcttattatactcgctttactaatactaaccatcacaaccattgtagttggaatgggacttggttcagcatctttatcttatgatcggctactcccaacattaatgggacaagggacttttaaagaggagtttgttttatactctttacgactacctagaattgttattacattattagctggtatggctctcgctttatcaggtgctatcctacaaggaattacccgaaatgatttagcggaacctggtattctcggtatcaactctggagccggtgttgctgttgctattttctttttatactttccaatagatgtaggttcatttctttacttactacctgttgttggatttatcggcgcatttctgacagctgttctaatttatgtattttcttatagtaaatcaactggacttcagccaatccgactaacattaactggtattggtttttcatttgcactatctggaatgatgattgtccttatttcatccgctgatcgtatgaaagtggactttatcgccaaatggattgcaggaaatatttggggagatgactgggtcttcgttttagcaatgctcccatggttaatcgtattaattccgttcgttttctataaagcaaatcgattaaacattctagcattaaacgagccagtcgcaatcggcgttgggattgaaattgaaaaagaacgcagatacttattagtcgcagccgttgcgcttgcagctgcagctgtttccgtaacaggaggaattagttttgtcggactaatggctcctcatattgcaaaatctttagtaggtccaagacatcaaattttcatgcctatcgcccttttaatcggcggatggctattgttattagcagacacaatcggacgtaatatcgtcgatcctaacggtattccagctggtattgtcgttgctttaattggtgctccttactttatgtatttattgcttaaaaaggcgtaagaaacaccctcaagattttttcttgagggtgttttttatttcattctactgttgcccatacccttcaaacttcttcgccaaattctccatctcatcttctggcaatagctttggttccccaatgcttttcgtttgataataaatttgagcacaaaactcaatctcttctgcaacagtaaatgccatttttatattatttgcaccagcaattaaaccgtgatttgcaagtagcacagcacgacgatcaatcatgccttcaaaagcagcatccgctaattgcttcgtaccaaatgtttcatacggcgcacagcggacattcggacctgcaaaagcaattaaatatgacacagccggaagctcccatcctaatgacgcaatcgtcttcgcgtaaggagaatgtgtatgcacaagcgcatttatatcttcacgcttcctatagtaaataaggtgcatatctaattcacttgatggttttctctctccttctattacttcaccatctaggtttaatataactacatcttcaggctttgtttcatagtactctaaaccacttgggctaatcgcaacaagaccttgttcacgattaaagatactaatattaccacccgtcccctttgttaaaccactagaaatcattttctttccatacgctacaatttcttctctttctttttgtaataacatatacatccccctaagtatgaagcttatgatgactgacttttatatttatctacttattgaaatatcttttttaaattctccgtaaacggtgcctttacaatccctttttctgtaataatcgctgttacattttcatgtggagtaacatcaaatgctggattatatactttactttctttcggagcagaatattgtccgaagcgattaatcacttcagaagcatctctttcctcgatgggaatttcttttcctgtcggtgtttttaagtcgattgtcggcgttggcgctgctacataaaacggaatgttgtagtatttcgctaaaatagatacgcctaatgttccaattttatttgctatatcaccgttcgctgccacacggtcgcatccaacaattacagcgtcaatcttcccttgtgacatgaccatagccgccatattatccgtaatgacagtaacatcaattcccgctcgctgtagttctaatgccgttaacgttgacccttgtaatcttggacgtgtttcatccgaaaagatttttaagtcccatcctttttctttcgctaagtacattggagccgtcgcagtaccatacttagtcgtcgctaacgcaccagcattacaatgtgttaatactcccattccatcatggaataatgttaatgcatgttctccaatttgacggtttatttcttcatcttctctatgaatttcttttgcctcttctagtaatctatctttcaactgtgagattgataaatgaatattatctgccgctacactttccattctttcaagtgcccaaaataaatttactgcagtcggtcttgatgtcgccaagtatgtacatacctttcttacttcatccataaatccttcttccgtactttcagcaaattcctttacccctaaatacactccataagctgctgaaacaccaatcactggtgcacctcgtactttcattacttgaatggcatcccacacactttcagctgttttaaatgattcatagacaatttcattcggtaataacgtttgatctaacaaaactaaagcatcatctttccactgaattggtattaattgctcttccatcatattctccccttactccgcgtagtgcattgactgttcttttaacgtttctacaaaacttctacctgttctatattgattcgctcgtaaaataaaactcttcgctactttaagacaaatttgctccgctctagcacgtgcttcctcattctcaatacaagtaatatcttttactttcgctaatccaacaatacggcggattaattcaagacctgtcactgcagctgtatcctctaatacagattgtaaatatacttcgttaaagccttcttccttcgccataatctcggtcacatgaatatcccaagcatctaaaaacttcttcttaaataaatcaattacctctaccatcgtagtttgtaaccaatccatatacgtatctttctcagctccaggtggcatcgttgcatctgcattcacccaagcaaacattaaattcgccattacattcccaacgtcatatcccataggtccataaaaagcaaactcaggatcaataacctttgtagaatcatctcttacaaaaacagaaccagtatgtaaatcaccatgaagcaatgcctgtgcattcgtcataaaagaaaatttacgtttcgctacttccatacgaagctctttatcactataaatatgctccctaatccatccctcatttaaaggaaataactcattacgcttattatgatttgtaaatggttctgaatatacgaggtcctctgtaatctcacataattcaggatttatataattcttcacaagttccttcttctctttatgattcattacaacatcagatgttaataaaagtgtatttaccataaaagtagttaagtcgtcagcaagctgcggaaatatttgatgatttataagtgctgtacgtaatattgtgtgattcgataaatcttccattacgcaacagttcatcacactatcaaataaatacaccttaggaacaagtccaggtgctaactcattctctaactgcaaaacatctgattctatacgaatacgattcgtcgataacttaaactcatctgaaatgcgagctgtatccccagcttgctttacgatgacagacatgttctcttttttatcccaaacgcggaacacataatttaaattgccatcacctatttctttacactttagcccctttgcatgttcaaacttagataatttctctttcacatatgcaatcacatcgctagcttccattaaaaaatactttgtgaacttagacatggtttcccctccacaccaattgtaagcgttttctaaaagctataaaaaataataggttgaattttttcatcctataaatatgtattcttctttttgaaaggtatatctaggttttattatatcttgttagcactttgagtcaatgtttctaactatcagcgtaatatacttcctaattatatatttgagatgacaaaaattgttcaaaaagatttcgattcattttattttatttatcgcacaattctttgtaaaatagaaataagcagttccttttcaaatacataacttctaagaaatatttccttcctaagaatttacacttacaccatatttctaacatacacactactctttcaaacaatcattgaaaatttataaacttaaagttacctttccattccctgttagccttaattgagaataaatattaattaaattggtataaagttggtttattctcttgacaaaataaccacttctatatgataattaatatcgaattagaattattatagttaattaaaaaatatattttatgagcacactattttttgatgctcaaaaccaacatttaggaggaattttaatatgttattaatcggcacagaagtaaaaccgtttaaagctaatgcttaccataatggagaatttatccaagttactgacgaaagtttaaaaggaaaatggagtgtagtttgtttctacccagctgacttcacattcgtttgcccaactgaacttgaagacttacaaaaccaatacgcaactctaaaagacttaggcgttgaagtatactctgtatctacagacactcacttcactcacaaagcatggcatgatagctcagaaactatcggcaaaatcgagtacatcatgattggtgacccaactcgcacaatcactacaaacttcaacgttttaatggaagaagaaggtcttgctgctcgtggtacattcatcatcgatccagacggcgttatccaatctatggaaatcaatgctgatggtatcggtcgtgacgcatgcattcttgttaacaaaattaaagctgctcaatacgtacgtaacaacccaggtgaagttt

SEQ ID NO: 1218 - DNA, 7467 bp, Bacillus thuringiensis
ctaagaacatactgcgtccttccattttaggcttatattcaactgtactaacttcagcacaagcttctgagaagcgatctaaaacacgttgaccgatttctttatgagtaatggcacgtcctttaaagcgaattgacgctttaaccttgtcgcctttctctaaaaacttgatagcattacgaagttttgtgttaaagtcgtgttcatcaattgttggacttaaacgaacttctttcatgctaattactttttgatttttgcgctgctctttttctttcttctgttgctcaaagcggaatttaccgtagtccataatgcggcatactggcggtttcgcatttggagcaactaatactaaatcaagattaagatttgcagctaagtctaaagcgtcattacgagacttgattccaagttgatcgccatttgcgccaactaaacgtacttcacgtgcacgaatttgctcgttaatcatcatatccttgctaatagtaagccacctccaaggttttctcagaacatattttgtagtcatagaacccgaacaaaaaaagtgcgggcatacgacacccacacttgtaaaatcttaagtaagaaatacatttacctgttaactgcgaatgcgtccatcaggtgagaagcgggtgcttctacttgttccacaaaacaatattctattatccttgatgagtttatcataggacatgacgtctgtcaagaagacgcgatgtgttttactaacaacaagaaatattgtaacaaacaactaacatacttgcaatacttttttatgataagtgtcacatggttattttttctaatttctctcgagtatattacataaaaaagccgcggtataccgcggctttttcttatcgttttccttctactttaatcatgtcaacaaaagcatctaatgcgattgtttctgatttttgttcaccatatttacgtacgtttacgccgttttcagttacttcattgtcacctactacaagcatgtacggaattttttgcatttgtgcttcacggattttgtaaccgatcttctcttcacgagtgtctaattcaacacggataccagcacgacgcaattcgtcttgtactttcttcgcatagtctaaatgtacttgcggagaaactggaattacttgtacttgaactggagctaaccatgttgggaatgcacctttgtattcttcaattaagaaggctacaaaacgttccatagttgatacaacaccacggtgaattacaactggacgatgttgtttaccgtcttcaccaacgtatgataattcaaagcgttctggaagtaagaagtctaattgtacagttgaaagtgtttcgtcttttccaagagcagtacgaacttgaacatcaagttttggaccgtagaatgccgcttcaccttcagcttcatagtaatcaagacccatttcatccatagcttcttttaacataccttgtgctttttcccacatctcatcatccgcataatactttttagtatctgctgggtcgcggtaagatagacggaatgagtagttctctaaaccgaaatctttgtacacttctagagttaagtttacaacacgttttaactcttctttaatttgatctggacgaacgaaaatgtgcgcatcgtttaaagtcattccgcgtacacgttgtaatccagataacgcacctgacatttcataacggtgcattgttccaagttctgcaatacggattggtaattcacggtagctgtgaatatcatttttataaaccatcatatgatgaggacagttcattggacgaagaactaattcttcgttatccatttccattgatgggaacatgccatcacggtagtggttccagtgaccagaagtttcataaagctctctgctccctagtactggagtatatacgtgatcatagcctaagcttgcttctttatcaacgatgtaacgctcgataatgcggcggattgttgcaccttttggtaaccaaagtggtaaaccttgtcctactttttggctattagtaaatagttttaattctttacctaatttacggtgatcgcgctctttcgcttcttcaagcatacgtaagtgctcatctaattctgctttcttaacgaatgcagtaccgaaatacgttgtagcattttattattgctatcgccgcgccagtaagcacctgcaacgcttaataatttaaacactttaattttccctgtagatggaaggtgaacaccacgacaaaggtcgaaaaattcgccttgctcatagattgaaataactgcatcttctggaagatcgttaattaaatctaattttaactcatcgccgatttcttcaaagcgacgaattgcttctgcacgtggtacttcatgacgaacgatttctaagttctcgttcacgattttttgcatttctttttcgattttcttgaagtcttcaactgtaattgcttcttccatatcaatatcgtagtagaagccattttcaattactggaccaatgccaagctcaaccttaacatctttatataaacgttttaacgcttgtgctaaaaggtgggctgttgaatggcgtaaaatatataggccatcttcagaatctaatgtaatgatagaaactgcaccatcttcttcgattggtgtaacaagatcgatcatctcatcgtttaattttccagctacagcttttttctttaagcctgggctaatagaagctgcgatttcttcagttgttacgccttttggaaactccttcacagctccatcagggaaagtaattttaactacatctgccatcactggtcactcctctttttctcaaaataaaaaacactcatcccgtaaaaagggacgagtgttgaattcgtggttccacccttgttccaattaacataattgttaattgctcaagttcaacataacggtgttgtccgttagcaattactagaaaaaccgttcactgctaaagtttagaggtggtaagtaataatcccgtactaggaagctcacaccctaaggcttccctctctgaaaatcgtagaaaactactcatgtcctcatcatgacatttcaatatatttcatttatgtaggtaattatatgctcaaaaacttagaaaatcaagggcgttacctttattttttaaatttttcacattgcgctcaaaatcatgtaatccatgtaattggacccgttcttggaacacatttcgcaaagtaataatcatattatggtcttgttctttcgtatataaataaatctttttaggcgaaatagaaagaagcggcgcaattactttcgtatcaatatatacatcattttgctttaataattcctcatctatatattggaccaacttctcctgttttaaacgtctacctttatcatcataaaagataaagctttcatcaaaaataagatgcacgcaagacaaacgtgatttacggctacttacttgttgccgaagcgtctcaatgaacatttggtattcttgctccatcttatattcatcaattgccacttccgcaagtttagtcaccatttccctatatgtacgaagacgaaaacggatatatgatgaaaacgagaatgagagcggatcacaaagccaattatttaaagaagacttaatatatgactcaaatgcgttacgcgttaaatcctgagctacaccttttcttcttccctttaaaatctcatgtgccatgtgcaatatttgatgacactcttcttgttcttcataaaaaaacttttcttttaaaatcgtataaatccactcattttgtttcacattcacaatgaaatacaccattactggcaataagattttttcaatataattcgattcacgtactggtatgtgaatcaccactttttgttcctgtaaatacacactcgtttccttatataacacttccgctcttttcagcaattgtctatatacgtgcatagcatcatttttttcttcgaagcaaatttcaatcacttttgtccccccttttatccccgctctaaaggactgtatctatacgttacaaatcctataagagtccgtcccgcgtgaatttcactcttagtagaatcacatttcctatcgttagaaaatccactcaatatggcttgctaattttatatatattaagggagggagaaaaaaatgatacaagctactatgaatttttattgtatactttacttatcaataaaagggggtatctgaatgtttgaatataaattcgtaaaagtcgaattacattgggggttcactcgctcaaaaccagctgaagactaccaagaaattattcaagaacatgctagagatggctggaggttcgtacagattgttgcccctacgtttggcagttctggacaacctgaatatttcgatctcatattcgaaaagaaaatatcactataatacaaaaaaagagcaagctgagaagcttactcttttacttatgacgacggtttttcccaccaattggaactggtttcgctaaatatttaattctttccataatacgtgctgctttcatttcttcagcctcaccacgctgcgtatacgttaaatggtgttccagttgtttaaaatcaaaattagacgtaaagaacgtcggtaagttttctaacatacggaattgcaagattgcaccaagcacatcgtcacgcacaaagcttgacatcgcttctgccccgatatcgtctaacattaaaacttgtacgcgtttaaccgcatcaatcttttcaccaatcgaattatcttgaattgaacttttaatttcacgtaaaaattccgggaagtatacgagcatcgaacttattttctttcgagcaagctcgttcgctattgctcctaaaaggtacgtttttcctacaccaaatttaccgtacaaatataaaccttgtgcttttttacctggttcatatgtacttaaaaattcattcgctgcaccaaatgcatcgatacgtgcatttaaatcagaagggtctaagttttccatagttgcctgcaaaatatccgttggcatatatacactttgaacgagtttttcatatttctttctctcgtcatgcgctacttttctaacgcagcgatcgtattgaatatcaatcatcttcccttgaataacaagctttggctcataaccttgtagcatatttttacatgaacctaaatccggacaatccacgcaacctacactttgtccaatatattcatataacttcacaagactgcgctcaatcatagaagtcgttacttcacccttatgttcgtctataaattctttcacccgcggatgcgccattacttctgcctttagtacttcatatctatttttaaagttttcattttccattaattttgcaaatgaattttgaatatgctccattttctcacctcaaagagcgttcattctcttctattaatcacgcttatatttttttaacacttcttctagtcgttttctttcatcttctagcgtactcgcatctttttctacacttgtatctttcttctctgtttctttctcttgttctttcggctcttcttccttaagccaatctggcaccatttctttccgcaccgttttcttcgccgtacggccttttttcttcgtctcagcccactcttgatattgtcggttctcttctttcgctaacgccatcgcgtccgctactgtaccgacctttttacgtgcccaatgcccagcaatcttctcgacatacgttttcgcaagtttcatatctgagcgtagcataacgtaataaataagtacattcacaactcctggtgtcaatttttgattaatcatgacatcttcaacgatctgcaagtccgctttcgttgcctctgcaccaccagaaatctctttcaatagttgttttggcgagatttcctctagctgctttattaacatctcctcttgcgatgaaggctctttctctttcatcgtacgtgcagcatgaggctgtactctttcacttaataccggtaatgcttgaccattttcaaattgataccaatcgcgcgctccttttctaagcctttccgtatcaattgtttgcatctctgtcactgcaccaagaacgatattttgcatcgataacacatctacaccatacacgtaagcaagtgttataacgcagtctctcacttgatctgtaatcgcctttttaggaacaagagcggacaatccatctacaaataaagagaaatcaaagaaatcattccaaactttcggagcgtctcccttctcgttacttggcatagttgtcgtttttggaatacgaaggtcttcttgcgcatgctcaagctgtcctggattaaacgaaccaaacacatcattgaaagaacgcgtaacattttcataagaagcaaaatcaaattcttcttctaagaaatattgctttacttgattatattttgtccggctcaatcgattgtataaaaagatacttaaaacaatatcatcaaaaaactgcttcggagataaaggtggttgcaactcatatatgaacattcgaatatctttttctttcttaatatataccttcaatagcccaattgcctctaactttactcgttcctcatatatttcaggaagttgcatttgcatagtcaccataagggaatgatgcgtattctcttttccaaatacacgatcttgctctagctctccccatagtgtcatgtataagctaaaagctctactacctattaacggctgatacaacatcgttaacacttttcggtcgtaattgtgcagtagccctttcgcacttactttataacgatcaatcggcaatagctccatccatgactgtttttccattcttgcttttcctttctctcatccaatctatcctctacttcattcgttctatcttcattatataaattcttagtgaaaaagagctattagcttgcgcttctagctctcttatcctattatttacggtatgtaaagagaataaaatacaacttctactctctttctttttgcagtatatcttttaattcttcaataaatacatttaaatctttaaattgacgatatacagaagcaaaacgtacgtaagcaacatcatcaatatcgcgaagttcttccatgacaatttcaccaatcatatcacttttcacttctgatatacctaaattacgcagttcacgttccacgctttgtgttacttcttctaattgtcttaaagatactggtcttttttcacacgctttaattaaaccacgtaaaatcttttctttattaaactcttctcgtgtgccttctttttttacaacgataagaggtgactcttctaccctttcaaaggtcgtaaagcgacttaagcagctttcacactctctccttcttcgaatagagcgcccctcgtctaccggacgcgaatctaacactcttgtaccattatgagaacaggatggacaacgcaatacattc

SEQ ID NO: 1219 - DNA, 7297 bp, Bacillus thuringiensis
ctgcaaagccaaatagtagtaaaggtacaaagaagtaatttaaatagagcatttgatttctttactttgcacaaaacaaaatataattattacaacaaaaagctatgctttcacatgtgaaagcatagctttttcatattaaatcattaaaatatctcgtatttcttcctccgtgatggatgctaatttttcttctcccggctcaatcacttcagcaattaaatttttcttactttcttgcagttcatgcattttctcctcaattgttccgtgggctactagctttataacttgcactgtatttttttgccccattcgatacgctctatcggccgcttgttgttcaacagctggattccaccataaatcgtataatattactgtatctgcaccagttaaattaagtccggtaccaccagcttttaaagaaatgagaaatagatccccttctccttcattaaaccgatcgcacagctctacacgttcctgcgctggtgtactcccgtctaaataaaagtatggaattgcttggtgatttaactcacgaccaataatggaaagcatcttcgtaaattgagaaaaaattaatattctctttcctgtacttctacattcctctaaaatctctaacagttgttcaaatttagctgaacttcctttgtaatcatcaacaaataaagcaggatgacaacaaatttgtcgcaatctcgttaaaccagctaaaattctaattttatttttacgtaacgtatctttgtctaaatgctttaacgtttcttccctgagcttcgctaaataagcagcatagagactcttttgatcgggtaataactccgatgattgtaagtgctctattttctctggcaactcatttaatacgtccccttttaatcgtcttaatacgaatggtttcactcgcttcgctatatcttcacgccttaaatcaccgaactcttttcttcctggtaataattctgggaagacgacatggaagatagaccatagctcttctaatgaattttctacaggtgtacccgttagcccaaaacggtattcagcttgaattgttttcacagctcttgccgtttgcgttgtagggtttttaaacgcctgcgcttcatcaaggaatagtgtatgaaatggtcttgcatacaatcttatatctcttctcagtaatggatatgacgtaattacgacatcaaattccgttatatctttcaaaattttccggcgctctgcttggtttccatctgcaataactgctctaatatgcggggcgaattttttcaattcactaaaccaattataaacaagagatgatggtgaaacgactaatataggtagtttcttttctcgaatctcaggcaaaacagaatctataaaagcaatgctttgcaacgtttttccaagtcccatatcatctgctaaaataccgccaaaacggtaatgagcaagtgttttcatccattcgaacccatatacttgatactttctcatttctgcatttaaagtatttggcacagcaaactttaattttttcgggttttgaatgttttctactaactcttgaacagaatcatctaaacttaaaacattgccttcatgaagtccgttcatccattttacactccgaataagtggaacatttacctcttctccatgtaaaaattctttccgaatacctgattcttttataaactgattaatttcattaaactctttactctctagcgataaaaacgaaccgttcgccaatcgataatatttacgtttctcttcaagggccgctaatacacctttaatttctgcttctggtattccttttatatcaaaacgaaatgacaaccaatcaattctttcttttcttctcactgtaataagaggaactgcatcccctttattaattcgcaatttgattgctgtcgtcgcataaatatcaactaaaccttttaatgttggcacgacgtgatataaaaagttatactcagcttcttcattatgcataaagtaaccgccttctgtttttgcaaaggcactttcactcataatgtctaaaatctctttttcctttttctcatcacgattaaaaacagacggctgtccatcctcttctagcggattaatcatgacgttcccatagtgaaattcaagacctgctaataagcgacttttcacgcggtctaaatacaatttcgcttttagcgaaggtgtttcaacacgatccgatattacttcatcaatgtgtacagttccgagcttcattaatcctggtacaactttcgcgacgaaatgttccatcttactttctggaatataaaactgattactatttgagcgactcatcatcttttgtaattcaataagtcgcatacaatcttcaatgtgtaagtgatataatttcccatcgtaaagtgcattgttatacatatccataacttgtacacgatttagaccatctatatgaagtgtaaatccgccattatttcccttcgtaaattcaaagtgtaacggcaacaaaccttttgaaacttgtaatccctgaaacagttgttcattttgtttcagctgtacatattcaactttagaaagtgaagagagcatatccttccacgaagctggcggtataaatatcatactttcatcttgtttcgcatgtacttctagcgtatcttcatacattttttcattatgatacattttaatgagctgctgaataattgcatccgtttcttgtttaaaactatgtacatctggtgtatatgtaaattcatttgaacaatgaaaagattcccttttctccaccttagaaagaaattctctaatatgatttatgaaatacactttggcaagtttcaattgaattccaagaagagccccaccacttctcgtagctactggtgtacatataaactcaatatctaatatttcacgtgtatcaaaacggtgttgtttactttttggcctcagtggtttgtctgcaaacagctgaaacataccacttgtcaattgatcatttctgttactagtggagctcattctacctgtttgttgattatagtttatttgtattaatactgctgcaacatgttgacagtacgtttgaaaagacgctaatgaaggacaactacattttgcaacaacatcaccctttttggcttttgctactgtaacatggaaatcctcgttcccttttactgtcgcctcacaaatttctttattttcatcgtactgatctattatcactttatttgatttataataggcttcacctcttttatatgaggtctctccgcacacttctttaataatcgatttattcaatgtgaaactcattgctttgacacttccttaatataaaaccattttctcttacttaacattttacatgctccacgagaaaatataaaatgttgatttaacaaaagaagatgcttatttataagcatcttcttcactctatctccatcaacctcttcgcctcaaaatacaacacttgaataaactttttcgtattaattcgcgtatgaccagaagatgcgagttcatctttcgtcatttctgtcatccgttttctaactacggtaaaatcgaaaaattttggagcatagctttcaaattttggatttgaaaagtctgttaatcctaaagaagccaaatgatttaacgactgataaatagctcgacgtactctttgttcagacgcttttttctctttatcaatatccgcctctaaagctaaatcccctaattttcttatcgtaatatgatggaaaatttcttttaacgcaggaaagccaaactcaaatgtctgtgccttttcttgaccatataaatattccagcatactaagtaaatctttacttccattctctcccgcaataccgagttctgatagtaaaaagcgccctaaatcccctatcttttttccttcttgcactggttcagtacgcaattgcggtttttcccactgaaacacgttattcaatgatttttgaatatcgtgtatagaacgctccaatctaatacgctccatcactttgcgtacaacagatacaacttcgattttatttaatggttttgtaatataatattctacaccaagtgtatatgcctcacctataagctgcttcgattccacttgagaaatcataatgattttccccgtgaaagttgacgcaatgtgacgaactgtttcaattccgtccctcatcggcatcaacaaatcaataaataaaatatctacttttttaaaatttagttgatccgcctcaataaaagctccgtcatccgcctcaccaattacttctccaagatctccatcttcaataatttgcgaaagcatcgaacggaaaacttcatcatcgtctacgatataataaaacaaatctattccccttcccgctttaaactaccctccggtaaacaaacgataaacttacatcctcttttattttctcggccttctaatctcacttctccgcctagctctgttaccatttcatttatgtaagaaagcccaataccagttgacggtgttcccgtttgatcatacttagaagtaaatcctggcttaaatactaatttcttatatttttgtgcaataccaggtccatcgtcaattacttcaaaaaatatatgttgatctcttttatatagcttaataataatgacacctttatcttcaattgcttcaactgcatttgcagcgaggttattaaaaattgatagaactgtatacacgtggtatgcagcatgctcaccttctatatgtttagaaaaacgtatatccttttctagcatttcagcatacttctcgtttattctaacaatcatttctgctaactcatgtccttctacatattcagccacatttttatctaataacagtttagataatcctgcaaatatcctttgattatccttttttatttcatgcacttcccccgctattttcaatgctgttttactacttgaatcagcgcttacttgtaaatttcgatatagttgatatgcttcttgtgtaattaactccgcattttgtaacgtctttttcaaatgaacagattccacatataaattagaaagatgcattaacatattttcattttcttttcgaacttgcgattcttttaatttcgtttcatataaattcatcatatttaaaaaaccaagtgcaaagaaactacgaaaaatagcaataatgatgagtttatttacttcagaaatcgttattgttgtacctagtactaacatgtgataaaacgcaagttctgacatacttgcaacaatttcaattgaaatcccaaggcatccaataatgattggtttctgatggaacttatttaccctgcaaagcgaaaaaaaactgccataaataaaataatagaagaacacaggataacgcaaataaaatgattctgtcatatgaaatgaaccttgcatgatccagtcaagacatactcggaataagactacagatataccaacaagaatacctgcaactcgtgctggtgctcttcttaaaaataataatataaagaagaatagcggtgtgcagaagctaactcgaaacgtatcattaaagggatgaaagttcagctccccagcaatcggaacaaccaccattaatataattaaaagggacatatctttcttccataattgattccaattcaaaggtgacacttcctatactttttttcagtagtaaaagcgaaagcccgcttattgttataaacgggctttttttctatattctaaccttttctaccgcttttatttggcgatactctggcttccacattgcttctttcactgccatcttgatatcgttatcacttaagttcactcttgcaacaccttctgcaactgcaactttagctacttcaattgcaaccatttctgagatattacgtaattcttcgacctctggtaaaataggtgctcctggctgacttgtatctaccatacttgcaactgcttcagctgctgctgcgaacattccatccgtcatgacgcttgctcgtactacaattgttccaagaccaagacctgggaaaatcagtgcattatttgattgtccaatcacatacgttacaccgttatatgtaactggttcaaatggacttcctgttgcaactaacgctcttccttctgtccactcgattaaatctgctggttttgcttcagcaagtggtgtcggattcgacattggtaaaataattggtctttctacgtgagaagccatttctttaataatctcttctttaaatgcacctgcaacagtagatgtaccaattaaaattgtcggttttacatgtttcacaacttcagcaagtccgatcacatcattttgcttccacccacttacttctacttcttttcttgcgtacggaatttggaaatcaagaagatcttccatattatctgtaactaacccgttacgatcaatacaccagaaacgcttatatgattcttcttcagatacgcctacgcggaccatcgcatctctaacttgatctgcgataccgattccagccgtaccagcaccaaatacaacaacgcggtgttcacttagcggtacaccagaagctttcactgccgataatactgccgcaagtgaaactgcacctgtaccttgaatatcatcattaaacgtacaaacatcatgacgatatttatctaaaatttttcgtgcgttacgagagctaaagtcttcccaatgtaaaagtgctttcgggaattgtttgtttaccgcttgtacaaacgtatcaataaattcatcgtaagctttacctgttatacgagggtgacgatttccaatataaaatggattgtttaatagctcctcacggtttgtacctacatctaaaattaccggtaatacacgactaggatcgattccaactgcagcagtgtaaacagctaattttccgattgcgatgttaataccaccaacgccccagtcaccaattcctaatatgccttctccatctgttacaacgactaaatcaatgttctcagctgttgcaccgatattcgtgaatgcttcttcgatacctgatggatcgttaattgataaataaacaccacgtggtttacgatattcatgactatatctttgaattgctacaccgacagttggtgtatatacaatcggtaacatttcacgtaaatgatctgttaatatacgataaaataatacttcatttcgatcatgtaacgcagttaagtatacattctttaataaatcatccggctgagaactaaattgttcgtatgctcggcgtgcctgttc

SEQ ID NO: 1220 - DNA, 7346 bp, Bacillus thuringiensis
  unsure (1)...(7346): unsure at all n locations
ttcttattattaattttattaaaatttaacctagttaaaaaagaatggatacaggacggagcagattttttattaaaagaacttattttatttttcatcccttctgcagtcgctgtcatacgttacagagatacactaacacaatatggaatcgatctcattttaattattatgattagcactctttgcgttaccttagttacaggacttttaacagaattgctactaaagcggaaaggatcaacgcaatgatcggatttctttgtttactattaacactattcacatattggctatcaaaaaaaatgtatcaacgctggaattggagtctactttctcctcttctcgtctgtcccattattttaattgctttattgctcggattagatacaccttatgaaacatatgaatctggtggtcattggttaactgaattattaaaacccgcaacagttgcttttgcatggccaatctataaatactttgatttattaaagaaacatggaatggctatcttacttaatgtcattgtcggttcgtttttatcagtcattacttcagcactactagcaaattattttcaaattgattcatcactagaacatagtttagcgccacatatcgtaacaacaccaatcgcaatggctatttcagaaatgattggtggcatgtcacaattaactgctgtatttgtcgttttaactgccttaacaggagcattgctcggtccttctctcatacgtatttgccgtattaaaacagcaatcgcaaaaggtattatgttaggaacaagcgcaaatggaaccggtacatcaaaagcattcgaaatcggtcctgtggaaggaacaattgcaagtttatctatgcttttaacagcaggcgctagtttagttatcgttccgcttttcttgtcttggatacattaaagaagcaagtatttacatacttgcttctttatctatatattggcacagcaattcataatcctctggaaaagctaaacacaattgttcaacttcatgtatccctttccaagcaatttcatgtattaactcatcaggatcttggattttcatattaccgcctatttgtttaacaaaataataatggacatacactggaacaccgtatgtaataccctctttttcatatattttatttacaacttccacattgtaacctgtttcttcccaaacttccctaatacaacattcttctagtgtctctcccttttcaagtcctccacttgggacagaccaccttttttcttctccctctttgccctgcagtaccattaaaacttcctttctttcatttacacataccgctgcactacctatccatctctccataaacatccctcccctactaaaattcgccctcttttttattttccccttgaaaaaaagaggaaaaaaataaaacaatgacgaaagattacatcaacttcataggcaatcccttcttagaaattaaaactggaaggatgaaaatatgatttctaattatgttgtggaatgtgtcttttgtgaagaaatcgaaagcctcgccaagctattgtcacagttcccgccacttctcaggtactaagcattgaaaaaggggcgtgggagaatccaaacgttgtcttggaaaaatgtgttttattccacccagaaatttaaagaaaaaattgtttttgaacaaaaagaaagctgaccatcaattggtcagctttcttatccgatcatattttcacatgaagattaggggcatcctctttaaggatcgggattttcccattatgtacgttccataatggtcatcgaacaatatatttctatacaattaactattgaatagaatagggcaaaacttgttcgcatttttagaaaagggatagggatataattcaagtagtacttcgaatactcgaactttacactcataatattaaaacaaatccttttatatgggaaatatgaattacctacataattcattcgtaaaatatattaatagtttgctatattaattttatcccgctatttgtaagcagtaaccccctacttattataatttcaccttattccatcaatagcatacatccagctaaaaccggtgtcataatcatcgaaaacctcaaaagcattcgcggtgcataatttgtaaacttcgcgccaatatatgcccctaacatggtcccgattaatacttgcaataacaatatataatctaaatatccttccgaactatatcctagcccacccccaattgcaatcggtaatataacaagcatcgttgtccctacagattgctgaatcgttagtctcaatagaaccattaatccaagctgaataaacggtgcagaaccaatcccaaatgaaccagccatcattccagtaactaatccaaggcatatacatttcaacaagtagttcatggaaaactctttatgcttatataaagatgactgttctttgttttggaacataattaatttaataaacataaaaattgccgataaaaataacatcccagctgtaaaccaatgaagaagatgtgctggtataagtgaaccaaatttagaaccaatataagagccaattgcgccaaatcctccaacaatcccgcctataataaatgcaacattgccttcacggtaatgactgacaacacctgataatgtcgtaaatgccattgcagttaaagatgttgcaagagcaacatgaataggaatatgaaatactaaagtgagtatcgcgataataaacccagctcctccagctccaacaaatcctaataaaatacccattactaacattgttataataattgccacagactttccctccagtaacacaattatccatcatatttatccttacatacaaataaaaagcatcctagacggatgctttttatttcaaaaatatgtacttaatcttgattaatcaaaataaccgctggaccagcgaccactactccagctacttctattttttcaaattcctttactgtaatagatataactccttctctttccatcaattctttactcaggacatcagtcgggattgctttcaccgtcttacctccttttcatttatacaatatgataaagtaaaactttaatgagtggggtttttgtccgtacttattaattattacccctcaccaatcggactaataatcacccaatgcatctatatatatgcatcacctccgctttcattccttattccactcaaaaaccttctcccccttccgtgacatattgaaaaataaaaaagaagctataacatatagcttccctctacgtttctttaatctttatgcaccgtatattccatgacttttccatctctatcaaattggaaaacaagctgttcgctatctattggaataaagccacgttcagtcccaagataatacaaagtggtaactccttcttccccacttctcgtttccgttggagctcctaacaattgtataatttcttcatttgatttccctattaatttatatttttgtaatagatcatctaccatatatacccgcttatctgcatgatttaaccatctattttgattaaactttgatgtatattcatttacacttagttgtacagtgcacactattaatggtatgagtgctactattaaaacccccaacatttgcttcttttcttcattacgatttttagaaacatataaaatagccctttaaatcatgactaataaaacaaatggtatgaatactacaaaaatgctccttacacttaagggtatatggaccatatcaatgacgaatataaatagaatgtacattactatatacaaacaaaaatagacatacaaaatgccacgtagcatagcgttcagaaagatctccccttttaactcactatataattcatccggctaatcatttctcgaatctgttctaattcttgcactgtatatactactttccctgctaagatttcatttctgaagaacgttacaatttgctcccgattttttaatctaggtgtttcctcactagaaagatctattatttcttttccattttcattataaaaatatacaactggttttaccttttcttttatactattagcctgcatttctttcaaacaattgtataaaatttgagatagtttcttcaccttatatactggattcccttcatttttcacttgtatagttgacgaatctttacctactatatattcaaatgtctcttctttttcaacttcttgttgatacttacccatttcatcaatcataaatgaatatataccagcattttctttcgttaaaccatgaattaatttctcttcccattctttcgtctcaagtagataaataccagttttgcacaagatgagatgatggattcgattatcgtttatttcattattatttttaataaaaacattcggcatgatttgaatttcagcatctaatatgatgccttgctctatgaatcctcgcttcatataatgtaatgtttcgtacgtattcatttcagcaccgtttttagtatattctcgtaaatttgcaattaatttttgaaacatatgtatttcgttattatgtttattttgtatttcactacgttctttactatgctgcatagctaattgatttttcatcatacgcatattttcaatttctctatttgcacttacttgtaaatcattgtattttttctgttccatattttttaaattattttgttgttctttatgctctatcactgtagctgcaatttcatttttatacgtttcaatcgcttgtttcttttcaaattctacttgctgactctctgattctaactgtttatttttataaaacagcacaaatgctacagctaataatattaaaatcgcacctattagcacataattcatatttttactcctttatttcattttcgattattttttataaatatatctactatagtatactatggtttcgatatagactttgtaaaagttgtatatttttaataaaaggcacctctgacggggcaccttttattttcactctattgtacaccatactgaatataactcggatcgtagtatatccattgatttgtccctaagcatagccatccttcttgcttactccacactcgatacgattcaccctgatgtaactgtcttataacatttccatttaatgatggagcatcacgcaaatttacattatcaccagtaatagtcgctacataatgtttatactgaatataactcggatcattatatacccactgatttgtccctaaacaaagccatccatcttgttctccccaaacttcatatgtttcgccacgattcaattggcgaattacactagactgtaaagatggtccacttctcaaattcacattatctccattaattatagcaaccccgtacactggagttgcattattaggcggggaaacattacctccaccacttgctccattcccttttaaagcttctaatgaaactgcagctgatacatcacaatttcctacgcctgaaatttgtccagaatctgtgtactgccacgctgtccacgctgtccatccaccagcatcagcaggcggtgtactcgagtatttagcaatccaaagcggtatatcacttaatccgctaattccgaactcattaatataccaaactcctgtatataacattacatcttttccagtagcctgtttcacataatttatgaagcttcttgcccaattcgatatagcgttaccagttaaattactgttgctcggatctgttggtgattctaaatccagaactggcattaagtctgtctggttattttgtaatatacccacaaaatattttgcctctgaaattgcatcattttgttctgggcgtgcaaaatggtatgcaccaattaatacattcgcatttcgtgctgcttgtacattcttagtaaaagtaggatcaatgtagtttacaccttctgtcgcttttgcatacgctgctggaattccagatgccttcactgcattccaatcaatattcccttcccaatgagacacatcaataaacgtaacatttgaacttgatctgttttgcatataaaatctcctatcaatttttttacttcgtatacatacaatatgtacaagtttcataagaggacacaacatttatgctatagaaacaaagagtaaacatatgttgtatacaaaataaaaaagaccttgtattacaaggccttttgcaaactcactttattttgtagcaagtacatattataatacaaaccttgctcacttagtaattcttgatgtgttcctctttctactatctctccatcatgcatcacaaaaatttgatctgaatcttgaattgtagataacctatgcgcaatggctatcgtcgttctaccttttcgcatttgttgcaacgctgtttgaatagcctcttctgtttctgtatcgatattagctgttgcttcatctaatactaatactttcggattcgttgctatcgttctagcaaaagcaattaattgtcgttgaccgcttgaaaatgctgcacctctttctactacttctgtttcatactgttttggtaacttttcaataaacgtatttgcttgcacaaatcgagcagcttcttttacttcttcatccgtaatttcttcattatacatacgaatattttgctttacatttccagcaaataaaaatgcatcttgcaatacgagtcctattttctttctaatttctcgttcttcaaatttttctaaatctacaccgtctattacaatatttcctgacttaatattataaaatcgcattaacaaattcataatcgtactttttccgctaccagtatgcccaacaaaagcaaccgtttgcccttgtttcacgtgaaatgatacattttttaaaacgtcacgctttccatcatatgaaaaagtaacatttttaaattcaatatccccatccacaacttgaggattctcattgcctttttgaaccggtgctaaatctttctcgtccattaaatgaaatacacgtgatgacgaaacaagtgcctgttggaaaaaggacaatttcatcatcatctcatttacaggttggaagaaacgatgtatatagttaacaaaagcatataaaactcctacttcaacagggctctttaaagcatcaatcccaaataaacctagtactaacgcaatagaaacaatatgcactaaatccgtagctgngtcgtaaaagntaatgcgtctaacttcaaaggtaccgtcgccctgcactataatgtttattattcacttcttcaaactcttttctcatacgttttttcttgtctgaacacttgaacaata

SEQ ID NO: 1221 - DNA, 7932 bp, Bacillus thuringiensis
aaacgaaagataactactgactaacttctttgaataggaaagtttcatacctacaccccctaacccaaattatgccactatttccattttgcttcatagaaaaaggccatttctaaatgacctttttcacaatgtacctataaaatttcttatctacctgtagcaccggaaagtttttcggcaactcgtctatactcacactttcaaaaccattcttttcataaaaacgatgtgccgctaaaaattttactgttgttcctaagtaaatatctttcaattttttatcctcagcccatgaaattgctgtttgaagcaacatatgtgatgcgccccattcttttccgcgaaactctttcttcacgaacatttttcttaacgctacttgatgattctcaatatctaataaagctactgttccaactactttaccatcataaattgctatccaaaagtttccgtaatccttttgatagaatgtttctatttcaagtaaatcaggttgctcttctttcgtaattgaaacattatactctttttgctgaatatgaacgataagatctactacttcctcttgaaacgtactttcatacggaataatgcgtatcttctcgttcatcgaatctccttccactctgaagctagtaaactatatacagcgatatcgtgaaaatgatcatatagccattcatcatctcttaaaatgccatctaacttaaatcctaaacgttctggaatagcgcggcttttcacattttcaacaccgcatctaatttccattttatttaattttaaattctcaaatgcatagtgaagtacagccttcacactacgcgtcataatacctttcccgccagcatcttctgcaagataatacccaagactcgtcgctttcttcccccagctcactggatgaatacctaccatcccaacgagctttcctttgtaacgtatgccactttcaaaaccatctccctctgcaaatttctttaaccacatcggaaaaatctcatcataagcatcagcagatttcgtcccatctacccaagggagccattttcgtaaatgattacggttttgatctaataattgatataattcctctttatgatgtttttctagtaattgtagttcgatttcgtcatctactcggagtgtgaacatgttttttagtcccctttttagttttcttattattctaacacttatatttcaaaacgcgtaccaatatatcaacgatttttgaaatatatcgaacacaactccatatatatagacgtttcaacattaatgcataaccacgacaacataaaaaagacgcacagctaagctatgcgtcttttctattacttctctgcaacttgaacttcttttacgtaagctgcttcgaatttttggatgtcacctgcgcccatgaaaattagaacgccgtttttatgtttctttaatacatccgttgttgtatctgtaattagctctgcaccgtcaatacgcttttgcagatcttcgattgttaattcacctttattttcgcgcgctgatccgaaaatatcacataagtatacttgatcagctttgcttaggctttctgcgaactcatctaagaacttttctgtacgtgagaatgtgtgtggctggaatacagcgacaatttcacgctctggatgtttttgacgagcagcttcaatcgttgcattaatctctgtcggatggtgtgcgtagtcatcgatgattacttgctctcccatcggcttttcattaaagcgacgttttacgccttcaaaagttgttaattgatgttttactgcttctacatcaacattttcataatggcaaagcgcgattactgctaacgcatttaatacgctgtgattgccgtatcctgtaattttgaacgtatcatagtacgtgttacgaacgaatacatcgaatatcgtgccatctgttctcttttggatgttgcgtgcttggaaatcattatcttctccaaatccatagaaaataacaggtactttcgcttgaattttttgaagttcttcatcatctccacatgcaataatgccttttttcacttgcaatgccatctcttggaatgcactgaatacatcattgatgtctgcaaaataatctggatgatcaaaatcaatattcgtcataattgcatagtctggattataagacaagaaatgacgacgatactcacaagcttcaaatacaaaatacttactattttctaccccatgccctgttccatctccaataaggtaagatgtcgggtgtgcaccttgcattacatgggctaacaaacctgttgttgatgtttttccgtgtgcaccagttacagcaacacttgtgtattggctcatcaggtcacctaagaaatgatggtaacgatggactgggatgtttaattcttttgctgctacgatttcttcatgcgtatcaggaaatgcatttcctgcaataatcacttgtccttcttctacattattcttatcaaaaggaaggatcgagatactacgcttttccaacgctgtttgtgtaaagaaacgcttttcataatcagacccttgaacagtatgcttcatatcatgaagaatttgcgctaatgaactcattcctgttcctttaattcctacaaaatggtaaactgtcatcttaaagaacctccaacatttcgaactaatacaacggcctatctataagacagtatatgaatcttttcttattttggtaatcatcatacatttttgatgtagtgaagttattttttcccttcacttatcaggataaactcgtacgtacttctttatatgtccataacaagtccattatagcaaaaaagaagccgctatactatgatagcagaaaagctgatagggtcaatcacctatcagtttttctctctttcacatctcttctcttttttctaattgaacacgctctaaacgtgggtttggacgatatttacgaccagcttttgcttctggtttcccatttaattctacatgatcgccagtaaagccaatattcatttttaataagctacttcctaccccgtatatgtcaacaggtacgttttgagcttcaaattcacgaatacgcttctcatcaaatccaccagttacaacgatgtctacatgctggaatccttcttcatcaagtgctttacgaagtgcgaatacaagcgatgggtttacaccacgtggatcgaatgttccaagtacttctgggtggcgaatgaagtattgatcaatcatcgtgcgggacgtatctacacgtacaccttttaatgttgatccaaattcacgcgctacgcgaagtgcatctgtaatgacatcattgttgtaatcaattaatacaactaattcatcttctgggaatttcttatgatatgcttttgccgcttccacaacatcaccattaaacatttgaattaatgcgtgaggcatcgtccccataccacttttgccccaccattcattcatcgcatgcgtcgcttgtgcgctcatacctccgatgtatgctgcataaccgtcaccagcttgttgtgtataatgatcgtcacgatctcccatgaaaataactggtttttctttatctacgctacgcgcagcttggacaacgttatatacgtttgtcgcaaccgatgtacgacgagctaaaatcccatcaatgacaccttctaaaaatccgaaattttcataaggaccatgaattgttaacactgtttcaaatggactaattttatcgccatcttttaaagaattaatctcaagttcctcaggatttttagcgaatgtttgtagcaatgcaattacttcatccgttccgcaaagaactgcattttccttttggaaaaattgcatcgttacaacacttttcgggcgaaattcttcgatgatttctctagtctttaaaaagtaaacggcagagaaccacccttctccaacacgttcgtcaaatttaaatgttttatttgttagtctatttatttcaccttttaattttaattcaatttctttcatgtcgctttactccctactttactatccaacattttctcttagtatacagcaaaaccgtttactatacattcgtttcctgcatagcggcaaattcgtcctcagaaataaggacatctctcggtttcgttcctctaccttcagaaataattccttgcgattccatctcttcaatgagacgtgccgcgcgattataaccgatgcggaattttcgctgtacagaagatgtggacgctcccccttgttctacaacaaattgacatgcatcaaggaacaattcgtcttccgactcagcttgttctgttttcgctaataaatcctcttgcttaaataaataattcggcttcatttgctttttcacatgatcaactgttttttcaatctcatcatccgatacatatacaccttgtacacgaactggcttagatgtaccgttccctaagaataacatatcaccacggccaagtaatttctccgcgcccccaatatcaataatcgtacgcgaatcaacttgagatgatacagtaaacgcaatacgcgttggaatatttgacttaattaaacctgtaataacatctacagatggacgctgcgttgctactaataaatgaataccacaagcacgtgctttttgcgcaatacgacaaatcgcttcctcaacatcaccaggtgctaccatcattaaatcggctaactcgtcaatgacaataacgatataaggtaatgtctctcctggaatttctcgctcacttacaatcgtattgtagcgagttaaatcacgagcaccagcatgcgcaaacaattcataacggcgttccatttcctcaactgcccattttaatgcagctgtcgctgcttttacatccgtaataacaggtgctacaagatgtggaacagaattgtatggtgcaagctcaaccatcttcggatcgattaacattaacttcacttcatgtggtttcgctttatataaaatactcgttaaaatcgcgttaatacacacacttttacctgaacccgtcgcccccgcaataagtccgtgcggcatttttcgaatatccgttacaattggatcccctgaaatatcaagccccagcgcaacagtaagcggtgattcactctttgtgaatacaggacttcttaaaatttcacgaagaaatactggcttactttctttatttggaacttcaattccaatcgcactcttccctggaatcggtgcttcaatacgaatatctttcgcagctaagcttaacttaatatcatcacttaaatttgtaattttatttactttcacacctgggtctggctgcacctcaaaacgagtgactgccggaccttgcgatacattaataacatgtgctccaacgtgaaaattattaaacgttgtatctaataattctttctgctcctctaaccattcagtattatctaacgctgattgctgtggaatcgacaacagcgctaatggcggaacagtgtatgtcggtggtgtgtgcaatacatttcgcatatcgttctctctttgatttacaacatatgctttctcttgtacttccgtacttgaaattggcttttgtacttgctctaccactacttgctgtattggttgttcttccacttgtggctctgctactacttgctgcactgggtgctcttccacttgtggttctgctactacttgctgcactgggcgttcttccacttgtggctctgctactacttgcttcattgtttgctcttccacttgtggttttgctactacttgctgcactgggtgctcttccatttgtggttctgctgctacttgctgcactgggcgttcttccacttgtggttctgctacctcttgttgcactggcttattctctactcgtacattagcagaaggctgcattgcatttgctctagctgcatgtctttccattaatcgtgttctatcttgtttcaacataacaacattaaatggtacatgacgctttttctcacgttttggttcttctttttgtacaactggttgttcttctgcgactggtgtttcctcggcaactggttgttcttctacgactggcgcttcttctacaactgattgctcttctacgaccggtgcttcttctacaacttgttgctcttctgcgactggcgcttcttctacaactcgttgctcttctgcgactagtgtttcctcggcaactggttgtttttctacgactggcgcttcttctacaactggttgttcttctgcaattaaaacatccgcaaagctttgaacatctttcttcgtttgttcatcagcctcagcaacatgtatgaattcactcttttgttcaattgcttcatcttcttgctgaatttcctcaagtgctacaaatgtctctactacaggcgcgtttatttctgcaattacttcagcttcttctgactcttctgcttccgcaattacttccacttcttctgactcttctacttccgcaattacttcagcttcttctgactcttctgtttctgtaattacttccacttcttctagctcttctgtttccgcaattacttctacttcttctagctcttctgtttctgtaattacttctacttcttctgactcttccgcttccgcaattacttctacttcttctagctcttctgtttctgtaattacttctacttcttctgactcttctgcttccgcaattacttcagcttcttctgactcttctgtttctgtaattacttccacttcttcaggtgcctctgtttccataactacttcttcaaactcttccgtttctgcaattacttctacttttgacacttcttctggtatttccacaatgattgtttcttcaagtttttcttctgctttgacaatcactgattcttctggagcttgcttttctacttcaatagtaggttgttttatttctgtattacgtttaatttcttctgataatattgtatcctcgtgctctactttagaagctactaattcttcttgtagattgttttcgtttaacaccactacatctttttctagcttagcactttccatctgctcagctactgttttatgaagtaattcatccgctgaaacttcctgcggtgtactcatttcttgaatcacttctttttcttctactaaaggcacttggcgttcaatttcataaccgtttttctctagccattgatcaactactgacttttcttcctttttattctctttatattgttgctctccttgctggttagcagctctatgactagaagaagttggtgcttgtccttctgagaaatcagataatgtatatccttttttctctaaccatgcatcaacgactgatttaccctctacagatatttcaaggtcttctctttcctttacttcctcctgcttttcttcctttttctctactgaaggacgattatatccataaattggcgaaatcatttctgttggccgaaatggtctacggttactctcttgcgctggtgtagatgctttctttacgacagactcccgcaccggttcatattgcacttccggctcttcatatgtagaaactaccttttccacatacggtcgtctgcttctttccacctttattcctctttgggcagtcggttcttcatatgttactccttgaacaggttgttcttcgaagcgatttacttcgctttcatcctcttcatcgaacccattatccggtactaaaggaaaacggcatttacctgcattcctacttgccatttgtgcttctcttgcttcagggcatatgtttacacgaggaattctcgggcgactttcaattccgctgtggaacttctttattcatccctgtttgaaccttcctcttagttaaaaagccttttttcacccaacctaagcgatgcctaccacatctggcttacccta

SEQ ID NO: 1222 - DNA, 7220 bp, Bacillus thuringiensis
gtcattgaaatttcaatttatttttaaatagctcttgcattttcatcatacttacactcaaaataggaaatgtattgcttataagaagaaaggtgatcactgtggcaaacagtatgacattatctcaagatttaaaagaattacttgcatctgttgaatataaaatgcagataaaaaaaggtagttttatttttcaagaaggtatggaggcaacagaactctatatcattcactcagggaaagtacaaattagtaaacttagtgctgacggacaagaattaacacttcgaatttgttcggaatatgacattattggagaattaacattgttcacggataatgcaaaatatttattaaactcaaaatgtcttgaagatgttgaagtaggtgtaataaaacgtgaagcgttagaaaaagcattactccaaaaacccgctcttgtatttgaatttatgaaatggattagtgaacatttaagaagaatgcaaacgaagttccgagatttagtattacacggcaaaaaaggtgccctgtactctactcttatacgaatgacaaatagttacggtgtattaaaagaaaatggtattctcatcgatttaccattaacgaatcaagaactcgctaatttctgtgcaacttcacgtgaaagtgtaaatcgaatgttaaatgaattaaaaaagcaaggtacaatttcaattcataaaggaaagattacaatccacgatttacaatttttaaaatgtgaaattgcttgtgaagattgctctgcttctgtttgtagcattgattagcatcttatttagatgctaatcttttttcaatttaaactacttattaacgtttattgcctatgtaaacaaaaacgaggccttccatattagacctcgtttcgttttaaccattagctcctatccgtttacagcagtattattttttcaactcattaggaatacgtcttctgtaaatcacataactacggcttacatatttaattggggcactaaatacatgtacaagtcttgtaaatggccacactgcgaaaagccccatccctgcgagaatgtgaattttaaaccatattggtacttccatcatatattcaactttcggttggaaaataaagagacttcggaaccaagggccaatcgttgtacgataatcaaatccttttgaatcgatatttaaaaatgttgaagaaagtcctgctagcattacgataagtaataaaataagcgcaatataatctccctttgtactcgttgcaatgatacgttttacagttacgcggcggtacgttaatataattaaaccgataatagaagcaacacctgccggaagcccgaaactaattgctactacatggtacacatgctcagaaatacctactgaacggtatacagcttctggaattaaaatccccataacatgaccgccaattacgaacatgatcccaaagtgaaataatagacttccgagtcggagcattttcttttctaatagttcactagattttgatgtccatccaaattgatcatagttgtatctaaaaatatgtccaccgataaagattgcaaaaatgatatagggaaacaatacccaaagaaattgatccatcattttgacaacgctcctttctaatttgtctgtacaccccatgtttcgatagcgagtagcacagacgcaagaattggttcatacatactacccgcttcttttaattgaacgtgtaatgcttgtatattttccgtgtatttactcataattggttcactgtcttgctcatttgcatttgcaaaaaactcaagtaaaagtggtaaatagtcaggtagttctttatctgttacgctaaaacctgattttttataatgttgttttaactctagtaattcaatacctctttctctttgttcaccagtgttcatataagtaagatacatatttgttttcttaccaaaatcaaatgtatatacgtaactatcaatgagttgatcattcgttttatctagcacttgctttataaaggctgtaagtgaagctttaacgtcttcctgttctattgttttaacctcttcttgcaattcagttaaagcttctctccaccctagttcaggataggagagaagaaaagaagaacaagaaaaagctgtttgtaaactttgtctcataattttctgccccctttatttaagaaattgtcatacaagagcctggaccacctgtgaatgataaaccacagcttccttgttcgctatataaatctgccacttgttcacggtgagatgtcgggataacgaagcgatctttatatttcgcgatggcaagaagacgatacatatcttctacatcctgtttcgttaaaccaagttcttttaatacagcttcatttggctctttattaatttgcagtgctctcatatgtgttcgcataacagccatttttttcaatgtaagacgaatgtgtgattcatcccctgcagtgagtaaattcgctaaatattgaattggaatacgcatattatcaattgcagggaaaacctcttctgcttgccagttactacctttcccttccaccatgttcataattgggctaagcggagggatataccaaaccatcggcattgtacgatactccgggtgaagaggcagagcaattttccaatcgataatcattttatagataggtgactgttgtgctgctttaatccattcttcaggaatgccttgttttttcgcttcagctgctatttctggatcatttggatctaggaaaacagtaagctgagattcatataaatctttttcgtcttcaacagaagctgcttcttttactttgtcagcgtcatatagcattactccaatatatctgatacgtcctacacatgtttctgaacaaattgttggcataccagcttcaatacgtgggaagcacattgtacatttttcagctttattcgtttgccagttaaaatacacttttttatatggacaagatgatacgcagaatctccatgcgcgacatgcattttgatctacaagaacaattccatcttcttcacgcttatacatcgcaccagatggacaagatgatacgcaagatggattcatacaatgttcacatatgcgtggtaaatacatcataaagacgttttcaaaatctgttttaatttcttcttccattttctttacgtttggatcttgcaatccagttatatgtccgcctgctaagtcatcttcccagtttggaccccattcaattttgtcgataaattcgcctgtaattgctgatttcggacgagcaactggctgatgcttacgctgcggactatttgttaacgtttcataatcatagttccaaggttcaaagtaatcatcaatcgttggttgatctggattgtagaaaatattcataagacgtttcattttcgaaccggattttagctgaatttcaccatttttcaattcccagccgcctttatatttctcctgatcttcccattgtttcggataaccaatacctggtttcgtttctacgttattgaaatacatatattcagcacctggacgatttgtccaggtgtttttgcatgttacgctacaagtatgacagccgatgcatttatctaggttcattaccattccgacttgtgctttaatcttcaagccaatctacctccttcagtttgcgaattacaacgtttaagtcgcgctggttcccagttggaccataatagttaaatccataacttaattgaccatatccaccaatcatatgtgtcggttttacgtgaattcgagttggactattatgcgttcccccgcgattacttgttaatttcgtaccaggtacgttaatgtgacgatcttgcgcatgatgcataaatgccattcctctcggtatacggtgcgttacaacagcacgcgctacaacaacaccgttacgattaaagcactcaatccaatcattatctgcaacacccgcttcagcagcgtcctctttattcatccaaacagttggaccacctctaaatagcgttaacatcggtaatgaatcgaagtacatactatgaatcgaccacttattatgcggtgttaaatagtttaatgtaatttctttcccttctacttcaggtcgtgatttacggaacggtttatgttgcagaattggtttaaatgttgccatcgtttcaccaaattctttcatcatgtcatggtctaagtagaaagattgtcgaccagttatcgttctccaaggaatgagacgttccacatttgttgtaaacggtgagtaacgtcgtccacctttttctgaacctgtaaaggccggagaagtaattactgttttcggttgtgctgtaatttgttcgaatgtaaagcattcttcttcacgttcttctgctaaatcacgtagttttaaatctgtttgtttttcaagtgcttcccatgcttttactgccatatgaccgtttgttgtagaagatagtgttaataccgcttcagcagcattgattgcttctttgatgtctggacaacctttcgcgatagaatccgttcgaacgactcctaatttgctctttaattgctcatactctttttctgctgaccaagagatccctttcgtaccaatcggttgttttccggcatttggtccaagcgcagtcattttgtcataaatcgttttataatccctttcaacaacgtgaatttgtggcatcgtcttacccgggattggttcacattcacctttactccaatctttaatcttgccaagtggttgcgctaattcttgcggtgtatcatgaagaagtggtgttgcaacaacttctttcattggttcaagatcaattttcttcgctaaatctgacacagctttagaaagtgaagtgaaaatatcccagtcagagcgcgcttcccacggtgaaccgattgccggattaaatggatgtacaaatggatgcatatctgtactgcttaaatcgtgtttttcgtaccaagttgaagcaggtaagacgatatcagaatacagtgctgttccagccatacggaaatctaaattaatgagtaaatcaagctttccttctggcgcttcttcatgccactttatttcttctggtcgtaatgaatcactgtcgtcattcattaacccgtttgttgtacctaataaatgttttaagaaatattcatgtcctttaccagaactcgaaattaaattcgcacgccatacgaataagtttcgcgggaagttgtttgtgttatctggatcttcaatcgcaaacttcagttctttttcttttaatttttgtgcaacatattttccgatttcttcttgcgttgttgcaccagcagcaacagcctctttatataattcaattccatttttctcgaatgttggataagaaggtaaccagccaagtcgtgcagctaatacgttgtaatcaccgtgatgttgataacgagagttaccttcaactggtgacgctaaatgtccaacaggtgtatcttcataacgccattgatctgttacgaaatagaagaaggatgtaccgttttgtaatttcggtggaccttgccaatcttttgccatcgcgattgtttgccatccttctgctggtcttaatttttcttgaccaacataatgagcccaaccaccgccgtttacaccttgtgctccaacgagaagaacaagatttaaaacggcgcgataaatcgtatcagagttaaaccaatggttaatacccgctccgacaattatcattgagcgaccattcgtatcaacagcattttgtgcgaactcacgagcaatttgaataataagctcacgttttactcctgtcattttctcttgccatgcaggtgtaaacggtatatcatcattgaagtctttcggttcttgtccgccaagccctcggttcacaccgtaatttgctaacgttaagtcgtatacagttgtaacgaacatttcgccctcttctgtcataacctttttcactggaatcgtacgttctaatactttgtttccatcatcagagaagtacggaatttgtacagttccaatcgcttcttccattccaagtaaagaaagacgtggatcaatcttttcacctgtttcttcatcttctaaacgcaagttccatttcttttcattatcccaacgtgaccccattgtgccgtgaggtgttgcaaaatcattcgtattctcgttccaaagaacaggtttccattcccctaacttcgtttctcgtccaatatcagaagcatttaagaaccgatcagcaacgaattgatctcctttttgtttcaatgtgacaaagaaaggaaaatcagtatattgcttcgcatactttgtgaaatattccacttgattatctacgtaaaattcttgtaagattacgtgccccattgccatcgcaagtgcaccgtctgtaccttgtttcacactaatccaatcatccgcaaactttgttgattcagcgaaatcaggactgacagaaacaactttcgttcctttatatcgaacctctgctaaaaagtgtgcatctggtgttctcgtcattggtacatttgaaccccatgtcataatgtaaccagagttataccagtcactactttctggtacatctgtttgatcaccccaaatttgaggagaagctggtggtaaatccgcataccaatcatagaagctaagcatcggtccacccataagttgcataaagcgactaccagcagcatgacttagcatcgacatagctggaattggtgaaaagccaacatttcggtctggaccgtatttcattactgtgtacagtaatgaagctgaaacgagttgtaatacttcatcccaattcgcacgaatgaatccccctttaccacgcgcctgcttatacgtacgtgccttttcacggttttccacaatgcttttccaagcctctaatggtgactcgttattttgcaattcttcttgccacatattccaaagaacaccacgtacatacgggtatttcacacgaagtggactataaatgtaccaagaaaaacttgctccacgtgggcatcctcgcggttcaaaatctggcatatcaggacctgtagtcggatagttaagctcctgcccttcccaagttacaattccatctttcacatatatattccagctacatgaaccagtacagttcacgccgtgtgtagaacgaattactttatcatgctaccaacgctttctg

SEQ ID NO: 1223 - DNA, 5368 bp, Bacillus thuringiensis
tttaattggctattttattgcacaatcattagtaatttacgccgttattagtctatatagaagagaacaatattcttctagtagaatcgcattaattatcggtttcactattatactcgtatacggttacattcatctgtttcaattaaattttgggatgaaaacttctcctgaatttaattatttaatacacactgcttctattttattaattggactttcttccatactatatatcttggataaaccaatgcaacatgaaacgaaagcaaaatattatcgattcgattatgtacgttttatactaccttattttagtataattattactttttcctttattatcattcaaccttgggatgataaatttatgttaattggtctcgtattatcacttattttgttattcttgcggcaactttacatgtggaaagataatcaagcactaatccttacatatgaacagttgactacacaactagaggatgaagttgaagaaggtgcatttgcattatcaaaaagtgaacaacgctataagtctttattcgaagatcatcccgatgccgttttctctttaaatatgaatggcatttttcaacaatctaataaggcttgcgaaagcttatttactgcctattattgccaagtggcaagctattctctggtacacttcattgattcaaaagaccacgaactactaaagaaggctttacaaattacaaaggaaggtaggccacaaacgttagaagttcggacaaaagaacaagaaggctattattattatcttcatattacacttatccctacttttataaacaaagaagtggtcggaatgtttgggatagcacgtgatattaccaccttatatgaaaaacaaaaacaagtagaacatttagcctttcacgatgcacttactggattaccaaatcgccgaaagttcgaaaaagatttaaaagccattttaaatacagctcaaactaacgcaaatgatgtcgccgtcatattccttgatttagatcgatttaaaaaaattaacgatagacttggtcatgacgtcggagatttattattaattgaagtagcaaaaagattacgcggttgcttgcgttcaaaagatatcgtcgctcgtcaaggtggagatgagtttacaattctattaccagaaatgtactcagaaaaaagtgcaatttttatagctgaacagattttaactattttaaacaaaccattcttcattcaaggcgaagaactctctattacaccaagtatcggaattgcgatgtaccctgattatggaactgatgtaaatgagttaatgaaaaatgctgatatggctatgtatcgtgcgaaagcaaatggaaaaaacagatttgttttcttctcaaaagaaatgagtatcgctcaaaatgaaattcaattcttagaaggtgaactttcaaaagcattacaacaaaatgaatttttccttgaataccagccacaagtaagcacaaaaacaaaacaaattatcggttttgaagcattaatacgttggaagcatccaaaactcggtatcgtatctcctgcccaatttatccctctagcagaggaaactggttttattattgaacttggcaattggattttacgtactgcctgtttagaagcaaaaagatggcataatcaaggtttttctcacttaaaagttggtgtgaatttatctgttgttcaatttaaccatgcagatttaatcccaactatttcaaaggtgttggaagagacagaactgaaaccagaagcactagatattgaaattacggaaagcatcgcaattaatcaaaatcaatctgtagttgcaaaactagaacaacttcaaaatctcggtattcaaatttcaatcgacgactttggtactggttatagttctttagcttatttaacaaaatatccaatcaacacattaaaaatcgctcgagagtttatttgtggaattacaactagccctttagaagaagcaattgtctcttccattattacactatcaaaagaactaaatttaaaagtgattgcagaaggtgtagaaacagcagaagaatgggaatttttacataaacaaaattgtgatcacattcaaggattctttattagcaaacctgtttctagtaaagacgtttggatgttactccataaaaaaacaaccgtctaagtaagacggttgttttttagaactcaaaaggtacttcattagctaattgtatctcttgattattatgagaaattatttggtttttctctaatgctgtatctcctaatgaaataccccatgccatcgctaacgttagtaaactaccaataagtagttttttcatattccatcacccgcattttttctttaaatatatcatgaaaaattatccagactttatgcaattatgcatatttgttctttatgtcttttttatttcttcattttttttataagtgattcttttaattcatggtttcctaatatatcaaaaaagaagcatgctttttcgtaagcatcttcaatttctgctctatcacacccaagttttgctaggcattcaccttttcgaaagtataactgcccaatcaatgtcatactgttaattcgacacgataggtcaatggctttatttgcgtgacaaagcgcttcttcgtattgattgtctatgtataatgcttttgcatgattatgtctcaccttcacatcaaactctttattatcatgcaatgcctctaattgttttaatatattttcaaacaaatcaataccctgcttcaaatagccgttttcagcataaatgtttgcaattgcgttttcaatataaaggttctgatatacatctattcctaccagttgttgattgagcaatttctttaattctaaaatgcaatattcgtaatcgatttttttcaatacgtaagcagctacataatattgccattgaagaaattgctgaagctcgggatgatattcttcctttttcaattcattgcatactctattataaatttctttatattttttttgcttacaaagcagaataatttgatcttttaactgcttattcctctcaatatcagaataaataagtacctcataaaaatgaatgatgggaacttgtaattttgttgcaataccttgcaatatatccatacttgggtataccgcgcccgattcaattcgacttacttccgattgatgacatatgttctcggataactgtttttgtgttaatcctctcatcaccctaattttcttaatttcacttcctaatttttctgcgtgcatacttactcaccatcccattataacaatctagttttttaagttgtcataccactacaataatgtgaattcgacaatttttgatatgaaataatgcataatatatatataattcggcaaatttttcatacaattcatctcacatacaataatagattaggagtgttatagatgaattatagaaaacttgctagtgctttcgttacattcggtcttctttgccctttatcaacagaagctattcatgctcaagagttagacaaaagtgcagtcaaagttgaaattgctcagcctggtttaacaatcgggaaattaacacaacctcaaaatgatacgaaagaaaatattgctaaaaagtatttaaaaggtgaggtaaatggggcgaaagctcaacaagaacaagtcactactgaaaaaaatgtagatttccaacctacaaataaagaaactaaagaaaatcaaaccgaagttcgccttgcacaaacatataaaaactataaagtatatggccaagatctcattgtaaaagtagataaaaatggagtgatcacaactgttagtggtaaagttgttcagaatttaaatcaacaacctaatcttactataacaaattttttgtcgaaaaatgaagtaaaatctaaattacgcgatatagttcaaattccaagtgatgcagttgagacagaattctctagcgaaaccgttgtttataagaaaaaagatggctattatacattcgcaactgttattacatttacttatgaaaacaatgaacaaattataaacggcaatgctatcgttgatctaaaaactggcgaagtacttttccaagaaaagttcattaaaaacaaagagaataagactataaatcaagtaacatcacctagattatcccctgcaagtgagcaaggaactgggaaaaatgcacttcaagaaaacatctctttcaatattgccaaaggaactgatgggaaattttatttagcggatttatcacgcggaaatggtatttatatttataatgcaaactacgccgattccctcggaggatatagtcaagctggttatccagggacactaatttcaagtagcaatcctaattttgcagataaagaagccgcgggcgctatgaagaatatgagtgatatttacgattactttaagaaagaacataatctaaaaagttacgacaataaagattcaaaagttgttgctagtgtacacggttttgattctactgaagttagtgatggtgtaaaagaagactatgtaaatgcattttggcatcccgcttggaaccaaatggtatttggtgatggtctagacggaaaactaacatccgctcttgatgtaacagctcatgaatttggacatgctgtatttagtggcacgacgaaaaataaagtcgtgagatatccaagcgctgaaacatctgcactaaacgagggattagcggatttctggggtacacaaatcgaatattacgtaaagaaagataaaggaaactggattatgggcgatacattaggcggcctaacaattcgtgatatcccaaaggaaattggtgacggcggtcataaattatatacaaatttacaagatttctataacgatggtaataatcaagaatcacacgtaaattctggtattatcagtcacgtattatatcaattagctgaaggtaaaacatataacggtgttgctgttcaaaagcaaggaaatgaaaaagtaagtaaagttgttatgcgtacattgcaaaattatgcaacttccgctgaagactttgaatcacttcaatctcatattgtacaagctgcaaaagatttatatggcactgccgtatcaaatgaatttgcaaaggcatttgaagcacacggtaacaaaccgttacaaaaaataaataaagttatagcggttctataataaaaaaagaagtttaccaatcataggtaaacttcttttcatatccatcccttttcttcccgcaattgtaattggcttcaatttttattttttgccatcaagctttcgcttatacctttagaaatataaattacgttctgtacccggcgaaag

SEQ ID NO: 1224 - DNA, 10964 bp, Bacillus thuringiensis
atagttattgctggtctatatgtagcgggaccatctgtcgttctttcagtacttggtatctatctttgtattgtaccattcggttatattatagcttatttacgacttatcacaggcagcatttggccttcggttatcatccatgctacttggaatgccattattcaaggacctttcacacgtgcaagtacagggtatcaaactgagatttggattggagaatctggcttgataaccgctagtattatcttgattactgcaataattacgtctcgaatcgtgaattttactaaatagcatacggatgtgttttaaattcaattagtgaaatatgacgaggcgaaataagatgctcctaaaaatattagaaaaaatctagttgaacagactcttacttcatcttaggctgctggatatgtgggggacatcaagctaagaaaataaacttggttgccataaaaaacataatgttttcatttaaaggctatgagatgaaatttcatcatcttcatcaagtttgaccttcaggaaataaaaagttaaacgattatacaaatactctaactgaaaaaacgatagtccttctacattttagatagaaggactatcgtttatttttttgacaaaattaggaggtgatgttcataaaatggataatataattcgtatttgcgtaaagagaaaaagttttccaaagaagatgtagttaatttccttggtataacggttgattgaaatttcattttataacttgtaaagggctgtgcaatgcatcgtactattgaaaaatctaaatttaatcattaaattgcgataaaatgtggtcggaaataatgaaattttaggaaaaataaggtacactagtttatgattttagttgaaaatcgtttgacgttaatgcatacgggggaaagattgatgaacaacaatacaacaaatgaatcagttgaagaaattgatcaaaaacgagtaagatcaaaaaaacgttatacaaattggaagtttattgcagcgggtattggtgtaattgcacttcttattgggggaatgagttattatcaggcaactcacttcaattcgaatgttacaattaatgacacaaaagttggtggtctgagcgctgatcaggcaatacagaaattaaagacatctggactagcaaacaaagtctatgttgatcaacaacaaattttagatgaaaaagatacaaaaacggaacttacggaaaaagatttgcctcaagttaagaaactattaaaaaaccagtggacatttttcccttcctcaaaggtagaaaattattcattgctaccagagaaggcagatcagtatcgtagtgaaacgttgaaaaaacttgtagaagaaaagctcatctctatgaatgagaaattaaaagcgcctcaagatgctatggcgaagctagaacaagggaaaattgttatttcgaaaagtgttgaaggaaaacagtatgatgttactagtctactgaaagattatgataagcaaaaatataaaagcgaaattcatctgaagtctgcatacataaaacctattaaagaagacgatccgattgtcaaaaaagaggagaaagcactacagaatcttcttgggcagtctgttgagtataaagtgcaggatgaagtttatcctttaaaagcgaaagatttaattcaaaatgcctctatgtcaaaggatatgaaagttacaattgatgcgagtgacattaagaagaaaattactgaaattaataatgccaaatcaacattaaataaagatttctcatttaaaactcattccggttcagtcatatcagtaaaaggagaaggatacggctgggcactagatgttgaaaaagaaactaaacaagttcaacaagcctttgagaaaggcgaaaaatcgctttctgcttctaatattcacgggaatggttgggagaaggaaggcatcggttataaaacaacatcgaataatggcatcggagacacgtatgcagaagtttcaattgcagagcaacaaatttggatttacaaagatggaaaattagttgttacaacaaatgtagtaactggtaaacatagtactggtgaagatacatcaccaggtgtgtggtacgtcctatataaacgaacaccatatacgctaagaggtaacgcagtaggaaaagctgattatgcggttaaagtagattactgggtcccattcacaaatagtggtcaaggattccacgatgccggctggcgcaaagactggggaaataatgcttatttaacaggaggatcaggtgggtgtgtgaaccttcttcctaatgttgcaaaaactgtatatgatagtttgaacacgtatgatccagttattgtgtattaaaaaatagctacgtatcaagaaataaacaaagcaggaaatcttacctgatggtatatgaaaaaacacctcttgcattcgcatactaagtgtgcaaatgcaatggaggtgtttttgtttgaatacaagagcgtattgcttataagaaacaaagtagaaagaaataataagtattcaaatagtcaataaaattgacaatgaatatcattttcacttaatatagaatcattgcatttaattagacatgaattttttgttaatataatagatttctattaagttgtcacatttaagaactatcattaaatattttaagaatttaaacgtaggaaagggtaatataaaatgaactggaaaaaaggcggattatgggttattatttttttcgttgtaaaaggcacgatttctacacttttaatcgttacaggtgctaaatattttgatttatcatttatgcaacttatcttattaattctgaccttattagtgatttctctaataagccgaaaattgctgtatagacataaacaaaacaaaaagcaaaaagagctaaatatataatggagccccagagacctttggatttctggggttttattttgatagttttttcgcatgtatatcaatttaacagaataggttgtccaaaatgataaaatcgatgatgtttaaaatgcgtcagttatttttaataacgattgatacccgtatttctacaatctgtataaatgactcaagcttcgcatcttatgaattccctgaagtgctaaacctaagcaaagtaatgaactatcttaaggaagaaagttgagttagctaatcgcatatattttattgaaaggatgtgattgaattatggaacggccgaattggggaattggaggattagtattcgttggctgtatgtttcttggtggaggagtgggatctatgttaggtaatgcccaaactggatggctaataggaatgggcgctggatttcttggtatggctttaacgagactgttcagaaaataatgtaactgagattcttcttctggtaaataaggaaatatgtaagtaagtcatggcataagagttctataaattatagttagaatcttctcttttgtatttgtcttttctaaatttctccatacatagatataattctcaagtcggaggatggcaccttagggtgtcttttttatgctctttaaaaatgtcttaccattataatagctgagttttgctttcagtctccgatgtccattaagcataaaataaaaattctgcaccatttaaactctgataacaattcatacgatcaagaataattgagttaatagctttcggtagatcgccatcatttttttataatagattagattcattgccgtttcagacctatgtatgaattcataatctaatagtaaaaggaggaatgattaaaggtatggcggttaatgaggaatcaatttgtcaacagtttgcaagaatcattggcggtcaagaaggattcgctggtgggaaatgcgtggcaacaataaaccgagatgaaatacgagcaacaatcttgggaaaacgttttagagtaacaacttccttttcattcgaatcacgagacaataaaactggacgggcattatgcctaggccgagtagcactcttacaaaaagaagtcactgaatttgtggcgacaattattaaacaaggaataatcgtttcgtctatacacaatgagtggttatgtgatgatccaaatttaatttacgttaatatcgaagacgttgatgacccactaaattttgcaagaaaagtgagaagagcgttatgcacgtaatcaatttctttagttaaacgagtgattatattaaattgaaaagttcagcgtgttggatggttttataaaacgaaagaaggcgtttcatatttggaatgccttttctttatgtgttcgttactaatgtgggtggttaactgattatatgctgtttatcttgcaacagcaagaactggacgaggtatctttaaagatgtttgactgtctatagataccatattttatcaaatgttattagcatatcataaaacgataagggagaaatcgccttcataccaaccaatcaaaatcttgaggtactattctttatgttgtaaggttccactattattttcatcaattactcaacgtattgcttcgatgttttctggagtcattttaataaatccttgcttttcatgagataatactttttgatgagtcattttgtgcatggcattgattatatgacgattagaattgaggtcaagtattacctcttcacctttaattctatcagtctgcttttccttaactcctgattatattagcttcaataacatatgatcattcttaagaatgtcattgaaatgtacgaatagatgttagtgcagcaaaataaattgtgttatgatatgaggaaatataaagctatgtaacggagggaataacatgccgcatgttgtgtttcgtggaattactactgaacaattaaaaagcataagcaagccattagtagaagaactcgcagatatctgtgagtgtggtacggataatttcaccttggaattaccaagttctacgtttgtattcaatggagaagaaatagaagcgtttcctcttattgaagtgaaatggttcgagcgtggacaggaaattcgtgatcgatttgccaaggccattactacatatgtaatggattttggacttccagaagtagaggttgtatttacagttttcacagaatcagcgtattatattaacgggaagcattgtgcaagttagagctattagaaagatttttattcctataataaaatatgtttcgttaaaaacaagggccggaattccggctccttttctatcccgcaaaataaagtcttactttatctctccgtctcaaaaaactcaatccactctccatcagggccagcgaagaatatgtaacgtgttccatctggtaatgtttcaatttcttctcctagtaaaaaggttactttttgtttctttagtctttcgatctcatcctctaatgaatccactttaaagcaaatgtgatgtacttttccttctgccggaagagaagagttgtagccttcaatgagttctagtatcgtttcttttgattcttctacacctaaaaaagcgagttttaagtctggattcggatgacccatacgtttcatgagctgtaagccgactacttcttcataaaatgaaatagatgtttctaagtttgcaaccataagtccaacgtgttcaattcttctaactggcatgtagattccttctttctgaaaattatatacaatatattattgaaaattaagaaaataagcaagataaaaaccttacaaattttagcgtgttatatggtatagtgagaaagtatgtttggggagaaggaaggagattatacgatgaatacaactactcaaactccttcattatcggaaacgatgaaagagtggcattatgcattagcgtatgaaattaaacattggaaaacgataggtggtagtaaaattgctatcatgaacggtcgttttttatatacagattatgaaagtacagtatacgtatttcagcttatttcggaagtaagcttacctgaaggttcacccattcgaattgagttcgatggtgaggaagcgacaggggaagtattatctatacatggattagaaatagagctgaaattaaatgattatatacaaggtgaaataagagaagcggttttatatagtgaaccgtggcaattgttagagcaactacaagagcgattgaaagaagcacgtaaagataagctgaaacgtaatcgtataaagcgtcttgttgatgggacgagcagtccgaaacatattgagaagatgaaaaatccaaaaaatgaactggcatatcgttcgttttataatccgacaacgtacgtatggggaccgccgggaacagggaagtcttacaatttatcacgtattatttcggctcattatcaaaaaggaaaatcggtacttgtgttggctcatagtaatgcggcagtagacgtattaatgagtgaagtaacgaagcaaattgagaagaaaaagaaatggacgcctggtgaaattgttcgttacggttatagtcaacatgaacatatacgaaatcatgaaacgttacttgcgtcgaagttagttgaaacgacgaacggatcttggggggaggaaagactctatttagaagagacacgacaagatcttcgtgaaaaaatcttatcgtataaagcaacatctgctgataagaagcgtatacaagagattgaaagtgatcttcgaaagcaaaaggctaaaattaaagaagtagaaaaagaatatattgaaaatgcaaaagtaatcggcgcaactttatcaaaatgtgccattgattcacttatttatgagcgtacatttgatttagttgttgtagatgaagtaagtatggcatatgttccgcaaattgcattagctgcttcacttggaaaacgtatcgtcgtttgcggtgactttttacagttacctccaattgcgatggcaaatcatgaactcgttcgtaaatggcttggggaagatatgttttaccatgctgggattgttgagtctgttaataaatcagaagcacacccaaacctatttatgttgcaggaacaaagacgtatgcatgcggatatatcgaagtttacgaattcgtttatttataaaaatagagtacacgatcatccgtctgtttcagagcgtaaagaacttgcgcaattgcagccgttcgcaaatgaagcgagtgttttatttgatacgagccaaatgggagctttttcgttaaaagatgctgcttctggttcacgttttaacattatgtctggtttagtagcaatgcaaatgatgttaatcggattgttagatggtgtgcaatcaattggtattgtgacaccttacagggcgcagtcacgctttttatcaacgtgtattagagaaatgttgcagagaacgaaatatcaaaacataccagttttagcggcgacagttcataagttccaaggttctgaaagagatatgatgatctttgatacggttgacagttatccgcaagaacgacctggcatattattctttgatcacaaaaaccatcgcctcgtcaatgtagcagtgacaagggcgagagggaagttcattcaattatctgattgccattatatgtgtaaaaacctttcgagaaaacaagcgttatcacaattaacagctcatatagaacgtcacggagatgtgtatgatcgtacgacatcaagacaattgtgggaacggaaaatttcgaaacgtttacgctggtttatggaaatgaatcttgaggaaacgaaaggggtattaaaagatattttagcctcaaaacgaaaaattattatttcacttccaagtacaaaacaagtggataagcgagtatggcaagcgttaatgcgtacaaatgcgcaaataacagtttatagtgatggaccagttccactgaaaaatgtaaagttacaaagacaaaataaagcattcccgtttatcgtaattgatgatgaaatcttctgggcaggcgcaccgcttacatctcaaatgatgtttgaaggtagtacggaatttccgtacgtatgtgcaagactgcaagcacctgagacaattggtgtattaaaaggatttttagatattcggtaaattcggataggaattccttgacttttacttggaatgaacttagaataaaaaataatttaatataattttatgaaaattcttatcacgagaggtggagggactggccctatgatacctcggcagcggattcgttaggaatactgtgccaattccagcaaggtaacttgaaagataagaaagaagctcattttgactgtatatacagaagcctctttctatcttttagaaagaggcttttttatgtgaaaataaaaggaggaagaacaatgggagcgacaggagtagcgtcacaaagaaaaacaattgaagagagtatcgaaagaaataaggaaaagtacatagaaacaagtcatgatattcatgcgaatccggaaattggtaaccaagagttttatgcatctagaacgttaagtttattgctaggcagtgcaggatttcagttgcagcacaatatagctggacatgaaacgggatttatcgcgcgaaaaagctctggaaaacaaggacctgcaatcgcatttctagcggagtacgacgctttaccaggactaggtcatgcgtgtggtcacaatttaattggcacaattagcgttgcagcagcaatcgcattatcagaaacgcttgaagaaattggcggggaagttgtcgtgtttggtacgccagcagaagaaggcgggccaaatggtagcgcgaaatcaagttatgtaaaggcaggtttatttaaagacattgatgcggcgcttatgattcatccgagcggaaagacagcgacaacgagtccttcactagcagtcgatccacttgattttcatttttacggaaaaacagctcacgctgcagcttcgccagaagaagggattaacgcattagatgcggttattcagctctataacggtattaacgcacttcgccaacaacttccgtcagatgtgaaaattcatggcattattactgagggcggaaaagcacctaatattattcctgactatgccgcaacaagattcttcatccgtgcagcaacgcgaaaaagatgtgcagaagtaacagaaaaagtaaaaaatatcgcacagggagcagcattagcaacaggtgcaaaagtaaaaatccatcaatttcaaaatgaaatcgatgaattactcgtaacaaaaacatataacgatatcgtagcggaagaactagaactattaggtgaagatgtaaatcgtaaagaaagagtagggattggttcaaccgacgcaggaaacgtaagtcaagtcgtaccgacaattcatccgtacattaaaatcggaccagatgatttaattgcacatacgaatgaatttagagaagcagcacgttcagaacttggagataaagcattaattacatcggcaaaagcattagcaaatacggcgtatcgattaattacggaagaagggttgttagagaaggtgaaggaggagtttagagaggcgcagaggaatcaggggtaaggggattaaggtgcttttttcgaatagagatctaattcataagtagagatataaaaaagaacattgaaatatcaatgttctttttttgtttactaatcattgatttcattggcttttctcataaaggaaaaacttttactgttagccggggataatacgtatccctttattagaacgacaatttctcctcaaactcactctttaaaacaattaaaggagacgataatccaaattgcattaaagagtctaaaaatgtagcgagagaatccatcgaatcgctcatgaccttcatcatataattaaattccccgctaattcggtataaatctgttacttcaggagcggcattacaaaattgaataaaatcagagcattggctcgttttaaacatgatgaatgcttgaatgtttttattaatttttgcaggctcaaatttcgttcgataagccgctataactccttgatcttcaagcttgttaatacgttcttttacagcaggttgcgtcatggatataattcgtcctatttctgaaacagaaattctcgcattttcatataacaggttcataattttatgatcgatttcatccaattttacagcgttttgcattgtgtagcctccttgttatgttttctaaagtgaattgtaaattataactataatatcataagtgaacgaactaaattacctataaatctatatttaaaatgattagtatttgcatgaaaatataagtatagggtttatcaaaagggaatttaggaaggatggaaaaaatgaagaatcttgatgggaaagtagcattagtaacaggggcaagtcgcggcattggtcgtgcgattgcgatgagattggcaaacgacggtgcattagttgcgattcactacggccgaaataaaatagttgcagatgaaacaattagtgagattgaatctaatggaggaaaggcattcttaattgaagctgatctcaatttaatggatggtgtcaaaaaaatagtagaacaattgaagaatgaattacaaataagagttggtacatcagagattgatattttagtaaacaatgcagggataggtacacaagggacgattgaaaatacgacagaagaagtttttgatgaaattatggccgtaaatattaaggcgccattctttttaattcagcaaacattaccgttactacgagtagaagggcgcgttattaacatttcatcagcggaagtaagacttggttttacagggtccattgcatacggtttaagtaaaggtgcactaaatacgatgacacttcctctagctaaacatcttggagaacgaggtataacagtgaatacaattatgcctggatatacgaagacagatatcaatacgaaattgctagatgattcagaaatacggaattttgct

SEQ ID NO: 1225 - DNA, 8467 bp, Bacillus thuringiensis
gtttattaacatttaatgaaatagaaaggttagcgagattatttataagtatgggagttaataaaattaggcttactggcggtgaacctttattgcgtaaagacttaccgaagttaattgcaagacttacaaatctagaaggcttaaaagatattggactcacaacaaacggaattcatttagcaaaacaagctaaggcgctaaaagacgcgggattaaaacgtgtaaatattagtttagatgcgatagaggaccatgtcttcaaaaaaattaacggaagaaatgtaagtacaaaacctgtactgaaaggaatagaagcagcaaatgctgctggattagaagtaaaggtaaatatggtcgtaaaaaaagggatgaatgatagtcaaattcttcatatggctcgttattttaaagaaaaagaaattcagctccgtttcattgagtttatggatgtaggcagtacaaacggatggaattttgaagaagtcattacgaaggaacaattaatagagaaaattaatcgtgtatatccaattgagcccgctcagcctcgttattttggagaggttgcgaaattgtatcgatatgtagggagtaatgcagaagttggatttattacttctgtttctgagtcattttgtttttcttgtacgagagctcgtatttcggcagacggcaagtttttcacatgcctatttggagcgaaaggaacggatttgcgaacgcttcttcgagaaaatatttctgatgcatcactattaaaaattttaaatgatacatggcgatatagaacagatcgatattcagatgaaagaacagttgagaatacaagtaaacgtccaaaagttgaaatgtcttacattggtggatagtgaaaggaggatttcttatgcaagagcgttattcaagacaagtgttgttttctggaattggtgaaatgggacaaagaaaaataagagaaaagcatgtgctcctaatcggtgcgggtgcgctaggagctgcgaatgcagaagcacttgctaggatgggaattgggaaattgacaattgctgatcgtgactacgtcgaatggagtaatttacagcggcagcagttatatacagaagaagatgcgcagcagtgtaaaccaaaagcaattgcagcagcagaacatgtaagaaagattaattctgaagtggaaattgtaccagttgtaacagatgtcacaatgcgagaaatagaagagttaacaaaagatgtggatctcatattagatgcgactgacaatttcgatacgcgtctacttataaatgacatttcacaaaaagaaaatataccttggatatatggcggatgtattgggagttacggtgtaacgtatacaattcttcctgggaaaacaccatgttttcgctgtctaatggatcatcctatgggcggtgcaacatgcgatacagccggaatcattcagccagctgtacaaatggtcgttgctcaccaagttacagaggcgatgaaaatattggtgggtgattatgaatcattaagagggacgatgttgtcatttgatatttggaacaatcaatatctctcattaaaagtaaatagacagaagaaaagtacatgtccttcttgtgggaaatcacgaacgtatccaagcttaatatttgaagcgcaaatgaaaacggaagtgttatgcggacggaatacagttcaaatccgttcaggaataaagagaaatcttaatttaaccgaaattcaaaaacgattacaaaaaagtgtacatgtcaaaaaaacgccttacttactatcatttctagttgatgaatatcgttttgttttatttatagacggtagggcatttattcatgggacaaatgatgtgaaaatagcaaaacgattatacgccaaatatataggatgaacagaaaaatcgttttttccttattaaaatgaggtgaaaaagaatgttagataaacgtataccaattccagtagcagaagcagttgctcgtgtaatgaaatatgcctaccaaggtgaaatggaaaaggtttctcttatagaaagctacggtagaacacttggagaagatgttattgcagatcatgatgttccgcattttgatcgctctccgtacgacgggtttgcgattcgagcggaagatacaaaagaagcgagtagtagtaaccccattcaatttgaagtaattggcgaaattggagcaggctttgtttttacagaagaagtgaaagaatttcaagctgtccgtattatgacaggtgccgcaattccggaagggtgtaatgtggttgttatgttagagctaacggaaggatttgaagaaaatgaaaagatttatatggtattaaaacgctctttctcttctagcgataacatttcttttaaaggagaagatgtaaaccaaaatagcatccttgtgaaaaaagggactgttattaatcctggagtagcagcgcttcttgctacgtttggttatagttccgtacatgttataaaacagccggttattggaattgtaacaacaggaagcgaactgcttgaagtacatgaacaattaaagctagggaagattcgaaatagtaactcttatatgattgctgctcaaattgaacgagccggcggagttgtacagtattatgggcaattcgctgacgatttagagacgtgttataacactgtaaaaaaagcgatgaaagaagtcgatattttaattacaactggtggcgtttcggtaggagattatgactatttacctgctattcataagaggttacaagctaatgtactttttaacaaaatagcgatgcgaccaggaagtgtgacaactgtagctgaggtagaaggaaaactactatttggtttatctggtaatccttctgcttgttatgtcggatgtgagttatatgttcgaccagtcattggaacatatttgcataggaaagatccacacatttatcgtgcagaagcaattttacaaaaagacttttcgaaagcaaatccgtttactcgttttgtaagagggagagtggaatttgtagatagtcaattgcaagctataccagttggtttagataaatctagtgcaatttcttcacttgcagaggcgaacgcatttatcgtcctgccaggaggaacgagaggatttgaagcaggaataactgtttccgtactgttattagaatcaaacgctggaagtgagtggccgtgggaagaaccacttcgatcatacaaataatagaaaaatagattactaacttatacaaagataagaggtgcaaaatgatacaaacgtattatgaagtaattgatacacctatttcaattgaggaagttacaaacaaagtaattcgtcgtgagtgtggcgcagttactactttcgttggtactgttagagaatttacgaaagggcgtcgtacgctacatttagagtatgtagcatataaaacaatggcagaaaaacaacttgagagaattggtactgaattaggagagaggtggcctgggacatttgtcgccattacacatcgcattggtacattacaaatttctgatcttgctgttgtcgtcgctgtttctacaccacaccggaaagctgcatatgaggcgaacgaatatattatggagcgtataaaacaaatcgttccaatttggaagaaagaattttgggaagatggtgaacctgaagaggagatgagaatatgattgaagtactattatttgcacatttacaagaagaagtaagtaagccagcattacaaatcgattgtgaaaatattacagttgctgaactaaagaaggtactcattaagaaatacaacgtagcgatttcaaatgaaatcatggtagctataaatgaagagtatgcaaatgagaatgacgtcattcaaactggtgatactgtggcgatgattccgccagtaagtggtggttgattcttttcgacctaatcatgttacgacgtgattaggctggagagaatgaatataactatgcatacataggagggaacaggatgaaaagtcctaattttcaattaagtttacaaacttctaatctaattataggttttatggtatgggtcattttatcatcattaatgccttatattaaagtggatatcccattaactgcggggcaaatttctatggtcacagcagtacccgttattttaggttctgttcttcgcattccaattggttattggacaaatcgtttcggagcaagaaaattattctttattagttttattctattattacttcctgtcttttatattagtgttgccaattctatgatggatttaattattggtggattatttgtaggaatcggtggtgctgtattctctgtaggagtaacttctttaccaaaatactttccgaaagagagtcatggttttgtaaatggtatttacggtgtcggtaacgccggaacagcaattacttcatttttagcgcctgttatcgcaacttcagttggctggagaacgacagtacaatgttatttagttttacttgcagcatttgcacttatgaactttttattaggtgatcgtaaggagaaaaaggtgaatacaccattaatggaacaaataaaaggtgtatataaaaatgagaaactttggtttttatgtatcttttactttttaacattcggatcatttgtcgcatttacagtatacttaccaaactttttagtatctcacttcggattagagaaagtagatgctggtatgcgaactgcaggattcatcgtactcgcaacaattatgcgtccgattggtggttggctcggcgataagtttaatccatttaaaatattaatcttcgtatttatcggtttaacactttcaggtattattttatcattcatgcctagtatgaacgtgtatacatttggttgcttactagtcgcattttgtgcaggcattggtaatggtacaatctttaaactcgttccaatgtacttctcagaacaagcaggtattgtaaatggactcgtttcagctttaggtggactaggagggttcttcccgcccctaattttaacattactattccaactaacaggccattatgcaattggatttatggcattatcagaagtcgcacttgcttgtttaatcattacagtgtggatgtatagtcaagaaaagctgttagtgatgttaaagaatcattaataaggaaaaagaaccatcccaaagtattttgggatggttcttttagtaataggcttcaacatgtttttattgatctctcaataaacgcttattttctataagaatgtgcttttaaaatgaagatgtcaaaagttattcaattaaagggcagattagttaaggaaatctttaaagtatttacatatagacttgcgaaaaaagacacaatctcgcttataattaaagttatatgagcttagggtgatagcgatggggtgggagtgtcaagtaagaattttatgcataattgccactaagggagatgattaaaagttgagtaaacagaatatcagcacaatagtttcaggagatttgattgttacccatctaattggccagattaatacagaggatgtgtatgaatggtttaatgattttgagcaggtttgtcagcaatttatttctgagggtcggaaatacaaattgttggtggatagaaaagggtataccccaaatcatttttctgttcaaaaagtatggaaagataagttcttcaatgaaaccattttgaatcatagtaaggcaattgcatttcttcttgaagaaggagagatactgaagtatttgcaacaatccaatacaaaagaatccgtggagttttttgatgattatgaacaagcgctaatttggttgaatgaatatccaatataaaaactgaatagaaagagttgctcgtaatgttacacttgtcatgaaatttatttgtttacaagttgcaaacaccatttattttcttcatagattgcttgtgaaataaaagaacggaactacaacaaaaagaacaaacgtcccctaaaaaacgtttgtccaaaggtaattactattttaactaagaaatagattacaatttatgtgtacgagaaatcttttttataagtttaggcaatatagatgttagttcttgcttcaaacgcttcgtaaatgatggatctttaccagaagttgaaatagtgacaacatattcattatttcttataacgccaggtgtgtgaaaagatgattctgtaccatcacttacaacgttaacccactggaaatcatgagcggcctgtttgaccatcatatttacagcgtgttgatttgtagctgcataaataaggtgagcatctttaatatcatcattactaaaagctttttgcttccaagtaatataagaaagttccttcatttcctcgcaaatttctgggctgacaacagtgacgaaagcgcctgtatcttttaatccagacgcttttcgatatgcaattttacctccaccaatgataacaaccactttattttgtagattaaacataagagggtacatgttatacatatatgcattcctccattcgttctaacaatgttagtttcatatatgtatcaaactgaagacagttacaagtcgtaacatgattgtatttttttgtatgcaattcaattttttgaagtaataatccggtaaagagaaggtatggcatgacatatacatgggacgcagtcgatgttatatccttgagctcaacagcaaaagagggagttcctttcgttaaaaaggaacaggatactggcataccaagttttcgttcgatggctgctccgatttgttgtaactcatgtatcggttgtgtatcactactgcctcgtcctacgagtaaaatactactattttgcattggcatagcttcacgtattcttttcactacaagttccaccatatgtggatgtgtactaaaaggaggtacaactgaaaatgttatttgtggatatttcttttgtagttgttctatttcaaaaggaacatcacgtttgtagtgagctgctgcaaataataaaacaggtacaatcattatttcagttactccctctattatcgtttctgtaactgcatccgaaatagtaggtgtcgttagttctagaaaagctattttttgaattctttcgtttcgctctttcataacagattgaataaattgaatgaattgttcattaccttcttgtagccggctcccatgtccaacatatacaattcctttcattgtctcaccatgtctttcttcataagagtttcttgtaattgatgatctacgttatgaaacccaactttatttgcatagtataaagttggaacgtcggtatacgagaatgggagagtaagaatattgataaagccaaggcgttttatttctgctagaaacgtatcaatagaagcacgaccttcaaatacaatgctatcccatgagaattcagaaagcatacgtgaatgaatttcatcgaagcgatgatcaattgtgtactcatgagtcatcatataggaaccagcaccaattttttcttgaataacagcaattcggttaatgtttcgtcctaaataaactgttgtattggaagagaactctgcttgtttacttagtagcccatattgcataagtttttcttgagtggcaacgttcatatgttgtagttgcgcttgtaaagaacgaatatctttttggtgtttactacatgattgcatcaatatttctacactttcagctgaacaaaaaacaagacgattaacgttaaaaatttcattgatttgttcaagtgttaatgtgtattctacctttttgaaagtaggaatttgatatatttctgcaccggcttcttgtaacttttgcttcattgaacttgttttattcgttgcagatgcaaataaaacttttttctcgtgtaatggtttacgttctttccaagcgatctgatcccgtaaggaaacgacatcaccaataattgtcatagaaggattagaaatattttcgtttttgacaatagaaacaatggtagacagtgtccctgtgacaacgcgctgtttaccagttgtaccccattcaatgactgctactggcgtatcttcttttttttctgcttgtagtaagttttcacaaattgtaggtaagttttctatacccatgtagtaggcaattgtgtcgctattgtgagatgaattatattttccatggtcggttaaaggaccttttgcatgtccggttaataaagtgacgctattactgtagtcacggtgggtgaggggaatacctgcatagatactagcggcgatgctagatgtaatacctggtacaatttcatatggaatatttgctgatgctaaagtttctgcttcttcaccaacacggccaaaaatagatggatctccgccttttaagcggactacgatttttccttctttcgcaaattgaaggaggtgtgcgaaaatcatttcttga

SEQ ID NO: 1226 - DNA, 5822 bp, Bacillus thuringiensis
gacttgttctatattacacctctaaagtataatcgtcaacacctttttataaagaacttcaatttaatatttttatgctcttttagctagatacgtctctataggatttcattatcggagcacggcttctgcttctctttgatttatttttccaaatatattcaagttaatttgaactctagacttaacttgtgtggacgttttcctccaacaaaactagcaaccttattttaacaaatactagtatataattagagagttgttgtactatcaataaaactctattagaaacaggtgaagatatgaaagatatacgtatccttatagcagacgacgataaagaaatccgaaatttattaaaaatatatttagaacgagaattatacatggtagacactgcaatcaacggcgaagaagccttgcatttatttaatcaaaataaatataacctcgttatattagatcttatgatgcccaaaatagatggaatcgaggtatgtaaaaaacttagagataaaactaacgtacctatattaatgctcacagctaaagatcacgaagttgataaaattttaggcttaagcattggtgctgatgattatattacgaaacctttcagcattcacgaagtaattgcacgagtaaaagctcttatgcggcgttttttagttctcggaagtaacaatactgctcaagaaaaaaccactttatcttttaaaggactaactatcaatttaaatacatacacagttcatacaaacaaagaagaaattagcttaaccggaaaagaattggaactgttaaaattctttacttcaaacccagggcaagtatttacaaaaacacagctcttccgaaatgtgtgggacgataattatatagaagatgacaataccgttatggtacatattcgaaaacttagaaagaaaatagaaattgacccttccaatccaaaattcattcagactatatggggaattggttataagtttgtaggtgaaaagcttgaagactgataaaaccctcttccttatttcattacaacttatcatttgcgggattttaaacatacaaatgggtccaagattaaaaatgtctttatttattatccttatcttaattacaatttatctcttcttttcaagaatacaattcattcaacatcgtaaagcaatggatactaaattaagtcgtgtactaaaaggaaacttacaaacgagattattcacaagcaatgaccactcattacataatatcgttttttcaataaacgagctaatagctaaattagagcaggttcagattgaagccaaaagatccgaggaatccagaaaacaacttttgtctagtatctcccacgatatacgaacaccactcacctccataatcggatatatagatgctttgaaagacggagttgctgcttctgaaatagaaaaacaagaatatcttaaaatactctatatgaaatcaaataacttaaagcacctagttgatgaaatattcaatatggcgaagctagacgctaatgaatttccactaaaagaagaagaactcgacttttctgaagttactagagaagttttgattgaatttttacctgagctctcaaaacataacatcgaactgcaaattctcataccagattctacttgtcctatcatcgcagatcatctaagcattatgcggattatcggtaatttaatgaaaaatgcaatttattacggaaaggatgggaaaacaataggagtcgaactgctagaagctgatgcagaatacaaacttcatatttgggatcaaggccctggtattccaaaacatgatttacaaaacatatttgagcgaatgtaccgaagcgaacaatcaagaaactcttcatttggtggtagcggtctcggactctctatttctaaagcactcgttgaaaaaaatggtgggcatatatgggttgaaagtactccatggaaacgaactacttttggcttttctattccaaaacacaatacttttaagaaatagttaagaaatgattaatatgcagttaagccttcctttttatgatgtaagtaagaacttatagaaagcaggtgtctcctataaatacaattataaaaacgactaaccttactaaagtatatggcaatcaaaaatcagtagataatttaaatattaatgttcaacaaggagagatttatggcttcataggccgcaacggtgctggtaaaacaacaaccattcgtatgctgcttagtcttataaaacctacaagtggaacgattgaaatattcggagagaacttattccaaaatcaaaaagatattttaagcagaattggttctatagttgaagttccaggattttatgaaaacttaactgcaaaagaaaacctactaattaatgcaaagataattggggttcacaaaaagaatgctatcgaagaagcattagaaatagtaggcttgcagcatgagacaaaaaagttagtaggaaagtattctttaggaatgaagcaacgcttaggaattgcacgcgctcttctccattatcctgagctactcatattagatgaaccaactaacggactagaccctattggtattaaagaaatgcgaaaacttattcattctttagctcaagaaagaaatataacaatactcatttctagtcacatattagccgagatagaacagttggtcgatcgtatcggaattattcatgaaggaaagttactagaagaagtttctcttgatacgctgcgcaaagcaaaccgtaagtacatagagtttcaagtgaataatgacgataaagctgtgatgttattagaaaatcatcttcaaatttttgattatgaagtacatgatgaaggaaatattcgtatttactctcattttggacaacaaggatacataaacagaacgtttgttcttaatggtattgaagtattaaaaatgatgataagcgaagatagactagaagattatttcaccaaactagttggaggtggaacaattggttaatctactctatacagaactcttaaaactaaaacgctctaatatgtttttaattagcattattggtgctggtgtcgcacctttcttagttgtagtagcctcttatatacatataaaaacaaaacagcctactccaactatttggttccatcaattattcactgacgttaacttatatactactttagttataggattccccttatatggagtagtggttgcatatttgcttacccgcgaatatgcagaagatacactgaaaaatttactaactatccccgtgtcgcgcattagctttattataagtaaattcatcattctctttctttggattatgatgctaactttagtcgcttgggcacttactttaatattagggctattggggaacttccctggctttaacatttctttacttttaggttctttcctagaatttttaatatgtggtggacttctctttctattgtcttcacctattgtgctactaactcttgtaatgaagagctatgtaccgcccattatattaacagtcattattacaatgactaatcttatgctcgtaaactccaagcataaagatttatttccgtggaccgctactctagatatcgcaaataacgaattacaaccgacatatccaccagagtattcttatatcatcattgcagtaacgacaatttccggatttattgcaacactattctattttaaaaaagtagacattcattaatttgtaggagtgaaactatgagcgatatcattattgccttcatactcggtattgtagaaggattagctgaatttttacctatatcctctactggccatcttatattagtcgggcatttattaggctttgagggagaaagagcgaaaacgtttgaaattgttattcagctaggcgcaattttagccattgcaattttatatcataaacgtctcgtttctttatgtaatattaagccacttctacagaaagaaaaaaaattcaacgcgttccatgtatttcttggcgtatttccggcagtggttgctggtttgctactacatgatattattaaaacatacttattccagccatacactgttgtgattggacttgtagcaggtgcaattcttatgctctttgcagaagtaaaaaagaaggaggcagcagcctattcactggacgatttaacataccgccaagctttaacaatcggattatttcagtgcttagcagtataccctggcttctctagagctggctctactatctctggaggtctattagcaaaagtaaattataagactgcatctgaattctcttttctaatagctcttcctgtaatgattggggctacaggcttagacttactaaaaagttggaagtatttaagtgtcgatgacatccctatgtttgcggtaggattcattacctcttttatagtagcgatgctagcggtagtaacttttctaaagcttttagagaagataggtttaaaaccttttgcgtactatcgtattttgttggctatcttatttacgcttttcgtattgctatagattcatataagtcacatattattaaactgatattcaatttagaatatcagttttttcatctattttaactctagtattactcacttcaatatggcatagtgataataaactaccattcataatctgaacgttctttaagtaactacatcctttatcataaaatgcaattggaaaattaaagatcccatatatgtacagaacatatttacaaactatattcactccacatagtatctttttaatttgcaacacaccgctacaacttttaaatgagtacaaagacatactaaataagtaagtaagtaaatttcctaggaattataaagagactaaatatgaattagagtgaggtaacgataaaaatgaatcaattagcacagacatattgggatacttattggggaaacaacaaaaaaccagaatctgttacagcttggcaatttggggatgcccctaattatcttgcacaactagtaattgacggtattaaaaccgctacatgctccggtcacattttttatgaattagaacatgaatcactaccgactactattgattatagtattatactcaatagtaatgatgaacctgtagctattattaagacaatagaagtaactgtaacaccaatgaatgaagtaagcgaagaattcgctatcgctgaaggcgaaggagatcgtacttataattactggagagacacccatgttcgtttttttacaaaggaactaaatgagcttggtcttaatttctctgaagatatgttactcgtctgtgagcgttttgaacttgttgatgtgaacaataaagtgaaattttaataaactgagatttaccagccattcttatttttataaaacacaaaaaagacgagtcattctgactcgtcttaaagttgcttggcgacgtcctactctcacagggacaaggtcccaactaccatgggcgctagagagcttaacttccgtgttcggtatgggaacgggtgtgacctctctgccatcatcaccaaactattgaaggcatattccttcaaaactagataacatttgctacatattatatggttaagtcctcgatctattagtattcgtcagctccacatgtcaccatgcttccacctcgaacctatcaacctgatcatctttcagggatcttactagcttacgctatgggaaatctcatcttgaggggggctttatgcttagatgcttttagcacttatacctttcgcacatagctacccagctatgcccttgg

SEQ ID NO: 1227 - DNA, 10663 bp, Bacillus thuringiensis
  unsure (1)...(10663): unsure at all n locations
aatcgtttcaaattcataaacagtcagctgatgattagcgaaataaataccgctccattttttaacttgcccttcataacgcttgtaaatgggtgattatttttgcatagtattcctatacgatctcctctttgcgcaccattatataacaaataatgtgcaaactgatttactcgttcattatattgctgaaacgaatatcttttcttcccccctacaagcgcttccaaatttggtgattgcattgctctcttttgtaataattgtcgcatcgttctcaagtaaaactcccctttatatatgttaggttttttattttaccagattaactattaatttactaaagattacacttagtgaatataaaaagaatataaaatatccatttactttacaagtaaatggatatttcccattatatattagaatacttcttgttcatcacatattgcacatactcaggtgcacttttatcaatctcttcatcacttagtttatattctgcaccatataaataaaaggaaggtataaattccatacctgtgtataagcatgtagcttggaatggtttcgtcaactcatccattgtaattccactattttcatagtctttttctaatccacctatagaaatagccacaccaaattctttccccttcactttatctcctttagatccgtacgcaaatccatatgttaatacatcatcgaaccatttttttaataatggtggtgaactgtaccagtaaagcggaaattgaaatatatatctgtcatgttctactaataacttttgctcttcttcaatatcaaactcccaattcggtgccactttatacaattcatgcaccgtaatttcatccgaatatttctcaagttcttcaatccatcttttattaatttttgatttttcaatatcaggatgtgctacaattacaagtgttttcatcttttttcatcccctttataaattattcaaccctttacgtattagtatgaatgagtcacatataattgaaaagtacgtactttaaagtgctataggaaccttaaagtacctgtggaggtgttatatgaatcaaaatgataattgcccaattgcaacaacactcgatgtaatcggtggaaaatggaaagttcatattttatgtattttgtcggatggaaaaatgcgaacaaatgaaattaaacgagaaatcccaaacattacacaaaaggttcttacacaacaacttcggcaacttgaagctgatgggattatctatcgtaccgtatatcaagaagttccaccaaaggttgagtacacactaagtgaatatggaaaatctttaatgcaaataatggataatctgtttgaatggggaaaagatcatcagattaaaagattacatgactaaaaaagcactatatactttgtttaatcctctacgttcatattttttatttctataaagtttattttcatcattttttagctaacttgttttcttagattgatggacgtgaccccacatccatcaatctaaaaagatacaattagaaaaatgagatttctataaagtttcacatataaacactacttccgcctcattaaacgctcgctctactttttctaatctcaattgtacgtaagctataaagaagcacccctaaaccgagaattttttcattattagacgcattagaacctaaggtaatagtaggtacatttaaacccataaacctttcactccgttctataggcatataaaaagatactccttaaaaataaagaacgctattctctctgtaaaatcatataaaacaatagcgctttttattttgaaatagaaatcatcatttaaactaaacatgctaatattgattttgtgcgattgtcagttacctcataataaatttctaatcctttccgagtacctgtaaccattttagcagcttttagtttagataaatgttgactaattgtactttgaggcatttgtaaatctccatacattgttgttacattagtaggaccttttgcaagcattatttttactaaagatagacgaactggatgcgccaatacctttaacacctcagcgatttcttgaaacatttcttttttttctttcatcttatttctccccttttatatacaattttatgttatccatatatantaatcggaggtatatgctgtttttgtggtccgtcattttaaaaaaatataaaaaaactttaatccgaaactaaaggattagcttaacataatgtctcaccattaatgatgaataggaatctcattatagagcagcagtttttatactacaactctacattcaactaactaaaaccaatgaaaaaaagagcagatagtctgctcttttatgatgcctccttatgttccgtggaatgtttaacactccccagtctctttagtttattccaccctaccgctactcctcgaagcgatgagaatatagatttaatgacaacataagtcataaattggcgataaataaaacgttgtaaaattaaccatgccaatggttttgggttctcttcctctaatttaaatgcgaacagagaagcgagaagatccattaaaaagaaaacaagataaaatcctaaaacttttagcggattactactaaatagtcctataatcattaatatatctgcaaaaggagcaatgaattgcagcacatattggaataaccacatattaggcagtgcaataaatcctaatgttttatgctttggattacataacgcttttcgatgtttccaaagacattgaagtgtaccatatgaccaacgataccgctgtttaatgagacttttcacatcttcaggtgattccgtaaaagcatgcgctttttcttcatatacaattctatgcccttgacgtaaaaatgtaatagtaagatccgtatcttctgctaacgtatcttcgcttaaatatccagattcaactacattctttttgcgccacgccccaatagctcctggaactactgtaatacaatttaactcatcaaaagctctacgttctaaattaaaccctgtaatgtactcaacatgttgccaagtagttaacaaattccgtctattccccactttgacattacctgaaactgcagctacattctgatcttcaaagtgtctaaccattagagaaatggcgtcttgcgcaataatagtatccgcatctaaagtgacaatgatttctcctcgcgattgttgaaaccctaggttcattgccgatgatttcccgccgttttctttctgaatgaaacgaactttagggtgtttataaaatgtttctttcattacttttgacgtaccatctgtcgatccgtcatccacaacaataacttcaaattctctataattactatccaaaattgagtgaattgtcttggctatcaccttttcttcattatatgctgccatgacaacactaacaaaaggttgataggacgaattaatatagcgagataacgtttttcttttctgcttccatgcaaaataaattaagaataaaaatcgaaaaatccctaatccaatagcaatataaaaaatagttgttaatatatgcttaaagtatcctgcccctgaaaagacagctttattgtaaagtaaatattgcttcccctcagaagaaacaggaggcatgatttcatctcgttctttattcattaaatctgaaattgttacaaaactatatccatgcttttttaggtctttaataatgattgggagcgcctctactgtatgtgtacggttccctcccgcatcatggagaagaataatatttccctctcccttataaatgggattaagagcacgctttactaattcatttgttgatggtattgcccagtcttcgggatcaactttttccgctaccattgtatagttcatattttgcgcacgtaaaataggcaatatttcatttgatgaatccgggttagcatccgcttcatatggcggtctaaataaaaccgtagaatgtccagttacttcctgaattaaacgttgcgtcgtattaagttctactttcgttcgtagtaaagacgtatctgctatgttaggatgcttgaaagtatgattgccaatttcatgcccttcatcgtatattctttttacaatactagtatttagttgcgcgttttcaccaagtacaaaaaaagcagcttttatttgattctcttttaatatatctaatatttctggcgtatatttcgggtctggtccatcatcaaatgttaatactacttgtttcccatttggttttccatatcgttgcacttcatatgcagatggtaaggattgatatacttcatctgtaatataatcatctttgcctactttaaaatctctcaatccattttttctttcattctcaatctgtaaaatttcaccttgtccagaataattcacttcatctaaactacggattttatgtaatacattaggatttttttgtacctcaataggattttttaaaactttccatattgtaggatcttctgctcctaatctccatagcgcaaacccctttgcatgattgtccattgcgattttcacttgattataaagagtaacaccgtctaagaaccaagcagtatgttctttctctcctgttttatatctaaaatacggatttccactcaccttatcccattgaatttttatatttgaatcatgagccattgccataacttctgagaaagtcatagactttgcagcttctttactatttacttcccaatcatatccatagttaccgaaagcaactacaagtttatcagacggaatattcagttctttcaatgtatgttggaaccatttatttgaagcaattggtcctggttccccggctccatagtgctcatcgtacatcattacaatcattcgatctattatttttgctaacgcactataatcaaaagccttatcattagctggaacatcttgtgtaacgagcaaatcatgttcatgaaattccgtagtaagttctttcataaaatttgttaagttttctctatcactttcaggtacggcctcaaagtcaatattaatacctgaaaactgattttttttaacttggattactaaatcattaataaactttgtctttacatcgtttgaggaactcagtaacttatgaattagcccactatcaggaccagaagcttcctcagtatagttagtaagcaaaggcataatcttcacttgatttttttctgccaactttactatctcaggttttatctcacttctaatcgttaaatctgcttttaaatgataccactctggtactaacgtagttaatgaatcgatattttcttttaaagaagcggtactattttcatcccagtttacataaaaaccatacacttctttaggatgtttactatccttcggcggattcaccaaatttttattatccttcgtttcggtatttgggttaaatgcttcctcctttaactgctgatcactaagtttttgattaattggtacaagtttagtatcttgttgtacagcggtattcatatttggaatttctggtgttgaaaaaatactttgaaagaaaaaataaaatacaacacttacactaactattgagatacatagaaaccaaataaaggctatgtttctccttcctttcggatcataaaaaacaggtttttctttatctttctcttgttgaatgtttttctccattatatttttcacatactccttcttaatagaactatagaatattaaagtgcaactttaatcagtgggggttttgttcacccccccactaatcatcagccctcaccaatcgggctgcccagcaaatagcggaataaatccttttagctttgaagtgaatctctcacttccatattctattgattcttcttttcattcccttgctggtggcccctattttcttgttgagaccccctaccattgttcccttgctcgtttccgtcattttctttctgggatcctcttccattgttcccttgcccatttccattattcccttgttgagatcctcttccattgttcccttgctgattcccattatttccttgttgaggatttcttccattgttcccttgcccatttccattattcccttgttgagaccctcttccattgttctcttgctcatttccattatttccttgttgagatcctcttccattgttcccttgctcgtttccattatttccttgttgagatcctcttccattgttcccttgctcgtttccgttatttccctgttgagatcctcttccgttgttctctttcctatttccattatttccctgttgagatcctcttccgttgttccctttcccatttccattattcccttgttgagatcctcttccgttgttcccttgctgattcccattatttccttgttgagcttctctactgttattctcctgttgattccctctattttcttgctgagatcctcttccattgttttcttttatttgcttcgatggctgttcctctgttttcttttgttctttctgctcttgcttttcatattttttttcttttacaggagacaaatcgagtgttgcatcaggagatgactccgggtgtgattgcacctcttcttcgttttccaccggattagacggggtgacaggaggcgtaagtgatttgttcttctcattctcttgctttatataaacacctgtgccaattccagcttttctagcattctctcgtatttgcattgtgctactttgatattcaactgtaatatgttttagctcatattctttctttaattctttcattgccttttccaaaagtggttctagtgccttgtcctttgcaacagctgttagcataacttgcttatcattcgttaaatacttatcctcttgactttgctttataatagtacgtattacttcttgtaattgtttatttttccattgcttcaattcttttaaaatacgccttccatcatcattacaagcctgcaaatctataacacgaaaatcctttgttacgctcacctctaaacttggatttatatcaactgagacgtaagcaaatactttttcttctggttggttgtagaaaaacagcactgcaaatagaaaacaagcaacaagtattgatgcaggctttaaaaaggaaggaatcgaaaaatgcgatgctttttgttcttgctcatcaaacgagatttcctccccgattatgcaagaatcccctcttcttttacacgtaataaactctccatttggtgttaaaacaactacgctatgcttttttatatccatcacaattcctttattcatcatgcttttcccctcttatgtaatccagaatatatgtatagttgtttgcaaaaataatacacattgcaataatgtattttctatgtcgttccaacgttttacgacttaccctaacacgcggttcaatctgtttaagcggtaactttttctttcggaacagctcttccatcatttcctcttcttttataattattttcacaatttctattaagtgctcacgtgtatcacgatgcttaggagattctttagcaagctctgagaatgtgattttaaactcagctagcacactttgaaaatgaagaatttcctccttacggttactattttccatctctttcatatactccgtaagcgacacttgcatttctaacatttcctcttgctcatcttcttttaaaaagacaaagttatgtttagactccttacgtatatagtcaattacatctctttttataagaagatcagcaaacgctaaaaaggattttccttttgtataggaatactgttcaattgcttcgttaaaagcaaacaatccaatgctatattcatcatcctgttctgtaatatatcgacggcagacagatgagattgattttctaataaaaggctgatactgtacgataaacgcttctttgtcttcttcgttgttttgtatgttatatacgatatcttctattttcggttttcttaagatcttcattactaaactcaacacttgtaatctcccagcctccttcaaatagcaaaatggccactacacaagtgaccatttaaccagattttcttggtacttttcttcggtcttgttttcttgctgttagttatatttttcgagtctaacttttcccaacgttttcttaataattttccttttctctcggcactaaagttaagtttgtatttttatctactttcttattttctaccgttcgttttgcttattctctttctattttatctgcaatccttgaataactcttctctatataattggtaatttcatccttccattttggatgccacttaatctagtaattttattaatacttctatattctttcatagtcatttttcttctatttatttttttcactatacatattcggaggagtacaaagttttatgggggtcaaaaaatattttcataaaaaaatacatatttatttcaaaaataaaaaccatcaatttgaaaaagggtaatcaaattgatggttttcttataatatctattaaattaagttggattctcattatatctaaaaaagcactaactattttctaccggttttctccatttttatctttcttggttatcataatatgtcttatctgcgtattttctatcatttccttttagataagctaaaattacttttggatttttaagtaaagtccagtctccatatgtatcaaatcttctgcatgaagtcatcattccatttttaattgtaccgaatttcttattatttcgctttccccatttttttaaccgtttggcaaaatcagcatcttctgccataagcatgttttcattaaatccgttgattgccataaagtcttttctatagcaccaaaaaatccctacagatatagctccatacttaaaaagtaagggaattattattaacattgcggaaacgaatattcctaaggacattctttcaaactttccagttaccccaccaccaatgtatttgcctgaagctagatgtttatctacattagacaacatagactctgtcatttgggtatcagcgtctatagtaatgattatttctccactagctatttgggctcctgcatttcggattttggataagtttttatcgttattttttaatgtaatacagttataagactttgctatttcctctgttttatctgtgcaacgatttaaaacaactataacttccgtttgctctttatatgcctctgatgcctttgcaattgaatctaaacattttctaatgtacttttcttcattgtgtgcaggaattataatagaaaacttcacatcttttttcaaattgactcctgaagattcgtttgtctcagtcataatatgccccccttattttataaggtaaatatctgttatacataacgtatattaaaattcaataaattatatgataggaactgcaggtaaactattacttgagtattaaaaaataaaaacgttattctttctaaataagcaaaattactagaaagaataacgttttttattagttacattaatattttattcgttgctttatttcttcaaaacgagcatgtataatttttctgatatctggatgattcttatataaagtaacagtatacatgatggaagatgcaagaatagtagaccatattaaccaatctccagcatgagaaagaactttaattatttcactcgtaaattcttcctgtccgtcatgaaatgtatagctgagtagttaccttatttttaaaaaaacattctgattatttctttttcacttcttctacaaattcccatgtctctccgttatcttttgattgataaagtgcactactatcgccattgtagtctccatctgccccttgtccaactaacatattaaaaaccccatctttctcatatggcatactaggagaatcaaaaggacttattgtggactgtgtatgatctaatttcacttcatgcggcggatattctacctttttgaaagatactcccccatcatctgtgcgatataactctccttcattaccagaaggcctaattgctcctaaaaacccaagtttatcatttataaaaatgattcctgatacactaccaatccccccattaaatgggtctggattgataacctcccatgttttcccttcatcactagtcttgcttaatgaataaaaagcgctccctaatgctttatctgtcatatttagtttataaccaacttctttcgataggaaaaactgttctttttcattctttaaatcttgttgttccttctctttaagcatatcttcttttggaggcgtctttgatttactccaacttgcgtcacttattaaattatatctagcagggactagctctttctcttttccagggacaaatatagatacagtatatccaatgatatcagaagctgcttctttaacactctgcctcttaccatcctcagtaatattaataattccctctgtattggatccccaatttcttttttgcataataaatcaacccatacttactttcattccattttttgaccgtttgcttaactgggatcgccttaaccgctttaattaaaggttctactaatttatcatcattataatcaggctttgcatattcctctcggatt

SEQ ID NO: 1228 - DNA, 9523 bp, Bacillus thuringiensis
tcccaaagttatataaggtcattctttcctttacgtgaaatttcatggatatactattgcaattctcttcaccgtttgatagaatatcacttgttctatgtaagaatcgagtcattcgattgcaccagggaggtgaaaagtatggcaaacatcaaatctgctatcaaacgcgctaaacttagcgaagagcgtcgtgcacataacgcttctatcaagtctgacatgcgttctgctgttaaaactgtagaagctttagttactaataacgatcttgaaaatgctaaagaagctttcaaaactgcttctaaaaaacttgacaaagcagctcgtaaaggtcttatccaccaaaacgctgcagctcgtcaaaaatctcgcttagcgaaacaagtaaacgcgtaaggcgtttaaaaaacgatccatttggatcgtttttttatatacaaaaaagttcatgcactaagtgcatgaacttttttgtgtcatcacatatgatttaatcgcattaagaaaaattcgagcacaagcttcttatccatctttcccgtcttcatactataatcagcttccgctaattctataatcactttttttaattcttcaaaagagaaaaacttcgtttgattcattgctaactttacacgatacggatgtacaccaatatgagacgcaatttgattttgtccataaccacgttgctgtagctctttcacttgatacaacaagcggaattgactcactaataacgcaagcaatttaatcggctcttcctgctgcgtaaataatccatccaaaatttgcattgcacctgcaatatcttttttcaccactttttctgtcaaagcaaatacattttgctcaactgattttggcacaagctctgcaacaagtttcgtcgtaatctctccgcccataccaacgtataacgttaacttgtccatttccttcgccaacatcgttacattacttcccacaagctctagcaacaaactaacagccgcgttatcaatatgcacatgcacttcatctgcacgagcaacaatccacttctgaacatcctgtacttgcatcgcattcgcttctactacatctgctgttttctttaatagttttgtaattttttttcgctcatcaagtttttcgtaaggcgcaacaaaaacaagaatagaaaatggagaaggttcaccaatgtattcttctaaaatttttatattttgctctaacttttctttttgcgaagtcaaaaatagcggtgattttattaacagtactttccgttctccgaagaaaggaagcgtacgcgcatcctcaaccacatcttctaaatacgcttcttctaaatcgtatgtcacaacattaaactctcgatcttcttcttcaagtgcttctgtcgtaataagctttatcgtttcatttataaaaaaagcttccgttccatatattaaatataacggagcaaactgtttctttttaatttttttatgtatatcactcatactttttcctactccctaacttggcaatatatatttatactaatgccctagcttttgttttacaagtacaaaggaacaggctttataacccgtccctttatttatattaaacgccacgcaataagccccgggtttcttattggtgtgcggtaatcaccttccctttattattcgcaataaaaatttgagtataagtgccaactgttaacatgcttggaaacgaaaaactcacattacttcatgatttacaagtaacaaaaaagctcgttttctcttcatatggaaattgtagatttttttctgacaatattttatactaaagtggaatgttggggagggattctaaatgaatgattttgaacaaaacgttcaaagtaaacgcaatgacgctattgattcaggggtaggatttatcgtctcatttggttttttcgcaacacttttcatcattgctactgttattaaatttatcggttcttaaagactgccacttcatggcagtcttctctttttcatctattatgtgttttatcatatgtgattttacttttaaaggttccattttcccctttaaaaacataggaaatagcaccttgcttgtccgtgcgccatatcgcactccccatcttctcaaaacgctctatcacttctttatgcgggtgtccatacctattctgcttaccaacagatataatcgctacacgaggctgtatgacgttcaaaaaaggctctatagatgacgtattactcccatgatgagcaacttttaaaacatccacttgtaaatctggatatgcctctactaaaatcttttccccttcttcttccaaatcgcctgtaaatagccacttcaaccctccaaattttgcccatattacaattgaagcgttattttcgcttttttcttttccttttggagctaaaacgaaaaattccgcttcatttacactccaactctccccttcccccacttcagttattttcatttccttttctaatgcctgtttctttactactttttctaatactgcatcttttccctttcggccaaataccacttcttttacaggtatatatgataataattcttgcgcagcacctatatgatctgcatctccatgcgttacgattaatttatcaattgttttaataccttctttttgtaaaaagggtattaaaacatcctttccaacagaaaattcatgctttttttgttgccattcttccttattcacacgaagcgttccacctgtatcaataagataaatccctttatcatacggaaggcgaattaatattgcatcaccttgtccaacatcaataaatgttacacttccgccgcctctaaaatatggatatatataatgacatgtgctaataaaaagaaatacactcgcaactatacaaactatttttttcggcgctctccgttcccaaaccatcaatatgctgacaatactggcgcaatatacagctacaagattgaagggcgtttccccgaagataagctgggtaaatggtaaactttcacaataacttagaaaatcattagacatactcaagcctattgataatacatcggcaaatccttttgcgagaaacgggacaattggcatacacagtaaaataataatgctacatggtaatacaatgatagataaaaacggaacgtataagagattgaggagaatgctatatggagaaaaataaccaaagtggtataacaaaatcggagtactaacgagctgtgaaatgatagaaatataaatagaatttcggattactccgttgctactctctaacaataacggagcagacaaaagtaaagcgaagctacctacaaaagaaaactgaaatccaatattaaaaacaagataagggtcatatataagcatgcatatagctgttacacttaaagcatctaaactagataaacgaatcgagcacataaaagcaattaacatcaaaactcctgttatagaagctcttataacagagggtgacgcccctgctaaaaccatatacaaaggaatacaaacgataaggcaaattgttgctacctcccttgtcacaccgcttcttagcaaaataaaatatactatcaccattaacagtacaatgtgcgaacctgaaattgctaacaaatgtacaagaccaaattgttgatattgctcttccacttcaaacgtcatttgttgtctatcaccaaatagtaatgcattcataaaagcacctgattgctctggaaacatttctgtaactttcgagattacttgttgcctcaaaagaagaatccattgcgtgagcgacagtgatgttttatagcattcagaaatatatgtagcctcaaatgtgaaatgaatatgttgtttgtataaataatcacggtaattaaaaccatgaaaattccgagctgtttccggttctttcctctcaccctcgaatacacatgatatccctgcgtataattgttgcatttttttcttttccaagactgatttgattctataacttaactgcactatatttttattctgatcttcaaattgaaaagataggcgatccccattaacaagcggtgcattttgtataacccctcttgtaactccataggactcccctagaggcttattccacgtttgaacataggaagtgtatatggcgctattaaagcacgctacaatacaaaaaatgaaggttttacgcgaagtgcgatataaacagaagaaaacatttaaaaagaggcaaaaaactatcaataaaagtgacgaggaaaaggcaattgcaacccctattataaatgagattgcaacatacccccattgttcctgcaacttatactcactccttatagcatcatttttgctttcgtgaatacatgctgtaattcttccattgataaattatctttttctaaagacgcaaataattctttcaactctgtataacgtttttgctcctctaatgcagcaatatcatattctagcggaacgtgcttcactgttacgttcgcttgttcaaataactctatggcgtatggatgatttttataatcctgcgcataataaaccgctgtaataccactttgaataattgccttacaacattgtaaacaagggaaatgcgtaacgtaaatttctgcttcctctgttttcgcaccaaacttggcacattgtaataaagcattcatttcggcatgaattgtccgaacacaatgattatcgattacgtaacaaccatcatctatacaatgtacgccacctttaattgaaccattatacccaccagcaataattcgtttatcgcgaacgattgtcgctcctaccgcaagccttgtacatgtactacgcaaagatagtagatggctttgcgtcataaaatattgatcccatgaaattcgttccatatttttcacctacttttttgtctacttgtagtgtagcgaaagaagaaaaacttcgtcaatcttttacggaataataatttgaccttttatcttttcaagagacttcgcaccaatcccatcaatctctaataaatcttctattttctgaaacggaccatgttcttctcgatatttcaaaatactttctgcctttcgagagccaatccctgtaattttttctagttgttctttcgccgctgtatttattcgaatcttgccatcttccttagaagaagtaagcaccccttgttctgactcatttttactcggtatataaagaagcatttgatcttgtacaatttgtgctaaatttacttttttcatatctacttctgataaaaaaccaccagccttttgaaccgcatcctttacgcgatctccttccttcatttcatataccccttctttactaaccgctcctttcacatcaattataattgttcttttctgttcctttgtatccgatattttcggtttaccctttttttctatctccttctcttgtacattcattgtaataggcgttcgttctacattctgattcgttttccaaaaaacaagaaaaagtaaagttccaataatagctactaaacctaaccactttttcggaaaatcccacatcattttacacctctaatcataaatttataacatcattcatattgtttaggagaaagctgttacgaaggagggatgaaactttgaacataggaattatagggacaggaaacatgggaaatatactaatcgatgcatttttagaaacccgtgctgtcaaaccttcttgccttacaatcattaatcggacgcccgcaaaagcatatcatataaaagaaaaatacccttctgttcagatagcaaaaacaatcccggaagtaatcgaacaatcacaacttatttttatttgtgttaagccgatagatatataccctatcctaaaaaaatacgctgaacatttttctgatgaaacgtgcttagtttctattacaagtccaatatctccatcacaattagagactctcgtaccttgccacgtcgcgcgtatcattccaagtatcacaaatcgcgctctctctggcgcctcactatttacatttggagataattgctctgaagaatggcaacaaaaactacttcgtctattcaaaaacatttctacacctcttgtaataaaagaagatataacgcgcgtttcatctgatatagcaagttgcggtcctgctttctttagttatttactacaatgcttcattaacgctgctgtagataaaacaaatattacacacgaagaggctactactttagtaagtgaaatggtcgtggggatggggaaattacttgaaaaagaaatcttcacattacctaccttacaagaaaaggtttgcgtgaaaggcggcgttactggggaaggcattcgggttttagaagaacacgttggagatatgttccataagttaatcgagcgaacacatgaaaaatttgatgaagatttagaatgcgttgatcagcaattcaataaacacacataataaatacgtcattttcattccaaatcctttttataaatacttacttttttacaatacattttcacttcaactactattcccacactttacgcatacgatctttagattatgctagaactaaaaatacatcttctttataaaacaaaagcaaccttctcggttgcttttgtttttatccgtttttcttcgccatgaagaaaatacgctctgtttgttctgtaacttcaagtcgctcaaaatcacctgttacacgaagcactgtaaaacctgcttcttcaagccatttcgttaactcttccacttgatatgcacgttgcacgtgacattcgtcaaaccgatggtacacatcttcttctggatcttgaacaaagaatgttaaatcatgctctacactatttgattcttcaccagggaagcaattccaaataagagatatttcttctccattcactgtatacgtttcattttgaaatacatgatgtattttatataaagagtgtacatcaaataaaaacaaaccatcttgacgtaaatggtgaaatactcttctaaatgtttcttgtactccatcttcttgcaatacataatttaatgaatcacaaaaaatcgttacacagtcaaactcacccggaacatcaagctcgcgcatatcttgttggtaaaaaggaataaaatgcccttctccgcctagtttttgctgagcgactgttaacatttcttctgaaagatcgacacctattaaatcgtaacccttttgcacaagcggcagggttacattacctgtaccgcatgctacatcaagaatttttgcctctttcatacctgcctgctgtaaacttccctctgtaaattccacccatttatcataagggacatcattcattagttcgtcgtacaacaatgcaaattgttcgtatttcattggcctaactcttctgtaatatcttcacgtggcacatcaccccatagacgctctaaattatagtgattacgctcatctttatggaatacatgagcaactacatctccaagatcaactaatacccaacgtgcttcgtcaaacccttccatacgttgtacgtcgatttggaactcatgtgcttttgatttaatttcacgtgcaattgcttgcacttgtttatctgaatttccgtgacaaataatgaaataatctgcaattggtgaaataccttgcatatttaggccttccatatcttctgctctcttatcatcagctgcttttgccgctaatactaataattctttatcgttcatttactcatttcctccttgataactgcattgtatgtttggaatgttaatggataaatcgtctgatctttttccattaaaaattgaattgttctctttaacgcaaataatagggcttgatttatatccgtatatgcgagtttacgagcctcttccacttctggaaactttcgcccaggttcaatgtaatcagctacataaatcactttatctaacatcgtcatattctcatgaccacttgtatgatatgtaatagcttgcaaaatttcagaatccgtaatgcctacttctttttctactaagtatgccccaacaggtgcatgccataactctttgttatagcaaagtaaatctttcggcaaatcttcacgtttaataatctcttccatttctgaaattgctctacatttcgcataatcatggaatatagctgccatctctgcttttttctcgtccacaccgtataacttagcaagctcaatcgctgtctccattacaccaattgtgtgtatataacgtttttcatgcatttgttgtttgacaatatgcagtgcattctcacgattcatacaacccattcctctcgatatatacctgtactttttcaggaagtaaatatttacacgttttcttctctttatatctctcacgtaataaggatgaagaaactgcaaattccggaatttccactgtagtaatcttatatggtgtatgcaatgtatacccaggtcttgcaactccaacaaacgttacaagattaagtaaagcttcaatgttataccacttcggtaaatattcaaccatatccccaccaataataaagtgaaactgcacatccggatacttcttcgtcaattgtaacatagtgtcatacgtataagatgggcccttcctacttagctcttctaaacaaatagaaaagtgttcttctgcctcagtcgcgagctctaacatatgtaaacgactttctacacttgtaatattccgcccttgtttatgtggcggaatctggtttggcaagaaccatacttcttccaagttcaaagcgtgatatacttcatttgcaattagcaaatgtccatagtgaggcggatcaaatgtaccgccaatgatgccaattttcctcaaaagaaacgccccttccttttatatacagcaactctcctcggttaggaatgaagagagttgctattaataaaagttcaattggtttcgctctctacatcattacgcatcagcgataaaaatagcgcatgctaatctttttatcgaggaagcttaatttgtttattttctcttgattctttgtataaaacgattgtgcttccaattacttgaacgatttcagcacgtgcaccttttgcaagttcttccgcaacctcacggcgatcaaattcacagttttgtaatacacttactttaaataactcacgagcttctaaagtatctgcaatttgtttaatcatattttcatttactccgccttttcctacttgaaaaattggtgttaaatgatgtgcttgtgcacgtaaaaatcttttttgttttcctgttaacatatatgttagccaccaagcttttctataactaattgtttcattctctccatatttggggtgcgtcctgtccacatttcaaaggcgagtgctccttgataaacaaacatatcaataccattttgaatgattgcaccttacttcttttgccttacataaaaatttccgattaaaatggatttataattttattctgatacaaatcgtcctttttttaaacaaccaatt

SEQ ID NO: 1229 - DNA, 7199 bp, Bacillus thuringiensis
ggagaatgtgaaatgaaaaataaatacgtagtagctatttctttcatgattttagcgattatttctttaacgatacatgcttcaaacagtaaagtaggagcggatggatttcttgaagaacctttctttttcctagtaccgataagttatatattgttccttagtggtattggtatattgctatttggatttattacttcaaagctgaaaaagggcaatagatagggacaaaacactcactatgaaatagaaacataccatatggaagaaaaagaataagtgagatgaatcatgatgaatcattatttttataatggtagacaagtaggagctgctattacgctggctggggcacaagggacaattcatgctgtgaatcaagctattcaaatgcagcaacaagcatattttgcacaaatgatgcaaattcagtatatgccgtattcacaacttccgatgcaaattatacattacgatgtacatccagctggtttattttccattccatatggcgggacatatttcttatgaaagaaagcgactcaatagagtcgcttttttatattccgcctaacttcattccaaggaaggcaaaggcgataccaattatgtaagtagcacttaaatataaaaggaagatgtatagttttttacgattgagaagctgaacagattctaatttaaacgtagaaaatgtagtgaatgcgcccataaatccagtacctaataatagttgccagcctgtagtgactccgttgccaattatatacccaagtaaaaatgcccctgttatattaataaggaatgtagcaattggaaattgtgttttatttcttttcttaaaccaattgctaattgcaaatcgtgtaatcgcaccgaaaaatcctcctgttgcgactaataaagcttctatcatgagtaatcaccttctgtaagagatttcttaattaagaaatctccaagtgtatagccaaggccagacataatgaggccaccaagtatgctgcatgatacatataagaaggctatgctccactcagaatgattgatcaattgcacagtttctacactaaatgttgaaaaagtcgtaaaggaaccgatgaatccagttccgatgcctgtgataacctctgaaggtaagatgtttagccgagcgatataagtagttagccacgctaagaaaaagcaaccgattaagttaatgagtaatgttgccaatggaaatgaatgatgccaaaatgtgttgatattaagacctaaataataacgagaaagagctcctaatataccagcaatgccaacgataatataaatcaattttctcacctctttaaatagcttgctcaaaaaaatagactcctaccagtatccatactggtaggagtcattagctaagcagcgtttatggcgaactccatcgcctatgattattacatatagtgtactaaatataccgattaattttcagtgaggaggagggtgtaactttttctttttttgatgtctgaaggctttttaagtaattaaaatgggatcgattacttatcaactaaatatagtgatatacggttttaattatgataaaatgtttcttatgtgtgtcgttttgttttatttgactgaaaataaagaaaaataaatttgcgtgaaaaggagtcatttatttgaagaaatttttaaaaatcgtatttacatgtgttttagtagtagcgggcattgtaggaggatttctagcttatatgacacttactaaagaacagcctgctgatgttataagcttgaaggtagagaataataaggagcgcgtattagcgactggaaatgagtttaaagttacaacatttaatattggatatgctgggttagataaggatcaagatttctttatggatggtggaaagggatctggttcaagtagtaaagagcaaacggaaactaatttaaagaatatgctttcgtttttacaaaatgagaatagtgattttgcactattacaagaagttgatataaagtcacttcgttcatttgatgtaaatgaacatgaatttttgaaaaaaggattacctgattatgtttcgtcatttggcaagaactacgatacgaaatgggttccagtgccaataacaaatccaatgggatatgcggaggctggattaagtacgttttctaaatacactgttcaagaagcgaagaggttccagctgcctggaatggagccttggccaaagcgtttgtttgatttagatcgagcaattgtggaatataaaattcctgttaataatggaaaacatgttagactcgtaaatttacatttgtctgcttatgatgaaggcgggaaaattagaaaacagcaagtagagtatttaaaagaatatatgaacaagcattatgaaaatggtgattacgtaataatgggtggagattggaatcaattggtttcgaacgctcaattaagtgatccgaagttcgtgaaagagcgtcctgagtggttagtagagttaccgaaggactttacagacggtggctttaaatgggctgtagatccgtctgttatgactgtaagagatgatgtaaagaaatatgtagaaggtgaaaatttcgtcactattattgatggctttatcgtttcaccgaatgtagagattgtaaatgtacaagggaaagatttaaagtttgaaaatagcgatcataacccagtaagtgcggtatttaaactgaagtaattgatatgtataagtagaaggtggggcttcatatggagtggttaaagaggacttgtttttctaaccttgagaaagaatcacagaaaaatcatttattactgtttataacgatttgtagtttcttccttgggataatcgcaattgggtattatggatatatttttacagagagagccatagcattttggatttgtggtatttctgtcgttgcatttggaacgctttttacttttataaaaagtatggaatcagcgtataaatatatcatgacatttatgttgcttacaatgtcttacattatggtacaagcttttaatgaaagcccggctgtatttcaaatggtctattttacattagctgtttcacttatttatttaagcgagcgcctcattttaattattggcggggtagctgttgtgatcacatttatcctttgtagctattggccggagcaattttttgcttatacagcctcatctgaagctgctaatttcgcaagtttgttagcgattgtaacaatcgctatgtggggcgtcacgaaaatcggttctaatctgctccttcgtttaagtgatgagaagcaagaagtaatgagaaaagctcaggagttagaagagacgcaaagacttattgaagaaacagttgtgaaactagatagtaatttcaatcatttaagacaaaatatgaacacgtcgatggaatcgatgagtgaaattaattttgcctttgaagaggtggcagttggtacgcaatcacaatcagagatgatgtatcgttcggtagaagtattgaatgatatggagggaaatattgagcaaatcatctctcaagtaagaactgcatcggctcatgtggatgaaagcttagaaatttcaaaaggtagtgtacatactctaagaaattttgaaactaacatgagaagtttaaatgatgttgtttcacagtctggaattatatttagagatttaatgatgcaatcgaaacaaattaatgaaattgtagatgtaataacgaatatttcaagtcagacgagtttgctagctttaaatgcaaatattgaagctgcgagggcaggcgagcatggaaaaggttttgctattgtagcgagtgaagtgttaaagcttgctgaagaatcaaatcgttctgcgggaagaattcaagggattttgaaggagtttagtaatcaagcaagtaaggtagaagtgcaagtagagaagtcagaaagagtacaagaagaatgtaacgagatgttagcaagtgttttaacaaatgtaactgatttagggaagtttattgatgcgattaataaagtaatgcgagaggttgttgttcatcaagaaagtttccaagttaaaacgacgaatattgtaaaggatgttacgcatgcttctaacgtaattcagcaaacttctacagctacagaagaagtgctagcgagtgtggaagaagaaaaacatcgaaatgatacgtcagtgaagacgttacaaactgttagcgagcaagtgaagttgttagaagatattttagaaaagtaatattgcttagaaagagcacgagtgatgtgctcttttttcattgaaacgaatacttgataggaatttaattgcttttctgcgcgttttctgccaagcttaaggagataaagtgagactagtacatactgattattagccctcaccaatcaagctatccgcaaatagcggaataaaatacttcaaagaaagaattatataggtgacgcatatgatcgaagttaagacttctgaacttagtgatggagaatttaatagaggtgtatttgcaactcgtgatattaaaaagggtgagttgatacacgcagcaccagttatctcttatccgaatgaacagcatgaacatattgagaaaacgttacttgctgattacgcatttgagtatggaatcaatcatacggcaatccttttaggatatggtatgttatttaatcattcatatacaccgaatgcaacgtatgacatcgtttttgagaatcatacatttaacttctatgcttataaagatataaaagcaggagaagaaattttaatcaattataatggtgaagttgataacgatgagctgttatggtttgataaagaaaaagaagagaacgaaaagtaatataaagagtatagaaagagcacattctgtgggatgtgctcttttttattgatgtaaataaagtaaaaagtacaaaaaaataccactttctttttgtgtggtatagtaagatactgagggatagtgttttgaaaaagtcatatattttacaaattgttgtctttctgatgacatgtcaagtttagtagtccatttgggttgctttattatgcaatatatattttaatatgagtggcacctcttataaattaagaggtttataggtgtctcgaattgattttgggtacactgtatccaccactttaggttttttcatgtacgtggggatattatgggcccgtataacgggataaaatgaatatagaaatagaggaatcgtaaaatgaatatgcaagaggtttataaatatttaagtacggtattgcctgaaggacatgttaaacaagatgaaatgttaaagaatcatacgcatattaaagttggcggaaaagcagatgtttttgttgcgcctacaaattatgatgaaattcaagaagttattaaatatgcgaacgaatataatattccagttacgtttttaggaaatggatcgaatgtcattattaaagatggtggaattcgcgggattacagtaagtttaattcatattacaggtgttactgtaacaggaacgacgattgtagcacagtgtggtgcagcaattattgacgtatcacgtattgccttagaccataacttaacgggtcttgagtttgcttgtggtattccaggttcagttggcggagcattatatatgaatgctggtgcatacggcggtgaaatttcgtttgtattaacagaagctgtcgtaatgacaggtgatggagagctacgtactttgacgaaagaagcatttgaatttggatatcgtaagagtgtatttgcgaacaaccattacattattcttgaagcgagatttgaacttgaagaaggtgtacatgaagaaattaaagccaaaatggatgatttaacgtttaaacgtgagtcaaaacagcctctagaatatccttcatgtggtagcgtatttaagcgcccaccaaataactttgctggtaagttaattcaagactcaggactacaaggtaagcgaattggtggagtagaagtttctttaaaacacgctggatttatggtgaatgttgataacggaacagcacaagattacatcgatttaattcacttcgtacaaaagacagttgaagagaaatttggcgtgaagttggagcgagaagtaaggattattggagaggataaagaataacgaaatacgtatgaagatatgaattattttaaaataacatttgggtattgttgacaatttgttttcaattcaatataatggctaataatttaacaagtaacatacgttgaaagagcccagtagcagtttgtcactgttaacgagagagctaggggttgctggaacctagcacaaacaaacttgcgaattacactctggagtatcttaggtaatgctaagcggactagcaatcgatattattgctaagagtggtatgagtagctatgctatttatgcaaactgggtggtaacacggtgaataatcgtccctatgtctatcgtagacataggggcttttttgtttttaaaaaataaaggggatgacaaaagatgaatattattgatgaattagaatggcgcggcgccgttaatcagcagactgacgaagaaggcttacgtaagctagtagaagagaaaaagatttcactatactgcggagttgatccaactggtgatagtatgcatatcggacatttgattccgtttatgatgatgaagagattccaattagctggccatcatcctgttattttaattggcggggcaacaggaacaattggtgatccgagtggacgacaatcagagcgtcagcttcaaacgttagaagtggttcagcataatgtagatgcgttaacagcacaaatgaaaaagctatttgattttggtggaaatagcgaagtgaagatggtaaataactatgattggacacatgaaataaatattattgagtttttacgtgattacgggaaaaactttagcatcaatagcatgttagcgaaggatattgtagcaagccgtttagatacaggtatttctttcacagaattcacgtaccaaattttgcaagcgatggacttccaccatttatacacgaaagaggatgttcaacttcaaattggtggcagtgaccaatggggaaatattacgagtggtttagatttaattcgtaagttagaaggtcatgaggcgaaagtattcggattaacgattccgttatt

SEQ ID NO: 1230 - DNA, 9008 bp, Bacillus thuringiensis
cctgatagcggacccagtcgaacccccccacggggagaaaacgaggggggcttatataacaagggcggcggacgaccagacaaccgcgggaatattagaagagcctttagaaaggtatggctatcaatcatttacagcaagtgatttacgtcaaataaaagatgagtttgtaaaagtgaatcctcatctcgtgttacttgatattaatttaccgtactttgacggtttttattggtgtcgtcaaattcgtactgtatcgaatgcaccaattatttttgtttctgcaagaacaggagaaatggatcaagtaatggcgattgaaaatggcggcgatgattatattacgaagccattccatttagatatcgtaatggcaaaggtgaagagtgcacttcgccgtggttacggagagtatgcttctgccgctgagagtgattgtttaggtgtaaatggactgttgttattcccgtctcagcatattgttgagtggcaaggacaacaaactgaactgacaaaaaatgagttttacttattagagtgtttaatgaaacaggtgaatcaatatgtaacgcgcgaagaactgttagaagctctatgggatgaagtagcatttgtggatgataatacattaaccgtaaatgtaaaacgtgtaaggaagaaactagaggagttaggcattaaaaatgcaattgtaacgaaacgtggatatggttatgcgctttttacggagtggggcgaagggcatgaaggttaaaaattaccttatgggccgcttttctttaattctttcttatattgttagcctttgtttatttgggctcgttttacagctgcaaagtcttttagaaaagaaatccattgattggagtacgtggttatatggacttttattaggaacagttgtgtttactgtatacctcatttacgattaccgaaaacggagtgtgtttttaaagaggatcgaaaagtatgttactgatggaaatacattacatgactctttacttattgatgaatcttatacatcagagcaagaaatggtcgttgaatcttttacgttattaagacagcaatatatgaatgaagttcataaacagcatgcgaaagagcaacagcaaatgatatttatgaaccaatggattcaccaaatgaaaacaccagtatctgttattgaattattgctgcaaaagtttggcaaagagcatcgtgaggcaagagcaacagttgaaagtattcgtgaagaaaataaccgtatactaaatggtttagatttagcgttacatatggcaagactagagcagtttgcgaaagattataagatagaagtagtaaatgttatagatgtcgtgcgaggtattattaatgaaaatcggaaatcctttattcaatcgtctgtatttccgaaagtgatgtttgaagaagatacttgtatggttgcatctgatagaaaatggctgagtattgctataggtcaaattgttgtaaacgcaatcaagtatacaaaaatttcagcggcagagaaaaaagaaattcaatttcaaattgaagagaaaaatcaaaaggtgttattacatattaaggacaatggaattggtattccagagcaagacgtaaagcgcatatttgatccattttttacgggaataaatggacgtaaaacgagagaagcgactgggatgggcttatatattacgaaggaaatttgcgataatttacatcatggaatgtatgtccaatcggctgaaggagaagggacaacattcacgttccaatttgcaaaagatgaagaatatcatacattgatgagaaaaatgacaaaactgtaagataacaaaacgttttgtaagggaaatcactcgtttctttttcttatttttcttatagtaaatgtaagaagaaaacacgtagggggattagaaatgagtgttcttgaagtaaaaggattaacgaaggtgtaccaatcaaaaggttcagtagcgacgactgctttaaacgatataaattttaaaatagaagaaggcgaatttgtagggattatgggtccttcaggaagtgggaaaacgacgcttttaaatttattagcaacaattgataagcaaacttcaggtcatgtgcttgtaaatggtgaagaaattaatcaaatgcgtgctgcaaaattagcggagtttcgccgtacacatttagggttcatcttccaagattttaatttacttgatacgttatccattaaagaaaacattattttaccacttgtaatggcgaagaaatctgtaaatgaaatcgatgcgaaagtactagaaattgcgaagtttttaaacatcgaagaaattttaaataaaaaagtatacgaagtatctgggggacaacaacaacgtgcagcagcagcgagagcaatcattcatgaaccgacgttaattttagcagatgagccaactggaaacttagactcgaagtcagcaaaatcgctaatgggcgctctgcaagatttacacgagcaaaagaaagtaacgattgcaatggttacgcacgatccagtagcggctagttattgtgaacgtatccttttcatacgcgatggagaaattttctcggaaatacataaaggaagaacgaaacaagcctttttccaagaaatcctggacgtacttgcgatgctaggaggagaatatcatgaactttcgccagctcgcgcttaataacgtaaaaggaaattggcgtaactataaagcgtttcttataagtagttgtttatcgattgtcgtatttttcatgtatgcttcttttatttatcatccagatgtcgtaagcggtaatattagtatgagaaagatgatcacaaaaggattagaatcgatgaattatattgtggtcatcttctcggcactctttattttatatgcaaattcaacgtttttacgagcaagaaaaaaagagtttggtctactaacattaataggcggaacgaaatcgcagctcggccgaatgattatattagagcaactgatgttaggtagtattgcaattgtagttggtattggggttgggatgctttgttcaaaattatttttccaagcgttaagcgtattattaaaaatagataagacacttccacttgtttggaatagtaaagcagttcttattacagctggtgtatactttattctatttttaatcctatcattgtttagtgtttggacagtaggacgcttgcaaattattgatttattaagagaggcaagaaagcaaaaagtagagccgtttgcatttacatggttatgtgtagttggtataggatgtattattgttgcatatgtacttagcttccaagtaacgtttctgaatttcctcatcctttttttaccggtggtgggactgacaattggcggaacgtatttactatttacacaaggtagtacagttgtattaaaagcattacaaaaaagaaagcaatctttttatacgtacccaaatatgttcgtccttagcaaccttatttataaaatgaaagataatgctcgttttctatttgtaatttctatcattacggcggtagtatcttcagcggtgggtacactgtacgtatattttgaaaatatgagtgcgaaaacggtagaacttacaccacatgctatttcatatgaggaaaaggggttaaatacgcataaccttattaatgaagaaaaggtacaggagcttgtgaagagacacgggtttgaagatgcgcgaaaagtaacatacgttaaactaccggcaacacagaaaataacgttgtttaatagtgaacatgaagtaccgatgacgattatttcagaaaaagaatataatgcagaagtgcgcaaacaaaagagagagcaacctacagaagttcataatgcaccaggtagtgcaacgatggttatggttgatatgtcaaatgaactgatgaagatagatcgtacgaaaccgtatgaatttacaattaacggacaaaagcagtctgttcaattaaataatccaacgcagtattctgtttttaatgatagtgaatatctcattgtaaatgatcaagattttgagaaatatgcaaaactcgtaccagatgaagaaaagtcgaaatattacggttattatattgaggattggaaaagtacagaaaatcttgtattagatttgaaaaatgaaattgtaccagaaaagcaaggggaattgagaaattcagtgtttgcgtataaggatataagagaaggtggagcaattacaatgttcatcggtttcttcgtagcggtactgttcttcttcttcgcttgtagtatgacatactttaaatggtttaacgataaagaacaagatcgtattcaatttaaatcgttaaagagaattggtatgacagataaagaaattcgcaaaattgcgattcgacaaatgggagttatcttctttatcccaattttaatcggttccattcatagtggatttgctcttcatacgttagggaaaatgctttatattaatttatggaaatcaggtgcgcttgtaattggagcatacattttagcttctgccatttactttatgatcgcgcaaagaggatatttaaaacacgtaaaaagctaggggaacctctagctttttgcctatgtagtaagttacaggaggacgatagatgaacattcggcaactagcgctgcaaaatataaaaggaaattggcgtaattataaagtgtttttcttaagtagttgttttgcaatatttgcttcttacgcatatatgtctgtcattgtgcatccatatatgcaagagacgatgtggtatcaaaacgtacgctggggacttatcatatgtaatgttataatcatttcttttttcgtcatatttattttgtactctacttctattttcatagaagcacgtaagaaagaattagggttatatatgttaatgggagcaacgaagtctaacgtaataggagtgattatgaccgagcaaattttaatcggggtcttcgcgaatattttcggtattgggcttggtatgatatttttaaagctcttttttatggtatttagtatgttactggggcttccgaaagaactccctgtcatatttgacgtaagggcgattggtgtaacatttattacatatatggtcgtttttattttgttatcttttataagtgctttacgtatatggaatataaaaatcattcggttattgaaagaatttcgaacagataaaaaagagaagaaaacatcaaagtggctctgtttattcggttttgcttgtttagtgggcgggtatgcattggcgctacaagtgacgatggctacgatagcgatatactttttccctgtgtctatacttgtcttttttggaacgtacttttcttttacacatggagctacccaagtgttagaaataataaagagaaataaaaagattatgtatacatatccttatttatttatagtgaatcaattgtcacatcgaatgaaggaaaatggtcgctttttctttctgatgtctatggcaacgacgtttgtagttacagcaacaggtacggtgttcttatatttttctagcatgcaagatatgtggcgaactggaggggtacactcgttttcgtacatagaaaaaggtatttctactcatgaagtctttgaggaaggtgcggttgaaaaattactgcatcaatatgggtatgacgattttcaatatatgagttttgttggagtgtatgcatcctttcagtctagtaaaggagaaacaacaatagtaccgcttataaaagaaagtgaatataaccaagaagcaaggaaacaaaaacaaaaaatgtatcgtcctaaaaaaggtacagtgacacttgtttattataataaatacaataattcgaatgtatataatcaaaaagagattgaattgcaagtaatgaatcaaccatatcaattcgtatttaacggtcagaaagaaggggttcaatttaaccatcacccttcgtacattaatggtctgttcttcgttatgaatgatgaagattttgatagtatagcaaatcaggttcctgattctgaaaaaatgatatatagaggctacacattaccaaatatcgaaaagacgaagaaattaaatgaagatttacggaaacatatgaaacaagataataataatgcatttcgaagcaatatggagttgtatgtaaatgtgaaagaaggcggcgatattactctatttgtaggctcatttattagtatattattctttcttacttcatgtagtatcgtttattttaaatggttccataatattgcatcggaccgaaagcagtatggtgcactctctaaacttggaatgacgaaggaagaagtatggaaaatttctcgttggcaattatgtatgctattttttgcgccaattatagtagggagtatgcatagtgcagttgcgttatatacgtttcataatacgctttttatggatggatcattaagaaaagtaggtttgttcattctgttttatatcgcagcatgtatcatttatttcttcttcgctcaaagagaatataagaaacatttagactagcgaacgctagtctttttttaatattcgaaatttacatagaagaatataaaaaagtatggtataacagtaagaaaacgaaaaagaggggaaaagacgatgattcgagtaggatatttaggaccagaagcaacatttacaaatatggcggtgagtcgtttttttccggaagcagagcatgtaccatatcgaacgattccagattgtatagatgcagctgcaaatgaaaatgtagacttcgcagttgtaccgttagaaaatgcaatagaaggttcagtgaatataacggttgattaccttgtacatgagcagccgctttccattgtaggagaaattacagtaccaattcagcagcatttacttgtacatccgcagtatgcagaagtgtgggatgaagtatatgcagtgcattctcatccgcatgccattgcacagtgccataaatttttaaatgaagaattaaaaggagtaactgttcgagatatgacatctacaagtgctgctgcgcaatatgtgaaagaacatcctgaagagaaaattgccgctattgcaaatgaagcggctgcagaaaaatacggattaacaattgtgagacgtagtattcatacgcataaaaataatcacacacgtttcttggtactccataagaaaaagaaagcagtactcccgaataacggagagaatcgcggagagaaaacgacgcttatgataacgttacctgcagattatgcaggtgccctatatcaagtgttatcagctttcgcatggagaaaattaaacttatcaaaaatcgaatcgcgtccgatgaaaacaggtcttggaaattactttttcttaattgatgttgataaagcatacgatgacgtattattgccaggcgtaacgatggaacttgaagcactcggtttttctgttactgtgctggggagttattcttcttattggttgtaagatgtagatggaatgttggtatttgtctaatcgtcaatatcatttcattgcctaatatattttttaatagattaataaaatcccacctgcagaaggtgggattctttattttaacttcgcaagacgatcttctaactgaccacgccaaatatcagctagttctggaacagcaagaattttttcaatgccatctttatcttttctattatgaaaataaatttcgttagagaacaagacagaaacattgctcggttgacgttctagtaatgtaattttagaatctttacgtacagtaccttcttgaagaacgcggcataggtagcctgtaaatccagttgctacaatgcgtggcagtatgccagggatgccaagacgttttgaaattgtgctacaaggtactcttgcttgtgtcacttgaatgattgtttcacctagttgatatgtatctccgatgcaaacatcacgctctaacatatttgttacggtaatgttttcgccaaatgtggaagctggaagcgtagtttgaaattcctcttcccatagtgcgtaatgctcgtgtgggtacacacaaacagcacgatcaggaccgccgtgatgttttaaatccgctacgtcatcaccaagaaatccgtcttttgagagaaaggcctcttctgtaggatctttacatatacctgttatcatttctttatcttcgccatatttcatttgtttcggtttgccaatgctaaagtgaacgagttcaattcccatgtttgatctcctttacgattgattacaatattatagcattaaaaaagcacagaggatgataaaaaactctgtgctttacattaataaacgagaaatcctgctttatctaacgcctcacaagcagcatctaacttttctttagaatctgcttcaattgtatgtaagtgaataccgtctgttagttgcgatagataggaagcatttgtgttttcgattttttgtaaatattgctctacatcaaatcgattacttaccataattgatgctgttaagtcgccgtatacaggatgctcaacttttacatctttaattgtaacgccatggtcaacaagcattgtaagttcttgacgtacttctgctggtttgtgctggcatacgattacgcgttcaaaagcttgttgtttctcttgtggttttaaatataaatagccttgggcagtcgcaataattggttcgtttcgtgctttaagcaaggaaatatcttgcacgataacttgtctacttacgtttgtcttcttcgatagttcattcccagataacggctcatttgcagcgagaagccactgaaggataagctgtcgtctttcttcgcctaaaatctttttttgttcattttgtttcattatgatttaacacctctataaaattgatttccaattgtgtgtagtgcatgaatagtagtatcaaatttgatctttcgtggttggtgccgaaagagaagcggcatattgtttggcctctcatacgtttt

SEQ ID NO: 1231 - DNA, 8938 bp, Bacillus thuringiensis
aaaaccactagagggaacattcttaaaaaatatgttaaacacagtgccaaaagagattcgtaccacgtacattcacgaagaaaatgcccaagtgttaggatcatattttagtaccaatcaacatcgcaccacacacaattgtagacccagtacacttaaactcaaacattatgaaagaacacggacgtgtaagtgaccacgacccagtacttgctcaaattgatttgaagaaggcttcttaaagtggggaacgcttaggtgactaagcgttctttttttgcatcgttatagaataggataaagagatgattcctttttttgtaatctaacgataaaattgattgaatatttagtttttaataagggggacaacaatgcagttacaaataaatggaaaggtaatgaatcagtttgcaattttttttagtacgatcatcatgcttcagtttgtagctgatataacaggacttacaagcaatctagatattacgtataacttaatacatacagcagcttcttatataacatttagtttggcggttattttcactttaataggtgcaagaagagaattaagtaaatatgcaattgtttcattatgtttagttgtaggtattaaagcgatttattttgtagcggttgttattttatggggattggctggtacaccgtaagtgaatagtaaataaaaccctaatttccaatatagtaaggaaattagggttttattatacttgaaacgcttttctacaccgctctcttttttgcaaccttcttctatatttttttttatcacgttttactccttgtatatacatgattaagctaacgaggaggaagaatgcacattgtattgtcaaaatatacggcgacatgccatgcaaaggttgttttgggtcatataaatgaaaaggagctccgcctattgtagggaatatcgtatttagcaggacgtatggaatggaggcaactgcaaatgggaaaagaatcgccatatagtccttttgtgaccacgcagatgcagcaagtcctaaaagggccattaaacctgcaaataaaaaattaattccgatatatacagtaatgtaagtgaggggagattcgtaatataagtttgcaaacatcccattatcatttataatgcctgaaccagccgtcggttctccgtctggaatggttaatttgcaaaataataacgataagatgaacgggaatgtataaagaagtccgccacaaaagaatgtaacaatatatttcgttactgaataagggaacaaagaaatccctttacttacaaacggtttaaaaccatctgatttatccgaattgtaacttgtactaaaggggaaactggcaataacgggcattaataataaataaacatccatttcattgtcgcgaaatccaatccatttaaaagctgttgttacaaacgcatccgttccatccccaatgtaacgaattacataataataatggtaaataaaaataagagctagtccactaaacataataattaaagaaacacgattacaaaaagcttgctttatatttaaacgaagtgcacgcatcatgactgaaaaagcctccactgttttgataaacttgtctattttctatattactattaattgtaaagattttcttgtttttttatttgattatttgaaaaagaggaattttgttgttggtaagtaaggtttagctgaaattaatttttctaaaatatggttgacaattaagtattacatttgtaatcttaattatagattacaaatgtaatacttaggagtgaaatatactatgacaaatcaattacctaaaatatctgaagcagaattagaaattatgaaagtgctttggtcgaattctccgcaaacagcgaatgaaattatagaagaactggaagatgcaatggactggaaaccgaaaacaatccgcacattaattaatcgattagtgcaaaaggaagccgtttcttaccatcaagataaagggcgtatgtacgcttattacccgttagtatcacaagataattatttgcaagtggaaacgaaatctttactaaagcgtttttgcggtgcagcgtttaagccattacttgttaatttcttaaaagaggagaaattatcttcagaagatattaatgaattaaaacgcattttagatgagaagacagaggagaataagaggaaggatcgataaaaatgataaacacgcttataaatgtataccttcctcatttttttgattggcttatagaaacgtcacttatggctagcatattagtcggatttattttgtgtataaaagttctattcagaaataaattaaccccccggtggcaatatatgctgtggatcgtattaatgataagactccttttaccgtggtcgccagatagctcttatagcatttactcattactttcttatagttctagcgtatcggaagttattccaaaaaatatgccggctactgagaatatagtgaacatagaaagcgaccgaaaagtggaattggaatcaaattctaaaatggtgacaaaaactagcgaaccggaagtaaaagtcagttcggaaaaacagactacattttctttatacaaacttgctttgtatgtgtggctagctggggtaatcatattagcagccatcacgtttcttacaaatagacgtttatattcttacataaagaaacaaccggatattacggacgaacaggtcactacagtgtttaatcgctgtaagcagtctatgaaaatgaagaaggcagtttcattacgtcttgcaggaaagattgcaagtccaacggtttttagtttctttcgcccgaaagtattactatcaaaaaaacatatgaaagtattaaatgaacaacaattacaatatgtcttttaccatgagttagctcatattaagagaaacgatgtagctgtaaattggattatgtacagtttaatcctattaaattggttcaatccaattctttggtacgcctatttttgtatgcgagaagatcaagaattagcctgtgatgcatatgcacttacttttatagataaagaggaacaaattgcatacggtcatacaattattacccttttagaacactattcctatcaattaccaagcctggcaaatttaagtagaaataaacgaacactaaaaaggagaatcattatgattaaaaaattccaaaagaaatcgtatcgtctttctttacttggagttattgtcatagttgctatagcatccctttctttattcaacgcacgtgcaacggaagggaaagaaaaacaaaaggataaagtagagcagtcaaaggatgctttccaacatgctgtagatatgctgtttggtacagaagaaaatgcaaaaaaagaatataggtattcagcaagagtgtatgaaaataagacagattatttatatttagctgaaaaggctttaacaacagatgagttccaacagtacataaaattgtataaagaaattattaatatacagaaaaaaggtgctccgagagattctgactacgagtcaatattttttagggaagaacgtttaacagaaactgatcgtgaaaaattatatgcactttatgatcaatcaaaaccgtttaatgacaaagtggaagaatctttaaattacacggtaaaggaagcgcaggaacatgtagattttcaaattaagaagccaacttacacaattgaaggctacgatctaaaggatgaaaaggtaagttgttttattaagagaagacccgagttaattatagaattagagtatacaaacggaaaaggaaactatacaacttatcaatcacaagtatttggagaaagtaaagatccgttccatggtttatttgttgtagaagaaaatattgaacagtacgaattagaaggtaatcaaatattctatgcgactcataactcggataggaatttacaaggtatgaagatgattgttccagcaaaagggaaaaatcgtgcataccaaatcgttattattaatcatagtttagagaacccaggagaagcagtattcgataagaatgtaaataaagaagaattagagaaaattatgctttctatgttgaaatagcaaaaaggtgttcttaagatgtatatctctagaacatcttttccttttctcttttcttctgataaactatggaaagtatgatatacactgactgaaatttttttatactggaaataataaaaagagaacttgtatagaatgtaagcgtgtggtaatatcaaagatgtactgattgactatattatccaattggtcatttttggaggtgacaatgtggcgatagatcgaaaacgttctattattgaagctgcaacaaagtctttttcagcgttcggctataaagcaacaacgatggatcaagtagcgaagttagcgaatgtagggaaaggaacgatttatacttttttcaaaaataaagaagagttatttggtgaaattatttctaatttaattacagaaatgaagcaagttgcagaaagtgcaattcgttcagatgtttcattttttgaaaatgtacatagagcattatatagcatcttggaatttagaaaagaacatcagctcatgattaaattaattcaagaagagcgcgatatgggaacgaaagaagtacaagaagtgatgcaacaagttgatgtggaaatcgtttctgttattcaatcgtatttaaagattgcgattgaaaaaggtgaaattagcaaatgtgatccagaaattacagcatttattatgcttcgtctatatgtatcgcttatttttgattgggaaaaaaatcacgaaccgctagaaaaagaaaaaattgcagagttatttgaactttatttactaaaaggattgtcaaactaagataatccttttaattttataaaaaaatgaccaaatgaacaattcggtcatatatttaagttaaggggggatatagaaaaattataatcataataagaaaaaattgcatagtaataaattcagggataaggcatatgtatgaacaagtatagcctttttgtttgggtaaaaatgactatatgaacattttggtcattttataaaagggggagaaattatgaaagggaagcagttactcggaaagagttcacggaaattataaaaagtaaaaaaatattaattccaattattgcggtcttattcgtaccaattttatatgcagggatgtttttgtgggctttttgggatccgtataaacagttagatgacttaccagttgcagtagtcaatttagataaaggcgcagtatttgatgggaaatcaattgaggtcggaaaagggctcgttgataatttaaaagataataaaagttttaaatgggagttcgtaagtgaaaaagaagcgaagaaaggaatggaagctagaaagtattacatgttagtgcgcattccagatgacttctcaagtaacgctacaacgttactaaaagacaatccaaagccattaaacttagagtacattccaaacgaaagcttaaacttcttatcttcacaaattggaggaacagccattgaaaagattaaaactgaagtatcaagcacgttaacgaaaacatatgcagagaaaatgtttgattccattcaagacgtctcaaaaggattagcagatggggcggaaggagcaaataaactacacgacggatcaagtgagctgcatgatggttcaagtaaagtgacggatggccttcatacacttcaagggaattctggggagatgaaggatggagttcagaaattagcagatggatctaataaattagtagatggatcaggcaaagtaacaaacggtttaaatgtgctaaatagtaaaacaggtgaaatgcaggtaggtatcggaaaattagtagatgggtcaggcaaagtaacaaatggtttaaatacgctaaatagcaaaacaggtgaaatgcagataggtatagggaaattagtagatgggtcaggcaaagtaacaaatggtttaaatacactaaatagcaaaacaggtgaaatgcagataggtatagggaaattagtagatgggtcaggcaaagtaacagatggtttacacgtattaaatagcaatgcaggtatcggaaaattagtagatggatcaggcaaagtaacagatggtttacatgcattaaatagcaatgcaggtattgggaaactagtagatggatcaggcaaagtaacagatggtttacatgcattaaatagcaatgcaggtattgggaagttagtagacggatcgggcaaagtaacagacggtttaaatacgttaaatagtaaaacgggtgagttgcgtgatggatctgagaaagtgaccggtggcttgaacaaattagtaagtaaatccggtgaattaaaaacaggaacaacggatctatcaaatggtatgggaaaacttgttgaagggcaaagccaattagaggaaggttctcaagcgatccaaaagggattgcaagagttaaatagtaacgtacaaaagtctgctgcaggcttagaggaaatgcagtcgaaagttccttctatattgaatacagtaaatgaaaaaatagatggagctggggcgaatgtaaatcagttaaatgaacttacacaatcaacagcaggagatgcaaaaaatgcagcacaagaggtagcgaatttacaaaagcaaattgaaagtttaccaaaagaatatcaagagcagttacagccattcgtaacaagtgctgtaaaaagtacagcgacagttcagcaaaaagctgccggagtagcaggtggaacaaataaattaaatgaagaagtgaaacaattaaaaggtgaaatacatcaaacaacaaatgggttgcaaaaaaacttaccaaatccagcagggataaaaactctagcaggtgctattgagaaactaacgagcgcacaaaatgaatttgttagtaagtttcatggatttggtgagggattagataatgcaaaaataggtgccgataaattaaaagatggatcagttcaattaattgatggagtaacgcaattgcaaagtggctctggaaaagtgacagcaggattaggtcaattatctgcaggagtaaatcaattagcagatgggtctggtcaagtaacaggcggtttaggaacattatctgtaggagtatccaaattagcagatgggtctggtcaagtaacaggcggtttagggacattatctgtaggtgtaacgaaattagcagatggctcaagccaagtaacaggtggtttaggaacattatctgcaggagtaaatcaattagcagatggctcgggtaaagtaacaggcggtttaggtgcattatctgcaggagcaaatcaaatggcagttggagtaaatcaattagcagatggctcaagtcaagtaacaggcggcctaggtcaattatctgcaggagcaaaccaaatggcaggtggagtaaatcaattagcagatggctcgagtaaagtaacaggcggtttagggacattatctgtaggagcaaatcaaatggcaggtggagtaaatcaattagcagacggatctggtcaagtaacaacgggcttaggtactctaaatggtggcctaaatcaaatgtcaaatggctcaacccagctaatcgacggcgtaaataaactagcagatggctcaggaaaagtaacagatggtctcgtaaaagtaaacgacggttcaggtgaacttgcagagaaacttggcgaaggggcagagaaaactggggaagtaaaaggaacggataaaacgtatgatatgtttgcaagtcctgtaaaagtgaagacagagaaaatggcggaagttcctaactacggaactggatttacgccgtatttcttatcactcggtttatttgttggggcattattattatctatcgtatacccattacgtgatacagtaggcgttccaaaatcaggatttagttggtttattagtaagttcggtgttttactatcagttggtattattcaagcgatagtagcagatgttatattactgttcggattgggtgtagaagtacaaagcattccatacttcatactctttagtatcattacaagtttagcatttatcgcattaattcaatgtttagtaacagcattcggtgatgcaggccgttttatcgccatcatcacattaattatgcagcttacaacgagtgccggaacattcccgctagaattgattccgaagtttttacaaccattcaatgcttggttaccgatgacatactctgtatcaggattgaaagcagtcgtatcgagtggagactttgacttcatgtggaaaaacataggaatactcatgatttttatcgttgtattatcatttggaacaatcgtttctttaactttgatgcacaaacgaaaatttaaaaatgtgcttgaaaatcaatcggttgaagcgtagataaaagcacctttttggtgctttttttattagttttgttttatcccgctttaatgatgggcagtaagaccccacctcaaaattcagcgaaagcaaagaagttaggtggggatcaactgcccattaaagcccgattggtgagggctaataatcagtgggggatgaagaaacccccactgattaaagtttcacttcattggttgagaaagttcattttgtttttctgtttttacggaacatgtatatcacgatacttataagactaatggcagctacaatccaaataaatggaccatatttttcagcaaaggtttatagcttcatattactagcaagtacctcttttgtttgttctattagaatatcagaaccactataccctgcaaggttatactccttttttatgccaacagtaagagtgtctgattcgatttctattccgcgatatccgcatcctctacttttaattgttgattgagtatcatgctttttta

SEQ ID NO: 1232 - DNA, 10970 bp, Bacillus thuringiensis
agccaaaaaaggtatacccctaggtggggcctaggcggtgtttctcttttacggcttagacatagaaaacacctacacttttttgccaatataggggatggagagattatcatgagcaacatgcagcaaaaaacagacgttatcttaattggtgcaggaattatgagtgcaacattaggctcattactaaaagaattagcaccagaatgggaaattaaagtttttgaaaaactcgcaagtgccggggaagaaagctctaacgaatggaataatgcaggtacagggcattctgcgctatgcgaactgaactatacttccgaaaaagctgacggatctatagatattagtaaggctgtaaaagtgaatgagcaattccagctttcaagacaattttgggcatatcttgtaaagagcaaattaattcgtaatccacaagattttattatgccactacctcatatgagtttagtacaaggggaaaaaaatgttgagtttctaaaaaaccgttttgaagcgctttcaaaaaatccactgtttcaaggaatggaattttctgatgctcctgaaacattaaaaaaatggcttccactcattatggaaggtcgcacatctaatgaaccgatggcggcaacgaagattgactctggaacagatgttaacttcggtgcattaacacgtatgttgtttgattacttaaaaacaaaaaatgtcgagctaaactacaagcatagtgtcgaaaatattaagcgcacgaaaaatggtttgtgggaagtaaaagtacacgatatgaatagtggtaaaattgagcatcatactgctaaattcgtctttattggcggcggtggcggtagcctacctctactccaaaagactggtatccctgaatcaaagcatattggtggcttcccagtaagtggactatttatggtatgtaaaaaccaaaaagttgtagagcagcatcatgcgaaagtgtacggtaaagctaaagttggcgctccgccaatgtctgtacctcatctagatacgagatatatagacaataaaaaagctttactgtttggaccattcgcaggcttctcacctaaattcttaaaaactggctcaaatcttgacttaatcggttctgtaaaaccgaataacgtcttaacgatgttagccgctggtgtaaaagaaatgggacttacaaaatacttaattcagcaagttatgttatcacatgaaaaacgtatggaagaattacgcgaattcattccgaacgcgaaaagtgaagattgggatattgtagttgctggacaacgtgtacaagtaattaaagatactgatgctggcggtaaaggaacacttcaatttggtacaaaagtagtaagtgcagctgacggctcaatcgccgcattactaggcgcatcaccaggtgcttctactgctgttcacgtcatgcttgaagtattagaaaaatgtttcccaagccgcatggtagaatgggaggaaaaaataaaagaaatgattccttcatatggcatttcactaactgaaaatccaagattgttccaagatcttcacacttctactggtcgtacacttggattaaacgaaaaagaaactgttcataattaatgcagaaataaaaaaacgtccgatatattcggacgtttttttgtctactaaaaattatacttatcaatattatctttcgtaaatacaactcgttctggtaatacgataattccgttcccttctgcctcataatcatatccttgaatggagtttggctctactttcacttttccaattccttttacttcgaagctatcccctacttttaacttcttcccttttacaacaatttcatttgctacatacgttgcgagagcaccttgttgttttacatcccataaaccaaattgttgtactgttcctcgttttacataatcacgcataacgttcggtgtagaaaatccagttaccactacttttttatccatttttaagttttcagctgcctgcgccattgctgggagtgctgttgcatctggacaaataactgcgttaatatctggatacgtttttaatatgttctcccctacggataaagatttttgtgcattattttcaccgtactgcgtcgttacaatttcccagttcggatatttctttttaataatttctttcgctttcgttacccattggttttgatccgttactgtcgggctagaataaaagaatgctacttttcctttatctccaatttgcttagaagtcatttctattaataagttagcaagttggtctggtgttccttggcttatataaaaagaacgatctttcggattcacatcagaatcccatgttaacaccgtcatcccttttttcttagcacgttgcagtgattgcgatagcccctccactgacgtagatgaaaccataagtgcatcatagttttggttaataaaattatttatatactttacttgccctgatacactcgcttcagacggtccatcatacttcacttgtacgcctagcttatctcccatctcttttgccccttcaccgcccgatgtaaagaagccaactcctgttattttcggaaaaaaagcaaaattccaccatccagcggcttttttattatctgccgtttgactggaacaagctattaaaccaattaggcaaatacatacgatcaatacaatccctagttttctcttcatgacatttcccccttatgcaaactctgtcttttccccgctaaaaattgatgtaatttgaaatgtctcataataactgaaagaataaggataatacctattactacattggattgttcatttgttaaacccgtcatttgcaagccatactgcatgagcccaatgaaaatactcgccagtacagtaccgataatgcttccttttccgcctgtaataagtgtaccgcctaagacgactgctgtaatgattggtaatattgtttcgcttcctatatcagcacgtgcagaaccgaaatatgcagttaagaaagctcctcctaatccacctcctaacccagaaagtatgtaagcaatgattactactttcttcgtcttaatcccggtgtattttgctgtattttcattcgcacctgttaattgtacgtggcgcccatatatcgttcggtgaaacaaaatcgtgcatacaattgttaataaaataagtagccataataaattgggtattcctataaaactaccatttgctagttgtacataagtatcaggtaaaccgcttatcccttcatatccagaagcacctgcccctcctgaaacgacaagcgcaattcctccgtataaaaacatcgttccgagtgtaacgactagtggctctacatctgtcatttttataatgagtccatttaaagctcctgctaagcaactgactataagtgccattattactgctagtaaaatatgaatcccattcatccaaaacacaccaattaaaatcgaggttagccccataattgatcctacagatacatcaattcctcctgttactataacaaaagtcattggtatcgccgcaattgcgataaataggaaatcatttgtactaaaaaggagattactaatatttaagaaatcgctatttataaaactaaagagaatgaattctataagaagtaatatgattaacacaccttcccatctgtaaaaatacttcatagattcatcctcctttctgctttccacctcttcatgacgctatctaatatgataataagtaatagtaaaaaacctgaaatagcattattccaaaatgctggtatttttaaaaagacgagtgagctacttattgtttctaaaaataacgctcctaatgcagctccaaataaagatcctgttcctccttttaaatgaattcctcctagtacagcggctgccattacttgtaattctaatcctgtacctgtttgatttgggacgaacccgatattcataacaaatatgcaaccagcgagcgcagcgcttatgcctgaaatcataaacgcatatatcttcactttattaacaggtataccaataagcctcgcgccatcttcattatcacctaccgcataaaagtatcttcccaatggcacttttcttaaaaagaagtatagtagtagtaaaataataagaacgaaccatacagttataggtaaaccaagaatgatgatagatgacagctgcttaaaatcgtttggaatatcttcaatccacttcccgcctgtgaagattaacattgcccccctagcaattcctagcatccctaatgtcataataatggctggtacccgaaactttgcgacgccaatcccgtttatgaaaccaatactagcaccaagcattacagcagcaaaaattgacaagaatgcattatacccgttcgttaacaacatcccgcaaactgccgcgcttaatcccataattgagccaactgatacgtctatatttttcgtaaataagacaaacgattgaccgattgctagcacgactaaaataacgcttgatttcatcagtaaagataacgagttaaattgaataaaactagggtttatcatccctacagtagctatataaattagtagtaacagtatgatagacgtttcgtgcattttatacatacgtttcattccgttacacctccgtatgcaaggcgtgtaacttcattcacactcagttgttctttttccatatgagaaacaaatcgcccatttctcattacatatacacggtttactaattggataatttcttcaacatctgaagagattaataaaattgcgagtccttcccttttcattttttttatcgtctcatacacttcaagccttgctttcgcatcaattccgcgagtcggctcatcaagaataataattttaggattacatgcaagatacttcgcaagcacgaccttctgctgattacctcctgataaagatgccaattctttattcatattctgtacaacaattcggaactgttctataaacgaattaactaaagcgctttctttttcttgatttataaaaaagcgattattttgatataaacttgctgctgcaatattttctttaacagaagcaattgagaaaattccattcctcactctatcctctggcacataaactaggccttcgtctagccttttatgcaaagaacacgtatcaattgattttccacccaataagatagaccctgattttatagttttcaatccaaatatcgcttctgctaattccgttctgccagatcctataatgccagcaacacctacaacctcacccgcatgtacagtgaatgatatattttcgaatgcgtgaccatttatatcaaccacttctaatatttttttcgtctttgctgtctcttgaactacttctattttctctttctgtttatatccttttggcaatagtccctccatcagcatgtcatatgtatagtcacatacatcaccttggcttacaaccattccatcacgtagtattgctactttgttggcaatttcaaagatttctggaaaacgatgcgtaatataaatcatcccaattcctttttcttgtaaacttttcatcaacacaaaaagactcttaatttcgtgtgttgttaatgtcgatgttggctcatctagaataagaatctcagcttctcttattaatcctctaacgatttctactaactgttgttgcgcaatagataacgattctccctgttcattaagatcaatatcccaacttaaactgtcaattaattgctgaacttttactttaagcttctttctattcccctttaatccaatacatatattttcttcaatggtcatatgcggaaaaatgagcggttcttgtggtattaaataaatcccttcttggtgtgcttcttttggatttgcaaactgctgtctctttcctttcacatacatttctccactatcatacgaatataaccccgttaatattttcattaatgtcgatttcccggcgccatttccaccaactaaagcgtatatatcaccatgctctacttgtaagttcacttcctttagcacaagttgattcgaaaacgccttactcattttcttcacttgtaataagggcacattctccacatgatgtcacctgcctttacccagaacattttttgagaaaatgattatttgttctacttgttttgtagcattgtatattccttttttcatatctagaacacttttttcaatgtactattaatcgtttcaactggaataaacaaaatatgtgacacatatgtttaagcattggtcaattgttgaaagggatgaagagtatgtcacagctgaactttgaagaaaatttattaattaaagtagcctggtactattataaagatcaattaacacaacaagagattgcttcacttcttcatatttcaagaaataaagtcgtccggttattagataaggcacgcagtgaaggtatcgttacatttcacgtaaaaggaaccggtttgcattgcttgagcattgaacgtgacttaatgaaaaagttccacttaaaagatgctttcattatccctactccaataaacaattatgctacttctctcggaaaagccgctgcacaatatttagaaactcatctccaacaaggtgatttactcggcatcggctggggtgaaacgataagtaaaatgctagaaaacattcattttgaaagttctattaatctttcattcgtaacgctaacaggcggagtaaaccactatctcccaagaaaacaaaactatttacactacatgcaaggtgatcttcatattattcctactccttttctagcatcttctactgaaatggcacgaagtattttatcagaaccaagtgtgaaagatatgcttcatgtcgcttcacttgcacatacagcagttgtcggtattggcgggttatctcaagacgctacaattgtaaaagaagaaaaattaacgctacgtgaaatgacatatattcgaagtcaaaacggggcgggcgatattttaggacagttttataatacgaatggtgagttattagagctctcgcatcataatcgtctaattggcacgcctctctctattttgcgcaatatgaatcatgtcgtcggtgttgctggaggtatagaaaagatagatgcaatttatggtgccttaaaaggaaagtttattcatacattaattaccgatgaggaaactgccctctccttattacgaaaggatggtgattgttaatgtcccatttattagctttcgatgctggtacagggagcattcgagcagttctttttgatttacatggtaatcaaattgcagtaagtcaaaaagaatggattcacaaatctgaccttcgttatccaggctctatgaactttgatgtagtagaaaattggaagctagtacaagaatgtacgaaagaggtgcttcaaaaaagcaacactcctgcctcttctattcttgctattagcgctacaagtatgcgagaaggatttgttttatatgatcaagatgggcaagaaatatgggcgtgtgcaaatgttgatgggcgcgcatccgtcgaagttagtgaattaaaagaaattcggtcacatcttgaaaaagatttatatacaaagtctggtcaaactttttcattaggtgctttaccacgcctactctggataaaaaaacatgaacccgacgtctataataatatttactcttttacaatgttaaacgattggattttatataaactaagcggcgtactacaaattgatccctcaaacggatgcacgtcaggtatttttgacttacaaaatagagtgtgggataacgatgtcgctaaggagtgcggtctatctttgccattttcaccaacagtaaatgaagctggtacagtaattggcaacgttacaaaagagtgtgcagcattaactggtttacttgaagggattcctgcgtcgccgggggtggagatgctcaaatggcatcgctcggaacaggaatcgtgaaccgaatcaaacgttaatatgcgggggtagcttttggcaacaagaagtgaatgttactgagccaataacagatccacatgctgcgattcgagtaaattgtcacgtcgttccgaacctatggcaatatgaaacaatcgcctttttcccaggtctcgttatgcgctggtttcgagacgctttttgccaagaagaaaagaaacatgctgataaactcggtgtagatgcttatgaattactagaagaacaagcgaaagacgtacctgtcggttcacatggcattatccctactttttcaaacgttatgaactacatttcttggcgtcatgccgcaccttcattcttaaatttaagtttagacgctgacaaatgcggaaaaaaggaaatgttccgtgctattgaagaaaatgccgccttcgttacacttggaaacttaaaactaattgaaaatcttactggtacattcccttctgaagtcgtttttgctggcggtgccgctaaaggaaaactatggccacaaattctatcagacgtactcggtattcctgtaaaagtacctgttgtgaaagaagcagctgctttaggaactgcgattgctgctggagttggtgctggcatatattcatctatggaagaaactgccgaagagtttgtacagtgggagcaaacattcgaaccagttactgaaaatcacgaactatataaagagttctatgaaacatggaaaactgtatatgacagtcagctcgctttagctgataaagggctcacctcacatatgtggattgcgcctggtgcactgtaacacattacataaaggagtgaactgtatgttaaaagcgaatgaaaatgacttctcctatcgcttcggtgataacgggccgaaatatttaatacaaggtccaaatattgatcttggccttgttgtcattcaaccgggccaggagtttcaaaaccattatcatacgacgtgcgaagaggtcttttatgcattagaaggtgaaatagacttctatgtaaataacgaaagagttccaattaaacaaggtgatgtcctgcaagttcgccctcatgaatctcactatctgattaaccattctgacaaaccttttaaagctgtttttataaagtcaccacatttaccaaataaagatacggtacaaacggaaaatccaacattaacgaaggagtgatttggaatgacttggggatttaaaaatcgattaaatacaattttacctgatggcagagcggtaatgttagcgatagatcacggctactttttaggaccaattcacgggcttgaacagccacttgaaactgttaaaaacttacttccttacacggattctctctttttaacgcgtggtgtacttagctcctgtattcctgaaaactgcagcacaccgatggttatgcgtgtatctggcggcgctactgtcgtcggtaaagatttagcgaatgaaacaattgttacacctgtgaaagaagcagtaaaacaaaacgcaattggcgtcggcgtttctgttttcattggatcagactatgaaacacaaactgttacaaatctcgcaaatgtagtttctgaagctcatgattacggcctgccagtactcggcattaccgcagtcgcaaaagaattacaaaaacgtgaagctcgctttctagcacttgcttcccgcgtatgtgctgaaatgggtgctgatattattaaaacgtattactgtgaaggattcgaaaaaataacgagcacatgccctgccccagttgtcattgctggtggaccaaaattagattcaattgaagacgcattaaacattacgtacaatgcgttgcaagaaggcgcaattggagtagacatgggccgaaacatatggcaatccgagcacccagctgcgatgattcaagcaatacatggcattgtaaaaaatggattgaatgtgaaagaggcacttgaactttatgatgatgtgaagaattaatgtgaaaagacagactatttattagtctgtcttttttactttacagtgaaactttcttaatccgtcttctaatatgatacatacttaaattctatacaccttcaaatgattactctagatgattactattaagctttgaaactttcttaccttctctataatcaagacaagacacttcaattaataagccattaaatactgtaaaataaaaaccataactactacctcgcatcaaataaggttccttgtctatttcaatgccgccggctactaaacgattatacgcttgatccacttcacttgatgtatccactaaaaaaccaatatgaaaagcttccggatacgtaacttccttattccctttaaatgcttttggatcacttagtacaagtataaaaccactctcatcactcatcactacaagtgctttccctttttgctccaaaaattgaaaatcaaaaaatgtttcaaagaaatgtctcgcttccgataaatcatcaacacataaatttaaatgattcagcttcatgtactcatctcctcgtatgataaagttaggttttttaggaaagggatttacctataaacccgtgagtatctagttatatgagatacttatatttgtagatagagtgttgccgaccacctccttgaatctttgtattcggttgaaagaatggtacctctgtctaataagtagtttacgaatgagttggatgttgatgaccattggtcattcttcgtatctcttacgaggtagtagcgcttattagttcagaggaggacaacactatctaacactgattaaaataggggtgtaagctatgttctatttaggtattgatatcgctaaacataaacattatgcgtccattatcgaccaaactggaaaacctattactaagccatttccctttcaaaatcatacagaaggcggacaagcactgttaaaatggatgcaccaattatattgagtcttcc

SEQ ID NO: 1233 - DNA, 7301 bp, Bacillus thuringiensis
attcgtaatgcgtatggtaacattaattttacgccttactccatacgtcgtattagctcttatggcaaaaacagttgctggtagcgatataaatgctattttaaaacttggtaacttcgtgttagcctcttacgtagcacttatcgtaatgtttatcattcacttattattaattgcattgtctggtttaaatccaattcaatatttgaaaaaagtgttccctgtactaacttttgcattcacatctcgctctagtgctggtgcgatgccattaaatattgaagctcaaaaagaaaagcttggtatttccgaaggaattgcaaacttcgcagcttcatttggggtatctatcggacaaaacggttgcgcaggtatttatccagcaatgcttgcaatgatggtcgctccaactgtaggaattgatccattacaaccacaatttattttaactttaatcgctgttatcgctattagctcattcggtgttgccggagttggtggcggcgcaacattcgcagctttaatcgtactatctacaatgaacttaccaatcggtattgttgctctagttatctcggttgagccattaatcgatatggggcgtacagctcttaacgtaagtggttctatgacagcaggtcttatttcaagtaaatggcttggtgaattagatcaagatacgtacaatcaagatgatacaaaaactggtgaaattgcttcataatgaaaaaaagacgctaacatacaattgttagcgtcttttttattccgttccctctttatagattttatcttgagaattcttactccaagtattcttctagttgctcttttaactcctcctcaatctcataacaagattcatcaacaagttcccctactttcttactcccaaaaatgtttgattgaattgacattcctaaaaagattctttcgcatttccaaattggaatatagtgaaattcaatcatctctttttcttcatctaatatagctatggcaactgatgaataatagcccacctcaaagggattctctttttctcttgcaaatcccatatctaattccatgtgtttttctatgtataaatgcgcatactctttatgcagtttaagtaatattcgctctatttccttctccatacattgaatgttctcttttaactccaacgtaaactcctgttctttatatttcattttcgcctcctgaaacatagaaaaagagaatatgataacatatcctctttcctcaaatatatttcattatctcacagcccgtccttttcacaaataaccattttgttcgcaccatttatgaaattgtcctacgtctactccaactaacacgatatcctttagctctacatcaatgatttgttctccaattacaatagcaaactgcgatgctaattttgtctcgtttttctttacaattccaattcggttccgatgcggtccatcttttatatatgctttttgtcctacaatatcaaagttcaaaattctcacctcttttactgcgctcaaattggaaatacgatctccacctcggaaaatttcctttcattgcactatttctctatatatatgacgaaacaataaaagagtccttccttctttacaattattttttctttgtttcatttttgtgattgaaacgtaaagtttataataaaacacacttggaagcgctttctatgtaattttttatgttataatatataagtagaacttcgtaaagagggttaaaaaatgaatacaaaaatgattaaaaaagtaattgaagcattaaaagtatatggctttcaggatgtatcattctgtgacaaaacgaagcaatttttatttcataacgaaaccgatattatgagcggctatgcagaaataacatatagtagtcaatttgaaaaattcaacgtacaaattcatccaattgaaacgcatcaccaagcagagttacaagagattgaaagacatatacaagcttgtataagaaaagtggaatatttaaacgcacttcttaccgggcagacaaaactagatgataaaattattattatgtaaaaaaagaacgtgatccaatcacgttcttttttcattatacgttcatcttttcctttagttgtaatcctgtaacagattctaatacatccatcgattctccaaatgtcatatcaaaaattgtcttgtcctctatgtatggaaactgtctgaaacgcttttctaacaccttcacagcatctgatgtaaagtttgcactatcaatgccaaattctgtttcaagaagaacgatccaatctagcacatgaaaacctaatccattgacgaatgaaataagtttttcttctgggtttgaagataagaatacttggcgttctatctcactaaaaagttcttctcctaagatttcagctaactcatcatcatgttcacgttcaacaagttcttcgtagccgtaatcatccacaagctcttctacttcttcactatcctgacaaagcaattgactaagaagtgcctctttcttaaattcactattttgtacgacttctaaaaagctcgtttcccatccattttctaatttcatattatgtactcctttatatacgtttcttatcatcactgtacccaaaagatcacttttataaccttttaggtagttactattatttcacatgattcataacaaaagatgcaaactcagctacatctccttcaaaaatatttatttctggcaagtgatagaacgttgtttggagcgggtttcctgcatgatatacatatatcgttttctctagtgcaatcgccattccaaactctgtatggctcccgtttccgccatctaatataagtaaaaatacatccgcttcttttacagcatttcgttctgcctgaccaatttctcttaattgttcttcattcgctgctctttcatttttggtccaatcatatgtatggtgccatcctgcatgtttcagttcatttgctacggaatgtacaagatgtttattttggaaacctgaggcgatataaaaattcatttatatacactccttcattgtgtatggggaaactcctttttagcgttatttgttatagctataataaagaacaatttcaaaaaaaatccccatctttaaaacttatttgcgtttaaatgatgggatgcttcatggtcttcttttattttttgttttttataactttcatcagctaacatttctagttcagctgttatctctgacttttcaagctctctttcttgcgaaaatttccttgaaatataaacaataacactaccaacgtacaacacaaagcatataataagtgcagtattttcatagagacttagctccaacacagtcactcctaatccattcgtattttcacgcctcattaattggaatttccctattaacccatttgttatcccgctatttgagggcagtaagactacctcctcaaaatttagtaacagtaaagaagttagatgtgggatgaacccaactgattaaagtttcactttattgtaacataaaaatatcaattcttggaatctttcaccctactaaaagaggcatgattgtttcatcatgcctctgaaatattttgaatgattgttttaattgcttcttttccattatatttttttagtgctgttttatacttctcattattttgattcaattcttcgacatactttataagagattttacagttacatcttcttcatataatacggaggcatacccttgcctttcaaaggactctgcatttaatatttgatctccacggcttgcaaatttcgataatggaattaaaaccatcggcttttgtaatgttaaaaattcaaaaattgcgttggagcccgcgcgtgaaataacaaaatctgttaccgctaatatatctggcagttctccatgtacatattcaaattgtctatatccttctttattttgtaaactttcatcaaggttaccttttccgcaaaggtgaacaatttgatattttttaagaagttctggtaatgcttctcgagccgtatcattaatttttttcgcgcccaagctgcctcccataatcgtaataactggctttttacgtgaaaaacctaaaaacgctaaacctttttcacgatttcccttcagcacttcttcacgtacaggagatcccgtatatattactttttctttcggtaaatgtttcgctgcttcttcaaatgtaacaaatattttcgaagcaaaacgaagcgcaattttatttgctagtcctggtgtcatatcagattcatgtaataaaactggtactctatttagccatcctccaattacgactggtacagatacgaaaccgccttttgaaaaaattacatctggttttagttttcgaatccttacatacgcatccataacacccttcattacaagaaaaggatcttttatatttttcaaatcaaaataacgacgtagctttccactcgaaatactatagtagggaatgccttccttttctataatcgttttctcaataccttgatgagaaccaatataagagatatcccagttgtcttcctgtaaatatgggataatggctaaattaggtgttacatgtcctgccgaaccgccacctgtaaagactattttcttcatacgtctcccccttctagactataatacactaaaatatcttgcctcagggtgagaaaataccatagccgttacggacgcttctggctccatcatgaatccttctgttaatgaaatacctattttcctctggatgaattaagcgaaatagcttttcttgatctgcaagttctggacacgccggataaccaaatgacactcgtattcctctatatttcgtacggaaacgttcttccatcgtcagttcaggtgagtccggaatgccccagcggtcacgaatgagcatatgtgttttttcagcaagtccttccgctaattcaagcgctaacgattgaatggcatgactacgtaagtaatcacctttcgccttccactcttcagcaatgtcccgaactccttccccaaccgtaacagataagaaagcaacatagtccatctcatctcctattgggcgcaaataatcacctaaagtacgatagggagcctttccttgtctagggaatgtgaaacgctctataacacgcgtatgatcttctggatcatatattacaatgttttgtccgtcgctttgcgctgggaaaaattgatacactgctttcggctttaaccaagattgtccttcctgcaataattcatctattaaatcatttaattcatgtgctctcttatctccctctttcaaaagcttcttcacatttccttttaatccaaggtgatgcccaagtagcatttgtctatttaaaaatggagcgagatgaagggccggaatatcgcgtaatacaattcgttttgttgaatcaggcacgataacttcagccttcggtaatgactcaattactgctggaatttctactttcttctcctctttttttacgatatgaagatgacgttcttttttatcctgtttcatcttctcacgctcttcttctttttgaagcttattaataatatcgagccccgtcatcgcatcactcgcataacaaacgagccctttatatgatggtgaaatccgattatctgtaaactttctcgttaacgctgcaccacctacaacaatgggaacatcaatatttgctgcttttaaatcttcagcagtcgttaccatttgttgcgctgattttactaataaaccggaaaggcctataatatccggcttcttttcttgtacttcttgaacaattcgatccgaacgtacattaattcctaaattaataatctcatatccgttatttgctaaaataatttcaacgagatttttcccaatatcatgcacgtcaccttttacagttgctaataatactttcccttttttcgcactatcactagattccatatgtggctctaaatagcttacagcagctttcatactttcagcactttgcaatacttcagcaacaataagttcattattattaaatagtcgtcctacctcatccatccctgtcataagcggaccgttaataatatcaagaggttttcttccttcttcaagcgcaagacttaaatcctcgtgtaatccttgtttcgtaccttctacaatataatttgctagtctttcatcaagcgttaacgtttcttgcacaacgatatctttctttttagcaactcggtaaaagtttgtaaattcttctaacgtctctttcgtcgtttcaaacagtagtgcatctgcaaggcgtttttcttcctctggaatcgacgcatagcgttctaatttttccgtattcacaatcgcgtaatctaaccctgctttcgtagcatgatataaaaagactgaatttaatacctcacgtccagccggtggtaaaccaaatgatatgttacttacccctacaatcgttaaacactctggtaacgcttctttaataaggcgaattccttctatagtcgctgctgctgaaccaatatattcttcatcacctgtccctaccggaaacacaagtgcatcaaaaataatatctgacgggcgtatcccatacttctttgtaagtaattcatagcttcttttcgcaatttctatctttcgctccgcactaaccgccataccgtcttcatcaattgttcctacaactatagcagcaccatacttctgaagaagcggtgtcacttttttaaatcgttcttctccatcttctaaattaattgaattaataacagcttttccttgaatataagtaagagctcgctccatcacattttcatctgttgaatcaatcataatcggtacttttaaaactttcgtaacttctgctaagaagttttccatatcttctatttcatcgcgatcaggatctgccatacaaatatcaataatatgagcatttttcttcacttgcgctcttgccacttcagcagcctcttcaaatttcccttctgctactaatcgtttaaatttacgtgacccaataacattcgttctttcacctacaaataacggtctcatagactcatcatattgcagtgcttctaatccactaattccatgtccttctctctcatgatggtcacgaggcttaagagatgctagcgcggatttcattgcttttatatgttctggtgtcgtgccacaacaaccaccaataatattaacccacccttcttcagcaaatcgcttcaccttttcagcaagagaagatggagattcatggtaatgtccat

SEQ ID NO: 1234 - DNA, 4691 bp, Bacillus thuringiensis
ccaacggcgcctcctatcgatgtaatgcttatgattttggcagtaattacagctgctggtgctttgcaagccgctggaggaatggactaccttgttcatctagctgaaaaggcattacgaaaaaatccaaaacgcattacattctttgctccaattgttacttatttatttacactttgtgcaggaactggtcacgttgcttattctgtacttcctgttatcgctgaagtctctcgcgaatccggaattagaccagaacgaccaatgtcaattgccgtaattgcttcccaacaagcaattacagctagtcctatatcagctgcaacagttgcacttttagcaatgttagctgactataaaatcaccttattagatattttaaaagtaagtatcccttctactttcatcgcttgtatgatagctgcatttgttgctagtaagatgggaaaagaattaaatgaagaccctgaatacttaaaacgattaaaagaaggattaattcctaagcttgaagagaaaaaagaatttgtaggtgtaaagggcgcaaaattatcagttatccttttccttgtaggaaccttccttgttgtacttcttggttcatttgaagcacttcgtccaggatggatagttgatgggaagttagcccgtctttccatgccgaacacaattgagatggttatgttaactatcgcggctcttattattattttctgtaaaccaaatgtagaaagcattgtatctggtaacgtctttaaagcaggagcaacagcagttgttgctattttcggtatcgcttggatgggagatactttctttaatggaaacttaaatatgattcaaggatcgattcagcatttagtaacaagtgcaccttggctatttgctatcgcactattcattctatctattttactgtacagccaagcagcaacagttcgtgccttaatgccacttggactatctcttggtattccaccagcgctactgattgcgatgttccctgcagtaaatggatatttcttcattccaaactatggaacaatcgttgctgccattaactttgaccgtactggtacaacaggtatcggtaaatacgtattaaatcatagttttatgattccgggcctaattgcaacatttacttctatcggcattggaatgctcttaatttcaattatgttttaaagaaaaagcacaaacctttatttaaaaaggtttgtgcttttttaatcaaatatttgtttaaattttgggcagtctatttcttcatgtagcacttaaaatactacacttccttccctacaaacttctctttacttcttcaactaattttctcgtactttcatacgcagattccgctaaactaattgctgaaataactgaaacaccgtccgcacccgcctctataactgccgctgtattttcaattgtaatcccaccaataccaacgattggcactgtaattccttgttctctaaaataagctaatcctttcgttccttgaaccgctttcgtatcttttttcgtactcgttgggaaaataggaccaacacctaaataatccgctccattttcgattgcaaaacgtgcttcttcaattgtatgagcagatacgccgataattttatctcccattttttcacgaacagatgtaattccttcatcatcttgtccaacatgaacaccatctgcatctaattcaatggctaattctacatcatcatttacaatgaaaggaacactatattccttacaaagcgtctgcaattcttttgcaaagcgcactctatcttctccgattaaagaaccttcccccttctcgcgaaactgaaaaagtgtcactccaccatctaacgcttctttcaatacagctaaaggatccctcgtgcagttattacttcccataataaaatacacttgcaatagcttagacattttatctatttcaatgcgtgccatttctttcactccctcttactctaactccacaatcttcccatacttctcaatatcacctgaagttgtattcgctaattgatttaaaaattcaatttggaaactaccaggccctttttctaccgccttagcagctgccagttccgaagctacaccataaaacgttaatgcggctactgctgctttaacataatctttttccactgctacaaatgctcctattacagaagttagtaaacaacctgttcccgtaactttcgttaaaatagggtgaccatttcgaataacaatagttctctctccatctgtaacaacatcttcttttccagtaatgaccgcaactgtatttagttcatctgctgcctgccttgcaatacttacaatattgccatttccagtaccagcgtctacccctttaatttcccatttctcattaataacatttgctatttcagctgcatttccgcggataattgctaaatcgatttcagccggaatatgtctcgcaacttctgttcgatatgaagttgctcctgcaccaactggatcaaatagtactggcacattgttcgcatttgctgatttacccgcaagtaacatcgcttctacttcttcaggacgaagtgtccccatatttaatactaacgctccagcaatgctagccatttctgctacttcttcttttgcatacgccattacaggcgatgccccaagtgccaacaaaccgttagcagtaaaatttgttacaacaacatttgtaatattatgaacgagcggattagattctctcaccaaatccactactttactaatttctttcatattcatccttttcatctcctaactataatgatgggagatacacaaaaagacactttgcgcgtacgcaaagtgcctgaacatgtgcttttacactctccctacgctggcattatccaacaggttcaaatggtcaatgacggactagtagtcatactctcagtttgtatccacaaactcccatgtgcttattattcatctacttcaaagtctactcttattctagtaaaataacaagttctttacttttctatttaatatagaagcaacctatataacaataaacataatcaagtgaaactttaatcagtgagtgttttgttcatcccactaaaaaccgatcaaatatggagcgaaactgaatctcaagaagatgtatgctatatttaacttatggaaatttgaaaggatgtttttaatatgtcaaaaagcgttgtaatcgctgaaaaaccttccgttgcacgagatattgctcgtgtactgaagtgtgataaaaaaggaaacggctatcttgagggtagtaaatatattgtaacttgggctttaggtcatctcgttacattagcagatccagaaagttatgatgtgaaatataaaaagtggaatttagaagatttaccgatgctacctgagcgtttgaaattaacggttattaaacaaactggtaaacaatttaatgctgtaaaaagtcagctacttagaaaagatgtaaatgaaattattgtagcaacagacgctggacgtgaaggggaattagtcgcacgctggattatcgataaagttaagctaaataaaccaatcaaacgtttatggatttcttctgtaaccgataaagcaattaaagatggttttgcaaatttaaaaccaggtaaagcctatgacaatttatacgcttcagcagttgcacgttcagaagctgactggtatatcggtcttaatgcaactcgtgctttaacgactcgctttaatgcccagttaaattgcggccgtgtacaaacccctactgttgctatgattgctagtcgtgaggatgaaataaagaacttcaaagctcaaacttactacggcatcgaagctcaaacaatggagaagctcaaacttacttggcaagatgcaaatggcaatagccgtagttttaataaagaaaaaatcgatggtattgtaaaaagtttagataaacaaaatgctactgttgtggaaattgataagaaacagaagaagtcattctctcctggtctttacgatttaactgaattgcaacgtgatgcaaataaaaagttcggttactctgctaaagaaacattaaatattatgcaaaaattgtatgaacagcataaagtactaacgtaccctcgtacagattcacgctacatttcatctgatatcgttggaacacttccagaacgtctaaaagcatgtggtgttggagaataccgtcccttcgcacataaagtattacaaaagcctatcaaacctaacaaatcatttgttgatgatagtaaagtaagcgatcatcatgcgattattccaacagaaggatacgttaacttcgcagcattcacagataaagaacgcaaaatttatgatttagttgtaaaacgtttcttagctgttttattcccagcattcgaatacgaacaactaacgttacgcacaaaggtcggcaatgaaacattcattgcacgcggaaaaacgattttacatgctggttggaaggaagtatacgaaaatcgatttgaagacgatgatgtaactgatgacgtaaaagagcagattctacctcacattgaaaagggcgatacattaactgtaaagttacttatgcaaacatcaggtcaaacgaaagcacctgcacgctttaatgaagcaactttactttcagcaatggagaatcctacaaaatatatggatac

SEQ ID NO: 1235 - DNA, 7592 bp, Bacillus thuringiensis
ccaaggtttgctaccataaatgctaatacacagaaaatgaaaacgactttttgataagaaagctttggtaataaggaagagaagtaatcaccacaagctgcaacaatacctacagaagttgttaaacatgctgctgtaattgcgatccctagtaataaagttccgtagctaccaaataaatgattcacgacatttgttaaaataattcctccgtttgcgcccattccaagtgacacactagaagctccaagataagcaagtgctaaatacacaagtagtagaccaagtgctgcaataaatcctgcaaagattgttacttttgcaatactgtttttatttgtaattcctttttcttttaacgcatgaattacaacatttccgaataccagtgctgcaagtccatctaaagttaaatatccatcaataaatcctttaaagagaggagcactatacgcttctgtcggtgcaccaaattctccaattggtgtaataagtgctttacctacgataattgcaataacagctaataatattggagttagcaccttaccaatacgacccactaatttcgaaggatttaaagctaaatagaaagtgactgcaaagaaaataagtgtaaagataacaagtggatatgactgaccagctatctcacttggtaaaaacggtgcaacactcatctcataagctactgttcctgtacgcggtacacttacgaatacgcctaaacataaataaattgcagtgataaaaacaagtgcgaatataggatgtacacgtcctgctagctcattaatatctccctttaaagctataacaattactcctaataaaggtagtccaacgcctgttacgataaaaccaaacagcgcgatccatacgtccgttccagcaccttgccctaacgctggtggaaaaatcatattacctgcaccaaaaaacagtgcaaataacattaaacttattgcaaacatctccgaaaactttaaagatgatttcattcctactaacctcctaaaataattaattaacaaaatattctgaattaaaatccgtcacatatcctctttcaagcatacttccccgtaaaagaacgcaaaaaacacccgtccctaacaaagggacgagtgttgaaatcgtggttccacccttattctaataaaatgaattcataacgaaataagctcattttatagctcgtgtaaattgataacggttttatccgccaagaattacaatgcatcatgtatgcagttcactcttgaagtttagaggtggtaagcttgtcttttcgtattaggaagctcacagcctaaggcttccctctctgagaatcgtaaaatacaactcatgtcctcatcattacttttataaaatatcttgtcgaaacttgttgttttttattatatgggctattttttaaaaaatcaatagttttattttttctgacaaaaaaatatagggagaaaattttccctccctataactgccctattaaaatttctaactcttcagctgtaacgctccgccactttccaacttcaagctcatttagctctatattcataatgcgtactcgctttagctttattacagtaaatccgaaagcacgactcattctacgaatttgcctgttcattccttgcgttaaaacgatacgaaatgttgattgatcgactcttgtcactttgcacggcttcgtcattccatctttaatctttacaccgctggacatctcattaataaaccagtccgtaaaaggtttatcgactgtgacaacatattccttctcgtgctcatgatcaccatgtaaaattcgattcgcaatgccgccgtcattcgttaataagataagtccttccgatactttatctaatcgtccaactggaaagattcgctctggataattgatataatcaataatattatcttcaatatgatcagctgctgtacaagtaattccgactggtttatgaaaggctatgtacaccttttctttctcttcttttacaataacttgcccatcaatcgttacaacatcaccatcgctcacaagttcaccgtgcgtacatatttcaccattaatagccacgcgtccagctttaatgaggcgatctgtttcacgtctggagcatgattttgcttcgcttatgtattggttgattttcatgttctattccttttcacatatattaaaagcgtcaatctatggcaatatcattctgccacgattgacgctttttcacttcgcaaaaacaactaaataaataaccccaatcaccaaaaatattccgcaacaagctaacaatacttttgcaagtttgtccataaacatataatggtttcccctttgtttcgttgttttctattttaattcgacaactgttacgcctaggcctccctcgcccatgtcaccgtaacggaaggtttttacaccgcgatgcttcttcaagtaatcttgtacaccttggcgaagtgctcctgtccctttaccgtgaataattgatacgcgaggatagcttgcaagctgggcatcgtctaagtatttctcaacgcgcgccattgcattttcaaatcgctcaccacgaaggtcaagttctaatgaaacgtgatagtctctaccttttaccgttgcaactgcttttttctctgtttgcttcggtgtgttaatgtattccatgttagattcttttactttcatcttcagaataccgatttgtacgctccactcagtatcgcttactttttcaagtaattgacctttttgaccgaacgttaatacttttacttcatcacctgcacgtaactgttgtttcggcgcagtgtttttcacgtttactttttgtttcttaacaagctctggtgctgcgccttctagacggctcttcgcttcaattaactcgtggtctttcacgtttgcaagctgtgctttacgcaattgacgaagttcttgaataatgccttctgcttctttctttgcagcttcgactttttcttccccttctttttgcgcttttaataatcgttcatcgcgatcttcgttaaattcaataatttgacgttgtaattcacgatgaagtttttcagattgtttgcgaagtgcttctgcttcgttccagtcacgctctgcgttcttctggctttcttctaacttcgcaatcatattttcaattttattcgtatctgtactaatgtggttgcgtgcttggtcaataacgcgatcagataatccaagacgtttcgaaatttcaaaggcattactacggcctggtacaccgattaataatttataagttggacttaatgtatttacatcaaactcaacactcgcattaataacttgctcacggttatatccgtatgcttttaattctggataatgcgtcgttgcaacaacgcgagcaccgcgattacatacttcatctaaaatcgaaattgctagtgcagccccttcttgtgggtctgttccagcacctaattcatcgaataaaactaagctttcaaaatcagctttttctaaaatatcaacgatgttcaccatatgtgaggagaacgtacttaaactttgttcaatcgattgctcatcaccgatatcagcaaatatatttttaaacacacaaatctctgactcatccattactggaatgtgaagaccagattgcgccattaaaacacaaataccaactgttttcagcgtaactgttttaccacctgtattcggtcctgtaataacaattgtcgtgaaatctttacctaacataatgttatttggcacaataatttctggatcgattagcggatggcgagcttgtcttaaatccatataacgctcgttatttacgattggtttcgttgctttaattcgctttgcataaaaagctttcgcaaaaatgaaatcaagattcgcaactacttctacgtttgataaaacgatatcggcttctactgccacttcttctgttaacatcaataagatgcgttcgatttcttgtttctctttcacacgagcttcttgcagtgcgttatttaattctacaatgacttgcggttcaataaataacgtttgtccagaagctgattgatcgtgaacaataccaccatatacgccgcggtattcttgttttactgggattacgtaacgttcgttacgaatcgttacaatcgagtcagacagcatcttttgcgcatttgaagagcgcgtcatattttctaatttttcacgaatacggctttccgcagtacgaatttgagtacgaataccacgcagtttatcacttgcgctatcgactacttcaccgccgtcaccgatacaatttgtaattttcttttctaaatcatataaagatacaatttgagcgacgtgagtttctaaaatcggaagctcgacaccgttatcagccatatcttcaatgaaacgtttcatattacgactaccatacatcgtattcgcaatatcaagtaattcatttggacttaacatactcccaatttttgcacgcttcacatttgagcgaatatccgtaataccacctaatggtgcactaccttttaaacgaataactttcgctgcttcatccgttgtatcttgcatttctacaatttcttcaaaatcagtgctcggcactaaatgcttcactttgtcacggccaagtgaagaggctgtatgttcaagtaattgttcttttactttattgtattctaatacacgcaacgttctttctaacatgttgcaggtcccccttgcgttacttattacgtttaatatagtctaataaacgttcaatatcccatgtgttaatcacgttatctttttgaatccaacctttacgtgctgctgctacacctgtttccatatcttctaacatttcaagtgtatgagcatctgtattaatcgctacttttacaccagcatcttgtgcttgttttaataatttagcgcttaaatctagacggttcggattcgcatttaattctaaaactgtatttgtctcttttgcgagttcaattaataaatctgtatctacatcataaccctcacggcgcccgagaagacgtcctgtcggatgagcaatcattgtgacatgtttattctcaagtgcagtacgcagacgcttcatgatcgtttcacggtcttgtgagaagctagagtgaatcgctccaataacatagtctaattcttctaatacttcatcatcaaaatcaagcgaggcatctggtaaaatgtccatttcaattccgcgtaaaattgtaatgtctggatacttttcattcatacgttcaatttctttcgcttgctcacgaagacgctctttcgttaaaccattcgctacttttaagtattgcgagtgatcagtaatcgccataaacttatatccacgagcacggcacgcttgtaccatttcttcaatagaaaaagcaccgtcactccaagttgtatgcatatgtaaatcaccttgtatatcggaaaactgaattaagttcggatactctttaattaattcaatttcttttccatcttcacgcacttctggcggaataaatggtagaccgaaatgagcaaagaagtcttcttcagtctcaaatgttttcacttcacctgtttctaagttctctacaccgtactcactaattttctcgcctttatcttttgcgatttgacgcatttttacgttatggtcttttgatcctgtgaaatggtgaagtgttgtaataaactcttctggttttactaagcggaaatcgattgaaatatcatattcatattgaagacgaacagaaactttcgtatccccacttgcgattacctcaatcatattatcgaattgtagtaaatgctcacgtaccgttgctggttctgtcgttgcaatgataaaatctaaatctttcactgtttcacgaacacggcgcaaactaccagcgcgagagaaacgaattacttcagcaatattcgacaatttctcctctatttccccggcaataggcaataccatcgcaattggtaaacgctctggacgagagcctacttgatcgattgcttctaatattttctcttctgtcttcttaccgaaaccagctaaagcttgtactttattttcctcacaagcagcttttaacgtctccatatcaataacgcctagctctttatataacttagccacctttttaccaccaagacctggtagttttaataacggcaataagctactcggtacttctttttcaagttcttgtaatacttcagatgttcccgattctatatattcttgaataacggctgctgttccttttccgatgcccggaatctttgtgaaatcttcaatctcagaaagactacgatcgtcactttctaatgctgctgccgctttacgaaatgcagatattttaaatggattcgcaccctttagttccataaaaagcccgattgtctctaataatttgataacttgttttttatttactttcatcattaccccgcctttctttcatagaaaaaaacttctctttccgaaaaaagagaagttatactctgctacctgtctgccatagttccttcaccttttcagatagaatcggtgtatcgtctacaattattttgctaattgatgatttttgtaatggtgtttgtacttgttcaatcggaagaatgtttccaatgataattaagacaaacaaaacaatatatacttctaaaaatccgaggattgcccccgcaaacgcatttacttgctttaaaaccggtatttctgcaaacatatttaacaaattaccaagtaatgaaagtgctatttttgtaataataaacaatatgataaacgcaagcgcttgataaaatactgtctcaatattatttgcatcaatccattctggaacagatacgtttttatcaaatggatacggaataaatttcgcaagtgctggcgctaaatctttacagtaccagtatgcaacaaggtatgcgataataaagcttgttaactttacaagttgcagaataaaccctctgcgtaagccgaggaaaaatcccataacaagcagtaaaatgataataatatcaatcatgttattccattcctttttttgtcatactttctttcaatttctcatgttcttcttttaattttatgtaatcgtgtatgacgtttaccgccgtcaataccgctagtctactcgtgtcaagcgaaggattcttggcattgagttcgcgcattttatcatccacaatcgctgctaccatgcggatatgacttgtactttcatcgccaacaactgaatattgctgaccatagatttctacattaattcgacttttctttcccttttgttgtgacaactcaccggcctccaatcacgtacagaatcctaaagtttatcataccatgaaccttcataatatggaaacagaaagaacaatccgatatgataaaaataacaatataaaaaaaggggcgaccattatgtcaaatgctatcgtaaattagacaaattctacagtaattgaagacatgaaacaacaatataaacattcacttagcccgaaaattccgcaaggcggtatctctatggctaaggtgccatcttgcacgattacagcg

SEQ ID NO: 1236 - DNA, 9189 bp, Bacillus thuringiensis
aatttggctaaaagtccgaataaagtttccgaaaaaaaaaaagtttagcattggccttttcgtttttgcaccacgcaatttcatttcgattgttgctactttatgaccaatagctcctaaaagccctggatttccacctgttcctgaaatcagaaatccatcatataattcgcctctaagttgcacagcacgtcttgataaaaaagaacccatactatggccaagtaaaaataacgggcatgtctgctcttttcttaccgtttctgatacaaaaataacatcagacacagcctcattccaacctacatttggtttaaaatgaccataatcttcttctcttttcactgttttcccatgacctttatgatcatgtgcataaacaccataccctgcttctaataacgcagcaataaagtctgtataaacacctgcatgttctgtcataccatgtgcaatttgaataatccctttcggtttaccttctggcaaccacttgcgtaaataaatttctgatccatccaatgccgtaacgaaactttcctgtacgttcatttcgtcagctcccaactctattatgtatctttaaaaatgaatatcgattcatttttcttactatgtattatatgcaattgccttcattatgacaaatgactaccttttccaattagctcaataactattatgttgacgaatcgaaaataaaattatatagttacttacataaagtaactgtataatttttaggaggtttctactattatgatgccatcattatttttagcacatggttcgcctatgctcgctattcaagatacagactatacacgatttttaaaaacacttggagaaacatataaaccgaaagcaattgtcattttcactgctcactgggaaagtgaagtattaacgatttcctcatcagataacgagtatgaaacaatttatgattttggaggttttccccctgagttatacgaaatcaaatatcgtgcgaaaggctcttctagcattgcatctatgttagaaacaaaatttaagaacaaaggtatttcagtccatcataatatgacgagaggtttagatcatggttcatggacactcctgcaccgcatgtatccagaagcaaatattcctgtcgtgcaaatatcagtcaatccattcctttctgcaaaagaacaatttgaaattggagaagcacttaaaggactcggacaagaagatattttagtaatcgggagtggtgttaccgtccataacttacgagctttgaaatggaatcaaactacacctgaaaaatgggcaattgaatttgatgattggattattaaacatatgcagcataacgataaagatgcattgtttaattgggagaaaaatgctcctcatgcacaattagcagtaccaagagcagaacattttgttcctttatttatcgctatgggaagtggtgaaaatagcggtgaagtcattcaccgtagttatgagcttggtacattaagctatctatgtcttaaattttaaagaaaaggatgaagcaatcattgcttcaccctttttttattcactaagttaactaacttccaaatgttgtttctctgatacctcttcgttcttattatgaaaataaacccagatacacgcaataaatagtagtgatgatgtagagaggaaaacatattggaagcctgcatgtgctgcaatttgccccccgagcactggaccaatcatatttcctaaaaactgaaatgattgattatatccaaatatccgtcccgtaacatgggttggtgtatgttgttttagtagagtttgtacggaaggtaataatcctgcttgtgcgatacctaataaaaatcgaagaattaataggtgccaagctgaggttacaaatgcttgcgggataaaaataattcctgcagcaaataacgctacaactaacgttttttgaggaccgatatgatctgataatcttcctagtcttggtgctgccaaaataacggctaatcctgttgctgacataactgctcccgcaattgtttcaatatgtgcagtatgaggacctactaaatttttcacgtacaatgtaacaattggttgaactgacatattagcaagttgaataataaatgttgttacaaataaactaataattaaatgcttcgctgggaccatcgtccatacttttttcggctgtgttttttttgcttgagcagagtgattttcttcatgcaagaagaaaaaaacgatgagaaaggaaaggaataaaaaagctcctgtaacaagaaagacatgacgcattccaattaactcagacaaatatccaccaagtaatggaccaagtaaagaaccgctcacgccaccagttgaaattgtagaaattgcccaacctgaatgttctttcggagtttctgctgcaataaatgtcattgcggttgaaaggaaaccagatactgctcccattaaaaatcttagtgcgactaattgatatacatccgttacaaaccccataagcgtcataataatcgccataccgaggctagcacgaataagcatcagtttccgtccatgtatatcaccaagctttccccatattggcgatacgatcgcacccattaaaaatgttacaccaaatgcaagtcccgaccactgtgcaatacttgaagtgccagttactcctaattcctcaatataaaaagataagaaaggaattactaaactcataccggctgcagtggtaaaacaacctagccaacaaatcattaaatttcgtttccagctggccattttcacaccttctttctttagatacccattctacaccctttcttgtaaaaagtttagtaatttgctttttatgcaagatttactacaaaacccgctattttctagtaaaaaccactacatctctacatcattttcataataaaaccaactcctctatatgaagttggttacttattatctatcggtattaaacgagcattacaatttctctcgtaaaactcaatgggacctgcttgtccaataatcgcatattcatatccatcttgcttcatattatataaacaatgatacaataattcttttcctacacctttcacacgattttgtttcgctatgcccattggaccaaacaatcctttctttcctctcactacatcgtaacaggcgaaaccaactattacttcctcctgctgtgcaatatagataggtaacttttcattatatgtccgatatccgtaatcaaccgactgtaaccaccgttcaccaaattcagccgccacaaatcgtgataacttatcaaaatcagaaggactagctcttcttacatgacaaaataatgtattataaatagatttaaaactatttaaatcaaccgctaagtctctcggtgcagctgtaatacgtaatatatctttttgcatttgtgtatgtataaattcaccaatatctgtatctacacgaaataatgcatacataacatgtccttcattgattactacttgctgaaagcgttccatacgtttcttcgctatttgtaaaatttctatcgccttataagatagtttatattgtcctatttttttatactcttgatgatgtaaatcgaatcgttttcgtaacgaaagtttttctaaaaaatctggaccgactttatgaaacaaatacataaataactcagcgcaaactcctgtaccttctttacacatacctatgaacagatggactggttgaattatgttatactcactctcttctgctgcaatctccaatattttatgcacacgttttgtaaattgaaattcctccatatgtgtttccaccctctactaatttactaacaaaccgtaaccataaataattgaaacaattacacctactaccaatatacctggaagtaaatttgccaccttgattttaataatactaagcaagttcaatccaatagcagatatcataatgccgcccgtagccgtcatctccactataaattggttcattaattcttccgggacaaaactattaatttgtgttgcaaaaactgcaataccaccttcatataaaacaactggaatcgccgaaaatactacgccaattcctagagttgtcgttaatataatagaaataaatccatcgataattgccttggtaaataaaatattatgatttccgcgaatcccactgtcaagtgcaccaagtatccccatcgcaccaattgcaaaaattaaagtagctgttacaaaaccttctgatatgcttcctttccccttcgatccaactttattttctagccaatcccctaaattttttaacttttcttctaattgtaaccactctccaattaccgtaccaatcactaaactcagtatgacaacaagaaagttttcactttttaatgccatttgaagcccaagcacagtaaccgctaaaccgattgcgtgcattatcgtccctttcatactttctggaatcctactaaataatttaccaagtaaagtaccaaatataatacaaattccatttacaactgctcctaatataaccatttctcattcttcacccttcgaattctttatttctatattttggtttatacattgatttacaggttatctatatgttaacttaatattgagaatattaacaaatgttttccactacataacccgctgtttttttgtaactttaattacctttaatagattcagtgttaatttaattgcgggataatattaaaagggaaggtatatatgaaaactttactaaaacgatttttgttaatagcctttttcattacaccgattgttttattaatcaattactcttttatttcaaaagcaaaagacaaacccgatttacaaaacaaatctagtaaaaccgcttcaaaaagcgaaaagaaaatagaagaccaagaaatcacactcaccttctctggtgatacaatgtttgattggcaataacgtcctataatcgaaaagaatggggctgattacccattccaacatgtaaaagaagaaataaaaaaagctgatatttcttttgtgaatttagaatcggcatttacaacgaaagaaaagaaagcacctgggcaactcttttggattaaaagtgatccatctacactacaagctattaaaaacactggatatgacatcgtaaatattgggaataaccacacacttgattatgggcaagatggattattagatacgatttctcacgtagaaaaattaaagttcccttacattggagccggaaaaaatgcgaaagatacatatacagcacgagaaatgaccgtaaaagggaaaaagtttaaatttctttccttcgttcgatttatgcctgattctaattgggtagctggtgagaataaacctggcgttgcgaatggctatgatttaaatcttgtaacaaaaacaattaaagaacaaaaacaagatgcagactatttaatcgtctatatgcattggggcgttgaaaaatcaaaccgtccggtagaataccaaaagcaatatgtacctaaaatggttgaagcaggagctaacgcgattgtcggaagccatccacattggttacaagggtttgagtattataataaagttcctatcgcttactcattaggtaactttttattcccaagttatgtgaatggaaaaagcgccgaaactggcgtattaactttaacttttaaaggaaaggatgtccaaatgtcattcaatccttatatcattcgcaacaaccaagtttcccctgtaaatgaggaagaaaagaaaaaagctcttcaatatttacaaacaatttcaactgatgtagaaattgatgatacagggaaaataaaaaataaacgaaactagacagctcaagatctatttctctgtaatctactttacagaataggtgataaacatgctgaaaaacttattagaaaatgtaagtttgttagaaaatatttataaaatgtctatagccgttctacttttatgttcagttttttctgttagatttctaaaaaaaataaaacgcgaacgaaaacttactacctttgaatttactatgtatgtaattattcgcattgcgatatttttttggttaactagctttattcttcttgaatttaatgagtatctagtttaactataaaaaagatagaacaagcactatatttctttgcttgtatctatcttttttatttagatgcttattcttcccttctattaaataagcaaatcaaacaaaacagggtttttattaagctccataaattgaatattattttctttaaagcgagtaattaattgctcataatcttctttatgttttaactctactccgactaatgctggaccattttccttattatgtttcttaatatactcaaaacgagtaatatcatcttctggccccaatcctttatcaagaaattctcttaacgcgcctgaacgctgtgggaattcaatgatgaaataatgctttaacccttcgtaaatgagagatcgttctttcatttcttgcattctatcaatgtcattatttccaccacttagcgtacatacaactgttttaccttttatttcatccctgtataaatcaagtgctgcaatagagagtgcaccagccggttcagctacaatcgcatttttcttatacagttctaaaatcgtcgtacaaactttcccctctggtactaaaacgatgtcatcaattacatctttacaagtttcaaaagttaactttcctacctttttaaccgctgccccatcaacaaaactatctattttctctaatgcgacattatcattttgaagaaaagcctctttcatagaggcagctcccatcggttctacaccaataacctttgtagtaggactaacaccttttacatatgtaccaacacctgatgctaatccaccaccgccgattgccgtaaagatataatcaaccggtttctccatatcatgcataatttcaactgccactgtcccttgaccagcaactacatacggatcatcaaacggatgaacaaatgtcattctattttcttcacaataacactgtgcttcttggaaagagctatcgaatgtatcaccaactaatacaatctctgcgaaatcaccaccgaaaaattgtacttgtgatactttttgtttcggtgttgttgtgggcataaatattttcgacggaatcttcaataaattacatgtataagcaactccttgcgcatgattaccagcacttgcacaaacaacaccgttttgtaacttttctttcggtaaactttgaatcaaattgtatgcaccacgaattttgaaagagcgaattaattgtaaatcttctcgttttacataaacgtcacaatcatatttctcagataaaactgtatcacgttgtaacggtgttttaataacgatatctttcatgcaattatgagccattaagatatcttcaattttcactctctcctttaccttttgcaccattatatatcatccttatctcttttaaattggctcaatcaaaatgtgggattttcagaacagcccctgtattcgccgatgttaccatttgtgcataacgtccaagccagccagttttcactttcggttctggtcgtttccattcttttttacgcttatctaattcttcattactcactcttacttctagcaagcgttcttcaacatcaatacatacaatatccccttgttcaagaagtgcgattgttccaccagctgctgcttctggtgaaatatgtcctactgaaattccacgtgaagctccagagaaacgtccatccgttaataatgcaacctcagcacctaatcccattccagcaattgctgatgttggtgctaacatttctggcataccagggccacctcttggtccttcgtaacgaatgacaactacatctccttttttcactttcccaagcataatgccagcaagtgcctcatcttgtgaattaaaaataacgcaaggtccttcaaaacgctttacctctgttgcaccgcttttaataaccgctccatctttcgcaaggttgccttttaatatacgcaatcctccttcctcactatgagggttttcaagagagtgaataacttccttatctttaatctctgcctcagcaatattttctcttaatgcttgcccagtagcagttattcgatcaagatgaagtactccttctttccggctcatctctttcaaaattgcactaatcccgcccgcacgatcaatatcttccatatgccaattggaagcagggcttactttacataaatgtggtacacgtcttgaaacggcatcaatacggttcatatcgtaatctaatccagcctcttgcgcgagcgccaatgtatgcaacactgtatttgttgaaccgcccatcgccatatcaagcgcaaacgcatcatcaattgcttcttccgttacaatgtctcttggtttaatatctctttcaattaaaattttcaatttctctgctgcttgtttaattaactcttcacgtcttggatcaattgctaaaatactcccgttaccaggaagagctaaacctaacacttcacataaacaattcatagagttcgcggtaaacatacccgaacaagagccacaagatggacagccatgatcttcaatatcttttaattcttcttctgaaattttcccagattgataagctcctactccttcaaaaacggaactcagatcaacaacttctcctttagatgtttttcctgctgccattgggccgcctgaaacaaacacagtcggaatattaatacgtagtgcagccatcatcatacctggtgtaattttgtcacagtttggaatacaaatcatgccgtcaaaccagtgtgcatttacaaccgtttctactgaatctgcaattatttcacgactcggaagagaataacgcataccgatatgtcccatcgcaataccatcgtcaactccaattgtattgaattcgaatggtaccatacctgcctcacgaactgcctcttttacaagtttcccaaactcgttcaagtgtttatgccctggaataatttcaataaaagaattacaaatcgctatgaaaggtttatcaaaatcttcatctttcaaaccagttgcttttaataaactacggtgcggcgctttatcaaaaccttttttaatcatgtcacttctcaaaaataa

SEQ ID NO: 1237 - DNA, 9012 bp, Bacillus thuringiensis
cttttaaacatctctcccgcccaccccccaagcgctatctagaagctatattgaatatcacgttgaaaatgaattattacctgacattcctgacttatacgttattcattccatttatgaagacgataaagacggcgagcctacgcaatattggtttcatacacacggtcttttaagagcaggcgtaactgaaatagagctaattattccaaatcgcatttcttcctactacggcattagcgatctctttcaaacatttgctaataatgccgctgagaatggacaggtccctatgaatgagcctatcgttatcgcacatagtcagcacggttctatacatacagtcgctgttccgtgggaaaaaggattatcttatatagggcataaaacgagtatggaccaatcatcttcaatcgaggatgaagaagtgaaactacaaccaatagatgcacaaaatacattcttaggcggtatggatgaccgagatgaataccatcaatctccatctgttctcttattcaaatttaatacttcagaagaatatattgaaagctttttccaagaacacgaggaagctacagggctcatgttctataaaacaaatagtgaaactgatcgtatggcttacaatgcgaagaatactttcgggtatttcagcaacatttttcacattgaacaatcaaatgaagattttcgtttccttgctaaatttggtgtatcctacgaagagggaaaaagtgaacatatgtggtttgaaatgcaaaacattacggaagatttcattcaaggaatactcattaatgaaccatattttatagaagatatgagtgaaggaaatagttatcatttagattttgataacttaacagagtgggttatttatgcaggagatgctgttataaagccaaataacttatatatgtttattggcgaataagtattttatataagaaacgaaacgccttcaatatgattgaaggcgtttcttataatttattgagcgattaattcagcatctattactttctccaaatgagataatacacgctttgcagcttcctcaccttgattaatacagtctggaagtccagcgccagcataggagctacctgccaagtatatacctggcaactctttctccataaatgttgtgagctgtttcattcgctcgttatggcctactgtatattgaggcatcgcttctttccagcgacttacaattgtaaactctggatcctctgtaatgtccatcgtcttctttaaatcttctagtacgagctgaacgagttcttcttcagtttgttctacaaccgcttcatcaccagcacgcccgacgtagcaacgaaggagtgtttttccttctggcgttgtatgcggccattttttatgcgtccacgtacatgctgtaatggtgtaatcgctatttcgtgatacgacaaatcctgtaccattaatatcacgctggattgcagacttttggaaagcaagtgccacatttgcaacggatgtggatggaatattacggaagaaacgaaactgcttgtactgagcaaacatggacggcaatactttatgcgaagttgccactacgatggcgtccgcttctatttcttttccgttactaagagtaattgtataaccatcaccctgttttgcaactttttcaatgcgagttccctttattatcgtaccttcatgcatctttacttcgagagattttacgatagattctaaacctgttttcactgtttggaacattccctttttcggttcagctttctcttctttcggagcgagcgtacgcataccgagtgaaatactgcgatgtttctgctcaatctgatacatttgcgggaatgttgacattaagctcatttgatcaatatcccctgcataaatacccgatagtaacggttctattaagttttcaaccacttcgtttccaagacgatgtctgaaaaattgtccgagtgattggtcagatactggctttgacctcggcattaatagatcaaaaccagctcttagtttaccaattggggagaacagcccggaaaatagaaacggcgtaatttgcgttggaattcccatcattgatccagtcggcattttatgtaaccgattgtttacgaggataaatgattgaccagcttgattatttacaagttcatcgccgagacccaattctttcactaatctagctgcactttcttttcgtgctaagaaagaatccggtccgcgctcaattgtaaacccatcttttcgaacggtttgaatttttccgccaagtttacccgatgcttctataagtaatgtatcaatcggcaagtttttttcatgaatatttttttgtaagttatacattgctgttaatccagtaatacctccgccgacgatcacaacttttttcctcaagcaggctccccctttcttcttacagtacagattcttttttctttaatacaacatctgttaaacaatcaataaatgcgtccgatgcatttggcatttctggacgataatatttcgcaccaatttcatccgttacaactttacactcaaagtcgttgtcatataaaacttctaaatgttccgcaacaaatccaactggtgcatatacgaatgaagtataaccgtgcttttcatttagttctctcgttaaatcttgtacatctggaccaatccaaggatctggtgtgtttcctgcactttgccagcctactgcatagtttgctacttcagctccgcgcgcgatataatccgctgtttcatttaattgatctggatatggatcgcccattgcaataattttctctggtaagctatgtgcagatacgattaatactgctttttcacgctctgcatctgacataccgttatatatacctttcactgcatcaacccagtactggatgaatttcggctctttataccagctatcaatgccgtgaattgttaagtttccaagtttctcagcttcttcttgtgctcgtccaacgtatgatttcacgctaaacgtagaatagtgaggtgcaagaacaagtgcgattgcatcttgtattccgtcgttatgcatatctttcaccgcatcttcaataaacggttcaatatgttttaaaccaagatacatatggtactctacttcatcttgtacttcatttaaacgctgttctaacttcttagcttgctctaatgtaatagtagctaaaggagaaataccaccaattgcacggtaacgctctgttaaatcttccagcatttcaggacttggctttcttcctctacgaatatgtgtatagtaacgttcaatatcttcttctttatatggcgttccgtatgccattacaagcaaaccaattttctttttcatacagcaattctcctttacttcgctaactgccctttagagtattcatgaataaatgtagttaaacgttttaatgtatccggatttacttctgggaatacaccgtgacctaagttaaagatataacccggctgtttcatcccttgatctaaaataccttttacatgttcttcaataacagaccatggtgcaagtaagaatgaagggtccatattaccttgtaccgccttatgaacgccacgtgcacgtgcttcttcaatcggtaagcgccagtctaagccgactacatcaagcggtaagtcgtgccactcattcactaagtgtgcagctcctacgccgtgcataatcatcggtacacccatcttacgaacttctgcaaaaatacgctccattgctggtttaataaatacgcgataatctgctacatttactgttccaacccaagaatcgaaaatttgaactgcttttgctcctgcgtttatttgcgcttttaaatatgtaataaccatatctgctagtttatccattaaagcaaaccaagcttttggctctgcatacatgaacgctttcgtattatggtagttacgagatggaccgccttcaatcatatagctcgctaatgtaaatggagctcctgaaaaaccgattaacggtacgtctaacatttctgtcgttaataaacgaattgtatctagtatgtacggtacgtcatcttctggattgatttcccctagtttttctacgtcttgtaaagaacggattggattatcaataactgggccaatacctgatttaatttctacatccacaccaattgcaggtagtggtgacataatatctttataaagaattgctgcgtctacgttatattgatcaaccggcaattttgtaacgtaagcacataactctggattatgtgtaatttcaaataaagaatacttttctttaatctttctatattccggctgtgaacgacctgcttgacgcatataccatgctggtacataatcggtacgttcccccctacatgcttttaaaaatgtctcatttatagttcttaccaagacccttgctcccttccttaccaatgcttcgaatacgttcgatatttatctttttttactatacagcttgtaaaaacaaaatgcataatattatgtacgttgttcattaaattgacacaaacattcttaaaaacgcttactattttcacaacattcttattataacacagagaaaaactatggtttagctacttttgacttttctccttcacgattcgtttgtgtattatatggtacaacgtaaaagctcggttttgaaaatatgttaacgaacttttcctcatattccccagcaccatttacagtgctaacatgtgtatgaattccgttctccactctatagattcggtacataattctgttatctggaagtggtttccaacttaattttgctttaaataaaccgaaagggctaaatgatagtttcatttttacatcttcaattttgcgcagtcgaatcggagcgccgattgtttccacaccttcaggcttcataaacttctctttatgttctacattagccttcgttaaaattttcttaaacaattttgtcgcagatgcactttctccttgcaactgatgctccttatccgtacggtcataaccaatccaaacagcgcctactaagttaggtgtatagccgacgaaccacatatctcttgctcccttatcgtcatttggcaatgaagttgtacctgtttttccagctagcgcaccgttatatacaccaactctcgctgtcccttccttcacaactccttctagcattttcgtcatataccatgctgtctgcttcgagaagattttcgtctctacttttggagattccccaatgactgcaccgtgtctatttaatactttatcaataacgtgcggctcaattatatttccatttgctaaaaatgaacgatacatttttacaagatcaaatgttgaaacgccattttttagtcccccaagagctgtacttaaaccagcatctgcaatatggacatttcctttttctaaatattgctttccttcttctacccctaactcatttaatagagaaactgccggtacgtttgccgactctaaaatcgcatcatacatcgtcatttcttttgaatactcatgattataatttcgaggttcatacccttcaaaagaatttctttcatttgttaataaagaatacggattatactttttcgtttctagtgctggtgcataaacgataagtggttttaaaacagatccgggctgccttttggcaaaaacacgattaaatcctctcgggacgtactttcttcccccaatcgccgctttaatccctcccgtacgattatccattaataagaaagcaccttgcgccccttcttctttcccaggaaaattccttgcatcttgaaactggttatatgctaccttttgaatcttttcatccataggtacgacaaacgtatatcctccgcgaagtacttcttgatgagacaacccgtataaacgagcggcttcatctatgaccatatcaatatacggcatatatgcaagctcattctcatctaaatttttatatagagcaattgtcttcccttgataacgaacgctttcttctgcagtcaaatagccttgtttatgcataagtgacaatactagatcgcggcgttccttactcttctctgcagaatagtacggtgaatatccgtttggtgacttcggaaggcctgcaagcattgccccttcctctactgttaaatcctcaacatttttattaaaatacaactttgctgccgcttgaataccgtaagccccatgaccaaaataaatatgattcatatacatttcaagaatttgttgcttcgtatatttttgctctaattgaagagaaattgcgacttccttcaatttgcgcgtaaatgttttttcacgagttaaaaagacgtttttagcgagttgctgcgtaatggtactaccgccctctaccttctctctagctaacgtatctttataaagagcacggaatatcgacggataatcaatcccttgatgctcataaaaacgagaatcttccaccgcaacaaacgcctgctgcacatacttcggaatttgctcgatcggtacaaggtctctattttctacgtataatttcgtaatttctttccctttctggtcaacgatacgtgatgaagagtggaaaacgagctgcttttcatccatcatatagccaccagctaacacgataagtttatagagtacaatcgctactacgaacgttgcgacgccgcctaataaagtccactttactttcttcatacatcgtccttctttccaaatgatggtacatttattatttgaaaaagaagtatctttatgtatataatcttcgaagttttttaagagagttgatataatagaaacaaactagtaagggggcattaaaatgaaggctattatttcatacgaaacacctctagaacaagcacatttcactgcaaaaaatgatgaggaaaatatgttttataaagaaaatacagaagaatctgtagaaggttcacttcagtatgacgtactagatgctgtcggtgaattcaaaggacaacctggctatatcgtttgtaacaacatttctgtaacagacgaaggtcgccctgtatttgaaaaccgctttaaaaaccgcgcaggccttatcgaaaacgaaccaggattccaagcgatccgtgttctacgcccattaagtaacgatacatatgtcatcttaacgatgtgggaaacagagcaaaactttaaagactggacagaatcacgttcattcgaaaacgctcataaaaaacgtcccacgcaagtagaaggaaaacctcaggctcaagcgcatccacatgcagaacagcaaaagagtattttctctcgcccttcttttgtgactacttttgatgtgttagtttaatttttttgagtttggagttcggaaaccacggtatgtgaaattatatcggcgatttttcgaatatatcggcgcaactcgaattatatcagcgtttttctgaatatatcagcgcaactcgaattatatcagcgtttcttcgaatatatcgacttatcgacaaatcatgacacaaaaaggaaacaccattacacaccggtgtttcctttttctttgtaccaattatatatacgaagtgaatctttttttctcatatgctttacttcataaccccgcccagctaccgctacaagagttgtacataattcatcctttctttgaaaatacgattgattataacctactgcttgaacatgtcttcttcgcattattcctgtatatttcgaaaaattacgatatacaaccgttagttgattttctcttaattcataaccaccacttttatatctagcatacgcaagtaacgaaaacacgataaataacggtaaaataaaaaataaagcaatatattgtttcaaatatatactcacgctagcaattagaactgtgagtatgatacttattaaccagctcataatgaaataacgacgcaacgctgtttttggtaagtgagcgatctccgcctcaatttcataaggtaactctaaatatgtgagcaggtgctgtacatcttttttcttcataaaaggatgcaacatcacttcattacttgctgctccaatactgtgaattgcttccacttcaacagcgcaataaccaaatggctggcgaagcatacattcttttacagtaatcgcttgaattcggtgcaattttaagacaaattctttcttttcaaataacccttgaacgatacgaatttcttccccttttcgctcaattttaaagtttgcatatttcaacacatatccagccgtggaaataatccatgaaattgccattaaaattaatgctattacaattagtttataaacaccgtttcccatcacatacgcttctactttacttgtgaatccttcaggaagaacaaaatcaaactttgtgtaaagaagtaccagtccagaaaacactagtccgaaccgaccagatgtaatcgctgctgctaaaacctctttcgctgttaactgataaaccgtcttgctttcttcctcttctatttcttcttttacagtagtttctttcttatgtaataaagagattaaatgttttgcctcgtcttctttaataccagccaacatcacttctggttcactaccaccacccgctacttctatatttaacttcataagcccaagcatctgataaatgacgttagaagacgtactaacattttgcacacgttctttatttaaataactttccttctttacaaaaacaccgtgctttatatgtaaaatattattctcaatccagtacactttaaaataccatttaattgctgaaaaaatagccatgatgaataaaacaaccagaaggaaaagataaaataaataccaaggttccacttgttcatcaggtttaaataaaacaagaataataagtggcaacaaactcgcaactctaatacctaacaatatcgtaatcggatgttgcctcttatacatccttatcactcactttcggcagttcttcaatttggcttttagctgttctgcttc

SEQ ID NO: 1238 - DNA, 8718 bp, Bacillus thuringiensis
gcccccaccaagactggcgccacgtggacgccatatggcatcaatttcatcaatgaaaatgacacaaggagcatttttctgtgcattttcaaataactccggtacacgtaaggcccccaccccgacaaacatctctacaaagtcagaaccactgatagagaagaatggaacgccagcctcacctgcaacagcacgtgctaataaagttttacctgtacctggaggtccaactaataggacaccctttggaatacgagcaccaacttcagagaacttacgagggtctttcaagaattcaactacctcaacaagttcttgtttctcttcatccgcaccagcaacatctctgaaacgaacttttttcttttcatcattatataacttcgccttacttttcccgaagttcataacacggctaccgccgccttgagcttggtttaataagaagaagaataaaatgaagatgatgacaaatggaatgattgaagtaaagaatgttacccaggcacttgtttcttctgctggttgatacttaacttcggcacctttcgctttatcattaattttcttttgtaattcctcagtatttggtgcataagtaacaaattgttctccttggctagagttattaaattgtccttttacctcaaatacaccatttttcggttgaagttgcacattacgcacttcaccgctttctagtttagtaatgaatttgtcgtagctaactgatgtcgttttttgtgtcgaaccattaaaatagctcacgattccaattactactaagaatatcagtaaataaaagatggtattacggaagatacgattcattcctaacctcctctcacggcataaacactatagtaaatcgtaacatagaaaaactttcctatacaattgtgaagcctatatttaattaatttgagtaaacgcttggttttaatacgcctacataaggaagattacggtactgctctttataatctaatccatatcctactacaaattcatgtggaacagtaaatccaacataatccgctttcagatcaaccttacggcctgttggcttatctaataatgtaacaatttttacagacttcgctttacgatatttgaataagtctactaagtagcttagtgtaagaccactatcaataatatcttcgacgattaaaatatcgcgaccttctacagaagtatcaagatcttttaaaattttcacttcgcctgttgaaactgtagagtgaccgtaactagatacagccataaaatccatttcaagatatgtatctgttctctttaataaatctgccatgaatggcattgcgccttttaatacaccaattgcaagaggtactgtgtttttataatcctctgcaacaattgcacctagttcgcgcaccttttcttgtatttgctcttcagaaattaatactttttcgatatcttgattcatcatttcattatcctcccggaagactccttgcttttgtagtgaataatcatatatttatccttctttgccatctctttcgaaattgcaaatgcagatcgcttcaacaagggtacccaaataatggtcccacttgcatcacaaacgaccggccattcttctcttttttctttcggtacttttgcttcgataaaaatagcttttatctttttcgtgccattcataccttgtattgacatgcgatctccattttccctagaacgaatacgaagtggatatgatatatcattatacttagcaacaaatactgtttcattcatgttacttggtatatcttcgctcacctctgttacaaattcatccccgttcaatagcgtaatggtcccgggtactgataaatcttgtaaaaaaggagaaacaatttcttgtttaaatctaaagctacactcctcgtatgtacgaacaattttcaaatcacctggaaaatcaagtgaacctgaaggttgtgtccgcttaaaaaactcaatcaccttgtcaatatgtatggaagaaagagaagatggaatcttatattcataaagatagtttaatattagttgaatccctcttctttgtaaaggcatagacatggattcaaaggcaggaattgataagctaatttgtttatcacttttttttgtaattactttattcattttctcaaaagctaattcctgcaaataagcctcatcctcttgcatctgcacgctaaatttttggaatttctcatgcacttgtggattttcttctttcaaatgaggaaggacatatttacgtaatcgattccttgtatatacttcctttttattactcggatctatacgtggcattaaatttagcttattacagtaatcaacaatttcttccttcgttaccccaagtaacggcctaattaaatacccattatgaaaaggacgcttcactgcaattcctgcatatcctttcggagtactccctcttacaagacgcattaaaattgtctcgacttgatcatctccatgatgtccaagagcaacatatcttgcatcatatttcttcattattctttccaaaaatgcatatctgcattctctagcagcaacctgtgcattcattccgtattgctgttgatattgtgatacattaatccttatcgtttcacaaataattcccagttcttcacaaaggccctgcacaaaccgtaaatcctcatgagattcatcacctctaaacatatgatccacatgagctactacaattttcaactgtttttccgctcttttttctaataaataatataaaagcgctaacgagtcaggaccaccagaaactcccacaacaattgttgaatcattctttaatacatcatgctgctttacaaagtcatctactttttcaacaaatgtatctttcaacttcgtaatcacctttcattaaacaagaacagcaacgttagttgccttgtctacaatggtacaacttttacaaacattgtgcaaaaaaaagatatacaaaaattacatttttatcttacatcctccgtgtatattcacaaaattaataacattacctttttccacaaaaaaacctaggtattcacctaggtttttaaaatcaaattatagataaacattccacttacattttactgcgcctgcattcctacaatcggaatcgtagcccacttcggcatatttttcttcacttttgccactacaatagtcatatcatcatttatataaccatcacaagagcgaatcacttcttccataatgatatcagcaatttcttgcgggtcttcggtttgcaattctttaatttttcgtttcatccacaattcatgattctccacatgctgtgctccttcaaaaatcccatcgctcatcataataagaatatcgcccgtttttaattgttcacccaccacatcaacttcaacatcttcaatgattcccatcggcaaattacttgcttcaattttcaaaatattatttgcgcgtttaacaaaactcggcgtcgatccaatctttaaaaaccttgcactcgcatcccgcaaatctaccatagctaaatctaacgtcgtaaacatctcttctgtcgttctcaaagaaagaattgaattgatagacttaattgctatttcttcatcaatgcccgattggagtattttttgtaataatttcaccgtttccttactttccatatgagccctttgcccattccccataccatcactaattgcaagtgcatatttaccaacacttaaatccatcatcgcataagagtcacccgaaacaaatccaccgccttttgcagctgtagccaatcctgtatcaagagaatacgtcttcgccgaaccaaatgatattaaactatggccatttggataagaagacttttcttcatgtttaacgacaatattttctttaaggatatccgaaagcatcggtgcaactaacttttcacattcaccatgttcattagatgcaactggaattaacatttcaatatcaatacttcctctatctaaacaataaatatcaacatgctctacttcgacaccaaaatcacggaatgcttgcataatctgttcttcctgcacttgatgattttcacgctctcgttgtatctccttagcaaaatcctccataacctttgatacacctaatagttgctccgctactattctacgattttccttcatttgttttcgtaatttttgtccctcatagaagtgatctaattcacccgctactaaatccgtcacttttttccctctcacacaatgcttgtcccactcacgaactaatttacgattatgttgcagggttccttcttccgtttcattcattatttgtttcatataatcgtacgttttatcaaaattcactacccagcattgatcctttttaaagcatgtttgacatgttttcgcagtaattgtactcaaaaacaaatctgcttctgtctctttatcttcttcctctacatacccatatacagaaaagctattagataaagcagcaaatacatttgcaaattggttgattttatttgctgtaacatcacgcatccttcttaaatattgttgttggtcttgcgaatgctcttgtgtacctggcataaatttagcaatacgatccaaaacaagcttcggtgttaataagaagataacaatcgctacacctgactcaattaaagttgttacaatatttgtctgtttgtccacatataatgtaattaagcttgtcccaattaataaacctaaactaacacctaaacgcttcccttcttttaacaatccaccaagcaatccagagaaagcaagaaggctaagctgagacaagctagacacatttgctaaacttaatattagtcctgttacaacccctactgtggatcctgtggcagcacctgcaataaatgcaaatactagcactaaataccttgtaaaaatatgttgaatagaagcatcatatacaaaccaatctgttgtacccgttaaaacagatgctagtaatataatcaaacaaacaatttcttccgtctctaatgcctgttgttttcctttcctttccactaaaagcgggacgctttgtaaaaatatcatagttaatacgaaactaagcccagcctcaatggtactaacgagtaaatcgtacatggtgacagtttgttgcgcaaaatatacaacaactaagtgtgcggttaatgcggagataaatacttgaaatggaacaagtccaacagttttacgtgtaaatcgactaaagaagatattataaatgaagaaggtaaagatagatgcaaaggtaaaaaacaaattatctatcgataccgaaagagctcctcccattagagctaaaaatgctagcggcatcttatcccgcttcataacataaacagcagcaaaaaatggcagtgcaaacggtaaaatatttgttaatatatatgctcgtcccaaaagaaaaccaataacaacaataataaatccccatctaaagaaaacttgctcaaatttcattcgcaacttactcgtccactttattcctccaagctgactctcattcattgccaatgcacttgtattcatagtattccttcctgctttaggcatatttttaacaccacctgcatagtttaattactgtcattataaaagatgattgttggtttttttgtcaaaacaacagttttcacttttataatcgttcgactttttattcgaaatacctctacagatatacacggtatgtaagttatttttgagattttaattaaatattcagaaaatatagggtgattttgtagaagtgttgtatatcttaatttatttaacaaaaaaagatcatgcaaatttgcatgatctttttagatgacccgtacgggatcgaacccgtgtaccgccgtaaaggacggtgtcttaacccacttgaccaacgggccgttaaattaaatatagcggcggaggggatcgaacccccgacctcacgggtatgaaccgtacgctctagccagctgagctacaccgccatgtcgtcttatttaacggacaattagtatcttacatcagatactaattaaagtcaacacatctcaaaaacttttttaaaaatatttttaacatataaaaaagcaccctgagccatcactctgggtacctctctatatgttaaaaactaaacgtccttattatccgcgacgcgcgccacggccaccacgtttagactctgtgttacgctttaaagaagttaaacgatcttcgctatcttttaagaagcgtgccatcttttgctcaaatgtttctttcggagctcggtcgttaccgccaccgcgattatctctgttgaaagagcgattattacgttgtggacgtccagaacgttgttgatcaccaccgcgttggtattcaccgcgtggacgatctccttctgttttttcacgttctttcgcttttttgatagataaaccaatctttccatctttttcaacattaataacttttacttctacttggtcgcccacttttaagtgatcgttaatatcttttacatagttatcagcaacttcactaatatgaacaagacccgttaagccctctggcagctccacaaaagccccaaaatttgtaatacctgttactttaccctgtaacttgctgcctacctcgattgacataaaaaaaatgctcctccttagtggttaaaaagtcaaattttactttattatatataatcctaaaatatagtgtcaataagacatactctacttagaaacaggaaaaattatctcccctttaccagagaagaaataatcccttctagcaatctttaatacgtactcttcatcatttaacttttgaacttcgtcttttagacttttttctttattcgttaatgaatccagttcttttttcatgtccttaacttttgcttcttttgctttaatggaactgttttgttgataaaacgttacactaatactcgcaataattgtaaaagtaaagacaagaaaaaccgctaaacggcgataaagtcgcttcctgttctcatccgtttgtattatatgctctttaacaggatttggactctgtttttcgattgttctttgtctcagttccctcatttccgaggtccccctaacttcttttttatatgctcccatagttggaagatatgtcccttcaattttgctatatattgcaggaaccctatatgtttcactataaaaagtttaacacgattagggagaagtttccatatgagcgaagcaataaatcgaacaggccagaaaaaaactttccatatgaaaagtaatatccaaatcaccattttccataacacatgtccaattgaaagcagtatacgaaataagaataatataaatgcaataaatagctgcgctataataataacaggttttatcatgagtagctgtataattcgaacaaaaaaatatgttgtttgcataaaaatatagatgagaaaatttaacagcttcatgtatagtgccttcagtaagctttgatatgccgcaaaaccacataataatgccaaaaacacatatatacgtagctcagcttcatttacgagaagcaatacataaaagacggataatgcttggacaatccaaaataatatatcatgtataaatacaagccaacgtttacgttcttggcgctttaaaaaacgttgatatgtatctaaagacgctccaatccaagcacccattccaatcattgaaagcattgtatacaactgaattgttaagctcatttaaacaacttactaaagaaacctttagttttttccccttgattttcatcaatatacagcatctcattaactttccctttaatcgacacaatacctttttccacatctaaatttttcatttgtaaattttgaccacgaattgttaaaaaacccattacggtctctagtaaaaactcttcgctatcaaaactctctacctgcttcacaccggtaatatcaattatacgcctgccacgcataataatgtcatgctctacagaaacattttgttgattagaagacgtaggtgagtaaccattattcacgtaaatccccccataggtttttactagctaatagtaatgtatgaggggataaatgattttagaacaagccttcttccgcttttactttttcttcacgaactaagctatacatatttgctgcatcttcttttttagttgtttcttttaattcatttattttcacagacactattttttgaccaaaacgaattgttaattcgtcagctactttcacatcagaacttgcttttgccacttgaccattaatagatattcttccttgatcagctacttctttcgctaatgttcttcttttaattaaacgtgatacttttaaaaacttatctagacgcatatcaaatccccctattaacgctctgtctgtttcgcttcttcccataaaacatctaactgttctaatgataaatctttcatctctttattcatttcagctacttttgcctccatgtataaaaaacgaccagtaaatttctcattagttgaacgtaacgcctcttctggatctattttgtaatgacgagctatattaacaaatgcaaatagtaaatcaccaaactcacccagcatctttttctcatccatatttgtaacctcttggtggaactcttgccattcttccaaagctttctcttcatcggttgcacatcaacccaatcaaatccacctt

SEQ ID NO: 1239 - DNA, 7014 bp, Bacillus thuringiensis
tttttatgggtacagaatttaatggtttatttgatgagtgggctcatacgtacgactcatttgtacaaggcgaagatatacaatataaagaagttttcgcccattatgaggacattctagaggatgtagttaacaagtcatttggtaatgtattagaatttggtgtcggtacaggtaatttaacaaataaattattacttgctggccgcacagtttacggtatagaaccgtcgcgtgaaatgcgcatgattgcaaaagagaaattgccaaaagaattttcaattacagacggtgattttctttcgtttgaagttccaaattcaattgataccattgtaagcacctatgcatttcatcatttaacagatgatgaaaaaaatgtagcgattgcgaagtatagtcaattgctaaacaaaggtggtaaaatagtgtttgctgatacgatatttgcagatcaagatgcatatgataaaactgttgaaacagcaaaacaaagaggtttccaccagttagcaaacgatttgcaaacggaatactatacacgtattccagttatgcagactatttttgaaaacaatggcttccatgtaacgttcacgagattaaatcatttcgtttgggtaatggaggcaactaagcaatagaaagagggattagattgagaattgctgtaattggagcaatggaagaagaagtacgtattttacgtgacaaattagaacaagcagagacagaaacggttgcaggttgtgaatttacgaaagggctattagcagggcatgaagtaatcttgttaaagtctggtattggtaaagtaaacgcagcgatgtcaacgacaattttattagaaaaatataagcctgaaaaagtaattaatactggttcagctggtggattccatcattctctaaacgttggtgatgtagttatttccactgaagttcgtcaccatgacgtagatgtaacaacatttaactatgaatatggtcaagtaccaggaatgccgcctggatttaaagctgatgaggcgttagttgcattagctgagaaatgtatgcaggctgaagaaaatattcaagttgtaaaaggtatgattgcaacaggtgattcatttatgagtgattcgaaccgcgttgcagccatccgtgataaatttgaaaatctttatgcggtagaaatggaagcagcagctgttgcacaagtatgccaccaatatgaaattccgtttgttatcattcgcgcactttctgatattgctggtaaagaatcaaatgtttcatttgatcagtttttagatcaagcagctcttcattctacaaactttatcgtaaaagtgttagaagagttaaagtaatgtaacaaaaaggcaactgtctcatataaagaaaatacatacagttgccttttctttattggcaaacaagggggagaacacgatgaatgtatatcgtggagttcatgagttaattggtcatacaccaattgtagaaattactcgtttttcacttccgaaaggagtccgtttatttgcaaagcttgaattttataacccaggcggaagcgttaaggatcgtttaggaagagaattaatcgaagatgcgctagaaaaagggcttgtgacccagggtggaacaattattgaaccgactgctgggaatactggtattggactggcacttgcagcattagaacatgatttacgtgttattgtttgtgtaccagagaaatttagtattgaaaaacaagaattaatgaaagcactaggtgcaacggtcgtgcatacaccgactgagcaaggaatgaccggtgcaattgctaaagcaaaagagttagtaaatgaactaccgaattcatactctccaagtcagttcgcaaatgaggcaaatcctcgtgcatattttaaaacactaggacctgaactgtgggacgcattgaatggagagattaacatatttgttgctggagcaggaactggcggtacgtttatggggactgcatcttatttgaaagaaaaaaatatagatattaaaacagttatcgtagagccagaaggatctattttaaatggtggtaaggctggttcacatgagaccgaaggaattggactggaatttatcccgccatttttgaagacatcttattttgatgaaattcatacgatttctgatcgaaatgcatttttacgagtgaaagaattagcgaaaaaagaaggacttctcgttgggagctcttcaggagcagcatttcatgcgagcttacttgaggccgagaaggcagcaccaggtacaaatattgtaacgatttttcctgatagcagtgagcgctatttaagtaaagacatatacaaaggatgggaataaaaaatgagagcaaagacaaagttaattcatggtattcgcataggagaaccttcaactggatctgtaaacgtaccgatttatcaaacaagtacgtacaaacaagaagcagttggtaagcatcaaggatatgaatattcacgtacaggtaacccaacacgtgcagctttagaagaaatgattgctgtattagaaaatgggcatgctggatttgcatttggttcaggaatggctgctattacagcgacaattatgttgttctcaaaaggtgaccacgttattttaacagatgatgtttatggcggaacataccgcgttattacgaaagtattaaaccgtttcggtattgagcatacatttgtagatacaacaaacttagaggaagttgaagaagcgattcgtccaaatacgaaagcaatttatgtggaaacaccaacgaacccactactaaaaattactgatattaagaaaatatctactcttgctaaagagaaagacctattaacaattattgataacacattcatgacgccatattggcagtcgccgatttctttaggagcagatattgtgcttcatagtgcaacgaaatatttaggaggtcatagtgatgtagttgcaggtttagtagttgtaaatagcccacaactagcagaagatcttcactttgtacaaaactcaacaggaggtattcttgggccacaagatagcttcttactacttcgcggtttaaaaacattaggaattcgtatggaagaacatgaaacgaattcacgtgctattgctgagttcttaaataatcatccaaaagtaaataaagtatattacccaggtcttgaatcacatcaaaatcacgaattagcaacagaacaagcaaacgggtttggtgctattatctcatttgatgtagatagtgaagaaacattaaataaagtacttgagaaactacaatactttacacttgctgaaagcttaggagcggtagaaagtttaatttctattccatctcaaatgacacatgcatcaatcccggctgatcgccgcaaagaattaggaattacagatacattatttcgtatttctgtcggtattgaagatggtgaagatttaattgaagatttagcacaagcgctagcataataaaaaatgcactgctctatattagcagtgcgtttttttattacgtctattttgtgaaacatttcacaaaatagacatacacaaacgaaatgatttcatgtatattgaattcaggaaacgttactcacgaacaaacttgtgaaacttttcacaaacaatgaaattcatgtaggaaagcatctctatttttttgtgttaattgggacttattttgacctacagggacatataaggaccgtaatagtagaataggaggaaattcacatggtagtcaaagagaaagttgtaaatgaaatgcaggaagtaaaaaagatgattgatacgctagtaaataatggtcaacaagctttacaagcattagaaagttttacacaagaggaaattgacaacattgttcatgaaatggcattagcaggtgttgatcaacatatgccgctagcgaaattggcagttgaagaaactggccgtggtgtatatgaagacaaatgcattaaaaatatttttgccactgaatatatttggcatagtataaagcaagataaaacggtagggattattcacgaagatcctcatgaagaaataatagaaatcgcggaacctgtcggtgtagtagctggagtaacaccagtaacgaatccaacgtcgacaacaatgtttaaagcgttaattgcgataaaaacaagaaatccaattattttcgcatttcatccttccgcacaaaaatgttctgtggcagcagcgaaaaccgtatatgatgcagcgatgaaagctggtgcaccaaaacactgtattcaatggattgaaagaccgtctgttgaagcgacgaaacaattgatgaaccatgatggtgtagcactcgttctagcaactggaggcgctggtatggtgaaatcagcttactctactggaaaaccagcgttaggcgttggtcctggtaatgtaccgtgttatatagaaaaatcagcacatgtaaaacgagctgttaatgatttaattttatcaaaaacatttgataacggtatgatttgtgcatcggaacaagcaatcattgtcgataaagaaatttatgatgatgttaaaacagaaatgattgaaaacagttgttactttgtaacagaagaagaaagaaaaaaattagaaaagctcgttataaatgaaaatacatgtgcagtaaatagtgatattgtagggaaatccgcacagtatattgccgatttagttgggatcactgttcctggacatacaaaaatgcttgtagctgaaattcaaggtatcggagcagcatatccgttatcccgtgagaaactgagtccagtattagcttgtgtgaaggcaaattcattagaagaaggatttacatattgcgaagaaatgttgaacctcggtggtttaggacattcagcagttatccattctacaaataaagatgtgcaaaagcaatttgggttacgtatgaaagcttgccgtctcattgtaaatgcaccttcatcacaaggtggaataggggatatatataatggatttattccatcacttacacttggttgtggttcatacggaaagaattcagtttcccaaaatgtaacagcgactcatttattaaatataaaaaggctggcaaatagaaaaaagaatatgcagtggttcaaactgccaccaaaaatttattttgaaaaacatgctacagcttatttagcaaatatgcctaacatttcacgtgcatttattgtaacggactccggaatggttgaacatggctatgtcgatacagtcgcgcactatttaaacaagaatgcaaatgatgtgaaagttgaagttttctttgaggtcgaaccagatccatcagatgaaactgttttcaaaggtgcggaaatgatgaaaagctttaagccagatgtaattatcgcacttggtggtggttcagctatggatgcagcaaaaggaatgtggttattctatgagcatccagaaacgacattctatggtattaaacagaaatttttagatataagaaaacgtacatgtaaatatccggaattaggaaataaggcgcagtttgttgcgattccaacgacatcaggaacgggatcagaagtgacaccatttgcggttattacagataagaaaaataatataaagtatccgctcgcagattatgaattaacaccagatgtagcaattgttgatccacaatttgtaatgacagtaccaccacatgtaacagcagatactggtatggatgttttaacacatgcaattgaggcgtatgtgtctgttatggcaaatgactatacagatggattagcattaaaagctattgatctcgtattcaaatatttaccgagagcatataaagatggaaatgatgaagaagcaagagaaaaaatgcataacgcttctgcaattgcagggatggcatttgcaaatgctttcctcggtattaatcacagcttagcacataagattggaccagaattccatattccgctcggacgcgcaaatgccattctaatgccgcacgtagtccgctataatgctattaagccaagaaaacacgcattgttcccaaaatatgagcactttgtggcagatgaaagatatgcacatatagcgagaatgctcgggcttccagcaagttcggcagcagaaggggtggaatcactcgtccgagcaattattgagcttggaaaaagcttaaatattaatatgagtattgcgggacaaggagtcgataaagagcaatttgaagaggttgttggagtattagcagaaagagcttttgaagatcaatgtacaactgctaatccaaagttaccgcttatttcagagctgaaagaaatttatatggaagcatataaaggtgaataatgataaaaaaagagccgcagtaaaagcggctctttttttattggaaaacatctcccagaatggctgtatttactggtctttcagtttcatagaatatgatacagtgaaatggaggagtgagaatataatgaaagaattaaaaggaaaaatagaagattatactcggtttggacaaatgcttctcgctgtaagtacattgttaatggttggcttattgattccgagtggagcaaaagagacaatccaattttttgttatgatggggagcatcgttatatttttaagcttatcgttctttttctttcagcgtgtgaaagtgatgcgtgaccagctagaggaaaatgaatgtgaataatattgttaactagagcgcagcgaaaagaaaaaatctttttgtcgcgctttttgttttttgtaggaaaatatatgtgtttcgtgttgacaatgataatccttatcaattaaagtataatagtagttaatgattatcattatcgattagaggtgaagaaatgaagaaatctatttcgctatttacagcgattttatccatttttttcttgttaataggttgcagtgccaaaggggacgaaatagcgtctgcaaaaaaaacagaaaaaggaaaagagaaaatcgaaattaccgacat

SEQ ID NO: 1240 - DNA, 6619 bp, Bacillus thuringiensis
aagcagcattttgccgcaaaagaaaaacccggatatggcggaactaatccgtggtaaaacaggcagagtatacggtaatttattcagtttacttacagtaatgaaaggattaccgctcgcttacaataaagacttgcaagaagataaagaaggaatgtttgatacagtaaaaacagtagaaggatgccttcatattatggcgggcatgcttgaaacgatgactgtaaacaaagaaaaaatggggcaagctgtgacgcaagatttctccaatgcaacagaaattgccgactatttagcaaacaaaggactaccattccgtcaagctcatgaaattgttgggaagttagtgctatattgcacacaaaaaggaatttatttattagatgtctcgcttgaaacatataaagaaatgagctctttatttgaagaggatttgtatgaagttctttcaccatatgcggctgtaaagcgtcgtaatagttcgggtggaacaggatttgaacaaatcaaaaacgctttggagaaggcgaaggggttaacgaaagaatttattaagaattgagttgggaagtacgccagtctagtaaagtctggcgtactttgttttttaataatatttaagttacaatatagtaaaaaataacaatttaggggaagtctatgaaaaaaatagtgtttatcattgtactggtaattagtttaattgcaaatgctaaagtgtttcttttggacaaatatatgtatgttggtgaaaaagaaaagcgagaagaagcgattatcgcaacgatgtggcatttgcaagataaaggatataaagaaagtgatattttatatataaaaccggccttttatagcaaaatggattcgtatggaatgaatgtgcagtttaaagatgaaccaaatgaatcatatacatatagagttttaaaagatacgaaaacaaataaactaactgtacaccaagatagcaatgagcaaggtggtatgggcgggaagcatcaagagcttaaataaagaaagaaaacgactgatggcattcgcctgcagtcgtttttcttttaatcatacttatgtcgttcttccgtaattcgaatatactcaatatccatcaaatctctaagtaatgcaccgttacttagttcaacgccatgtttctctttaaaatgagtacgaatcgtatctagcatttcgagttctttcccattcacatctaaaataatacgttcagaatcatccatgttgcatcctccttttttacacatatatattttgtccgtctatttctaaaaaatgtatgttaacgtaatgttaggaaataagaaagggatgaaaaatgagacgtatttattttatagggttaattttgtacacgctaattgtattacacgttgcattcccaaatatcttttcatttgaggatttagaaacagtacacgttgcgatatttatttttgctctatttgtagtagattgctttatttctatatggatttcgaaaagaaaagatatacaaggtgaaaaagaaatggaacggaaaaagagaaaacattcattttggatgatgacatactgtttgtctttagtgcttactgctgctttttttagtgaacatattccattagaaagattaaatattggatttggagcgttcgtattcgcatactattttttttatgcactttcttccttatatgaaagaaaagcgaggagaagaggaaaatccgcttgtagaagaagcgaaagaacaagagagtaagagaattgaaggagatataaagaaacttggagaacaaaaatggtatttaaaatcaaaaatcatatatgttctttgcttcattacgccgccaatcggctatttgtacgtcttcttacttcgtaaaaaaatgacagagggtgcaaagcaaacgtacttaacgatcgcgacaatcatgatggcgttatggtctttgaagtttcttccgccttatgtgttggcaattaccgttgttgtcgtagcatgtcttgtgtttatagtgaagtttatgaaatgaaaaacaccaagcctatgtggacttggtgttttatctataaattaaagctcaccttgctcttcatcaccacgaacaacaaggacatcgcatttcgcatagcgaataatatgttcagagacgctaccaattaggaaacgctcaacagcatttaaaccagtcgcaccacacataattaaatctactttatggtttggagcgatttcttttgaaatttttgatttaggattaccgaattctaatacagtttcaattttttcaagaccagcttcaagcgcagtttttttgtagtcttctaataagtcttctgcaaatagatttgcccgttcagcaattgcacggctataagcttctactgctgagtatgcttttacatcaacgatatgagcaattgttaatgttgcattgttgcgctttgcgacttgaattgcttttttaaaggctttttctgcttctttagaaccatccaccgcgattaaaatatttgtatatgtattattcatagtaaattcctcccaatctgttttataactgtttacaacttaattataaaacaaattttggtaacgtgcttgccagaaacgttacagaattttgaaaactctgtttcaattcattttagttgtaattggagcgagaacttgttacatatgaagtatagcaatttaaaagggggcagttttgtgagacatgcgctcattacagccggtacgaaaggtttaggaaagcaagtaacagaaaagttattggctaaaggctattcagtaacagtaacgtaccatagcgataccacggctatggaaacgatgaaagaaacatataaagatgtggaagagcgtctacaattcgtgcaagcggatgtcacgaaaaaggaagatttacataaaatagtagaagaagcgatgagccattttggcaaaattgactttttaattaataatgctggtccatatgtatttgaacgaaaaaagttagttgattatgaagaagatgaatggaatgaaatgattcaggggaatttaacagcggtatttcatttattaaaacttgtcgtcccggtcatgagaaaacagaactttggccgtattattaattacggatttcaaggggcggatagtgcaccgggatggatttatcgttcagcttttgccgcagcgaaagtaggacttgtttcattaacgaaaacagttgcttatgaagaagcggagtatggtattactgcgaacatggtatgtcctggtgatattataggcgagatgaaagaggcaactattcaagaagcacgtcagctgaaagagcataacacaccgattggtagatctggaacaggtgaagatattgcaagaaccatttcgtttttatgtgaggacgattccgatatgattaccggtacaattattgaagtgactggtgcagtggatgttattcatagacatcgatagaataaaataagatgaagtttcgaataattggacagtttatccattgtgctgagaggtgcggataatactgtcctttaatataaaattaaatctatcggaaaactcgtgttatttttttgtcaaatattgagatattatgttaaaatataagagcgtagaaagcgctttaaaaaaatgattcaggggtcatttcataactcaagggggaactaatcatgcgtatcggtattccaacagaaattaaaaacaatgaaaaccgtgtggcaatgacgccagcgggagcagtacatttagtacaaaatggtcatgaagtttttgttcaaaaaggagcaggtttaggatctggctttacggatgaagaatacgtacaagctggtgcgaaacttgtagaaactgctgaagaagcatggaatcaagatatggttatgaaggtaaaagagccagtagcaagtgaatacggctatttccgtgaaggtttaattttattcacatacttacacttagctccagaaccagaattaacgaaagcattaatcgataacaaagttgcatcaatcgcatacgaaacagtacaattagacaatcgttctttaccattacttgcacctatgagtgaagtagctggtcgtatgtctgcacaaatcggtgcacaattccttgagaaaaacaaaggtggtaaaggtattttacttgcaggcgttccaggggtaaaacgcggcaaagtaacaatcatcggcggtggtcaagctggtacaaacgcagctaagattgcagtaggtttaggtgcagatgtaacaatcattgacttaagtgcagaacgtcttcgtcaattagatgatattttcggtaaccaagtaaaaacattaatgtctaatccatacaacattgcagaagctgttaaagaatctgaccttgttattggagcagtattaattccaggtgcaaaagcgccaaaacttgtaactgaagaaatgattcaatcaatggaaccaggttctgtcgttgtagatatcgcgattgaccaaggtggtattttcgaaacaactgatcgtattacaactcatgacaacccaacttacgaaaaacacggcgttgttcattatgcagttgctaatatgccaggtgcagttccacgtacgtcaactcttgcattaacaaacgtaacagtaccatatgcagtacaaattgcgaacaaaggttacaaagatgcttgcttaggcaacactgcattactaaaaggtattaacacattagatggctatgtaacattcgaagcagttgcagaagcgcacggcttacaatacgctgatgcgaaagagcttcttgaaaaagctcctgctttatcataatagaaatacattcgagaccttcctttatgaggagggtctttttttatggagaaataacatgtgaataattgttatttattggtgtaaatcattttttattatgataatttagaattatataataaaaagaggggattcaatggggagtaaaaagaggaagaaaaagcaagcaaagagacaaaagtacataaagaaaaaacaggagcagaacatacctttttcacaaaaagtagtccttatgatagaaaaagtatttcgatatatttgtatgttcttgtatgtgattttttgtgtgtttttatgtgggatggttaaatgtttggggataacacctaatgttattgaaggtatttttggcgttatgcttgttatggtagaaggaatcttattctttatattatttgataaggtttggcctagtcatgaaagtaaaaaagatagaaaaagaagcaaaaaatcttcatccaattcaagctcatcaagtggattcggtgactacagtagcaacgattgtagcagctcaagtgatggcggaggagattgcggaggtggtggagactaagttggtttttcagaagaacgactaatggaaggatgggatgaaatatggaaactgtgaacttaatagaattaacaaaagacattcaagatcaacataaaaacttcgtcgtttcaaacataaacagtcattgcttacgcatcgctgtatttactggtgaatatgattggcactatcattctaattcggatgaattatttattgtgctagagggagagttacttattgattttgaagatggagaaacggcggttttaaagccaaatgattctattttaattccagcatgtacgattcatagaacgagagcattaaagaggacggtaaatctttgttttgaacatatagaggctgatacgattatagtggagcaattatgaaaaaattatctgtagccgagtatagaaaaatcattccgattttggaaagtaatacaagaacgacgacatttgcttatgcggtatgtgatcaaatggtagatggtgaggtttttgccaacgagaagttaacagcaggattaattcgtacagttaacggtatctattatttatttggtcatacggatgatcaaaattataatgaagatttattgatgtatttaaaaatggctattgaaaaaacagagaagagatttacactattcgcttcaagtgaagagtgggaaatgatgattgaagggtgttttagtaatgtacttcggaatatgccacgaatgaaattccaaagagaaatctttgaagagcgaacacaagatgcaaataaaaatacatatgcagtgaagcgtattgataaaagtgatatagaacgaagcagtgaatttacagaggagtactacaaaggatattggggatcaaaagaaacgtttttgaatagtggttttggattttgtatagaacaagatgggataattgtagctgaatgtgtctcaatatttagcgggaatggttatgctgaaatagatatcgcaacacatgaagcatatcaaggaaaaggattagctcaagctgttgcgacacggttcgttgagcattgcatgcaaaatgatattacaccgtgctgggattgttatgtagacaatattccttcgcaaaaactagctagtaaattaagttttcataatccgatagaatatagattgtttgtaagtaagaaaacgggggaataaaaatgaatgtggaattaacgagatttaaagttaagcctggtaagagtcatcgagtagatgaatggatgcagcttctt

SEQ ID NO: 1241 - DNA, 7081 bp, Bacillus thuringiensis
tcctgcagaaatggttcctgatttattataaatctgctacagtcggtttccgtaaaatttgaatcactagccctagcgaggcaatctctaatttccagaccttctcctcttgcttcggttcttcttttttctcacttcgaaaaaattgatataatacccaaatccctattccaataagaacaagcccaccgatacgcgttgcgataacaggtgaaaatactttcgcgatcatatgtccaattcccattgaaacaagcataacagccgctgaacacattccgataattataattgatcttagtggaattcttacgcttcttaaaccatatgttagccctacactacagctatccaagcttaatgtaaaagctaataaaataagagataaataaaggtacatcggtaagctcctcccttatacatagctctgctgtatgtatatgacaaatgcctatccgatgttatctcttttctatattctaggctgacaaattgggcagtaatgcgttcctggcccgccaacaactgatttttctaaatcgtgccacaagttacgcacgcctctccttttttcccatatacatttaggagttcttggaacgaaccaatttgcccttgtgagttgatatacgtccgaattgtacttccgccacgctttactgcttcgcctagcgttgtaacggtagcctcataaattcgctcaatttcttctactgttaaagacgaagcttctcgttccggatgaatttgagaacggaataaaacttcatctacatatatatttccaagccctactaaaagacgctgatccagtagcacaacttttattttacgatttgtcttttgtaatctttcttgtaaatactgcggtgtcatttcaggatcaaatggctccggacctaagtccgcaagaggcatttggttcatttcttcacctttcttaaagagatgcatcgtaccaaactttctcacatctttataatgtaattccgttccatctgtaaataagaaacggacgtgcgtatgtttatcaatcggctcatcctcttgatgtagtaaaaacttaccttccatacgcaaatgtgaaacaataacataattcgttacatataaaagcaaaaactttcctcttcgctttatattttcaatcttctcgccttttagcatttctttaaagatttctgcatcatccggtcgtttcactatttttggataagtaacaataacatcttcaatcgtttttcctgttacaagattttcaagtgtccgtctgacgttttcaacctctggtaattcaggcatttcatcacttccttattttgcgtcgtaccaagttggaccgtaagaataatcaactttcagcggaactgcaagttcaattgcatgctccattacttcaggtacaagcttctctaatttttcaatttcttcttttggcgcttcaaatatcaattcatcgtgtacttgcagaagaagacgtgcttgtaatccttcttcttctaaacgatccgccataataatcatcgcttttttaataatatctgcggcagtaccttgaattggtgtattcatcgctgtacgctcagcgaagctacgtaaattgaaattacgactcgtaatttctggaatataacggcgacgatttaataatgtagccacatatcctttttgtttcgcatcttttacgatgtcctccatgtattcttgtacaccagggaaactttctaaatacttttcaataaattccgctgctgcttttcttgtaattcctaagttttgtgaaagaccataatcactaataccatatacaattccgaaattaacagctttcgcttgtcgtctcatatttgaagttacttcatcttttttaacgccaaatacatccatagctgttttcgtatgaatatccatatcatgttggaatgcttcaactagccctttatcatttgcaatatgagctaatacacgcagttcgatttgtgagtaatcagccgcatacataatccatccttcttctgacggaacaaatgcctgacgaatctttcttccttcttctaatcgaattgggatattttgcaagttcggatccgttgaacttaatcgacctgtttgcgttaacacttgattaaagcgagtatgaattttagatgaatcttcatgtacaactttcagcaaaccttcaatgtaagttgaatttagtttccctaattgacgataatgtaaaatatttggaataatttcatggtgattcataagcttatctagtacatcagctgacgtagaataacctgttttcgtctttttaataaccggcaagtttaagttctcaaacagaataacaccaagctgcttcggtgaattaatattaaattctgttcccgcaagcttataaatttcctgttccatttcctttaatctacccgcaagttcttctcccatattacgaagacgctctgtatcaacttttacaccctttacttccatatcagctaatacacgtgcaagcggcaattctaactctgtaaacagttcatattgctcattcttctttaactcttcaacgaatgtttgctttacatcatataatacatgcactttacgagccacatgctccgctactacctctaactttggaacagcacgcttcgcaccttttccgtaaacttcttcatcagatttcacagcatgcgtttctttcattttcgctacagtacggaagtctttatccgtatcagctggatcaagtaaataagcagcgattaatagatcaaagtcaatcccttgcatatctatcccattccatttcagtgcaacgattgcacgcttcgcatcaaatgtatgctttctcatttctccatctgcaagccactctttaaaagcatctgacttaagagcaatgtctgtctgaataaagtaacatccattttcattttgaataccgaaaccttgaatgtctgctttatgatagttatcttcttgtacttcaacgataagcgcactatcttgctgaagcatttcttctgtaacttcttccacaatatcaaatgtaatatcatctaattcagctggagcagtttcttctggcgtaacgcctaatttatttaaaagggatgtaaatcctaaactctcgaacattggaatgacatcacttgcttcatatcctttatacgccatatcatccacacgaactgtaatcggcgcatctgtaataatagttgcaagatccttactcataagagcttgttctttattttcttccagtttttcttttaatttcttcccacttacttgatctatattttcatacaccgcttcaaccgttccaaactgtgttaacaatttaattgccgttttttcaccaactcctggtacacccggtatattatctgactggtctcccattaaacctttcatatcgataatttgctttggtgataagctgtatttttcaaataaagcttctttcgtatattcatccacttctgtaatcccttttcgcggaatacatacaagcgtgttatcagaaacaagttgaagtaaatctttatctcctgaaataacttttacacttgccccttgctcactcgcttctttcgctaacgttcccatgatgtcatccgcttcataattttctaattcataacgcggtacattgaacgcatccagcatctcacgaataaacgggaactgctctgataattcaggtggagtcttttgacgccctcctttatactcactatacgttttatgacggaacgttgttttgcctgcatcaaacgccactaacatatgagttggcttttcttcctctaatattctcattaacatcattgtaaaaccgtaaattgcgttcgtatgtatacctttgtcgttatttaaaagcggtagtgcaaagaatgcacgatacgcgatattattaccatctactaatacgacctttttttccaaaattgaaacctccccatacaaatttgaaatgatttttttcacagaaaaaaaccgttcctttcctctctctatattaacatgactaatagagagaagaaaaataacggctattttctttcatatataaaacagacttatattggcataaagggaagtgacgagaacagcttaactattctcgtccaaaattactccttggatgaaggggttttcatgtattatattaacagagctttattaatatttaattaagccattgttaatatattgtaaacatccttcatcctatttttcagttgctgatttcggtaaaacaactgtaaacgttgttccttctccaacttcactatctactgtaatcgtaccttgatgcgcctcaactaaatgctttacgatcgacaatccaaggccggtaccaccagtatttctacttcttgctttatccacccggtagaaacgttcaaaaatacgcggaatttcctctttactaataccaattccagtatccgatacttttatataagcattatatttatcttccgctaactctactgaaacaacgcctccagccggtgtatatacgattgcgttattaattaaattaataaagatttgtttcaaacgacttggatctccaataacagaggcacgttttaatacattcacttgtaaagagatttctttttctcctgctttattatcaagcaccatatgaatatcttcaagcagccccttcatgtcaacggttcccatatttaatttaaatccttgttgttcgatcttcgacaaatctaataaatcttcaattaatccttgcatgcgctcactttcttttaaaataatgtgcaagaaatgttcgcagaattttttattatccatcgctccgtctaagagtgtttctgaaaaacctttaatagaagtaatcggtgtctttaattcatgagaaacattcgctaaaaagtcttttctcatttgttctaatttctttaactctgttatgtcatggaatacgagaacaatccctttccattcatggtttgtcccgataataggcgctccatatacttcgaaatgcttccgttcaattccaagtggtaataacatttgtttacgcactttcacttctgtcataaagatttcttctacaagctcaataatttctgtatgatgaaacgattcataatataagcgatctaaatattcttcatctgttacgtggaaagtttccttataagagcggtttacaaggtttatatatcctcggctatcaattaaaatcattccgcttcccatattttcaattaacgtatgcagacgatcttgctgcatttcttgttcaagtgtcatctcttgtaaatttcgtgctaaaatattaatcgctttactcagcattcctgtttcatccgaatgactttcgtatgcacgtgctttataattaccctttgccaattcaattgcaactttcgtaaccgattcaattggcctaatatattgccctgtaattttcatacctaaaaatacaactacgagacaagcaatgacaaatccgataattaataatccccacgttttttgatgtacgtctcttaaaggatcaattatacttttcaccaaaatgtatccttgttttccttctacatcttgaacgaacaccgcatgataaaattcattctttcgatccgtttctttcgtaattactttacttcgttgttttgccacttccgaagaaagttctttaatcgtctctggactaaatgccaattcttgtccttttctatattgaactttctttttttcatccaaaaatacgatagaagctggtattttttcttctaacttttcaaatacgtatggattttttaagacattatcaaaaccttgctcttctgctaacgtcgcaacatactccgtctcttttaccattctctctttagcatgatctatatagtagttttcaaacacagtttctagtaataaacctagtccaactaaaataaatacaataagagaaacaaatgtaaaaagaagcctggaacgaaatttattcattcccttttggctcctctaatttatatcctaaaccacgtatcgttttaatgtacgtcggttttttcgtattttgttcaattttatcgcgcaaatggctaatatgaacatcaacaattcgtgtatcaccagcaaaatcataattccatacagcacttaataattgatcacgtgtcaacacgcgacttttatttttcgcaagatacacaagtagttcaaattcttttggtgttaattcaagctttcttccttggaaataagcctcataaaactccggtaaaattttaagttctgcaattgtgatgctatcttcatctggcgcttctgcaacttgttcttcttgttgtaatttcgtacggcgcaaaatcgccttcacacgagcaactacttctcttggactaaatggctttgtcatataatcatctgccccaagttcaaggcctagcaccttatcaaactcatcatcttttgccgttaacattaaaatcggcgtcataacgcgctgcaatcgtaattctttacacacttccataccatccattttcggaagcattaaatctaatataattaaatctgggcgttctgttgtcgctttttgaagcgccatttctccatccatcgctgttataacttcaaacccagcttgttgtaaattaaattcgattaaagttaagataaattcctcatcatcaactactaaaatacgattgttcattcttttcctccaagttatagacttgaaaccttcttcatcctagtattttccccgttattctcatcatactagaaaacaaggtccctctcaatataattgtctattcatggattcggattgtgctattgttattcctaaaaacaattacgttcgcctcaattatgttttgttatccatactttatatacttccatatcgttattaaattctacttccgtatgaatattgagttctcgattttgcgctaagagaaaagataaaggatacgctattttataatctggtgtttcatatccatcaaatactcttccgtacatttcattcacaaaccccgtctgcccacacttcagcttttcttaccgtttaaagatc

SEQ ID NO: 1242 - DNA, 7600 bp, Bacillus thuringiensis
aaagaaccagcttttcaacatctatggaaatgatctcacattaatcgaagaaccagaaattaaacaagtggtatatgtagatgaaaatacaaataaagctacaaacgcatatcaaattacttttagtgcatctacacctgaatatgtatccggtacagtattaattgatgcttttggtggtaatctattaaaagaactcgttcaaaaattgggtatacaagtagagagtagtattgtccaatctgcgacatcaaataaatcaacagatccttcaaaattaacaggtacaggaaaagatgacttaggtattaatcgtacgtttggaattacacaaagaagtgatggaacgtacatgcttgcagattattctcgtggtaagggaattgaaacatatactgctaattataaagattataataattatagaagaaatgtatggggttatctcgatgatttagtaacaagtaattctacaaattttacagatcctaaagcagttagtgcccattatttagcaacgaaagtatatgatttttatcaagaaaaatatggccgtaacagctttgataataacggacaaaaagtaatttctgtcgttcatggttggaacacaaatggtacgaataaaggaaatcctaagcagtggtttaatgcatttagtaatggcgctatgctagtatacggagacccaattgttagagcatttgatgtggcaggacatgaatttacacacgcggttacaagaaatgagtctggacttgagtacgcaggagaagctggtgcaattaatgaagcgttatctgatattttaggagtagccgttgaaaagtatgccaataacggaaagttcaattggacaatgggagaacaatcaggtcgtatttttagagatatgaaaaacccatcatctatctcttctagatatccagaggattataggcattataataacttacctattgatgctgaccacgatcatggtggtgtacacacgaactctagcattattaataaagtagcttacttgattgctagtggtggaagccataatggagtaaacgtacatggcattggagaagataaaatgtttgatattttctattatgcaaatacggatgaattaaatatgacttctgattttaaagaattaaaagaagcttgtattcgtgtagcaacgaacttatatggtaaagactcattagaagtacaagctgtccaacaagcctttaaagcagcgtatatttaatattattgtgatgaattacaaactctttcattttaatatagtgattaatttgtatttatagacaaaaaccttgtagaatttttctgcaaggtttttgaatgttatcccgctatttgccgggcggtaagaccccgcttcaaaattcagctgttatttttttacttgttgtaaaggatggaaagcttttaaggttgtggcacgcctcttaagaaaaagataaggcgaagcgatctcgctgttattttccaacaacaaacatttgttatttgtattatttagtgaaagttaccaaacgtttttcaaaactattttacctattgctttatttgactccaaatattcatgtgcttgtgcaacttcatcaaacgtaaaagatttagaatctagcaatggacgaagttttccttcttctacaatttgcgttattttcgttaagatttctccgcaatcattacgcttatctgtatgtaatatttttaatgccataaaagtaacgtgcagagagagtccttttgcgtgtaaaggagagaggtcatgggttgaacgagctgcaatagttatgacagttccattgaccgcagcagcttcaaaagaatgatcaagattcttgccgcctactgtatcaaatataacttcaaatccgtttccgttcgtatgtttttgtacatattcttgaacagattcttctttataattaatagctatatcggctcctaaacgatgggctatttccattttgttttgctgagaagctgttgtaaaaactttagcgcctgcccatttagctagttgaatggctacgtgtcctacgccaccagtagctccatgaatgagaacattttgaccaggtttaatatttgcacgatcaaataaagattcccaagctgtaattgcaactaatggtagagcagcagcttcttccattgttaaattgttaggtttgtgagcaattaatcgtgcatcagcaagcataaattctgcaagtgcacctccagtttctttaaaacctccggcacatccgtatactttatcccctgatttgaatttcgaaacaccttctcctacttcaataacaataccagctacatcgccgtgtaatatagctggaaactcaggagcgacggctgaaacggccccactacgcatttttgtatcgattggatttacacttgttgcttttacatcgattagaacatgacctggtaaaagttttggttttgaaactttttctaattgaaatacagatgaatccccaaaagaatggataatttgtgctttcatagtttatacctcctgtttgtggttatagcatagcaaagtacgaaaaataagtataatattttgaattttgttagtgagaattttatatagagaaggggaaagtgcatgaaatgaaataatgtaacgtacttctaaaaactactgtaaagctttttgaagaaagggtagatgttatttttgcagcatgatttattcattatgtttatcccgctatttgccgggcagtaagaccccgcctcaaaattcagcgaaagcaaagaagttaggtgggagttgggctgctcgtaaaagccagattggtgagggctaattaaagtttaactttattcggagcgacaggggatttagcgaaacgcaaaatttaccctgctttatacaaactatttagtaattaaaatataccgcagtctatttcgattatcggtattggcagaagggtaatgtcagatgtggaatttcaaacaaaggtagaacaatccattgctatattttctagaagatctactgatgacgaatcaggagtagaagggtttattagcacatttcgttattgtcaattaaatacagcgaatgtagaggactatcaagatttgttgagtcttgtaaagaggcgtgaaacagaattaaacattcctgaaaaccgcatgttttacctatctgttataccagaagtatttgatgtcattgctttaaatattaaggaaagtggattgtgagctacaaaaggattaaatcgtcttattatagagaagccttttggttataatgtaacgtctgctcgtgagtttagcgctaaattaattgaatattttgataaaaatgatatttattataacgatcattatctttgaaaatgaatggtaactaggaatacacttagaaaagtattacgaaataaatcgtatgtaattcaagacatttttattgacgataataatttatgtggttaatatattagacataagattatttaattactaaaagtaatcagatataaaatgtttcgttaaattctataaataagtaagttgtggtagaaatgctttgaattgccactattaatattggggacaattaaaaagcgaaaggtataaaaagaattgggatttgataactctttgtttttttataaaaacaggggcttctgtacaattcatttttagtatatcgacgaggattatacaacaagagggggactgaacttggaatcaatgacctttgttttatttggagcgacaggggacttagcgaaacgcaaaatttacccagcactatataatttatatagagatcaaaagcttccaaagcaaatatccgttatcgggcttgggagacgtcaagtatctcatgtagattttcaagaaagaataaaagaatcaatagagacgttttcccgtcatagagaagaaggtactccggaactggaaggttttttagataattttcgctattgtccattagatgtgagtaagccggaagactatgagaggttattacaagtcgttcgtgaaagggaagaagaattacatataaaaggaaatagaatgttttatctttccgttgctcctgaatttttcgagaccattgctttaaatattaaggaaagcggacttgataaaacggatggatggaaacgtctgatgattgagaaaccattcgggcacgaccttacatctgctcgtgagcttaacgataagcttagtcgcacgtttgaagaagacgagatataccgtatcgatcattatttaggtaaaccgatgattcaaaatcttgaagcattagaatttgcaaatcctgttctccaatcaatttggaataaagaacatatagcgaatgtacaaatcacagcgagtgaaacagttggggttgaagaaagggcaggatattatgaccaggcaggggccattcgagatatggttcaaaatcatatgttacaaatattaatgatgactgctatgaatctgccggaaaaggttaatgcatgtgaaattcgagaggaaaagcgaaaggtaatggaaacgcttcgtaaagtgaaaaaagaagacgttcaaagccatatcattcgcggacaatacgctgcaggtgagataaaaggcgggcaagttgtagcatacaaagaggagccaggagtaaatccttcttctaacatagacacatttgttgctgctcgcctgtggatcgataatccattttggactggcgttcccttctatatacgaacaggcaaacgaatgaaagaaaagtctactcgtattgtaatcgaatttaaaaatacgttaaaacagcaatatcaagataataatccaaatgcagcacctaacttattaataattgaaattagcccaggtgagaacgtttcattacagttaaacagtaaaaatccattgaaaaatggagaaattgaaccgatgcgtattaactttacttgtgagcaagcggatgtgggagtacctgaagcgtatgaaagactcattcatgatgctgtgagtggagacgctacattctttgcacattggagagaagttgaattgtcatgggaatgggtacaaccaattcttgaagcgttcgaggaaaacttattaccgcttcatgaatatgagtctggttcatatggtccagaagcgtctaatgaactgttacaagaaagtggatttaaatggtggttagatcaagagacggaaaaataagtactttctttaatgaaagcatttagggggacgattactatgacacaaaacataaatcaattagcagtgaatacacttcgtacgttatcgattgatgctattaatgcggcaaactcaggtcatccaggtcttccgatgggagcagcaccaatggcttatgcattatgggcgaatcatttaaattacaatcctaatcacccagaatggtttaaccgtgatcgtttcgttttatcggcgggacatggatctagtctgttatatagcctacttcatttagctggatatgacgtttcaattgatgacttgaaaaatttcagaaagttaaatagtaaaacacctggacatcctgagtttgggcatactcctggagttgaagcgactacaggcccgttaggacaagggattgctaatgctgtaggaatggcaatggcagaagctcatttagcagcgaagttcaataaggatggtcactctattatagatcacaatacgtatgctttagtcggagatggtgacttaatggagggtgtcgcttatgaagcgatgtcaatggcaggacatatgaaacttggcaagttaattgtactgtatgattcaaatgaaatttcacttgatggtgaattaggcattgctttctctgaagatattcagaaaagggcagaatctgtacattggcaatatgtaagagttgaagatggaaacgatgttgatgcgattacaaaagctattcaatcagcgaaagaaaatacggatcaacctactcttatagaaattagaaccattataggttatggaagtccaaaagttgctggaacgaacaaagcacatggtaatccgcttggagtagaagaagcgacagcgacaaaacaagtgtatggttgggattatgaggaagatttctttgtacctgaagaagtaaaagctcattttaatgaactaaaacaaaaaggtattgaaaaagacaatgactggaatgagcagttcaacttatacagagaagcgaatcctacactggcagatgaattagaaaaagcgattacaggtgaggttttaattgaagcaaaagacattctatcttttgatactgaaaaaacgatttccactcgtgttgcaagtggggaagctattaatcattatgtgaaatcgattccttctattttcggtggaagtgcggatctttctcattctacgatgacagatataaaaggtgaagcagtatatgcagtagaatcatatgctggacgaaatatatatttcggtgtacgtgaacatgcaatgggcgctgcagcgaatggattggcgcttcatggaggagtaaaacctttcgtaagtacattctttgtatttaatgattatcttcgtccgtccattcgactggctgcactgcaaaagttacctgttacttacgtatttacacatgattcgattgctgtaggagaagatggtccaacgcatgaaccaattgaacaattggcagctcttcgagcaattcctggtttaacagttatccgcccgtcagatgcaaatgaaacagcaagtgcttgggcgtatgctttacagcaaacggatggtccagtcgttttagtactgagtcgtcaaaatttaccggtgtttaatgaaacgaaagcgaacatagagaatttctctaaaggagcttacgtattaacacaaacaaatgaaaatccggatgtaattttaattgcgacaggttctgaagtatccttagctgctagtgcgaaagcaaaattagaagaagatcaagtttctgttcgcatcgttgcaatgccgagctgggagttattcgatcgccaatcgaacgaatataaagaatccgttcttccgtcttctataacgaaacgagtatctcttgagatgggtgtatctctcggttgggaacgttatgtaggacaagaaggaaaagtaatatcaattgaaacatttggagcttcaggtactggagctgaagtcatgaatctatttggatttacgacagaaaatgttgttcaaattacaaaaaatgtgttgaattcttaagctatgactgtgaatacctttctgtacatactaacatttcagtgctgaaaggtattccagattgtagtgatatggatttttaataaaagatgatttgaggaggaattatattatgcaagtaggattaattgggttaggtaaaatgggattaaatttagggaaaaatttaatggatcataaacatgaagtagtagcgtttgatttaaatacgagcgcagtagaagaaatgaaagagtacggggcaacaggtacatctagtttaagtgaacttgttcagtcattacaatcaccaagaattctttgggtaatggtaccacacgctgttgttgattctgttattgatgaggttaca

SEQ ID NO: 1243 - DNA, 5326 bp, Bacillus thuringiensis
caatcgtcccgagttcttcccttttactaatgatcgattaaaaacgcagcctcatacaatattttcccgcaaaagtttcgaaaaaattcgcttcttttctcgtattttcgtattttttatgaaaaaagggcattttttgtaaaaaaatagatgtttcctaagtagaaatcttattttaagcagtacgatagtaaatgaaatttatatcggcgatttttcgaatatatcgactgtaactcgaaatatatcagcgattttccaaatatatcgaccgcaactctaattatatcagcgattttttaaatatatcaacttaccaacaaaaatcgacaatgacagtcgctatacaataagagaaagctgttccaaaatccctttttggaacagctcattaaaagtttttataatttacttccaaatgattttaattcattcataaaatcattgaactgcggtatattcatttgctgcgccgcatctgataaagctacagctggatctggatgtacttcagccataattgcatctgcaccaattgccatcgctgcttttgcagttggtaagagaaggtcacgtcgccctgtagaatgcgttacatcgacaacgacaggtaaatgtgtttctttctttaaaatcggcacagcggaaatatcaagcgtattacgcgtcgctctttcatacgtgcgaatacctcgttcacataaaataatgttcccatttccctttgccataatatattctgccgcattaatgaattcttcaatcgttgctgatagaccacgttttaataatactggtttatttacagcaccagctgcccttagcaaatcaaagttttgcatattgcgagcaccaatttgaataacatcaacgtaatctaatgacatctcaatatcattcggatttaaaatttcactaataacagccaaatcatattcatctgctacctggcgcaaaatttgtaatccctctaacccaagaccttgaaaatcatacggtgaagtacgtggtttgaacgcaccaccacgcattaatttcagaccttgctctttcattgcttcagcaacttgacgtacttgttcataactttccactgcacacggtcccataataaaatgctgatttccgtcaccaattttttcacctttaatttcaacaatcgtatcttctgtttttttcttacgagaaacaagtaatgctttacgatgatcatcttcttgtaattctaaaccagcttgaaaaatttgtttgaaaatatgttgtaaagtcgaagtttcaaatggaccattattattctctgcaattaaatccagcatatttctttcacgtacaggatcaaaacgtttcacaccttgtacttcttttaaattaccaacttcttgtacgagacgacctctttcgtttagtaactctaatatttgtaaattaagttgatcaatttcagaacgtaaacgacctaattgttgtgatgccataagaaagccacctctttcaaattcctatatgttacttttttaagataacttattatagctgatacatatacgattgtcacacgatatacagcaatgaattaccatcaaaaaacgttgtatattttcatttaaaataaaaaaagacagtttacatactgtcttttttacaagaaggaaacaaacggtttatcactgtttttctcttttataatcacagcctcgattttactttcggacttgatctgtaattgtactttcgcatctttaggcaatttgtctaacataccttgcgcagccaattgggtaagagccattaattctgttttaccgttatatttaataacaatattcatatttaatgtatccatttgatctttcttataagaaactttagcgttgactggaataaaatctccattagaaaaaccttttatttccttagcaaagttatttatttttgtattatcttctccatgtgcttgtgtaaattcatcagaaggatatgaatacgacttttcatcaattgtactccaatttccaaggttcgtatcattcttttgaacagtagcactagcaatatacgtaccattttttaaagaactagtactttcttgcttaaagatagcaaacgtaattggagatttgttatacttatcatttttgttaatagcttcaataagttgtttagcaacttcagaccctttagacatagcttcttcattcgatacacttgaagacatagctaagccaatcataacaccagataaacttagttcatttgaattctgttttccgaaatagtcttgttctataatattcgtcaaaactggcgcttctactttcgcaactagttcatcaattagtttctctggaatatactggtttaattgcagtacgtgactctctgtatcaaattgctgcgttgcaatatttattaaaccattttcatactctgctaaatctaatttagaatttgtttttatattagctgtattaataaccttttgttcttttaaaggaataacagttctataataatctttagaaacagcagttctcggaatcatacttttttcttttgtatctttttgtataacttcatccttcttactaatcgtattactattgttactacaagctcccagtaataaacttacgactgcgaaggataatgccattttcttcattacttaaaacctactttcaacaatctagttatttagtttgaactattaatagtgtaccactaaatatatttcaacaaaaacaaaaaaaagaagcaagcacctttagcttgcttctttttactttatattctcttctaaagcatcttttttaatattccaatgagatgtattccatactaccatcccatcttttatgtatagcacttgcggtgattcatgtctaatactgtattgttctgcaacacgatttgacacatctctcgcatcttgtacgtataagtaatacgctggcacttctctttcttcgctgcaatacgcttgaaattctgtgtatgcaccgtgactaatcgggcatgtcgtactatgtttaaaaagaacatacggctcgttcttttctactaagacttcaagctcttcaattgtttcaagttttgtcatattcatcacgattcacctctcatacgaaatctagagcgcttctctttcttttcagcttttttctcaattctttctaatttacgctcttctttttcaaccttcttctcttgtctcgacgcacggtaatgattgtatacttcaatcgccgcactgctccactgtacaacttgcgctactttatcagcgttattttcaatttcgtccgttacagagtccgatacattacgaagcttcgtatttaaagattggattgtcgttccaatcccatctacacccgctaccactttatttaatgactgtgacttctgttgaatatcatcagctaacgcattcgttttatgtaataattgctctgtctctacgctaattccttgcatttgcttttctaaaccttctaacgtgcttgcaacgttttccaacgtcttctgaaccgataacaacgttctgcatacatacactactaatactgcgaaagcaaccgcgataatagccgcacttacatataaaagaacttgcatttcatcacttcctttatctttttcatactttcccctattatacaatcattttccgtttcattctaatccctatctcatcattagaattttcatacttattcgttaactgtaacataaatcattcaacaaattccactaagtaggttacaataggagaggatacataattagtagggaggctttacatatgaaagatccacgtattgaaaagttagcatacaatttaattaactactctatccgcttacaaaaaggtgaaaaagtattaattgaaaactttggcttacaaaaagaacttgtaactgcacttgtaaaagaagcatatgcagctggtggtttcccattcgtctctttaaaagatcatcaagtagatcgctctttattaatgggtgctactgaagaacatttcgaacaaatcgctgcatatgaagcaagcgtaatgaaagacatggacgcttatatcggccttcgctctggtgataatattaatgaacaagctgacgttccaagtgagcgtatgaaagttcatggccaaacagttggtaaaaaagttcatagagacattcgcgttccaaaaacacgctgggttgttcttcgctacccaaatgcttctatggcacagcttgctaaaatgagtacagaagctttcgaagacttctacttcgaagtatgtaacttagactacggtaaaatggataaggcaatggatagccttgttacattaatgaataaaacagataaagttcgtttaactggtcctggaactgacttaacattctctattaaagacattccagcaattaaatgctcaggtcatttaaacattccagacggtgaagtatactctgcaccagttcgtgattctgttaacggtacagtttcttacaacacaccatctccttacaacggttatacatttgaaaatgtacaacttaagtttgagaacggtcaaatcgttgaagcaactgcaaacgatacagagcgcattaacaaaatcttcgatacagacgaaggcgcacgctacgttggtgagttcgcaattggcgtaaacccatacatcttacatccaatgggagacatcctattcgatgaaaaaatcgatggcagcttccacttcactcctggacaagcttacgacgatgcatggaacggcaacaactcgaacatccactgggatttagtatgcatccaacgccctgaatacggcggcggcgaaatttacttcgacgacgtactaatccgtaaagacggacgcttcgttgtacctgaactagaagctttaaacccagagaacttaaaataataataaaaacgctcggaattttcgccgagcgtttttatttctttcctaccatttctattttcacatgtggattttctttctctataagccccaagaattcatccatattttgcggcatcgcaaccatatgtactttatatgcattcgtcgtaatttcaagagactttccgacctgacgtataattctcacatcttttaatacaatatcatcatttaaaataccgtactttaatacgccattttctactttatgttttttaataaatacttcccaaacgagtggtacatttacaatgaagcataaacccatcccaatcaacgctgacatccaatgcgctttattggtgaaaagcataacaattggattataaacataaacgctaacgtaagacaaacgaaaaatca

SEQ ID NO: 1244 - DNA, 5921 bp, Bacillus thuringiensis
gtaacagaaccaattgaattcatttttttgtttattgctccagcattatatgttgtatatgctattacaacaggacttgcattcgtgctagctgatttaattaacttacgtgttcatgcatttggatttattgagttaattactcgtacaccaatgatggttaacgcacgtttaacaagagacttaatcaactttgatattgtttcattagtgctcttcggtcttaactttacactatttaatttcttaattaaaaaattcaatttaccaacaccagggcgtgcaggtaactatattgataatgaagatgaggcatcagaaggaacaggaaatgtaaaagacggttcactagcaacaaaagttatcgatttattaggtggaaaagaaaatattgctgacgtagatgcttgtatgacgcgcttacgtgtaacagtaaaagatttagatgttgttgcaccagaagcacagtggaaacaaaatggtgctctagggcttattgtaaaagataaaggtgtacaagcggtatatggtccgaaagctgacgtattaaagtcagacattcaagatatgttaggtgcgtaataatatgaaattgctaactttaaactgtcattcttggcaagaagagaatcaaatagaaaagatacaataccttgctaaagtaattcaagaagaagagtacgatgtcatcgcattgcaagaagtaagtcagtccatacaagctgaaaatgtatgcggtaacaagaaagaagataattttggacttttactattagaagagttaaaagcgctacatgtaaaagattacaatattacttgggatttctctcatattggttatgacgtgtatgaagaaggattagcgattataacgaagcataatattataaaagaagatacgttcttcatttcagaaaacgaggatacaacgtattggaaaacacgtaaaattgtaagtacaacaattgcttataatggtaaggatataacgttttactcttgccatctcggttggtggaatgatgaagaagagtcattcaaaggtcaagttgatcgtttgatggagcgtgtagatagcaataagctcgccttcttaatgggggattttaataacaatgctcggttggaaggcgaaggttatgagtatatgatgcaaaaagggttgtatgacacatatgaattagcaatagagaaggatgaaggaacgactgtccaaggtgagattgctggttgggatgaaaataaacataatttgcgaatcgatctaatattgtgtaaccaaagtaaaaaagttcattcttcaaaagttatttttaatggtacaaacagaaatgtaatttcagatcatttcggtgtagaggttcaattggatatataatagaagaaatcctcacagagaataaaagctgtgaggattttttttaggaatacaagtatttccaagagaaaatacttgtattttttatgacatttcatatatatttgttattattgaatgtaaaaccgatttggtcattttgtattcatactttgactcacttcgttatataatgaagtaagtgaaagttaatgggaaaaaatagtacgtttttggttaatacacgatgtagaaagtgatataattgcaaaatgcatgtatcattttctaaagaaggaaaaatatataattaggtgataacttctatgaaacaaatttggcgtatttataagacagatttacggaatgtagccaaacattgggctgcaattgttattgttttaggattaatgattttaccatcgttatatgcatggtttaacattaaagcttcttgggatccatatggaaatacaaaagaggttcccattgcagtttccaaccaagatgcaggttctaatttaagagggaaagatattaatatcgggaaagagattgtagactcccttaagaaaaacaaaaatcttggctggaaatttgtagatgaaaaacaagcaatttacggagttgagcgtggggattattatgcaagtattacgattccaaaagacttctctgaaaaaattgcaactgttctggatgaaaatccgaaaaaaccagaactggattactatgtgaatgaaaaagtaaacgcgattgcaccgaagattacagcaaaaggtgcatcaggtattacagaagaaattagtaaaaactttgtaaaaacagcaaacggtgagatttttaaaattttcaatgaccttggaatcgatttagaaacaaacttaccaagtatcgaaaaagtaaaagatcttgtatttaagttagaagcgcagttcccagaaatgaatacacttatggataaggcgttagatgatgcaactcgagcagaagatgttgtgaaagtagcgcaaaaagagttgccggttgtagagagtgttatgaatgatgggcaagaggcgttagggaatttagataaattctttgcgagaaatgatgaaacattgaatcgcgctccgggaactattaaaaataatttaacagtaatgcagcagggattggatgctgcagcgaaaattacggattacttaaaaaatccggcatttgactttaatctgacattgccagatccagctaaattaccagtcttacctaatataactattccacaaataccagagattccagcattaccacaagtgaatggtgaagggtataaaaatattgctaaaaatattgatcaaactgtaaacactgttttcaattctactcgtgttggaacggcatatgtaaagagtgttatggatggccttcaaaataaaggcgtggatccagctgtagcacagaaaaatgtgcaggatgcttcaaagctcctccaagagcgtatcgatagtgtttcatatttgattgatttctttacagctttcaaggaatcagcttccacggaattcggtaaacagttctttggaaacagagtggaaagtttaacggtgcttaaaaattctatggtggacgctaacaatagggttaagcatgtaggagatttaattagttccggacaagaagttaaacaagatgtgcgagatgctgtaaatcaaaaattagatgcagtaaataatttagtaaatcaagctgaaaaggattataatgcaacgtttgtagctgattttgaaaaagcagtaagtacagctgagcaactgaaaagtaaggctgaaaatgcgcaagaaaatgcacagcagcttagaggcaatttaaatcaagatataaataaggctaatgagatattaaacaatggtagagagaaatatgataaagctgtaaatgattacagtagattaaaaacggagcttgaaaaagcaagagaagacttaagtaacaaaggtgttaacggattagattctacaaaagtagccttaaatgatttgaatgggcagttcaaagcaagttggaatttagttaatgacatgattccagttctggaaagtacaaataaagtgttagctgatgtgaatagtgataaaaatcttaatggtacaatttctaagttaaataaagcaaaagatggtttgcaaaaaggaatggatttaactgataaaggaattgacgctattaataaaggtcaaaaaccagcagctgatgttattgaaagtattaatcaagtgtctaaaagtgtttcgggccaaattggtgacattttagctaaatatgactcagaaatcactccaaatttcaatgcagcaattgctcgcacaaaagagatgtctaaaaatacatctcaaattttaaaagaggcagacaaaaagcttccagatgttaaaaaattactagaagattcatcaaaaggtttagtagatggtaaaaagaaattagcagacattaaagctgaaatgccagctactgagaaaaagattaaagaattagcagataaaattcgtgattttgaatctgaagaggatttaaaagacatcatacgcttattgaaaaacgatgttgagaagcaaagtgattactttgcgaatccagtaaatttaaaagaaaataaattatttgcgatgccgaactacggttcagcgatgtcaccattctatacagtgcttgcattatgggtaggcgcattattaatggtttcattattaacggtagaagtacacgaagagggcgcgaattataagagccatgaaatttacttcggacgtttattaacattcttaacgataggtctttcacaagcgtttatcgtatcgatgggagatatattcttactcggtacgtacgtagtcgataagttctggtttgtgttatttagtttatttattggtggagtcttcgtttgtatcgtatactcactcgtttctattttcggaaacgttgggaaatcgatggcgattattttacttgtactacaagtagcaggatcgggcggaacattcccaatccaaatgacaccagcgttcttccaagcgatttatccgttcttaccattcacatacgcaattagcgcaattcgtgaaacagttggtggaatgctttgggatatcgtaacgcgagatttacttgtgttaagtgctttcgtagtagttatgattgttgctgcgttattactgaaaacaccaattaacaaatcaagtgaaaaatttgttgagaatgcaaaaggaagtaaaatcattcactaaaataaaaggttcctaccgatagaggtaggaacctttttgtttaatcaaattttaatttttttaatgcttccgcgaatgggttatttaatggttcttcttcttttttctgttgtttcatatatttttgaacgtcgcgtttatcggctttgtttccagattcttttttacgtcgctcttggaatgttgataatttctcgcgatagccacatttacatgcgaaaatttggcctgcaccctcaccacgtaattctagtttctttttacattgcggacagcgagcatttgttgtacgagatacatttttacgatgaccacattcacggtcttggcatacgagcattttccccttttttccatttacttctagcattggtttaccgcaatctggacaagacttcgttgaaatgttgtcatgtttatatttcttatcactcgatttaatttcagcaacaatttctttcgtatagttcttcatttccgaaatgaatacttctttctttaattttccttttgcaattgcttcaagtttttgttcccactcaccagttagtgtaggtgattttaattcttctggtactaaatcaagtaattgacgaccttttgatgtaatgtgaatatctttaccacgtttttcaattaagaaagaattgaaaagtttgtcgataatatctgcacgtgtcgctacagtacctaatccaccagtcgattttaacgtatcagcaagttgtttattttgcgtatccatatattttgtaggattctccattgctgaaagtaaagttgcttcattaaagcgtgcaggtgctttcgtttgacctgatgtttgcataagtaactttacagttaatgtatcgcccttttcaatgtgaggtagaatctgctcttttacgtcatcagttacatcatcgtcttcaaatcgattttcgtatacttccttccaaccagcatgtaaaatcgtttttccgcgtgcaatgaatgtttcattgccgacctttgtgcgtaacgttagttgttcgtattcgaatgctgggaataaaacagctaagaaacgttttacaactaaatcataaattttgcgttctttatctgtgaatgctgcgaagttaacgtatccttctgttggaataatcgcatgatgatcgcttactttactatcatcaacaaatgagccacaaatggtaaatgaatttcagaaggaattaaaaccgaagggaatagagttagctggttatgcagtggatctagaatcgtatgtttcaaattaagaaggccaagtatttaaagattctcaa

SEQ ID NO: 1245 - DNA, 5685 bp, Bacillus thuringiensis
ttttcattttcgcttcttttaccatttcaacaaagtatgctgtcacacgaatgatcatctgttaattccggatggaatgaagcagctaaaaactgatccttgtcttaccgctaccattcggtcaccatgcttagaaagcacttcaacattatcagctacttctacaacatacggcgcacggataaatacaccaatgaagtcttcacccacgccttcaattgaaagcgcagcttcaaaactatccttttggcgtccgaacgcattgcgctcaactgtaatatccatagcaccaatatgtgctttttcatagccaataagtgttttcgcaagaagaatcatccctgcacatgtaccaaacattggtttaccagactttgcaaatgtacgaagtggttccatgaaagcatacttatcaataagacggcgcattgttgtactttcaccgcctggtaaaataagaccatcaatctcttcaagttgctctatacgctttacaacaacagcttctgcaccacttgcttcaactgattttacatgctcacgaactgcaccttgaagacctagtacaccgattttcaccattttaaagttctcctttaattaccatccacgctcttgcatgcgttgttctggtaataacgttgaaatttcgacacccttcattgcattacctaatcctttagaaaggcttgcaattagttcgtaatcttcataatgagtcgttgcttcaacgattgcacgtgcaaatttctctgggttttctgatttgaagataccagatccaacaaataccccatcagcaccaagttgcatcattaatgctgcatctgctggtgttgctacaccacctgccgcaaagtttacaactggtaagcgaccaagacgtttaatttcaagtaatacttcgtaaggagcgccagtattttttgcatatgtcattaactcatcttcacgtagactcgcaacttgacggatttctgcattgacttggcgcatatgacgcactgcctctacaatgtttcctgttcctggttcaccttttgtacgaagcatagatgcaccttctgcaatacgacgtgcagcttctccgatatcacggcaaccacatacaaatggaactgtgtaatcacgtttatttaaatggtatacttcatcagcaggagttaatacttcactctcatcgatatagtctacccctaatgattctaatacacgtgcttctacaaggtgaccgatacggcattttgccataaccggaattgacaccgcacccataacttcttcaacaattgttgggtctgccatacgagaaacgccacctgctgcacgaatatctgctggtacacgctctaatgccataacggcaactgcgcctgcctcttctgcaatttttgcttgttcagcgttaactacgtccataataacgccgcctttttgcatttctgccattccacgttttacacgttctgtccctgttacatttgtcatgtacaaaaacccccctaggtgaattgctttcccccgttaaaggcgaaaattaagaatactcttacattctaccactaactatcagatgcttgtctactactttttcataaagtcggtatgaaaaataggaataaaaaaaagctcctatcatgaggagcttttaaaaccaaccttttactgtatcaacagcactattccacatgccactaaagaatgaaccaattccgcgcatagcacgagtaaaccagtttgcttcttctacttcagatgttgttacaagatccacttgcagtgacttaccagttaaaaatccagggtcgtttgtatcttttggcgtaattaccatttgaccaagcgcagctccctttttaataggtgcttcttgtcccttgcttgattcttttaattccgttttataaacatctttacttccttttggcactggaagtgaaatagcttgtttcgtttgaactgctacatctttatctttcgcattttctactcgtactgtttcttgtccttttactgaagaaccttttttatacatttgttttacttcaaagttagcaaatccataatcatatagcttctttgtttcatcaaaacgtgctgtatgagaacttgttttaataactacagaaataaaacgcattccgtttctttcaaccgtaccagtgaagcaatctcctgcctctggagttgagcctgtttttaggccgtctacgccatcatattctttaactaagccctttaacatccagttccagttcgacattgcaaacttctctttttctggacggaattcttttttagggatttttgctgtatctaacacttttggataatctttaattaaatgttgtgctaaagttgcaacatcctttgcagacattttattttcttcatccgctgttgttccttcaggatgcattccctttaaatctttattcgttaaacctgtagaattgacaaatttataatttttcaaccctagttctttcgatttatcattcatcatttttacgaagtctacttctttacctgcaattgcttctgctaatgcaattgttgcaccatttgcagaaaagattgccattgcctcgtataactcttttactgtataagagccaccattttctaatgcaacatttgataatgaagcatcttgtgaaaccttatatgcatattcagaaaccttaattttctggtcccacttaagttttcctttatccactgcttcgtgaactaaatattcactcatcatctttgtcatactagcaatggataataattcatctgcattcttttgatataaaattttcccagaattcgcttctactaaaattgccgcacctgcttcaatgtttaaagcggctcctgtttcagctgatgcattgctatatggcataaaaatgctacaagctagtgtaagcactgttaccaaagcaatgaatcttttgcaaaacatacctttcacttttgctacccccaatatctatgtactcacataaccgttattctaacataatcaaaaaaaaatagacagagatatcaaatctctgtctatttgtatataagacattataatgagtagtttggagcctcttttgtaatttgtacgtgatgaggatgactttcacgtaagccagcacctgacatacgaatgaattgtgcattttcgcgtaagaattctaaatcctgtgctccgcaatatcccatacctgcacgtaagccaccaactaattggtgaactgtatctgctaaaggtcctttatatggtactcgtccttcaataccttctgggacaagttttttattgccttcttggaagtaacgatctttacttcctttttccatcgcaccgacagaacccataccacgatacactttaaattgacgaccttggtaaatttcagtttctccagggctttctgcaacacctgcaaacatgctacctagcataacaacatgtgctcctgccgctaaagctttcaccatatcaccagagtacttaataccgccatcagcaataactggaatgccgtgtttacgagcttctgttgcacaatcataaaccgcagttaattgtggtacaccaacaccggctacaacgcgtgttgtacaaatagaacctggtccaataccaactttaactacgtttgcaccagcttcaattagtgctttcgttgcttcagcagtagcaacatttccagcgataatatttagtgatggatatttagcacgaacttcttttaccttatcaataacacctttagaatgcccatgtgctgtatcaagtacaattgcatctacactagcttttactaatgcatcgatgcgaagcatagcatccgctgttacaccaactgctgctccaactaataagcgtccttgcttatctttagcagagtttgggaattcaattactttttcaatatcttttattgtaataagcccttgtaatacaccgttattatcaacaagagggagtttttcaattttatacttttgtaggatcttttcagcttcttccagtgtagtaccaactggagctgtaattaattgttcttttgtcattacgtcagaaattttgattgagtagtcttggatgaagcgcatatcacggtttgtaataataccaactaattttcgctcatctaaattatttacaaccggtacacctgagatacgatattttcccataagatgttctgcatcatatacttgatgttctggagttaagaagaaaggatctgaaataacgccgctttcagagcgctttactttatcaacttgctctgcttgttgctcaatagacatattcttatgaataattcctaaaccaccctggcgagccattgcaatagccatgtcagcttctgttactgtatccattcctgcactaattaacgggatatttagctgtaagctttcagataaaactgttttaacacttacttctcttggtaatatatctgacctagctggtacaagtaatacatcatcaaaagtcaaaccttctttaacaaatttagattcccacataattgttccccctatgataccagaaattattattagtagcttatcaattggttaaaatactgtcaaggacgtatatatatgttagaatttttagacaataaaaggagcgtaatatatgcatcaaacatcttgtacttggcagcagttaagtttctttttttcatctcaaaacgtacaacgttatcttgcccgttgttacgaaaaatcctctattcaggatgccgaaaaaaaaagttttgaaaattgttatccctttatttattacttagaacacgggaaaaattattatgaattatataagacagctccattttccattcaaccaatgttgttattttatggaattagtcaactttttaaagcatgcctactaactattgaccctaactatcctgaatccactactgttttagctcatggcgttacaactcgcaaacgaaaaaaacaagggtatcaatttttagaagatgaggtgaaggtacaaaaaaacggattatttactcatgttgcagaacaactgtttcacatgaaacacttagaagcagaaaaatttaacatgttagaattaatgggaaatattccagaattacaaaatttatttcgttatagtcaaaaaggatcaactttatataaaatcgattcaacaattaaaaatgagctctccttttcagtcaacctactagatcgattacatatgactaaagagagattttctcgttacattgaaacatcttgtaagcatttatcaatacagcacgtacctgagaagactaatgaatcgaatttactttttacggcgcccgttcaatcatggaatcctatgtacagtactcctttatactatgaacatcttactaatacttattatttgccacttacgactgatcctagaaatcctaagccaatattacctgaactcctcattcattatttattgctctataatttaagcatgatttctaggtatgaaacagattggtggtatgacttacttggcagttatggttctgaagattatccatttatttatcaatttctaagtatttctgctcaaaaaatcccttactatatttcaaattttttattaatggaaccaaatctatttcatgggaaataaaaaaacacaagtcaaatgacttgtgtttttagttg

SEQ ID NO: 1246 - DNA, 7427 bp, Bacillus thuringiensis
gataagatgattgaagaaggaaaagaactagcgaagattgctccaaacgttgtagtaaaagttccaatgacaacagaaggtttaaaagcagtaaaagcgttctctgatttaggaattcgtacaaacgttacattagtgttctcagcagttcaagcattacttgcagctcgtgctggtgcaacatacgtttcaccattcttaggtcgcttagacgatatcggtcataacggtatggacttaattcgtcaaatcgcagaaatctttgcaattcatggcatcgaaacagaaatcattgcagcatctgtacgtcacagtgttcacgtaactgacgcagcattaaacggtgcacatattgcaacaatcccagcaaacgtaattgcttcattagtgaagcacccattaacagatcaaggaattgagaaattcttagctgattgggaaaaaacacaagagaaataatagaaaagcaagaatcctagtttaattgactaggattctttttttatttaaaagaattttcatgcaattttgcatattgtcttttaaatttgttatataagatatttaatatatatcacataactctttatttttcatatttcgacataaagtgaaactttaatcagtgggggctttgttcatccccccactgattattaattgaaccaagggataaaaagatagagggtctgaccagaaaactggagggcatgattctataacaaaaagcttaatgtttatagaattatgtctttttatatagggagggtagtaaacagagatttcgacaaaaacgcactaatttatctgaattttaagttttataaaaggggagaaatggaatgagaagaaaagcaccatttaaagtgttgtcatcattagcaattgcggcaattatcggatgtacatctgtaatgagtgctccgttagcatatgcagaaacggcagcaaaaaagaaagataatgtatctacaacaccaattgattacaatttaattcaagaagatcgtttagcggaagcacttaaagaaagaggaacaattaatccatcatcttctaaagaagagacgaaaaaagctgttgagcaatatattgaaaagaaacaaggagatcaggcgaataaagaaattcttccagatgctcactcacaagaaacgtctgatttcacaaaaaaagtaaaagagaaaaagatggaagaaaaggaaaatgtaaaaaaggctgaaaaaaatgttagccttgagcaaaagccagaaccaaataaaaatcaattgaatgggcaagttccaacttcaaaagcaaagcaagctccatataagggatctgttcgatcagataaagtattagtgctactcgttgaatttagtgattataaacataataatattgatcaaacaccaggttatatgtattcgaaagactttagtagagaacattatcaaaagatgttgttcggtaatgagccgtatactttatttgatggttcaaaagtaaaaacgtttaaacaatactatgaagagcagtctggtggtagttatacgacagatggatatgtaacggagtggctaactgttccaggaaaagcatctgattatggagctgatggtagcagtgggcacgataataaaggtccgaaaggtgcacgtgatttagtgaaagaagctttgcatgcagctgctgagaaaggactagatttatctcagtttgatcaatttgatagatatgatacaaacggggacgggaatcaaaatgaacctgacggtgtaattgatcatttaatggtaatccatgctggtgttggtcaagaagctggtggcggtaaattaggtgatgatgcgatctggtcacatcgttcaaaattagcagtagatccagtagcgattgaaggtacgaaatcaaaggtagattactttggtggtaaagtagcagcacatgattacacaattgaaccagaagatggagctgtaggtgtgtttgcacatgaatttggacatgatcttggattaccagatgaatatgacacgaaatatactggaaatggttcaccagtcgaagcttggtcattaatgagtggaggtagttggacagggaaaatcgcaggaacagagccgactagtttttcaccacaaaataaagacttcttacaaaagaatatgggtggcaactgggcaaaaatattagaagtagattacgataaaattaagagtggtgtgggagttcctacctatattgatcaaagtgttacgaaatcaaatcgtccaggcgttgtacgtgttaacttaccaggtaaaagtgttgaaacgattaaaccggagtttggaaagcatgcatattatagtacaagaggcgatgatatgcatacaacgttagagacaccattctttgatttaacaaagggaacaaatgcaaaattcgattataaagcaaattatgagttagaagcagagtgcgatttcgtcgaagtacatgcagtaacagaagatggaacgaagacgttaattgatagacttggagaaaaagtagtccaaggagataaagatacaacagatgggaaatggattgataaatcatatgatttaagtcaatttaaaggcaaaaaagtgaaactacaattcgactatattacagatccggctgtaacatataaaggttttgcgatggataatgtaaatgtaactgttgatggacaagttgtattttctgatgatgcagaaggacagtctaaaatgaatttaaatggttttgttgtttctgatgggacagagaagaaagctcattactactacttagaatggagaaactatgcgggatcagataatggattaaaagcaggaaaaggtccagtgtataatacaggtcttgtcgtttggtatgcagatgatagttttaaagataactgggttgggatgcatccaggtgaaggattccttggtgttgttgactctcatccagaagcgctagttggtaatttaaacgggaaaccagcatacggtaatacgggcatgcaaattgcagatgctgcattttcatttgataaaacaccagcatggagtgtaaattcattaacacgtggtcagtttaactattctggattacaaggtgttacaacttttgatgattcaaaagtatatagtaacaagcaaattgcagacgcaggaagaaaagttccaaaccttggacttaaattccaagttgttggacaggcagaagataaatcggcaggtgctgtttggattaaacgttaataacataaaagcacattcttcatatgaagagtgtgctttttaatttgtacagtaagttattattttagtttatgtaatacaagtttttattcatgtgtagtgtatcaaattatgtggggaaaggaaatatttccgaggaaattgtcgaagtatcgtcagtatttataaactttctgtttaaaagaagagatgtattattgcctttacggctcaatttatttacattgttatttggttatacacaaaagtaatatattcggcagtaaaagagcgctattggatagtgttctttttgtagatagaaaggagttgagttaaatgaaagaaataattgaatgtccacagtgtgaaggagagattactgcgcaacatattattgatctcccgcatcctttttcattcagatgtccacactgcaaggtgaggttaaaagaaatgagaatcacaccgtgcttaatattagcagcaatttgtatcattccactgtttattataattggagagagtattaaggaattactagtaaaatatttttctattatagatgatgtaccaactgtacttattttcttcttattttgttatccattgtattatttctatgaaaaatataatgctatattgtttattaaatacggcttattgaaagttaaaagttgaattgaataggagattatcataatgctttggaaaatatatttagttattgtagcaatgttagctattatttcgttagtaaggggcatgtttcaaacaccaattcaaaagtttgactttgtagtttctattattacgtggatagggctctttggttttgtatttgatatacaaatattaacctcaattgtttggaaatgtatcttcttgtttagcgtcatttggactttaactgcagtttttgtttttcgtttatatgaagagcgagatgagccgttaccttttatatttaaagtaattggaattattccaacgcttccattatattacggattatatcaatatgcatttaaaaaaagacaacgatggattatcccatcattgtcttttttactttgcttcttacataaatcatcccagcaaatgttaataaaaatgctgtcccgataatgaagctgatgctaggtgatgctccgattgcgccgactgtaaaggagccagcaacaactcctaatgagaagaaggcataaaataatccgaatgcctttccgcgattatcgtctgtagtattttcaacgagtaaagcgttaatagacgggaagaggattgcgaatccaattccataaatcatcattacgataaagagcataccttttgtagcaaataatccgagtaaagataatgcgaatgccataactgcaattccgattagcattagtttcgaacgattaaatcgatcgtaaatacgatttgttggaagcaagaagaagaggatagcagttataccaaatacacttaacatcatgcctgttgtggatgctttaagcgctaatgcctcaacttttactggtaacatataagtgacaattccttgtgaaaacattaatgtgaaagcaccaatatatgcttgtaataacggttctgattttaaaagttcaaccatatcttctttgttcatcatttgcgttcttgatgtatcttttcttgatacgttatttggtaagaagaatagagatacgatcgtaccaagagccattaaaatagaaatagtaatgaagacccattctacgccagctgttgctttcataataccgctgaaagccggtcctacgattgcggctgttccaacagcagcaccagatagagccattgcttttccttgtttttttgcagttgtttgttttgataaaaatgtaaaggcagcaggaattaaaaagccatcactaaatccatgcataaagcgaacaactaatagttgttcaccactttgaacaacggtgtataacaagactatgaaactcgtaattcccatgcttatataaaggattttttttgcaccaaatttatcgacagctgctccagcaataatattaccgatcatattagcgaatgagtacataccgacaactagcccgataataagaggggttcctccaaggctttgagcgaaagtactcataataggtaattgtgaaaatgtatctaaaaatgccacgataacgataaagtaaataaaatatttcaagcgatattcacctctcctatgctattatggcataatgctaatttcacctgcaatgaaattgaattaacagatgtggaaaaaagtacaaagtgacaaaatattgaacgttatttgtaaaaaattagtagagatgcgattgtttttttgaaatatatggatagaagtattataatagaattgtaaacttcaccaggttaagtatatacatagagagggatgtataaaatgaaagcactactttggcataatcaacgtgatgtacgagtagaagaagtaccagaaccaacagtaaaaccaggaacagtgaaaatcaaagttaaatggtgtggtatttgtgggacagacttgcatgaatatttagcagggcctatttttattccaacagaagaacatccattaacacatgtgaaagcacctgttattttaggtcatgagtttagtggtgaggtaatagagattggtgaaggagttacatctcataaagtgggagaccgcgttgttgtagaaccaatttattcttgtggtaaatgtgaagcttgtaaacatggacattacaatgtttgtgaacaacttgttttccacggtcttggcggagaaggcggcggtttctctgaatatacagtagtaccagaagatatggttcatcacattccagatgaaatgacgtatgaacaaggtgcgcttgtagaaccagcagcagtagcagttcatgcagtacgtcaaagtaaattaaaagaaggggaagctgtagcagtatttggttgcggtccaattggacttcttgttatccaagcagctaaagcagcaggagcgactcctgttattgcagttgaactttctaaagaacgtcaagagttagcgaaattagcaggtgcggattatgtattaaatccagcaactcaagatgtgttagctgaaattcgtaacttaacaaatggtttaggtgtaaatgttagctttgaagtaacaggtgttgaagttgtactacgacaagcgattgaaagtacaagcttcgaaggacaaactgtaattgttagtgtatgggaaaaagacgcaacaattactccaaataacttagtattaaaagaaaaagaagttattggtattttaggataccgtcacatcttcccagctgttattaaattaattagctctggtcaaattcaagcagagaaattaattacgaaaaaaattacagtcgatcaagttgttgaagaaggatttgaagcacttgtaaaagataaaacacaagtgaaaattcttgtttcacctaaataagatagaatcgaatagagtagcccttttctagaaatagaagagggctactttttttctatactgaaaggtgatagactttcctttgactaaatgtatttttgtttggaagggagaatctaatgctttcatttttgttaactttaaagcgaatgttaagagcctgtttacgagcgtggaaagataaagaatttcaagtattattcgtattaacaattttgactttaatatcgggtacgattttttatagtacagttgaagaattacgtcctattgacgctttatattttagtgtggtcacgttgacgactgtcggtgatgggaattttagtccgcaaactgatttcggaaagatatttacaatcttatacatatttattgggattggattagtgtttggatttattcataagttagcagttaatgtacaattgccaagtatattatcgaatagaaaaaaagagtaaagctggtcatctccctgtcaagtagacagaaataaaaagagtattatgccacggccttttcccgatattctatcggggaaaggccgtgaagtttttcttggaatctttctgtattataaaactgaatatattcttgaattgctcggtaggccatttcatatgtttttgggcacactaaatacaacttctttgcttttaaatgtgagaagaatgattcgatacacgcattataaaacagttccacgtctagaatgactaccg

SEQ ID NO: 1247 - DNA, 9501 bp, Bacillus thuringiensis
taaatttgcaatcattaaaaagtggccacctaaaatacctgtaccgaatgcccacatttccatctcatgctcaatttcatacatgatgatagcccctaaaatagcagctgcaaatcggtttaaaactcctaatccaggagccttttccttcattacgatactttttccgagtttctccactctgcgagctaataaccaaagacaataggcgcttactgctaatccaataccgaaccctgtcacttgttttccaaacggagtaatcgtccacataagtagtaaaccactaaagatcacatacaattgtaatcgatatacacgtaaggcttcttgaatcaaaatatccgctcctaagttctcattttttgtactttagaagaaaagcagcaacttacacagttgctgctttctcttcttcttgttcttgttccatcttacgaatttcaacacgtttaatttggtaagcgtctttttctaacactttaaattcataaccttccgcgtcaacatgttgtccttcttcgatttcatgattttgcatcataatccatccaccgattgtatccacatcatcttcttcgatgtgtaatccaaataaatctttcacttctgaaataagcacttttccatcaacaatgatatgttgctcgttcacatgttgaattggcggtgcctcatcttcatcatattcgtcacgaatttcgccgacgatttcctccaagatatcttcaagcgttacaattccggctgttcctccgtactcatcatataaaacagccatcggaattcgcttcttctgcatttgaagtaataaatcgtgaattggagtcgtttccatcacttcaataatcggacgcatatacgagcgaatagatgataaatctttttgatcctcggtcatatatcgaataaagaaatcttttacgttgaccataccgataatatcatctttatcttctccaaaaatcggataacgtgtgtatcgctcattttggattactttcatgtgttcttctactgaatcttccaggtagaaaccaacgatttctgttcgcggtaccataatctcttttgcaatacgattatcaaattcaaaaatgttatttacatacttgtattcagcttgattaatttcgccactttcatagctatctgaaaggataagacgtaattcttcttctgtatgagctacttcatgttctgaagctggctttaaaccgaataaaccagttatcacacgagctgaaccgttcaatacccaaataaatggatacattactttatagaacatcattaatggacctgccaataataacgttaccctttcagccttttgaattgccatcgttttcggagctaattcccctactacaacgtgtaaatacgtcataatcataaaagcaagaccaaatgttaatactgatgaaatagaaggatttaagttccatttctcaaataacgggtgtaataacttttcaattgtcggttcacctaaccaacctaatcccatagctgtaactgtaatacctaattgacaagcagataaatattcatctaaatttgttgttacctttttcgctgctaaagcaccgcgttttccttacgcaacaagctgatcgatacgacttgaacgtatctttacaatcgcaaactctgctgctacgaaaaatccagtaaatgcgattaaaatcgcaaccatgactaaattaaatatttccaatgaatccccttagttaaaaaactaaggtgtccacctcctgtatactataatgttttcttatttgtttgttagaaaacatagcccgatacaaaaattaaagaggtcggatttcacttattctataataatagagcaagtgtctgtattaaagctgtcgtttgacctgataaagatttcgatattttttcacgttgtgaatcagtcaattcatctaaaagcggctttaactcagtaagctccacttctaattgatgaatatggtctgtcacttcattcacttgtttcgaaacgtgttcattgataccgagcagcttcttcttctcctcgattttctctttaatctcacaaagcggcatatgcatttctttgcacttctcaataaattgtaatgtctcaaatgctgtttcgtcgtaatagcgataattagattgagatcgctccgcttttaagatacctagattcgtataataatcaatcgttcgtttcgacacgtgagccatgagagccaactgtccgattcgatacaccttcccaacgatcttccccccttgtttatattacatacatcatacaacacataaactgtacagtcaaacgtgacggtttattattcacaatttatacaaaattccaatctcctcctatgatgattcaatacgagtaatctacacttatacaataaaattactaaactactacctaatcactacattgtctgccacttttaacctttcttatttaaaagcatatcctactaataatgattgcttgtataggagggaattaatatgaaaaacacaatcatttctcattttttataatgaagaatacctacttccatggtggcttatgcatcacacgaaaatattcgaacacggcattttaattaatagagggtctacagatcgttccgtagagatttgtaaactattagcaccccactgggaggtacgaaattcaagatttcttgagtttgatccaactaatactgatattgaagtgatggaaattgaaagagaagtttcaggttggaaaatcgttttaaatactactgaattcttttgttgtaataatactgaagaatttttttcatctcttcatacactaggccaaaacatgtatgcgattagaatgattttaatgatagataatcataattataattattcaaagcctagatattctatccccttagtagaacagcgataccacggtgtcttcccttataacccaaatctcggatgtgcttggagatttattcacaatcatctagacggtgcatatttacctggtagacatcattcgcggcacggatatataatttatgactatccttcatttattttaaaattttattttagcccttggaatgaacaatcaaaggcaagaaaattacaaattacacctaccctttcaaaaaggggtgttcaaatgggacttcaaacacattacggtcaatctcctgaagtactggacatacgttttttagagcttagtaacctaacacaagacctccgtcataaccctgaatatcaagaattatttccaaaattcaaaccgtaatattttctgcatcgtcatcacctcaaacattttcattcacttaatcaaaaacaatctcatttgcataaaacatgaatactgtataaataataaatttttattttaggaggaaaaaatgaaagctgttattcttgctggtgggtacggtacaagaattggggaagaaacacatttaaaaccgaaacctatgattgaaattggaacaaaacccattctatggcacattatgagtttgtatagtcattacggaattactgagtttattatttgcttaggctataaaggatatgcaattaaagagttctttctaaattacaacttacacatgtctgatttcacaatacagttaaacgataatacaattactagccattctcatcgtgtagaaccatggaaagttacactaatcgatactggtgtaaataccgaaacgggtggccgagtgaaaaagattcaaaattatgtcggagacgaacctttctgcctcacttatggtgatggattaagtaatgtaaatataaaagaacttattacattccataaaaaacatggaaaaatggctactgttactgccgtacaaccttttggtagattcggttctctcatattagataaacagtctgtaacatcttttcaagaaaaaccattaggtgatggcggatgggttaatggtggatttttcgttttaaatcctgaagttttcaattacattagtggagataagtctgtttttgaaacagactctttagttcagttagtaaataaaaatgaattggccgcatatcaacattctggtttttggcatccgatggatacattgcgcgataaaaataaattagtcgagctatgggaaagtaataacgctccgtggaaggtttggtaatatggcttcatcattttttttggaataagaaaaaagtatttattacgggacatactggatttaaaggctcctggctcacccttttcttaagatctttaggtgcagaagtagtaggcttttcttctcatcccccatccattcctaacatttttgaacaaggtaacgtagcaaaagagtgcacgacaatgaaaggcaatattacagattaccattctttatttcatgccatgaagcagcataaacctgacataatatttcatttagcagctcagccaatcgtaaccgcttcatacaaaaaccctatcgatacattcaaaacgaatgttttaggtactgttcacgtgctagaagcagcaaagtccgtcgaaagcgtacgtgccattattaatgtgacaagcgataaatgttatgagaatgacggtagtggcgaccgatcgttcgtggaaaatgaccgactaggaggtttcgacccttatagcgctagtaaagcttgcgctgaaatattggcaacatcctatcaaaaatcattcttccgcactaatacccagaaactcgcctcagtcagagctggtaacgtcatcggcggtggtgattgggcagaagatcgattattccctgatatcattcgggcatatttgcacaatcatactttgtgtattcgaaacaaatatgccgtccgtccgtggcaacatgttttagatcctctacatggctatatccttttagctgagaaactttggaatgatgctaaatatgcagaagcgtggaatttcggcccaatgaatgaacctaacagaaccgttcatgatgtcattgaatctgtaataaaattatggaataacccactaacaatcatttcctcctctacaaatactccttatgaatcacctgttttaacactcgatagtacaaaagcagtaaacaaactcagctggactcctaagttatcaacagatgattctatcgcttggactgttgattggtacaaaaaatatgcatctggtgaaaatatagaatctttcacatgacaacaaatcgatgcattcaaaaatttataaaggggctataaaatggaacagaaaaaatgccgtttttgccactcattactaaccaacacttttttagatttgggcgtttcccctctcgctaattcatttgtagctcctgaaagctcatataaaatggaacctttttatccgctgcacacatttgtttgtcactcttgtttactcgtacagctagatgaatttgaatccccgcaaaatatttttcataactatttatacttcagctcttactcctcaagttggctactacacgctaaacaatatgtagaaatggcgattaagcgtttcaacttaacgaaacattcaaaagtgattgaaatcgcaagtaacgatgggtacttattacaatactttaaaaaagaaaatatcgagacattgggaattgaacccgcgaaaaacgtagcagaaattgctatcaaaaaaggaattcctactcatgtgaattttttcagtaatgacttagcaaaaaaattgccacaagctgatttaatcgtcgcaaataacgtattagcacatgttccaaacttgcatgattttgttgctggtttaaaaacactattaaaacgtgatggcacgataacaatcgaattcccgcacttattaaaccttatatcctttaaccaatttgataccatctaccatgaacacttctcctacttctcacttataagccttcaaaaaattttagctcatcatcatttacaaattgttgatgtagaagagctttcaacacatggtggttcattacgtatttttgtaaaccatctaagttcccaatccactatccattccaacgttacaaacttactccaaaaagaagtcaatcacggactcgatacattagattgctatctccttttttctaaacgagtggaacaattgaaaataaatattttaaagttttttatcaaagcaaaagctttaaacaaacaaatcatcggctacggcgctccggctaaaggaaacaccctgttgaattattgcggaataggtaaagaatttttagcgtatacagtagataaaaatcctcacaaacaaaatctccttttaccaggaactcgtattccaataaaatctccagcagaaattaaacgtacaaaaccggattacattctcatacttccttggaatttgaaagacgaaattataaaagaatgctctttcattcgtgaatggggcggtaaatttttagtgacagttccagaagttgaggtgattgagccatgaagaaagttgttgtaacaggtggtagtggctggataggtaaatatgttgtacattcacttatacaaaagggatacgaagtgcacgccacgtataataaaaataaaccctctcacctcccttgccactggcataaagtaaacttgctccgcaatgacgaagtaaaacaattcatttacgacgttcagcctagccatctcattcaccttgcttgggaagcagtaccaccagcatgctatgtatctattaataattactattggctaaagtctagtatttcattgattcaacactttacaacatgcggcggaaagcgtgttgtcgttgcaggtactggcgcagaatacgaatggtttaacggcgtattatttgaagattcaccgctcctttcctataaaaccccgtattctttatgtaaaaatgcactgcactcctggctagaaacgtatgcacaacaaacaggcctcagcatgtgttggggccgcatttttcatatgtatggacctcacgaacaaggtaatcggctcgtttctaacattatcacttccttattaaaaaacgaggaagcactatgtacacatggaaaacaatcgagagatttcctccatgtgagtgacgtcgctgacgctctcgtaacaatattagaacacggcgttacaggcaccatcaatatcgcttctggtcaatctgtacaaattaaagagttagcttctatcattgctaaaaagataggaaaagaacatttaattaaactaggtgcaatccctttctctaaagatgaacctttatttgtcggggttaatgtaaaacgtttaaaaactgaagtaaactggaaaccaacatacgatctaaatacaggaatagaagaaacaattttatggtggaaatcatttatacaaaaacataacgatatgcatcattaaaacgtaaatccttcgttcctctcgctaattccttataccattcttctaatctttccggcgtaacaatatgatgcgtacccattcctccatgcttactagcttcagaaagagtcggaccaatttgtaactttctctttctcatcgcatcattccacggactaaacccaaaccataatatacaggcaagaggtggataaatcatcgattcatgcgcagataaatgtcttccaaccgtataacttccatgctcatgattatgaataaatcttccccttctccatagtctccactcctctggtaaataaccatgaaatcgctgtttcattaaaggtattccaaagttaagttccggataattatagttaggatcatcgaccataataagcccttctagccaatacatcctacctcccaattcatctagtgatttccaaaactgatttttatcttgcatgcaaagaaactcagtcgtatttaaaatcattttccatccttgtacttcttgttctatcctcatcacttcatgatctgtcgcatatgcatcaaactctggatttacagaatctcgcacttcccaatgcggtgcgaattttttacaaatctcaacggaacgatctgttgaacctttattaattaaaataccatgatcaaaaagtttcgtatgatgcataagccaccatggcaataaatattcttcattgtaaaaatgcgaaataacggttgtagttataataatctcctcctctttctctattaatctactttttatcctacaaccaatatactcataagcaaaaatatgtttcctaattattgatcaaatattattattaatatttttgtaagttttcctttggtacccagcccttctcaccatctcttccttcgccccaaacccatccattgaattcttctaatccaatcactctttctccaatactcacatttaattctttcgcagtatattgttttataataattcctgttccattcatatctttttttataatttgctccggaacccatcctttccggtcatatttctcttcgtgacaaaacatccagttttcccagttttccggaccagcgtaactctctatcattttcactacatccccctcttctaagcgaattggattaggataattgctaacatgtgattttataacgatatatttcataacaacctccaataatcagaaaattaagttataatatcattataacttaaagaggaggaatgcacgcatgtactacaacacttcattcgaaaacgatcaacctgtaggccgtctataaactaagacgggcaatcatataacacatacactacgcctcgtcttagggaactcataataccctaaaaatagacggaggtactttacatgaaacaaacaattttaggagctatatgtttatcactagcagcaagtatatggggtggtatgtatgttgttagcaaatacgtactcgattttatcccaccactaaccctcgtttggctacgctttatcattgcttttgttgttttgtatggcattttgaaactagctgagaaaaagcaaaagaaaaaagtaaccattcgcaaaaaagattggctcctattcgcttggattggatttatcggctatttcatttcgatcacatgccaatttatcggaacaaaattatccgacgctcatacaggctcgttagttacatcagctacacctgcatttatggttatatttgcagcgctcattttgaaagaaaaactaaccgctcgtagacttttatctactataatagcgacaatcggcgtcattatcgtaatcgggtgggatattgaaattggctcctattttattggaacaatcattttagttggagccgctattacgtgggctttactatctatttatgtaaagatcgcttcaatccaattctcatccttagttattacaacgtatgccatattcttttcactcttttttattacaccctttatgatatgggaactacaaacatcctctatcggaacagtaaatacgtacgtaatattaggcgtattatacttaggtattgtctcaacagcaggtgcctttttcctttggaataaaggattagaattaatagatgcaa

SEQ ID NO: 1248 - DNA, 10381 bp, Bacillus thuringiensis
tattatatccatataccatatatcagcaatgtattttcgtaaattcctaatacataatcgtttattgtaagattactgggaaagatatttatacatatagtaggatgtagatgaagaaataagataataaaaagctcgcataagcgagctttttattaatatacagatgtattattttctgacatgttttctaaaatttctttaacacgtcctaagaacttaccacaaattaaaccatcaagtactcggtgatcaagtgataaacataagttaaccatatcacgagcaccgaacataccgttatccataattactgggcgttttacaattgattcaacttgtaaaatagccgcttgcgggtaattaataatacccatagattgaacagaaccgaatgatcctgtgttattaattgtaaatgttccaccttgcatttcgtctgcttttaacgatttcgtacgtacttttcctgcaagttctgtaatttcacgagcaatacctttaattgttttctcgtccgcttgcttaattactggtacaaatagttcttcctctgttgcaacagcgatagaaaggttaatatctttcttctgaacaattttatcgccagcccacattgaattaatttgaggatactcttttaacgcttgtgctactgcttttacgaagaaagcaaagaacgttaagttaaagccttcacgcttcttaaagtcacctttaattgagttacggtatgacacaaggtttgtcacatctacttcaatcatcatccaagcatgtggtgcttcgtgtttactacgtagcatgtttgctgcgattgctttacgcacacctgttactggaatttcaatatctccaggcattgtgggtacaggtactggtttcgcaggtgctacgttttgcgctactggtgctgcttttggtgcttctgggcgagcttctactactgccgctacagcttcctctttcttcgccgcacctgcttgtgggatatttccagattccacaagctttaaaatatctttacgagtgatacggccgtttgctcccgtaccttctactagatctaaatcaacgttatgctcacccgcaagctttaacacagctggtgaaaaacggggttttccatcagatggttgctttactttcggtgctttttcagacgtagctatttctgcctttgattcttcttttgttttttcctcaacagctgttgctgctacttcatctgcgccttctacttgaataacacaaactacttcacctacagctaacgtatcaccttcaccagcgattaactctttcacaacacccgtgaaagaagatggtacttcagcatttactttatcagtcattacttctgcaagcggatcatacttatttacgtgatcgccaacattaacgagccatttactaattgtgccctctgtaacgctctccccgagctgaggcattgtaatattttctacagccatgtatagtccccccgattaaaattccgcaagttcacgcattgctttttcaactttatctggatttaccataaagaatttttccattgttggtgcatatggcattgctggaacgtctggacctgcaagacgtgcgattggcgcatctaaatcaaatagacagttttcagcgataattgctgccacttcactcataatgcttccttctttattgtcttctgttacaagaagaactttacctgttttagaagctgcttcaatgattgcttctttatctaatggatatacagtacgtaaatcaagaatgtgtgcagagatgccatcttgtgctaacttttcagccgcttgaagagcaaaatgaacacataatccgtacgtgataactgtaatatcatcaccttcacgttttacatctgcttttccgattggtaatacgtagtcatcctccggtacttcacctttaattaaacgatatgcacgtttatgttcaaagaataatactggatcttcatcacgaatggctgcttttaataagccttttgcatcatatggtgtagaagggataacgatttttaaacctggttggtttgcaaacatcgcttctacagattgtgaatgatacaatgcaccgtgaacacccccgccaaatggtgcacggattgtaactggacaagtccaatcattattagaacgataacgaatttttgctgcctcagaaacaatttggtttactgctggcatgatgaaatcagcaaactgcatttcagcgattggacgcataccatacattgctgcaccaattgctaccccagcaattgcagattctgcaagcggtgcatcaagcgcacgatcttcaccaaattgatcatacaaaccgtgtgtcgctttaaacacgccaccttttttaccaacatcttctcctaaaacgaatactttctcatcgcgttccatttcttcgcgcattgctaatgtaatagcatcaatataagacattacatccatgaaacgttcccccctattctgcgtatacgtgcttcaatgcatcttcaggtgctgcatacggagcattttctgcatattctgttgcttcatttacgatatgcataatttcgtctaacatttgtttttccgattcctcagttaacacaccagcttcttttaaataagccgcgaatgttataattgaatcttttttctttgcttcttctacttcttctttatcacgataaacacgatcatcatcgtcactagaatgtgctgttaaacgatatgatactgtttcaattaaagttgggccttcaccacgacgaccgcgatctgctgcttcttttacagctttatatactgcaagcggatcgtttccgtctattgtatatccaggcataccgtaaccaatcgcacgatctgatacgtttttacatgctaattgtttttcaactggaatagagattgcatatttgttattttcacacataaaaataacaggtagtttgtgtacaccagcaaagtttgccccttcatggaagtcaccttggtttgaagaaccttctccaaatgtaacgaacgttactaaatctttcttctccatttttccagctagtgcaataccaactgcatgtggtacttgcgttgttactggagatgaacctgtaacaatacgatttttcttttgaccgaagtgaccaggcatttgacgaccaccagagtttggatctccagctttcgcgaaagcagacaacataagctctttagctgtcataccaaatgctagtacaacacccatatcacggtagtatggtaatgcataatctttctctctatcaagagcgaacgccgctccaacttgtgcagcctcttgtccttgacaagaaattacgaatggaattttaccagcgcggtttaataaccacatacgttcgtcaattttacgtgcaagtaacatcgtacggaacatttctaatacttgctcatcacttaagccaagctcttcatggcgcttttcttttacttctgccatttttcataacctcctaaatccacatttttatgcgtgtaacgctcttccatctacagcaagtgctgcttcaccaatcgcctcagataatgatggatgcggatgaattgtatgtgctacttcccaaggtgttgcatcaagtactcttgcaagacccgcttcagaaatcatatctgttacatgcggtccaatcatatgaacaccaagaatgtcatttgtctcttcatcaactacaagttttacgaaaccatctgattctccgtatacaagtgcttttccgattgcgcggaatgagaacttacctacttttaacttatagcctttttctttcgcttcttgttctgttaaaccgacagaagcaacttctggactgctatatacgcattttgataccatagagtaatcaattggtgtaacttctttccctgcaatatgttctactgcagcaattccttcatgagaagcaacgtgagcaagttgcaggccaccgattacatctccaattgcgtaaatatgcgattctttcgtttgataaaactcatttgtttgaatgtatcctttttccacaacgatatctgtgttctctaagccaatattttgcgtattcgcttgtcttcctacagatacaagcattttttctgctttaaattctttattttcaccgttgtgttcagcttggattgttactccattatcttttaccaatgtttctggtaatacttttgcaccagttaccactttaataccttttttcttgaatagacgttgcatttcttttgaaacatcttgatcttctagtggtaatatcgtttttgcatactctaatactgtaacttctacaccgaagtcagcaagcatagatgcccactcaatcccgattacaccgccaccaacgataataattgaactaggaagcgtttccatttttagggcatgatctgaagacattacgtactctccgtctaattctaaacctggtaatgaatttggacgagaacctgttgcaataagtacattttttggaattaacatttcattctcttctccacttgcaagttcaactgaaattgtccctggcatcggagagaaaatagatgggccaagaatacggccaataccttcaaacacatcaattttaccttgtttcattaaatgttgaacgcctttatgaagctgcgttacaatcttctctttacgctcttgtactttcgcaaagtttagttctacattgcttgcaataactccgaactcttcgctttttttagcagttgcatatacttccgcactacgtaaaagagctttactaggaatacatcctttgtgtaaacaagtaccaccaagattttctttttcgactagtgcagtttttaaccctagttgtgatgcacgaattgcagcaacatatccaccagtaccgccgccaacgatgactaaatcatattcttttgccattatctcaacccctagctaccgtttctttttcacgtacaacgtattcttttggagcttcttcttcacgtaatacacgaagtgctccttctgctaacgcttctaactcatcttcgcctggatgtacgataacatctgcaatccagtccactcgctcttttatttcatcgacaagaattttactgtatgccagtccaccagttaatacgattgcatcgattttcccgtgaagtacagcgctagctccaccaatctcttttgcaacttgatatgccattgctttataaataagagttgcttcaggatcacctttttcaaccattttctctactttaatcgcatcatttgtaccgattaaacttacaagtccaccttgtccgacaagctttttaatcatttcatctcggtaatactcaccagagaaacacatttctactagttgccctactggtactgtaccagcacgctctggactaaatggtccttctccgtttaaaccgttattcacatcgattactcttccttttttatgagcaccaactgtaataccaccgcccatatgcgtaactaataaatttaaatcctcatatttgtggtttaactgttcagctactttacgagcaactgctttttgatttaatgcatggaagatacttttacgttccataccagcaataccacttatacgagcaactggctccatctcatctacaacgacaggatccacaataaatgcaggaatgtttaatccagaagcaatttcatatgctaaaatgcctccaaggtttgaagcgtgatgaccgctaaacccattttttaaatcttctaacatcgcatcgtttactgtatacgtaccgccttcgattggacgaagtaatccaccacgtccacaaacagcgtttaactttgaaatgttaataccatgagaatgtagaacttctaaaatcgtttcttttcgaaactcatattggtcgataattcgcttgtatttcccaatctgttctacgtcatgacgaatcgtttcttctaaaacgggtctttcattatcaaaaacaccaatttttgtggatgtactacctgggttaataacaagaattcgatttacagacaatgttgctacctccactaataaattcaaaaggaagtggaaacctcatacgagataaccacgccttttgtaaaagttatatatgaatgattagcgacggctaataatatcgtgaccgttgcgtaagtaagtgctacgagaatttttcaagcttgcaatgcgctcttcagctagacgatctgccgctacataagttgctatgccatcgcgttttgaaatttcgattacttttgcaattgtgtcataaatagactcaacacgttttagtgcacgttctctattgtatccatataattcgtctgctacgttaattacgccacctgcattaattacataatctggtgcgtatacaatacccatttcatgaatgatgtcaccgtgacgattttcttttaattggttatttgcagaacctgcgattacttttgctttaagttgtggaatagtttcatcattaactgttgcgcctaatgcacatggtgcgtaaatatcgcattcaacaccataaatttcatttggttcaactgctgatgcaccgaattcttctacagcacgttgtacagcttctttattaatatctgtaacgattaattttgctccttcagcgtgtaaatgtttgcataggtgatatgctacgttaccaacgccttgaacagcaattacttttccttctaaattgtcagtaccgaaagcttcttttgcagctgctttcataccacggtaaacaccgtatgcagttactggagatgggttaccagaagaaccgaatgatggtgagatacctgttacaaagtcagtttcttcatggataatatccatatcatctactgttgtaccaacatcttcagctgtaatgtaacgtccgtttagtccttggatataacgtcctagtgcacggaacattgcttcgctcttatctttacgaggatcaccgataattactgttttcgcaccacctaagtttaaaccagctgctgcgtttttatatgtcatcccttttgcaagacgcaatgcatcttcaatcgccgcttcttcagaatcatatgtccacattcttgttccaccaagagccggtccaagtgttgtatcatgaattgcaataattgcttttaaaccagattctttatcttgacaaaatactacttgctcataatcatatttttctaagtattcgaagatttctaatgtcattgtcgtttccccctaatgttttaccctttttggtttattttgaagcagtcgcaactgccaatgctaatgaatatacttttgtttctgctgaatcagcacgagatgttaaaacaattggtgcttttgcgccagcaatcattgctcctacttttgcatccgcaaagtatacgagtgatttatatagcacatttccagcttcaatcgttgggacgagtaaaatatctgccttacctgctacatcacttactatgcctttatgttctgctgcaatttgtgatactgcattatctaaagcaagtggtccatcaacgatacaatctttaatttgtccgcggcgattcatttgtgttaacatcgctgcatcaattgtcgcctgcatcgctggattcacaacttctactgctgcgattggtgccacttttggcaagtcgattcctattgcccgggcaacttctacagtattttgtataatagcagctttttgtgttacgtcaggtgcgatgttcatcgctgcatctgtaacgaaaataagacgatcgtaattttgaacttcaaatgctgctacatgtgaaagtacgctacctttacgtaggccccactctttgtttaacacagccttcaaaatattcgctgttgggatgttccccttcataagcacatctgcttcaccatttctcacagctttaacagaaagttctgcagcttcagcactagacattgctgcaatcacttcaacatgttctgaagtttgtaaaccatgttcttgtagcatccccattattttttcttgatttccatatagacgaaattgagctagctgtaatttaattgctttcgctacagcttcaattacttcatgatcttcagctactgctacagccacagtttttttaggctttcctgctgcttgatcaattaagtattctaacttcatattttgtaatcaaccctttccgtcgtccctcgtctatttataaagcaaataccgtgccaacttttaaaagtggtcttaccaataatgaaaacgcattcaaaatgcagtaaaatcaatactttagaaaataacgaaagattctgtcttattttgtcgctttttgtataccatgcaataaattgcatggtacgcaatttattgcatgctattttttgcatggtcatacttttctagcttgtaatataaatttcgaacggaaattcctaacgcttttgcagtttgtgttttattcccatcaaatctctccaaatattcataaataatattcccttcaaactctgtcactaaatgttcaagtggcttttcttctaattcaggtaataaatgagattgctttgactccacctgctcttcgttatgtaatggcggtaaatggtgtacatcaatataggtctcgttataattcataaagataatagctctccccaaaatattttcaagttccctcacatttcctggccattcgtatgattgtaaatataaaacggctgaatcagtgagcccttctacattacgaccgtaatcttgattaattttttgaatcaatctgtccgcaattgtcggtatatctcctttacgttgacgaagagatggaatttgaattggaattttatttaatcgataatataaatcctccctaaacttcccttctagaatagccttttctaaattcacatgtgtcgctgcaattactcgatcattaataggtatcgctttcgttccaccaacttttacaatttctttttcctgcaatacacgaaggagtttcgcttgtgtatttgcagacaactcccctatttcatctaaaaaaatactaccgttattcgcttcctcgaagagaaccgcgttttcccgcctcttttcgctccagagaacgccccttcctcataaccaaataattcactttctaacaacgtctccgaaatggccgcacagtttacacggacgaacttattgtattttcgattacttccattatggattgcatgtgcaaacaattctttaccagtcccagattccccgcgtaacagtactgttgctggtgtattcgctcctagcttcgcctgttcgatagctgccgttgtttcatctgaatttccgacaatatcatcaaatgaatattttgcttctaatgtacgaataatttgccttgctctattcaattcatttgttaatttttgaatttccgacacgtcacggataacaccgacgcttcctttcaatattccatccacaataactggtgctacgtttacaattacatctcgctttttttgcccaatcttcatatgtattccgcgcaccgcacgacgcgttcgaagtactttcatatgcatactttcgccttctacaatatcagttgtagcaggcttcccaataatatcttcttctgttaaacccgttaatttcgtatatgctgggttaatgactaaacctcttcctttttcatccacaaccgaaatcgcttcttcagatgagttaataattgcctctaatagtgtttgaatttcttttaagtctgtaacttcttccgcaagatctacaacttctgttatatctttaaaaattgcaaatgccccttgtacctctcctccttcttttaatattggaatacgcgttgtaataattttctttccattctctaatgtcagttcataatttacttctatttgtttcgtacgtataatgcgaagtaatttactagttggaatgacttctaaaatatactttcctatcgcctcttcttttttatatccgataatacgctctgcacttttattaaaaagacgaacttgtccctctcgatcaattacaatcatgccgtcatgtgtagaatttaaaattaattctccttgttgcgtctgttcctctaaccgcccaattagcccttccttctcatgcgctaatcctgtaacaatttttgcgatatcacctggtataagaagagtgtcttttttctttttttctaataaaactttatgtacatcatcttcacctgtcatatcaaatattacatcgatatgcatagaaagaaatggagttacactttctccaattgcaatcccgtattccttagcaatttgtagtccttttgccaacggatttatatcaataatccctataatttgaaatatattcgaactttgtaacag

SEQ ID NO: 1249 - DNA, 8821 bp, Bacillus thuringiensis
tgttttgtcaaaaaatcagttagttgagtggagaaggcattttcataagtatccagagttatcttttcaagaagagaaaacatcgcagtttgtgttcgatatacttcggaaattcccatatttagaagtgtcacggccgactaaatatagtgtgatggcaaagttagtaggtaaacatccgggcaaaacagttgcgattcgagccgatatggatgctcttcctattcatgaagaaaatgagtttgattttatttctatatataaaggtgtaatgcatgcatgtggtcatgatggacatatagcgatattacttggggttgtacataagttagtagaagaaagagagaagattaaaggagagattcgttttctattccaacatgctgaagagaattttcctggtggtgcagaggagatggttgctgcaggtgtaatggaaggtgtggattatattattggtgctcacctttgggcgtcgttagaggttgggaaaataggtgttatttatggtcctgcaatggctgcaccggatgtttttaaaattaagatagagggaaaaggtggacatgctggaatccctcatgaaacggtggatagtattgcaatcggaacacaagtcgtttcgcaacttcagcaaattgtatctcgcctcacgaatccattagattctctcgtaatatctgttacgcaatttcatgcggggacaactcataatgtaataccagagcaagccgagattgaagggacagtgagaagtttaagacatgaattacgaggtgaaacagagaagaagattgagcggattgtgaagcatattacggaatcttacggagcgaaatatacattttcatatgaatatgggtatcgaccagttgtaaatgactatgaagctacagagcttattgaacaaacggcattacaactttatggaagggatagagttgttcgtttacagccgacgatggctggagaagatttttcagcgtttttacaaaaggcaccggggacattcttttttatcggagcgggaaataaagagaaaggtattatatatcctcaccatcaccctcgttttacgattgacgaagatgcattactgattggagtggaagtctttgtatcagccattatgaactttataagtaaaggagaatgagatgaagaaaatacacattctagcgcttatcccagttctttgtttagtagttgggccaatatttgcgaattcagttactccttacgtattagggatgccatttttattattttgggtattattatcagtgtttattacatctttttgtatggggcttgtgtacgtgtttgatcctgctaataaggaggatgtaaaatgactgcattacttatcattattttatttttgtttctcgcactatttttagggattcgggcacaacatggaaaagatatgaatttagagcaatggtcagttgggggaagagggtttggcactatttttgtttttctccttatggcaggtgaaatttatacgacgtttacatttttgggaggaagtggctgggcgtatagcaaaggagcacctaccttttatattttaggttatggcgctttagcttatcttttatcgtattttttattgccaccgatttggaagtatgcgaaagagcataaccttgtttcacagtcggatttttttgcgaagaaatatagaagtaaagcgcttgggattattgtttcaattgttggtgttgtttccatcatcccatatcttgttttacagttaaaaggactgggaattatcgtttcagaagcttcttacggaagggtgtcacctgttgttgcggtttggattggtgctattgttataactatatatgtaatggtttcaggtatacatggttcggcttggacggctgctttgaaggatattatgatactgtttatcgttatgtttttaggtatatatttaccgtatcattattatggaggatttcagccgatgtttgaggctgtagaggcagcgaaaccgggatttttatctttacctgaagaaggaatgagtatttcttggtttgtttctactattatattaacggccctcggtttttatatgtggcctcatacatttgcttctgctttttctgcaaaaaatgaaaaagtatttcgtaaaaatgcagcaattatgccattgtattctttagttttacttttcgtattttttgcaggatttgctgctatattgcaagttcctgggttaaagggagcggatgtagatctttcgttattccgtcttgctttacaaacttttgatccttggtttattggaattattggtagtgcgggagtattaacggcattggttccgggttcgatgcttgttatggcggcttctacactgttagcgaaaaatatttatcgaacgatagttccatctgcttcagatagacaagttgctaagatggcaaaattatttgtgcctgtagtaacgctcgtggcagttttatttacatttaaaggaggagaaacgataggagcgcttctattaatgggatacagtattgttacacaacttttccctgcacttgtatgtagcttgtttccacgccaaattattacgaagcaaggagcgattgcaggaataggagttgggctgttagtggtcgcatatattaccttatctggttcaactatagccacaatgtttccgagtttcccgcagtatataaaagatttgaatgtaggcatagtcgcattgttaattaatatgattgtgatgtttgtagttagtgggtttacaaaaagtgtatctataaagaaaaacaatataatagtagaaaagtaattcgtttatcccgcattaacgggcagtaagaccctcaactcaaaattcagcggaagcaaagaagttaggtaggggccctgctgcctgtaaaagtccgattggtgagggctgattaaagttttactttattagagctatctttgaaaagagatagctcttttttgtatatattttcttcaattagcggaatctaactaaaaacttgttgaaaaggaagttaggtggggaaattgttagagcttgaaggtaacttatttgaagttatgaaagaaattagggatgagttaggttcacctaatgatttaacaattagagaagttgttcttgctgggagttttacacgttgtgcggttgtgtttttatgtgggttaacagacaaggataatgtttataaatatgtagttcgtactcttcaatatgaagaagtgcaaaatgaagcggctgtcgttcagacgttattggatcattttatttctattgcggaagtgggtaagaagacaacgtttccggatattataaatgcgattttagcgggagatacagttatattaattgataatattcaaactgctatcgttattaatagtagggcttgggagaagagaagtttagagccaccagtgacagaagatttaatacgcggaccaagagttggattaaatgaagatattaatgtgaataaaatgttaatccgacgcagtttacgcgatccaaagttgaggttccaatcttatattatggggaagcgatcgcagaaagaagtaaccctagtatatatagaagatattattaatcctcacattgtaaaagagttagatcgccgtcttcaatcaatagtgacagatgttattttggaaacaggtacgattgaacaattaattcaggataataatttatctccatttccacagtttttgaatacagagaggccagataatattatagcgtcattagcgaagggaaaagcggccattttagtagacggatctccgtttgctcttattgcaccgcttgtgtttgttgatatttttcaatctgtagaagatcattacgagcgctgggtgattggaacgttactaagatttttacgtatgggttcaggtataatcgcggttttgttaccagctatgtatgtagcacttgtatcttatcatcaaggacttattccttctaaactggcttattcaattgcaggtgcgagggaaggtgttccgtttccagcatatattgaaacgttaatgatggccttgactatggaattaatacgagaagctggaatccgattgcccaaaccaatgggacaaacgatagggattgtaggaggtcttgtaattggagaagctgcggtaaatgcagggattgtaaatccgtttttagttattattattgcagttactgcgattgctacgttctcgcttcctgtatatagtattacgattacgttccgaattttacttttcgtctttgtattagctgcaacggcttttggactgtatgggatcattctagctctgattgcacttgctattcatattacaaatttaacaagtgttggtataccgtatacaactcctattgctcctgcattttataaagattggaaagaagaatttattcgcatgccaaaatcgatgttgaaagatagaccagagtacttacaaacaaaagattctacaatacgtccaaaggagcgaaaataagtgaaaccatttgagtatggcgatgaagagattggatctcgggaaattgggtttgcggtatcatcgaccattattggtataggggcattgtctatgccgagagatatcgctaaccaaactttattttcggacggttggattatcttgcttttgggtggattgatttgcgcagttttaggctggtttgtgacgagagtggctatcttatttccaaaacaaaattttgttcaatatacgagtgcgcatttgacgaagcctgttgcatacacaattagttgtattttagtattaacgtttgctgctttgacagcatatgaatcgcgaatgatttcagttatttctcaaacgtatttatttagtgatacaccaatacaactactgtctttcttcttcttattagttgttatttatggaatagcaggatcaagagcagccttattaaggttaaatgttttattcttacctattgttttaattgcgatagtacttctttctttattgaatataaatttaatggaaataaataatttactaccagcttttcaaacgaaagtaagtcaatatgctgttggagttaaaaattctatttttacgtttattggatttgaagtagctttattttatgcggtgttgctgaatgataagacagcgaaaaaagcgccgatggcagtcgcgaaagcggtgatggtaaacgtgctgtcatacattttaatttatgtaacttgtattagtgtttttacgtatatgacaacacgtggattgacatatccaacaattgaattagggaaagaaattgaaattggtggaggatttttagaaaggtttgatgcgattttttttacgacttggattattactatttataacacgacagcaatgtactatgatgtcgcatctttattgttttgtgctatgtttccgaaagtgaagaaacatatttttattttcgtaagtgccccaattatttttatggcgaatatgatacctagtagtttgaatgctttatcaagttatgggacttatttagcttggatagatatggggtgtgttgtgttagcacctttgctcgttttaattgtatataaaataaaaagaaggaatggtggaaatgaaacaccttcttaaaattataatggttatggctttaactggatttatgagtgggtgttctgagttagaagagatagaagaaagaggatttgtagtaggagcggcttacgatatcgtgaaggagaagaaagcgaatccaattatgaaagggacctatcagatggtactccccagtaaattgtctcaacagggtggacaagggggtggggatagcgaaaattatattaatgttagtgcaaaagcagatagtgtatttgaacaaataagaataatcgctaaaaaaattagccgtacattatttttccctcatagacaagtgattattttctctgaagaattactttcacatccatacattttacaaaatacgttagatgtatatattcgcgatcatgaaatgagaagaaatattcgtttgttcgtttctaagaaaaatgcagaagctattttaaaacaaagtgccaagcctgaaaatttaccggcgcagtatattgatatgttagctgaacaccctccgaaaaatgcccaaatgattgaggctgcaagaattggggaggtacaggagaagatgatctctaaccgcagttttgtattacctattcttgaactgacaaaacaaggggtacaaatgaacggtgcagcattgtttcgtggaaaggataataaatgtgtaggcaatttgagtggggaagaaacattagggatgaattatataataggcaaaaaaattggaggtttttttacgattcgtaaaaaaaatcaacttattacatatgaaattcataagttgcgtcgaaaaattaaagtatctacaacgaatgctacaaaaccaaagtttgatattcatttatctctggaaggcacattggctgagttgcatttcagtgatcataaaaaggttttgaatgaaaagcgtttagagaaggatatatcggaagaaatggaggagcgtattcaaaaatcgattaagcttgttcaaaaaaaatataaggtagatgtattagagttaggggaagtgtataagcgacataattataaagagtggacaaaaataagtaagaattgggatcaaggcgaaaattactttagtaatgctgaaattactgttcatgttcatccaacaattgaacattcaggttcagctttaccgaaaagagtgaaataaggtgatgaaagttgtttactggattaggaattagttgcacgatattaatggcagttcttccaggaactatatattttattcataaaaaactcacaacgtatggagcacagccgtggaatactgatgtgcaaaaaaagaaacctgaataatttcaggtttctttcgtgcaaagcatatgtgaagggggataccttctatgtatgctttgctttatacaagccctaaccaatgtaccaattgtgtagagaggaatgtaacaacaatggcgataacggtagggattgcaaacgataagaatgtccattttgcactttttgtttctttgtatatattaacaagtgttgttccgcacgggaaatgaagaagtgagaacaacattgtgtttaacgctgttaaccaagtccaaccattttctaggaatagatttttaatttgattaaaatcatctatttcagttaaagccccagttgataagtaagacattaataaaattgggattacaatttcattagcgggtagtccaagaatgaatgcagctagaataaacccgtcaagtcctaacattttagcaaatggatctaggaagtttacaaaatacataagtaagcttgtgtcaccgataaaaatgttagcaagtaaccaagttaatgcagccgcaggggcagcaacaactatagctcgttttaaaacatagattgatttatcgagtgttgcgcgaacaatggtattccaaacttttggcttgcggtacggaggtaactcaagtgtgtagtgagttggaatcccttttaaggctgtctttgatagtacccaagaaacagttaatgtcataataacaccaattacaaccattccaactacaacgccagcagtaaccaatgtttgcatactgcctgtataaccagcagccataaatagtgaagccattaaaattaacataggccagcgaccgttacaaggaacgaagttgttcgttaaaattgctagcatacgttcacgtggtgattcaatgatacgtgttgacataatggctgctgcattacaaccaaatcccattgccattgttaaagattgtttcccgtgtgcgccggatcgtttgaataagcggtccatattaaacgcgacacgtggtaagtatccgtagttttctaatagcgcgaacatagggaaaaagattgccataggtggtaacataacgctaataacagcaccgataccacggaacaaaccaagtattaaaatgccatgtaaccattcaggtgcatgcgctgcttggaaccaagatgttaaatatccttcggcccatccgaagaattcggcaatcatatcagatggtacgttagcgcctgcaattgtaagataaaaaataatagataaaataccgagcataattgggaatccccagattggagatgtgaaaattttatctagttttaaggaacgatataatttatcagtatttgtatattggacagattctttacatatgcttgcagatgttcggtaaatatctccgactatatcatctcgtatatcttcttttgaaagtgtttgtgcatgttgaataatatagtctaatggaagacctttactggctgagtgagattccattaattacgacctcccttacaagtggttcattatggtgtttttgaagtgtagttaagaaatttttatctccatctaatatacgtaacgcaatccaacgtgctggatacgtatcaccgaacactttataaatttgtggttctaattcctgaatcatattttcaattttttcgctgtaagtaattttaattggtgttggaattagttttttatttgctactcttgcaataacatttagcaaatgaccaatacctactcggtgacgtgctgaaattttaacgacaggtacaccaagtgattttgctaatttcttttcatcgattacaatcccttttttctaggtttcatcaattaaattaatgcatatgactacattatttgtcatctccatcacctggagtgcttaatttaaat

SEQ ID NO: 1250 - DNA, 8246 bp, Bacillus thuringiensis
tttgcggtataaagaatattctttcttaatattttccctattataactaacaatgcatttgatcgtgtaaaaccaaatatatgcaaattacttacatctctagaaaatatcccttttatacatgctcttatatcccttcctaaaacaattatatcctcattatctatatcattaacaatactattgaacaccttttgtggaccagacatttctttttctatgttctctactttaacccctattactaaagttttttgcaacaggatctcctccgttctctcttttaattaaatcactacctaactttattgtagtaaatataaagaaaaaccataaaaagtttagataattatttcttaataaagagaattctgtaccctgatggaataaaatagctactattattgcaatatttccagaatacatgagccactgatttttatactctaagttgttcttgtatttttgaaactgttgaattaaaatccctaatgtacaacagacaaaaaatagaaataatcctaaaccgataacccctatctcagctgtaatacctaaatatagactatgtgcatgatttactccaacattcatttctcttaaaaactcttgactagaattgaaccctatccccaaaaagaaatggtttgaaataacatcggctaataaatcccatgcttttcctcttcctgccaaatctaagcttaatcgctggttacttccctgtaataaaagggctattattcctcctgcaaaaacacttagaatcaaagatattctcatgaatttccaaatgttttttcttaaacggttcattcccctactattatttaaccaaaagaacagaaataagaagattccaaatgccaatatccctgttcttgaatatgttaaaaacaaggcataacattgaattaaaaatgatattataaaatagaaagtttttattgactgtcttaaaaacaaaatcagagtggtcgctaatgatattaatagtatgtatgataatatgttaggatttcctgtaatagatgaaaatctcagtgtcgctcctgaataataaactgcctgttctattcttataggacctaaggtaatataatttagtgaatattcgtcattaaaccacatcattaatccaaaaattttaataaatatcattaagatagctaaaaataaacctactaacatttgaattttataactagcaatcaatgttttttcaatcattcgatctacattaacaatgtatgccattgcgaaaataggaccaaaaattataaatgttctccataaagtttcaaattgtatttcactccaaaaacttgaaatagcacagtaaagacctaagacatataaacagcccattgattgcaaatattctttagtaaaattagcatttttactatttaaaaaattaaataaccacagcacaaaaataattaaaaaattagcataataactatatggtgcttttattaatggttgcatgctatttactaccggcacatataaaatgaatagtgaaattaacattatgaaaatagagttataaacataagaattcttactatccatcttttgaagtacaaaacttttgtctttcatattttaacctctacttttaataaatttccctagtctgtattttaagacctttggtaaacggcttattaatattaaaattaccttaggatttaaatatatatttttcactatacccttaatatctttttcttttattttttcaatgaagctataatataaatttagatttgagagtcttaccatcctaccttgcaattgattaattaattttttattcccttgaaatttttcatgttttaacagttccctatttgcttgtattaactgttggattctctttgtcttttgtcttgtaagagaatctcccctctgcctataaaagtataacggtttattataaaaataacatttattagactcgcatagtacctcaagataaaaaacataatcttccccaaatatcaattgatcattaaatcttatattttttttctccaatagatttctttttattatcggttgcattcctaaatctaactctactaataactctggggtaatattaaggctagattcaagcttttctttgtaattttgacattgtgttgcatacggacttacatgcccatcatatattaggaaaatatcatcaaatatcatgtcagcttctttaattctagcaaaattaagcaactcttttattctttcttgatcccaccagtcatctccatctaaaaaagctatccaagtaccttttgctttagaaatcccaaagtttctcgaataagccggaccttggttagaaccattttcatatagctttatccgctcatcttgtaaagattgaatgatttcaactgttttatcccgtgatccatcatcaattactataacctctaattgcttaaaactctgattaagtactgaacttaacgcttcctctatatattcttctacattataagtgggaattattatagatatctcaggaacagacatttatagcctcctctacataatagatttctttttttgaatcatattttttattaaatctttttctgatagaataacaattaaaacaatgagataacttattactaatgagataaatatattaatatttcctagaaataatttatttatgacatacaaaaaaattaaacttaataaacttttagaactacccctaaacacggtaaatattccctgcttattaaaaattattaaacccagtaatagtacaatctctattaaaacagctgcgattgctgctcctaaactaccgtataactttccaaaatacgagtacgcaaaaatacctgtcccaaaactaattaataatgcaatagatctatatttttgcaaacctttagttgttaaactatccgctaaaggaaagttaattgattgaataaaaacaataatagataaaatagaaagcgtttcagcaattcctatccagttttcccctaacagaaaaactgaaatttcttctggaaatagtattatgggtagaaccataattaaagacaataaagtcattaacttgatttcgataactattacctctccatgtttttttagctcacttctatcaataagcttaaacaaaactggataaaaagctgctgctacaatacctggaatttgatatagaacagaggggatacgtaatgcagcgttaaaatagccaacctgttctaaactagataccttttctaaagcaataggtcccattaaaggcataagtattgttaaaaaagcagttaacgtaaaagcacttaacccatttaaaatagaattatctaatcctttatgcaatttaattttattaatgacaaaagagatacttataataccccctaaaatactacatagcccataagttaaggctaccattaaaagactatatccaaaataaactccaataagaagacctatgacagaaattaagcctgccatgattcgaataattgcagtatatttcattttttcgataatttgataatataccgctcctacattttgtagtgctgcaccaaatattgtagggattaccatcaagaaaattacctgtttcatttctttctgactatacataaaatttactagaataaatacaattacagaggagaatatacaaatgaataatcttgttaccaaatagctatttaaaagtttagatatatctttatcagctttggtaccctccctaataaatgtatgagttaatcctagatctgtcattgaacttgcaaaagtggaaaatactaatgcaatacttaaaataccatattgttctgccccaagatacctagctatcacaattgctgaaatggcggttaacattcgtaccatcacatttcctacaaataaaaatgaagcatttttaagaattaattgtaagttcatactaataccatcctgtatttataagatacattatctagctccgtcacctgtgcatactaccttaatagtctttaatataattttaaaatccaacaataaactggagttgttaatgtaatatatatctagcctcaacttttctctcggtgtaatttcataaccaccatttacttgcgcccatcctgtcagtcctggttttacctctagtctctttttaaaacctggaatttcacgctcaaatttctcagtaaacataggtctttccggccttggtcctacaagagacatttcaccttttaaaatattaaataattgcggtagctcatcaatcctcgtcttacgaataaataatcctatctttgtaatacgtggatcattcttctctgcccattttgcaccatttttttctgcatcatttctcatagaacgtaatttaataacattaaacttcctaccattcatacccaatctttcttgtaaatagaaaggcgaccctggggattctaaaataattagtaaactaaatatcaacataacaggtgccaatataatcaagcctagtaaagcgaatataacatctaatatatacttactccctaaatataacttggattgtctattttcgacttgaacgatttgatcatctgatgtaacttgatattctctcgctatattttcaccagtcttcatattccctctcccttataatcttattcattgatttctttatgtactaaatcattcatatattttattaattgcttttttaattccttatgctgtaatgctacctcaattgtcgtcttaataaaccccaatttctcaccaacatcataacgctttccttcaaaatcatatgcaaatacccgttgaatttcatttaatcgttgaattgcatctgtcaactgaatttccccaccagcacctgtttgttgatcttcaaggagcataaagatttctggtgttaatacgtaacgtcccataattgctaaatttgatggcgcagttccttgagctggcttttcaacaaattggcgtacttgataacggcgatcattcctttcaactggatcaataataccgtaacgatgtgtttcattttctggtactgtttgtacaccgataacagatgattgtgtaccttcatattgatccattaattgacgtaaacatggcgtttctgcttgcacaatatcatcaccaagtaatactgcaaatggctcatttccaataaatttacgggcgcaccacactgcgtgtcctagaccctttggttctttttgtcttatgtaatgaatattaatttttgatgaagcttgtactttctcaagcatttcatacttccctttttctaagagattttgctctaattcaaaggaatgatcaaaatgatcttcaatcgcacgtttaccttttccggtaacaataataatatcttcaattcctgattctatcgcttcttctactatgtattgaattgttggtttatcaacaattggtaacatttctttcggcattgcctttgttgccggtaaaaaccttgtccccagtcccgcagctggaataattgcttttcttacttttttcaaatctagtacccccaaacatattattatatccacatgtaacaataacaaaaaccctacttatagggtcgtctttacaactccataagtagagtttctaacataaataaattatgggcatccaacccatcctcacgtcatactcccgacgacaagcgtctaaggtaggttcgaaataaaaatttctacccacagcacgaccgagtgcctccgttgataacggttaggagacatcaccaattctttatttaaaaaataccgaacaattttttacgacgaatttgttctggatcttctttataaattgccttcccgctaattaataagtacggattttctttcaaatcactcataacactcattccaaattctttctcaattagttcatagctttccgctaaatgaaatcctcttgatgtcgtgttatgtgcatctgatgcgatcatatgtgttaaattatgttctacaagctgtagtgagaattttttaattttttttccaaatttcccaagtaaactacctgctgtcacttgtgttaatgcacctttatttacaagattatataacttatctggccgctcgattaactcggcattacgttccggatgaacgataattggaatcattccttttacgcgcaattcatatagtagttgttctgcataacgaggtacgtgatttgatgggaattcaatgaatatatatttatttgtttcatttaaagtaacgattttaccagcttcatagtcttctaataaatcgccatataatctgacctcttgcccaggtaaaatggtaagtggcatattatgttgttgtagttcatcatttagttgttttacatgatgaataattgaggtacgttcatttacatattttccattttgatggtgtggcgttgcgacaatggtatgtattccttctgaaacggcttgttgtgccattgctaaactatctgttactgtctgtgcaccgtcatcgatccccggtaaaatgtgacaatgtaaatctatcatttgtttcatcctccctctctcctataaagatcttttttcccttgaatatgagatatcgctcatattcaagggaaaaaaggagatatgtttttaccatatctcactttaaaattagtttgcaccgtagtagtagtataggccttgttcacgttcacggtcgtttagaacaacgcccaacaatttacctttagccgattctaacaatccttttgcttttaccgctgtttctttctctgtcgattcactacgaacaacaagaatagaagcatcacatacatttgccataatttgcgcatctgttacagctaaaataggcggcatatcaaaaataactaagtcgtacatgctgtatgcttgtccaagaagttctttcattgattttgaacctaacaattcagctgggtttggggggattggaccacaagctaaaaagtgtagattatcaactagtgttgtttgcacacatttctctaaacgttcactatgtgttaatacattcgttagtccaaaaatattgtctacttggaacatttgatgcattgctggtttacgcatatctgcatcaattaataatactttttttccttgttgagcaaacacaacagccatattcgctgtcgttgttgttttcccttcacttggatttgcagacgtgaccattaatgaatgtaaattcgtatcaacagctgcaaattcaatattcgttcgaatattacgatattgttctgaaattggtgatttcggttgttgatgagcaattaattgacggcgttgacgatgattctttttctttttaaataatttaagagccaattgtttgtcccctcacttttcttgatgatggagcgtgtgatttcacgttcattgtttcttcatccatacgagctacaattcctaatactggtaagccaagtaagttttccacatcttcttcttttttcactgtgttatctaagtattctagtaagaatgcaagaccaactgaagccattaaaccaacaacgaaagcaattgccacatttaacattggacgcggtttaattggagattgattttctgcaacttctgctttagataatactgttacgttatcaacgttcataatttttgcaacttcacctttaaatacatctgcagttgcattcgcaatatcgcgagctaatttcggatctttatcctcagctgttacagagattacttgtgaatccttttcattcgcaacattaatctttcctgttagcacttgagatgtcatatttaaatttaatttttcattcacttgttctaagattactggacttttaatgataaccttatatgtattcgttaattgaatattcgtttgaatttcaccagcttggaacattgcaccctcttgcttcttctgattcacaagaatttgcgtcgaagattgatagattggtgtcataaagaagaagctaatgatagcacttacaatagctgcaccaaaggcgattacgaggatcattgctaaacgtttttttaagatatgaaataactcttttaaactaattgtttcttccataggttcctccaactttctaaaatttacacataggaaaaattataacatataaatcttacattttttatttttaataatttagttctatatttgttcacaagaaacaagtataaacatacaaaataatcttaaata

SEQ ID NO: 1251 - DNA, 7610 bp, Bacillus thuringiensis
gctatgaacttatttggacacggcatcgccttatctggagacttcgttattcaaggtgcaccgaaattaactgcagacgcggctggtctccctgtttccagcatcgtatctgcaagtgttccactcgttatcgttatgggcattgtgacaacttctgtcgcttttttcttcttacgaaaagagtttcatacaggcttatctatacaagaagctattccatcaactgagtcttctaaaacgctcacttcattatcttctcgcataaagaaatggctcgctatttgtatccctatcatatatatcattgatatcctttgcatgattcaatttaaattacaagaagcgacgcaactgcacttatcggcggaacgactgttattatgattatcatcatttccctcatcgcctacaaaggaaatggactgaataaaacgaccgattatttcatagaagggctccaatttggctttaaaattttcggaccagttattcctatcgctgcactcttttatttaggagatagtggatttgtaaaaattatcggggactatttaccgaaaggttcacacggaatcattaacgacttaggcatcgctttatctcaaactgttcctttaaatcaatatgtatcggcagggacattaaccatcgttggtgtcattaccggcttagatggatcaggtttttcaggtatatcacttgctggttccattgccaatctttttggaacagcacttggccatggaacagctacattaacagcactcgggcaaattgcagctatatggaccgggggcgggacgttaattccttgggcacttattcctgctgctgcgatttgtaaagtcgatccatttgaacttgcacgccgaaactttttaccggttgttatcggtttaattgtcaccacgatcgttgcgatgtttatcctataacgtaagcaagtgttctcttgcttacgttttgtgcttgtaaaattcatcatgaattatcagttttcaagagggattcgttattacttagcgaaattatattaggagagtaattatttcaaaacgtttacgagaaacagattactgcaattagaaaaggggacatacctatgaatgaattgattttcgtcttattaatttgtccattacttatctttatcgtttctgttattggaacgcgcaagacgaaaacgtattacgtaatgccgattgtaacgtttgctagttttttaataataggtgttatcgcctttactccaaaatttttcttttgggttggcatgtacagcatcttctcatttattgtttcttatatgactttattgtttttaagaggatatgagcttgcagaaagcgctaagtagttaaggagattgtaatatgattttctttgatattgatggaactttacttgaagttttaacaatgatataaaaaacgaccgcgttcccccgcggtcgtcttttttcgtgttacgctgtgatccaagcttcgttagctggatttttacgccactcttgtaatttcttcgtttcagcttgtccaatcatacctttttctgctgcaacttcagttaatgtactgtaatcacttaaagaatatgatgctacgttagctgcttctagtttttcttttcctgcttcaagctcgtatgtgaagattgatacgatccctaatacttcacatccagcttcgcgaagtgcttctacacatgtaattgcactaccgccagttgaaattaagtcttctactactacgactttttgacctttttcagcttttccttcgatttggttccctttaccgtgaccttttgctttactacgtacgtagcacattggtaaatccatacgatcgcttacccatgcagcgtgcgcaataccagcagttgcagttcctgcaataatttctacagttgggaagtgctctttaattaactcttctaatccagctgcaatcgcttgacgtacttttggataagataaagttaaacggttatcacaataaattggcgatttcatacctgaagaccaagtgaatggatcattcggttgtaaaaatactgctccaatttctaataaatgcgatgcgatttcttttttcatactgttacaccttcccactgttgttttactgttttatacgcttcaagcggattttctgcttttgtaatactacgtccaactacaatgtagcttgagccaagttccctcgcacgtttcggtgtcgctacgcgcacttggtcatttacatcatcgcttgcaagacgaatccccggtgttaccgttacaaattcatttccgcatacttcacgtaattttggaacttcaagtgttgaacaaacaacgccatcaagtccactttctttcgttagttttgcataatgagcaaccgcttcttctaacgttttctcaatgccgatctcttttttcatcatagcttccgaagtgcttgttagttgtgtaactgcaatacaaatcggtctctcttttccttcttgcttaccttcctctaatccctcaatcgcagctttcatcatactgcttcccccagcagcatgaacatttaccatatcaacatctagactagctaggctacgcatagcgctttttaccgtatttggaatatcatgaagttttaaatctagaaagatcttatgccctttttcttttaagtacgtaataatcgcagggccttctttgtaaaataactccataccaactttgacaaataactcttccccttcaaagtggcgcaagaattgttctacatcttgtttccctggaaaatctaatgcaacgattaacgactgtgacatgtttgcttccagctccttccttgacattccgaaatgtgatcaaatcctaattcatctagtaatgctggtaactcttcaataattgtcggacatacgaacggatcaataaagttcgctgtacctactgcaactgcgcttgcgccagcatagaagaattcaattacatcttccgctgtctcaataccacccattccgataatcggaatgtttaccgcttggcttacttcatgtaccatacgaattgctactggcttaatcgcaggacctgataatccacctgtacagtttgctaaaattggtttagctgtttttaaatctagacgcataccaagcaatgtattaatcatcgttaaaccatctgcacctgcattttcaatcgcttttgcaatttccacaatgtttgccacgttcggtgacaacttcacgtatacaggtacttcagaaacctcttttactcgcttcgttaaatcagcagcaatttcaggatttgtaccaaaggcgataccacctgtttttacgttcggacaagaaatatttaattctagtgcatggacattaggcgctttagaaatttccttcgcaaccgctacgtaatcctcagcttgtgagcctgcaacgttcgcaataattggaaggtcaaattgttctaaccatggtaattccgaattcattactttgtctaatcccgggttttgaagtccgattgcatttagcatgccgcctggtgtttcagcaacacgaggcgtcggatttccataacgtggttgttctgtcgtcgctttaatcatgattgatcctagtacacttaaatcgtaaaactgtgcatattcacgaccaaacccaaagcatccagatgccggtataattggattttttaatgataatcctggtaattcaacttgcaatctgttcatagtacaacctccccgattggaaatactggtccgtcgctacacaccttcttgtaagaatgtccacttggatcttcttgtaagtggcatacacatgcgaaacaagctccaataccacagcccatacgttcttctaatgaaatataggcttttttctctttgtaacgtccttctaatgcacgaagcatcgctaacggaccacatgaataaagaatatcaaagtcaattccgtaattatcaattacatctgtgacaaatccttttgtaccgtgtgtaccgtctactgttgcaacgtacgtatcaccaagttctgcaaatttttcttcatagaaaactacatctttcgtttgaaagcctaagatgtgaataacacgtacaccttttgcaacgaggcgctgtgataattcataaagtggtggtacaccaattcccccgcctactagtaaagctgtttgaccagcttctgcttcttctacaggaaaaccgtgtcctaatggtcctagtacatctaccatttcaccttgttttctagttgctaatgtttttgtcccttgtccttcggcacgatatagcattgtaaattcgttcttctcttgatctacattacaaatactaattgggcggcgcagaaggggcgcaatgccctctgctaccttaatgtgtacaaactgccctggttcgttcatttgctgtactaacgttccttgaagcactaattcgtaaatattttttgcgatttctttttgattaacgacgatcatattttgcttttgcatcatgcatgtaccacctcgtgacgctttgtttgcgtaatttctttcattgaatgagctgagaatgtcatagattctaatactcgtaagattgctctcgttgtatcaagtgatgttaagcaagccacaccattttctactgattcacggcgaatgcggaaaccatcacgcgctggttgtttaccttttgttaatgtgttaattacaaactgtgcttttccttgacggataatatctagtaagttgtagtcttcagaatcaattttgtttacaacttgtactgggatattttgctcttctaatgattgtgctgttccagctgttgctaataagttatagccgatttcgtggaaacgttttgcaatttccatcgcttcttctttatctttatcagctacagtaatgattactgagccgtgcgttgggatgttaattccagaagcaactaatcctttatataatgctttttcaagcgttaagtctttacccattacttcccctgttgatttcatttcaggtcctaatgttgtatcaactgagcgtagtttcgcgaatgagaataccggagcttttacatatacttctttctcttctgggtgatagccagttccgtatccttgctctactaggtcttgccctaaaataactttcgttgcaacattcgccatcggtacgcctgtaattttacttaagaacggtactgtacggcttgcacgtggatttacttcaattacgtacacttgatctttgaatactacaaactggatatttagtaatccaacaatgtttaatccttttccaagtgcaattgtatgttcaatgatttgttcttttagtttttcagataaactttgtggtggatatactccaattgagtcaccagagtgaactccagcgcgttcaatatgttccataatacctggaatgaatacattctcaccatccgaaattgcatctacttcaatttctttaccaaccatgtaacggtcgattaatactgggtgatctgcatgaactttaactgcatttttcatgtagtgcagcagttcttcttgacgatatacgatttccattgcacgtccacctagtacgtaagatggtcttactaatactgggtaaccaatttcttctgcgattgctaccgcttgttctacagtcgttgctgttttaccaactggttgcgggatgccaagttttgttaaagcagcttcgaatttatcacgatcttctgcacggtctaagtcttcaagtgatgttcctaaaattttcacaccgtgttcttctagtttcgctgctaagttaattgccgtttgtccaccgaactgaacgataacaccttctggtttttctaaatcgataatgtgcattacatcttcaatcgttaatggttcaaagtataatttgtcagaaatactgaagtctgttgaaactgtttctgggttgttgttaatgataattgcttcatatccagcttctttaattgcccatactgagtgaactgttgcgtaatcaaactcaacaccttgaccaattcggatcggaccagatcctagaactactacactcttacgatctgttacaatcgattcattttcgtccgcatatgtgctgtagtaatatggcgttgcagattcaaactctgccgcacaagtatctaccattttgaatactggcatcatattattttctttacgcatatcgtaaatttcacgctccgttttgttccaagctgctgcaatgtagtgatcgctgaagcccatttcttttgcagtttgtagtacttctatatttcctacattcgcttttacttcacattccatatttacgatgttttcaactttttgtaagaagaagaagtccatttcacaccattcattgatttcttctttcgttacaccttggcgaattgcttctgctacaataaacagtcgttcatcatccgctttaatgatacgttttttcatcgtttctttatcaagttcttttaagtggtctaattctaagtgataaatgccaagctctaaagaacgaactgcttttagtaatgattcttctaagttacgtccgattgacataacttcaccagttgctttcatttgtgttccaagcgttctgttcgctgattcaaacttatcaaacggccaacgtggaatttttgaaacaacatagtctaacgctggctcgaagcaagcgtaagttttttgtgttactgggtttacaatttcatctaacgttaagccgactgcaatttttgctgctaatttcgcaattggatatccagttgctttagatgctagtgcagatgaacgacttacacgtggatttacttcgattacatagtattggaagctatatggatcaagcgcaagctgaacgttacatccaccttcaattcctagtgcacgaataattcgtaatgaagtgttacgtaacatttgatattcacggtcgcttagcgtttggctcggtgctactacaatcgaatcacctgtgtgaacaccaactggatcgatgttttccatgttacatactacaatcgcgttatcatttgaatcacgcattacttcatattcaatttccttacagccagcaatacttttctctaataaacattgtgttactggactatgttttaaaccacttgttacgatttcaattagctcttcttcgttatggcaaattcccccgcccgttcctcctaatgtgaacgctggtcgaacgattactggataaccaatttcatttacaaatccatatgcttcatcaaggttatgaataatttcacttggtggtgttggttcatttaaatcttgcattaatgtacggaataaatcacgatcttccgcttgctcgattgctgataattttgttcctaaaatttcaactccgcactcgtcaagtacgcctgattttgcaagttcaacagccatgtttaaacctgtttgaccacctaatgttggtaggattgcatcaggacgttctttacgaataatacggcttacgaattctaatgttaatggctcgatgtatactttatctgctgttgcagtatccgtcataattgttgctgggttagagttaacagggattacttttgtaccttccttttaagaga

SEQ ID NO: 1252 - DNA, 3861 bp, Bacillus thuringiensis
ctcttttatataaactaataacagcgtaaatcactaatgagggtgcattaaaatagccaattaaaagccaagtttcctttgttaacatacggaagcttgaaaggtccaagataaaagttaaagtgaaataaatgtacataataacaataaagatgctatcgaatgaaaattgagcaagacccttaatagagtaaatttttataaactttatggcaaatccaacaaagagtaaaacatattgtatgataaaaaaaggtaatgctttatatgagaatataacttgcttatgaatagaaagtgaaggaagaaataaagttatttccatagctaacccgcatagacaagtacataataataaaatccaaaataatttatcaccatgcgtcatttttctaatcgctttacataagcaatagcaagaaaaaagtgcagcgaaacagaataagaaaagaatcccgatttcttttatattcgactcatttggtataaggaatatccaaagagcaaatataaatatgtatattatgacagattgtatatactttttttgattaatcatattatgactccgtttcaataaagttgaatctcggggagaaaatgctaatttaaataatagcatataaaacagaatgttttttactataaaaattacttttttgaaaaaatggtgcaaagttacaatttaccactgtaacattgcaccacttattcttttaattcctcttatagcagaaagttcatctattaattggaatagtgctaagtctttttgtttactttcaatcataatatcgaaattatgattgtgtttttttgcaatgtgtaagaaaggcttaataaactctaaatcgatatattcagcatgagccctaaattctttttccgatctcggggaggaaatgtgaactttaggagagatatttgtatgtgaccaagtttcaaaaattgcaggaagcaactcttctagtggttcctcgcaaagattggccatatgatgatgataatcaaatacaaatggaatattttctttttggcaaatggataaagtttcagcggttgtataggttttatcatcattttcaagagtcatttgtttttttatatgtgtaggaagtttttttatgttttcatggaagcgctcaattgccttttctttatttccataggctccacctacatgaatattaatgtaagaagaatctgcaatgcctatagcatccaatattttataatgataagtcatatccgtaatagcgttagtagtaatatgtggcttgtcgcttgtaaatagcgtaaattgatttggatgaaaacttattcgtaaattgtgttctttaattaaagcccctattttacgccaaagtggtgtgaataccccatgcccatcaacttaagaatttgcactacccccaagtgtcaaaaaacgttattctttctaaaaagctagctagaaaggatgacattttttatgaatctttcaattcaagatgaattacaactattttctgaagagctgtatcgtcatttaaccccttctcttttggaagaactcgctaaagaattaggttttgtaaaaagaaaacgaaagttttcaggaaatgaattagctaccatatgtatctgggtcagtcaacgtacagcgagtgattctctcgttcgactatgcagtcaattacacgccgccacaggcactcttatgagtccagaaggactcaataaacgctttgataaaaaagcggttgaatttttgaaatatattttttctgcattatggaaaagtaaactttgtaaaacatcagccatttcaagtgcagcactcacgtattttcaacgaatccgtattttaaatacaacgatttttccaaagtaccgaaacatttagcacatgtatatcctgggtcaggtggttgtgcacaaactgcaggtatcaagattcaattggaatatgacttacacagcagacagtttttaaacttccaggtaggtcctggaaaaaataatgataaaacatttggaacagattgcttagataccttacggccgggtgatctgtgtattcgtgatttaggatatttttcattggaagacttagatcaaatggatcaacgtggcgtgtgctatatatcaagacttaagttaaaccataccgtctatacgaaaaatccatttccagaatactttcgaaatgggacaatcaaaaaacagtcacagtatatccaagttgatttagagaacattatgcacacgttaaaaccaggacaaacgtatgaaataaaagagtcgtatattggcaagaatcaaagattatttacaagagtaattatctaccgattaacagaggaacaaatactggaacgtagaaaaaaacaaagctataccgaaagtaaaaaggggattacattttcagaaaagagtaaacgattaacgggtatcaacatatatgttacgaatacgccttgggaagtggttccgatggaacaaatccatgatttttactccctccgctggcagatcgaaatcatatttaaaacgtggaaatctctatttcaaattcatcattggcaaactatcaaacaagagcgattagaatgccatgtgtatggaaaactcattgccatttttatatgttcttccacgatgtttaagatgcgccaacttctgttgcaaaagcacaaaagagaactaagcgaatataaagcaattgggatgattcaagatcatctatccctgttatatcaagcgatacagagaaacacccgtataataacaaaggttttaatccgcctgtttaccctactaaagaaaaatggccggaaatcccatcgatatgagaagaaaactatctttgatattatgggtgttgtctatgagtataatggattgagaaaacaaaagaaagctgcataagaaaaaaatgaaacccgttagggtttatttcgtatgctcatttttaagaggattatactgtttaaaagtttgttcatttcaattaatggaaaaccgtagagtttctatccttaagttgatgggcatgtaaggtgacccctattagtggtcaaaattttaaaaaaacaaggaggctgtccagacagccccctcgtttttttcgatattctaataaattgcatatacacttacattgaatgggtctgcagcgtttctaggattagcgatataaagtgatctcgctgattctacagttgttctattaccattcaatacagcggaaaaaatgataggatccgtaccactagatacatccttcataacattaaaactaataatatctgggtttcctccatcagttattacccattttaaatattgtgttccaactggaagagattccgtactaaaatttccacttgaacgattgctttgtccttctaaaggagacgtttgtgataaaacagttgcaattaattgttccggcatattaattcctcttttcttaataaatttatattaattttttataacaatgattcaactcaaatatatgaaggattaaataaaataagtattgagaaatattttgtattagggaatcgttttaaaaatgggcttaacgttgtaaatccgcattttcctaacgctccccctaggggaagcgttaggaaccgtgccgtgaagtgtaaagtaatttacagaaaatgtaatacgtgatgcatcgacagttgcaaaaattaacatttatgcaacactccacttgggcttgatttttatggcgccataacgttgcatatattgtgttgcaaattaattttcgataatacggtgatatttgtagcgaaatagaaaatagatatttgcagcactatgaataccttaacgtgctgcaaaatgattacaaaaaac

SEQ ID NO: 1253 - DNA, 9274 bp, Bacillus thuringiensis
tatgtatactgttccgacaatgcttgaatctttatataaagaaaatagattaatagaaaataaaatgaaaattatttcatcaggagcgaaatgggaagctgaagcgaaagaaaaaataaagaatatatttccttatgcgaaaagatatgaattttatggtgcatcagagttaagttttgtaacagcactagtcgatgcagaaagcgaaagaaggccaaattcagtaggaaaaccttgtcacaatgtgcaagttcgaatatgtaatgaagcaggcgaagaagtacaaaaaggcgagataggaactgtttatgtgaaaagtgatcagttttttatgggatacataatagatgggggtttaacacgggagttgaatgcagatggctggatgacagtgcgagatgtaggctatgaagatgaagaaggctttatatatattgttggtagagagaagaatatgattttatttggaggaatcaatatttatccagaagaaatagaaagtgtattacatgaacacccagctgttgatgaaatagttgtaattggtgtgaaagatagttactggggtgaaaagcccgtcgcgatcgtaaaaggaagtgctacgaaacaacaattaaagagtttttgcttacaacgattatcctcgtttaaaataccgaaagaatggcattttgtagatggaataccttatacaaatagtgggaaaatcgctcgtatggaagcaaaaagtatgattgaaaaccgggagaaaacatatgaataaggcagttattgtagaggcgaaaagaacacctatcggtaagaaggatgggatattaaaagagtatgaagttcagcaattagcaacgccgcttcttacgtttttaagtaaaggaattaagagagagatagacgatgttatattaggaaatgttgttgggccaggagggaatgttgcaagattatctgctttagaggcaggacttggctatcatattcctggtgtaacgattgatcggcaatgtggtgctggtttagaagcaattcgaactgcgtgtcatctcattcaaggcggggcaggtaattgctatatcgccggaggagtagagagtacaagtacgtcaccttttcaaaaaagagcaagattttcacctgaaacaattggtgatcctgacatgggagtagcggctgaatatgttgcggagcgttataacataacgagagaaatgcaagacgagtacgcttgtcttagttataagcggacactgcaagcgttagaaaaaggatatatacatgatgaaatattttcttttaatggattattagatgaatctataaagccagaaatgaattatgaacgaatcattaaaagaacgaagcccgcatttttacaaaatggaacagtgacggcaggtaattcatgtggtgtaaatgatggggcatgtgctgttcttgtaatggaagagggacaagccctaaagttcggttataaacctgtccttcgtttcgttcgtagtactgtagtgggagtggatcccaatcttccagggactggtccgatatttgcggtgaacagattattaaacgaaatgaatgtaaaagtagaggacatcgattattttgaaataaatgaagcattcgcctcaaaagttgttgcttgcgcaaaagagttacaaattccgtatgaaaaattaaatgtaaatggtggggcaattgcgctcggtcatccgtacggtgcatctggggctatgcttgtaacacgtttgttttatcaggctcaaagagagtttatgaaatatggaattgctacattaggaattggaggcgggatagggattgcgctattatttgagaaagtagaagactagtgaggtaactagttttctactttttgaggaacataaacattgctgccaggcttcgctttcatttcgttccaagcagcaatcgcatcagcttttgcttttcctttattatttggatctttgaaaaagtcccgagtaaagcgattgtattcaaattgcgcgctgatcgttgttttataagtaggatctttttttcgttcgttttcttcataccaaaatgttatcgcgtcttcatatgtttttccaacattctctttaaaaaacttttgaagagctactgtaaagcggaagtttgtttcgattttttctttgaaaaaagcacgaacatcttcgctacagcggtgatttttagtaataatcgtttgaagagaaaggtctttataagagaggggagctttgctcacttttggcacagagctgttttttaagactttccccgtagttaaataatgtgagatacgctcggttatttcgatcttagagccactagctggcagaccatgctcgcgacaaaatgtttgcagttctgcttttaaccaataataattttggaaatctgtaagagatatagtttttgttaaagatggtcgcatgaatgtaacaactactttcttccataattttctttaattataaaacatacgttctttttatggaaggattaatgtgtaaatataatgggaagaggaggttatatatagaaaatataatgcaagttcgtgttacgggaattttaattgaagatgaaaaagtattgctagtaaagcaaaaagtggctaatcgcgattggtctttacctggaggaagggtagagaatggtgaaacgttagaagaagcgatgattcgagaaatgagagaagaaacaggattagaagttaaaattaagaagctactctatgtttgtgataaaccagatgctagtccatctttgttacatattacgtttctgcttgaaaggattgaaggtgaaattacactaccttctaacgagttcgatcataatccgattcatgatgtgcaaatggtaccgattaacgaattaagttattatggtttttcggaaacttttatcaatcttataagtggcggttttgcaaatgcaggaagttatcaagggttgaaacaacatataggcctgtaaatatagttgaaggatagccgttagctatccttcataaacatgttttacactgctgactgtaaagaagaaacaagctgatttaaaaactcgtccccgttcataaccgcttttccgccgccgcgtgcactctttttatttccgccaccttttccttcaattgtaggaagagcatcttttaaaagagcattcatatcgagcgttactgtttttccgcaagcgagaatacattgtagtttgtcatcattttcaataacgaaatacgtaattgcatgctcttgttgttctgtaatgatagctgatatttttgcaatttcttgcatagaacgatctgtaaatgctttagaaataagtaacccagcatgtatttcggtgggctgttgcagtaattcatttgcctctgcaaataataatttttcattcattgtttgtgttgttttttcgttttccttttgagaggtaagaagctgtgccacttttgctgggatatcagtttcgctactgtttaattgtttggaaacatctttcataatttgttgctgttgccccattaatttaagtgtacgccaaccagcgataaaggttaagcgtataccacctttattgcgctcccatcctagtacttgaataagaccaacttcaccagtgcgtttcggatgggttccaccacagccgttgtagtcgtaattttcgataataacaacgcgtatattttctgttatattcggttctttacgaagaggtaatgttttcgcttcttctaagttcatccactctatacggattggatggttttcaaaaacaattttgtttgcaatttgtactgctttttcaactgtttctgtatgcagattttctgtttctaaatcgattgttaccgtttctttaccaagatggaatccaatcgtaggtatgttaaaatggtcccaaaaagcagcagataaaatgtgctgagccgcatgttgctgcatatgatcaaaacggcgctcccaattaattttaccttctacgtcttctgtatgtaattgttctgcgatgtagtgacgaatttctccgtttatctcttctacattgattacattgatatcatttaatgtaccagtatcatatggttgtccgccacctgtcggataaaatgctgtttcattcaaaacaacgtataagttaccgtttttatcataatcttgctttataattttagtagtaaagtcttgcttataagcgtcagtgtaatataatttgtgctccaattttctttctcctctcgcattaactagtttcattgtaaagcaattgaaattagtttcctaatatttcagaagaaagaaactatttttagaattttcttgctataataagaagaaaatgcgggggtggaataaatatgttatatgaaaatggcgtagataaactgcttagtttaagcaaaaatatttctgaattgtatcgagaattaaatgaaatgacccggattttaacggagtgtaatcgagaaagtgtgaagtttgatcggttatatgtaaaagagttactttggaagaaagaagatgtaatagagaaatatgaccagctacttgtacaactttgtattaacgaatgctttgatctaaaaagtgtcattacaggcgaatataagtatacatatgaagaagtggagaacatcgttttacaatttaatgagaagtataatgttgcaatattaattaaagatgtttgtaaagaattacagtttacatatggcatagatatggatataacgagaacagcgcgggtatcaacagcgcaagtataaaaagggaaaagaaagcagatcctttgctttctttttttatgtaagaacagggagagtaggtttttaagatgaaggggaagttgcaaaatattcatccgttaggaatgacaattataatagggactttatttgcgaggtttgccacgtcaatgagtattccttttttagcaatttatttaacgactgtgaaaggtgtatcagctggaatgacaggtgctattatcggaacgagtgcacttgttggagtgtttgctagttttatcggagggaatttatcagatcgattcggtcgaaatatgattataatatggtccatgatcgtttgggtctttgtattcattggtttttcacttgcagatcatgttttaagtttctttttattaaatgctttgaatggattatgtaggtcattttttgagccaacatcaagagcgttattatcagatttaacgaaacctgagtatcgtttactcgtatataatttgcgttacggtgcaatcaatgttggagtagcgattggcccacttgtcgggttacagattggaagcgcaaaatcaacaattccgtttttagtagcagctggagtatacattttatatacagctatattagcgttccaatttaagaagtatccgattgaaaaaaagaaagtaaatacagaaaagcctgtcacaatgttaaaggcaattcgtattttgcgaaaggatgtcgtatttttagttgcactagttggtattattttgagtaattgtggtttttcacatttaacgacaacagtatctcaatattttgcaaatgcacatatatttcaggatggagtgaaattattttcatatatgctagctttaaatgcgattgttgtagtcgtaattcaataccctgttattcaaatttgtaaaaagtatacaccgttaacatcaattatggtgggggctttatttgtgagtgggggattatttggctttggaatagtagaatccatgctaggtgctgccgtttgtacaattatttttacaattggagaagtcttaatgttttcgatgacggatgtatttattgatgatattgctgttgcgcatctaaaaggaacatacttcggtgcgatgggcttttcgggaattggagcagtaataggtccgtggtttggaggagtacttctcgattactacgggtaccaaaatgggtttgcagtattttcagcattagctacattctcaactgtggcatttcctgtgcttttagttacaaaaggtttattgaaaaaaaggtatgatagaaattctaatatagaaatgcatgcgaaataacataagccccagtaccaactggggcttatgtttgtattatattaactcttaatttgaaaaaagaactttcttttcatgtttatcagcaacttcatttttggaaatatgaatggccaaaaaaccattctctaagcaggctagcatcttcttataaataacattagcgggtaaagggatagttcgctgcaaagaaatgtttttatgaagtatgcaaatggttaggcctgtctccatctttttaatgactacattttgttcattggcatttggtacatctgtttccaaaatgtattcttgttcagtttcgcaaaggtcaatatgaatttgatttgggaaactaaagttactacaagagtcagaacaaaactgatccatccattcttcgaaaccatcaacatgaaaaagacaatccttctttttcttgcccatgtaagacaccctccgtaaaatctcaattcatactatgttatgcatgaatgaattaggggtgaagaataaatggaaaaatataaacattgtatgtggaaaagatagctagtgtgcactttttgttttacatatcatgatgcgcatgatgtttttggcgtgaatggttacggttttttactttatgagatccgcttaatggttcaggttgtccttttttttctttcgcttcacgattgttttttcccattgtatgtgacacctcctcttcctttttagaatgagagaagtttgcaaatttatacgagaatgtttttagaaaaaaaggtaaagataattgggactaactattacagaaaggggattatataatgccatatcataaagataaacaacaagcgtttcaagcagcgcagcaaggcgttacacaagcagaaaatgcatttaacaacattgtgaaaaatgatccaaactacggtcatgatttaaaagaattacgccaagaggttcaggaagcatatgaacaaattcaaaatgcactagaggtagcttcagaaacacaacgtccacaacttgagcaatatgaaaataatctccaaaatataatgcgaaatgtagatcaattagaaaagtaaattaggttgttgtgtatttgacaacctaatttactttaatgaacattatgcgaaaacagaaaatttttctattcgttttttctttattatgcgcagtacatatatttcaagttgaaaaagtggaagcgaaaatgttgctcagaaaagagctagaaccaactggctatgtaacgtgggaagtacctaataatgaaaaaattattgccattacatttgatgatggaccagatccaacatatacaccacaagttttacatttattacgtcaatataaggctgaagcgacattttttatgattggatttcgagttcagcgcaatccatatttagtgaaacaagtgttaaaagagggacatgagattggaaatcatacgatgaatcatttatatgcaaatagttcatcagatgaaaaattaaaaaaagatattttggatggaaagaaatttttcgaaaaatgggtgaaagaaccgttgctattccgtcctcctggtggatatattaacgatgctgtatttaaaacagcaaaagaagcaggttatcaaaccgttctatggtcgtggcatcaagacccacgtgattgggcaaatccaggggtggaatctatcgtaaatcatgtagtgaaaaatgctaaaagtggcgatattgtattgttacatgatggaggaaatgatcgtagtcaaacggtagcagcactagccaaaattttacctgagctaaaaaaacaaggctatcgatttgtaacggtttcagaattgttacgttataaacattagaaaaaatcccaaaaggtgaatgttccttttgggatttttcgttactggttctttttgcgtttcttattattttgtctttctgcaggagttaagttttcatttgcaaactcttcgttataaccagtaccttgtccttgtgcggatgctgcattcattcctgaaatagtatgatttgcttttcttttacccattttatttcacctctataacatttttttgtatgttgaatgatgagcagttcatagtgtgtatgaactataagtaaagcgctaatagagcactttactttatggtaatagtattcataaggagcatgaacactattcaaatttagaaacataaagaaaacttatgataatctataagtttcttattatttacttatttagaaagttgtaataagatattatcgtaaggtattgaaaagtttgtctacattttatattcagacaacttagtcacgtttaacaggggggaaacataatggtcaaacataatccatttcaatcacgtgcaacttttgaagtagatggaaaaacgtatcattattatgatttgaaagcgcttgaaaatgcaggggttggcaacgtatctcaattaccatattccgtgaaagttttacttgaatcagtacttcgtcaagtagacggacgtgtaattacagaagagcatgttacaaatttagcgaaatggggaacgaaagatgtgcaagatatcgatgttccatttaaaccatctcgtgtaattttacaagatttcactggtgtaccagctgttgttgatttggcttcgcttcgtaaagcaatggcagacatgggtggagatcctgataaaatcaatccagaaattactgtagaccttgtaattgatcactctgtacaggttgatagagcgggtacggcagacgcgcttgcattcaacatggacttagagtttaaacgtaatgaagaacgttataaatttttaagctgggcacaaaaatcatttgataactatcgtgcagttccaccagctacaggtattgtacaccaagtaaaccttgaatatttagcaccagttgttcatgctgtgaaaaatgctgaaggtgacttagttgcatacccagattcattagttggaacagactcacatacaacaatgattaatggtatcggcgttcttggatggggtgttggtggtattgaagcagaagcaggaatgcttggacagccttcatacttcccagtacctgaagtaatcggtgtgaaattaacgggtacacttccaagtggtacaacagcaactgacgttgccttaaaagtaacgcaagtattacgtcaaaaaggtgtagttgccccattcgttgagttcttcggtaat

SEQ ID NO: 1254 - DNA, 7989 bp, Bacillus thuringiensis
ctatgtaagcacgagaaaattgatcgtcatgtacaacagtccatctagtgagatagttatgtatttccctatacttcgtactccaataagcacggctgctgtttccaattatatgttaaaatccactctgaaaataaaggcattgatagccccatcagattggattcttgtctcgcttcttggacaaaacgatcgatgagactatgaatttcttccacttttccaagggaaaggtttcctttcaccatctgcatacgattgagccaatcatgtcttgaatggcgcaatgcatctataattgtccatttttcattcatttagataccccttaatatagaaaaactctaacctgcactcaggttagagttttccgtgagttcttatgcttcttgagcaacaggatatacgctcacttgtttgcggtcacgaccaagacgctcaaagcgtactacgccgtcaactttcgcgtataaagtgtcatcgccaccacgaccaacgttaacacctggataaatttttgtaccgcgttgacggtaaagaattgaaccacctgtaaccgtttgaccatctgcgcgtttagcaccaagacgttttgactgagagtcacgaccgttctttgtactactgacacctttcttagatgcgaaaaactgaagatctaatcttaacatacgttactcctcctgcactttttctattaaacggatatactttccgtaatcaagttcgatcgtcttaagcgaaacaactaatccttctaaaagcgtttgtgctttttctgctgtatgaacgtctaaatcattaggcaattcatatgttaagaatccgccatcacttccgagttcaatagttgcttgcacattacaaagttcttccactgcatttatagaaccaaacacaaccgctgtagttccagcacagacaaggtcttgtccatgtggcgcataatcggcatgtccagtcattttaaatgattggatacttcctaatttcgtgcgacttatcgtaattttaatcatgttaaccagaattaagcgttgatagcttcaacaactagcttagtgtaaggttgacgatgaccttgtttcttacgattgttctttttcgctttgtatttgaaaacgataattttcttagcgcgaccttgtttttcaactttcgcagtaactgttgcaccttctacaactgggctaccaactttaacgttttcgccaccaacgaaaagaactttgtcaaaagtaacagtttcaccagcttcaacatctaatttttcaatgtagattgcttgaccagcttcaactttaatttgttttccacctgtttcgataattgcgtacatacttgcacctcctcttaattactaagactcgccaaaaacgaggtagacataaatgcctttagggaacctgtcttgtgcggttgtagcatatagccgattaggtgctataaactataacataaagatgttatcatgaatcatagacggttgtcaataaatgttctgctaactattttttccgctctacaatgcccttaatacttccaaaacgaaccgatagcatacccctggatattacacatctttgaaataaatttcaaatggaatatttttttgtaattctttttgcaaaaactgtttttgcagttctttaggcgcagcgattaataccgcttcatcttctatattgccatatgtgattagttctctctctaactcatacgcaattgtttcatgcgacatcacataacccgtcgctttgcaaggtacacactcttttaataatacgtcccgtaaagaatgctttttacgtttacgtgtcatttccaaaatccctagctccgtaaagccgagcacccttgtatatgtgcggtcatcttgcatagcagctataagacattctcttaccttttctttatcttctctttttttcatattaataaaatcaattaatatcataccaccaatatcacgaagtcttaattggcgtgcaatttcttcagctgccatctcatttgtgcgaagtactgtatcttgtaaattttgttttcccgtaaacttgcccgtattcacatcaattacagtcatcgtctccatttgttctacaattaaataagcaccatttggaagccacacaattttttggagtgctttctcaatttcacgctctattccaaaatggttaaacatcgaagacttttcattataaaaagatactttttcttttccaactttgtcttctaattcttttactatacttcttgtatctacaactactttttcaatggtttcaattggattctcttgaaatacacgatctaaaaaggtcgccggtcgatgaagtaataacggcgcctttccttggccctcttttctttttaactcttcatacaactgttgtaacccttgcatttcagcttgtatttcttcaattgctcctttttcagaagcagagcggaaaatgtatccccccgttccctctatttcaatttggagtaactgttgtcttcttttattattttttatttttcgagaaacagcgcgcatctcatcaaacggcatataaacgacatatttcccggtaaattctatattcgctgtcaatttaggccctttcgtatcaattgcctctttcacaacttgtacgagtatcgcttgcccttcatgtatacgataagaagatggtacatcatcgtatgaaaggtaagcatgtttttctaaaccgatgtttacaaaagctgcattcattccagcaattgttcttacgacacgtccaacataaatatgcccaacaatctcttgctcttcattacgtttccataaaaactcaacaatttttttcttctcttcaattgcaacgcgcttttccgaaccagcgtaattcacatataacgttttcaaaattatttcctcactttataatcttctttgcttttacaataataaaaggttagtgctatcgtcaacactaaccgattaattcttcaactgatgaagttgttcgtttttcagtaaaatatgcatagagcaattcattttcatccaatgtgtaatgctctttatattttccacggacgataatagaatgcttatatcctctacgaaattttgtaaagatcgtatataaacgatcttccgtttgcacttcaataggtgcaatcttttcgattcctcttttgtttccataataacgttctaataaaaaacgcataaatgcataccgtctttgtttccactcttgatataatgacactgctaaaaatatgagtagtatccacatcataatattgttactattccagagtaactgccatcctaatattacaccaaaaaaaacacatgacaattgcatcatcttttcatgtgcttgtaaataagggaaacgatatgataatacattaaacaatactttcccgccatctaacggccaaatagggagtaaattaaatgctaaaataattatattattccacataaagaaataatataaatctgtattcagccaaccgacttcgaacaacatataacctaccagcatcatccaaacatgttgaatcggtcctgcaattacgacaacaagttcctctttcaatgacttattaccatgttcctcaagctcggccacgccaccaaacggcaaaagttgaattctttttatacgccaattatagtgtgctgctgcaaaagcatgcccaagttcatgaataagaacaatacaaaataacagtagtaactctttaaaacgcgcagtaaaaataccaatgacaataataacccaaaataatggatgcacggaaattttcgttaaaacgtccctatatttaatcaaatgatatcacctggatcggatcaataaatttttcattcttttttatcgcgaaataaaactttccgtttttatcatttgtatcattactcaccgttccaattttttgtttctttgaaacgtaatcatataatttcactgacatatcgtttaagtttgcataccatgactccgtaccatctgcatgttgaatttgaactgtatttccaagttcctctttcttgcctgcaaaaacaactaacccttcatttactgactccacttttgcatttgtagctgtttggacaaatacaccttggccatttttttgaaacccttgcattacctttccagaagcaggaattgcataatccttttgctgaatacttccttcttttttctcgttcggcgaatagaatacgagcggttttccaaattgcttttcataccatttcgctacagtagcaaactgaaattcctctttcatcactttttctgtaacagctttagctccattgaatgaagaaggagcattcttatataaaatagcaaccgaaagaactaatattgctgataataaaactttgaagaaaaagacttcctttcgaaataaaggatgcatttccttttctccatcttcaataaataccgcttcactatcgaaattccctccgttaaaatactgctcttcctccatcctttcttgctcggccttcctttttgcaatccgctttttaatttcttctacgcgtctattcttcatactgtctcctttctttcgttaagctaatttcattagaaacagttgtatacagtttgtacatatgtatgagctaagaaagaaagatattcgtgtgaagaaaaaagaaagcacctcgcatatgtgcgaagtgctcttaacggattccaaagaagtttttcacctttgcaaataccgataccttttcttgttcaaatgcttgtaatggtacattctcacctaacaagcgtcttgcaatattacgataagccaacgctgcttttccgcttggttgcaacgccacaggttcacctgtatttgtagctcgaataacttcatcgtcatcttcgacaacaccaagaagctcgattgacaatgtacgtacaatttcatcaacatctaacatatcctgttcatgaagcatatgactacgtacacggttaataacaagtttcggtggttcaatatcctctttttctaaaagcccaataatacgatccgcatcgcgcattgaggatacttctggagtcgtaacaacgattgctttatccgcaccagctaccgcatttttaaatccctgctcaatccccgcaggacaatcgattaatatgtaatcataatcttgacgtaatacttgtattaattcatccatttgttcaggtgttaccgctgatttatcactcgtttgtgctgcaggtaataaataaagatcatcaaaacgtttgtctttaataagagcctgaggtaaacggcaacgcccttcaacgacatcaacaagatcaaatacaatacgattttccagccccattactacgtctaaatttcgaagaccgatatctgtgtcaattaagcacactttctttccagataacgctagggccgtaccaatgttcgcagatgtagtagttttacctactccgccttttccagatgtaattactattgcctctcccacagctatacaattcccctttctaactttgttaaattaggtctgagatgagtgagaagttgcaggcgatcgacaacaatgtgattgttctcattaatatacgcacattctgccgcctccgctccgtcttctttctcttccggagcccgcattgccacatcactaattcgaagttgcatcgggttcataacagatgcagcgattacagcatccgaatccccataatacccagcatgtgcaattcctcttaatgatcctacgacaaaaatattccccccagcgataaccgttccgcctggattaacatctccaattaacaacaaatttccttttacatgtaaaacttgtccagagcgaacaattttggaaatagggacaatttctgtttcttctttccaagctattgcttctgctttagtgataacatcactttcaattgaatccacaacaagattctttttattacgaattaacgtacgaatctcttcttgttggacttctgttaaataacgatttcctactttcacatgcacttcaattaaagagcgcccatcaccatcgtagtaatgtgtagaaagtttttcgtctaattccaccaataattctgagaatgaacaacaatcatctaaatgaagcgttatcccatcttttgtcccttttatcgttacattttgttgctttttttcttccactaaagttcaccccaccgattcaattcgacataaaattagaaaatccttttttctttttcttccatcgcttttgaaagacgcactatatatcgtctcagtgggaaacaaactatcaataagaaaatagcatttaacaataaagtagaaaggagacgatctgtgaaaaagacatacgctggcatatgagtacgtcctaataaagttaagaatccatacacataatactctagtgctacaacgctagctaatatgatagaaacaacaataaataaattcaattgtagtactttcatcacactatatactaaataagctaaaatcggataagcaaaaatatatatcccgacaagttctgtgtatacggtatcaaataagaagccaaataatagtccgtaataaatcccttggaccggactataatacactgtaataaaacataagacgattataaagaaatgcggtgctgctatgctgtctttccaaaacacatccgttggaacaacagtagcaaacatattttcaaatagaaacacaaaaaggagcaaaagaggaagagctgctctttttaatatcttcatcatctcttcttctcctcctattctaatggcgctgaaggtgttgcacgtttagcaaccgtaatatgctctacgtcatttaaatcagcggcaggttttacataagctgtttttgttaagccatatgcatctggctgaacttcaacgatttttccaattacaagacctttcgggaaaatatcacccagtccagatgttacaactagttgatctttcactaccggtgcatcagagccaatctttgtgaaaagaagtaattgcttttctttgtcataaccttcaatcaatccaaagattttctcttgcccttgtacaatagcagaaacacgatttgttcggctcatagaacttagtaattctactgatgatgtaaactgagatacacttttcactcttccaactaacccttgtgaagttactacagccatatcttttttaattccttgctgtgcccctttatcaattccaattaaatcgtaccatttatctggattacgagaaacaacagtagctggaatttcagtatacccgctatttaactcttttttaccagttagctcttgtagcttcttgttatcatcttctaattgttttactttccctgatagacctgcataattatctaattttgcttttaattctttattctcttcatacgtgcgctttacatcctctacattttcgaagaatccagctacgtatttcgctggcttttggaatacacgttctacaacaccgacagtatctttaacaaactgctctggccatgttaaactgttccgttctttcaatgagattccaatcaatgccacgagaagaataatactaaccaacaaaacaattaatcttttgtttaagaaaaactgtggcacgttcacaccctcttaatttcactgatttttattttgcaatattatcgagcagcagttttgaaaagatcgatattgtctaatgctttacctgttccaattgctacgcaatctaatggatcttctgcaacaagaactggcattttcgtttcttcactaattactttatctaaattacgtagtaatgccccgccacctgttaatacgataccgcggtccataatatcagccgctaattcaggtggagttttttctaacgtatttttaactgattctacaatcgcatctactgtatcttttaatgcatctgcaatttcttctggctgaattagtactgtttttggtaaaacacttactaa

SEQ ID NO: 1255 - DNA, 10276 bp, Bacillus thuringiensis
ccattgaagagcggccgtctacatttgcattttcttgcattaaatcttgttcattgccgtggactattgtctggaacactttcattaattcttcttctccacgtgtattattttgtaccatttataaccctccaccaatatgttgttatcttttgattaaaatgttactacatatagtcttactgtttctgtgagaaatgtaacattactgtgaaatttttttcacgaaataatgaatttttcatttacaaaaaagaaatgtgctctttacaaatgtatggtacaatatgcgggaaaactcttttagccctttatcaacacatttgaataaaggagactgaccttatggttactacatatcttttatttatcgttgcctacttacttggctcgattccatttgcactagttgttggaaaaatcggctacggaatcgatattcgtgagcacgggagcggtaatctaggcggaacaaacacattccgcacattagggaaaaaagcaggttttaccgttacaattgctgacattttaaaagggacattagcaacaagtctaccaatgattttcggattagatattcatccactatggttcgggttagcggctgttcttggacatgtctatccaatcttcgcgaaattccgcggtggtaaagcagttgcaacttctgctggggtgctattatgctattcaccagttgtttttgcaatattggctgttgtatttttcacccttttatttacaacaagatacgtatcactttcttctatggtaacagcagttgttgctgttattgcatccattgttagcggggataaaatcttcattattgcgatgtgtttattagcaggtatggttatttataaacaccgtgcaaatatcggacgaattataaataaaactgaaccaaaagcaaacttttcaaaaaagcaaaaataagatcgtaacccacataacgcaaaaagaaaacgtgaagcatattaatagcgtctttttgcgttattttttatactaaagaaaaagcaacataatttggaggaactatacatgaatctttccgtaacaaaagaagcagcacaatggtataaaaatgaattaaacttacaatcaaatgaaacactacgctttttcgtacaatacggtggttgcagtactgtgcaaaaaggactttctttagggattcgtaaagatgatcctgcacatcctgctgttcaagttcaagaagaaggtattaacttctttattgaaggcgatgatgaatggttcttcgatggacataatttatctgttacacttaacgaaggtgacgacttcccacaatttaattatgaaaaataaaaaaacgtggcttctgccacgcttttttattttttcttaatttcctcatatttcgcataccactcaggatataactttttaaatgatacagggcggaacccttcttttttcgcacaaatattcgtcgtacttgcagtaatacaaagttcaccatcaccattatatatttcatatccatatacaacgcgaagtgggctcacagtatctacccatgtttttacgattgctttttctccgtaacgcatcgctttacggtatgaaatttgtaaatctaacacaggagaaataattccttctttctccatttcaacatatgaaaaacctaaatcttgtataagtttcgtgcgacctaactcaagccacactaagtagtttgaatggtaaacaacacccatttgatctgtttccgcataacggatttcaacttcatgttctgctacaaacatatgtatattcgccgttgccataaacttataaaaatctataatttttgtttatttccctgttctacgtgtccgatttcacagaagctactttcgtttgatgtaacactccgagggcgtaaattcggatacaacgaatcctacatattagccgtaacttttttagatgttaactggctaattcataccgtgacaaattgatagccgcatttaaatccctatccatttcgtgaccacaagtgcatttgtatacacggtcagaaagttttagttctttgttaatgcttccacaactggaacacatttttgaagaaggataccatgtatcagcttctacaaattcaataccatatttttcacacttgtattgaatttgtcttttgaactcatataaacactgcttcgcaatcgctttagctaggtatctattcttcagcagacctttcatatgcaacgtctccatcacaatgcgaaatggcttggttttcacaatttcgctcgtggattgatgaagatgattctttctgatatttgataaccttctatgtagttgtcgtatctctttctcgatttttataatattgcttgttttgacaaaacggtttccctccttattcatttcatatttacgagaaacttgacgttgcaacctacgaaggcgtttctctacctgtcttaccatttttgttttgttgatattgttcttcctctgcccatcagaacaatatgctaattctttgattccaatatctattcctaacgaaacagccgttaatttctcttttgtaaactcctgttcaataccgacagacaaataccaatacttaccgtcaaagctaacgcgtggattagagtacttaacccctacaggtaacttttcggatgtttttacccaaccaactttctcaatcaaaacttgtttttcttttacttttaacttgacattatcattgtaaaaagagagttttgctttccttctgcttttgaatcgtggtttatcagccagtcccttgaaaaatcgcttatatgcttcacaagcatctttaatcgcttgtttggctatattatttgaaacatcgtacaaccaagcatattcttcagactgctttaatacagttaattctttccgtaaaaaaacgtctgatatgaactttccgccattcttgtaattctcttcttgcttcgccagtgtccaattataagcccatcttgccgtaccaacagatttccaaagttgcaattcttgttctttattcggcttgattctcactttcttcgcaagcatcattttccagcaaccccttaaccatcttcttagcttattttcccttgaagatggcaactagtttgttctatcctacctgcctttttttgcaaaatcaccaattgaatatactttcatatttttcatcccatgaaactactttactccggcgacaatttttcatctacaaatattttatcactaattatatatttttgtagatatacactaactgtttcttcccttctttcacttctgctaccttgcatacatttaatcataatacagtgacatcaaaaataaaataaaaatagtgaatcttttcccgaaaggagcaagcatatgattcaaattgtaacggttcgtagcggtgatagcgtatatagcttggcatcaaaatatggatcaacacctgacgaaatagtaaaagacaatggactaaatcccgctgaaacgctcgttgttggtcaggcacttatcgttaatacgaaaggaaataattattatgtacagcctggtgacagcctctatcggatttctcaaacatataatgtccccctcgctagtttagctaaagttaataatttatctttaaaatctattctccatgtcggacaacaattatatgtaccaaaaggcacaaaacgagctgtagaatccatcgcttatttacaaccttccactataccgattaaagagagtttagttaatgctacacgtgccatcaatccatttttaacatatttagcttattttagttttgaggcaaaaagagatggcacattaaaagaacctactgaaacagctaaaattgctaatattgcaacgcaagggcaaacaatccctatgctcgttattacaaatattgaaaatggtaatttcagtgccgatctaacatcggttattttacgcgacgcaacgattcaaaacaaatttattactaacattttgcaaacagctgaaaaatatggcatgcgagacattcatttcgatttcgagagtgtagcacccgaagaccgcgaggcgtataatcgctttttacgaaatgtaaaaacacgcttacctagcgggtacacattaagcacaactctcgtaccgaaaacaagttcaaatcaaaagggaaaatttttcgaagcccatgattataaagcgcaagggcaaattgttgatttcgtcgtcattatgacatatgactggggttggcagggcgggccaccaatggcaatctctcctatcggtcctgtaaaagaagtacttcaatacgcaaaatctcaaatgcctccccaaaaaattatgatggggcaaaacttatacggattcgattggaaacttccgttcaaacaagggaatccaccagcaaaagcagttagctctgtcgcagctgttgcacttgctcgtaaatataatgttcctatccgctatgatttcacagctcaagctccacattttaattactttgacgaaaatggcgtacaacatgaagtttggtttgaagatgcgaggtctattcaaagtaaattcaatttaatgaaagagcagggcattggcggtattagttattggaagattggcttgccatttccacaaaattggcgtttacttgttgaaaactttacgattacgaaaaagggctgacaaaagtcagccctttttgtacattttgttaagattcatctttgatttcactttttaatgagtcaatactttctaaacgtctttgattttttgcttcaatagcagcacgatctttttcattagaaagttccgctgtttcttttgcttcattaaagttatcaactgtattttgcaccatttcttgtaacttttcagcgttgtcacttcgattatctggatttggcatgtacttccctcctaatattgtatatacacaccatcttaaattacctatctttcctcaaatttatacataaaaaaggagaatgtaatattctccttttctttaaccattatcaacaatcggttgtttacctgtttgatcttgcatttgctttcctttatttccaccagctttttttgattgtgttccaatatgattcggtgcaaaatcttttgaattttttttcggattacccattactatcgcctccttaatactagtatcgtactagtgttaagaattattcagcttgcttaaaaagtttcatttcataacgtttttcaatgcgctcttcaatgcgatcaattgcctcacgatcgcttaataattgttgtttattttcatttacaagttcttcaaacgatttacggcgacttcttctcatgttgttcaccctctctccttcgctttcttattacatagtatgagcaaacaaaaaactctttaatcagatttgcaagaaaattttatgttttagtactcctaaaaaaactccgtgtacaatatattgcacacggagttttttataccataatatttaaatactctttcaacttttcatctgcattcatttcattttctttataatcatgaagcgcctgtaatacaaaatcatactgctctaaaatataactttctaatttcataacatcctctaagctattaagcataattctcgtattaccagcttcactttttaacgccggttcacattttaaacttgtacatatttctttcacatcttcttctaatatctctgttaatacatatttctttcgcccttttacctttaatctcataactggataaaaagcttttatatctaaataacttcctacgttcatacaacgtagccattctacattacgtttattacatgcaagtatttctttcaccgcttcatataccgcagtttcatcaagcatagccttatttacttttcgtttcccttcttcttcaatagctgcacacttttgataaacagcagcacacgtaatgcaatcgtcaaatgcattatgagagcttaaacgaattccaagcattcgttttaacgtttcaagtttatgattaggcgcatgcttcatgtatttctttgctaaaaatacagtatcaattactttatttttaggttcaggcaacccaagcatatttacattacttttcaaaaagcgcatatcaaaagaagcattatgggccacaataacatttgtatgtaaaaatgctaaaaataaaggtaacacttcttcaatcgtcggtgcatctgaaacgcgataattagtaatacctgttaaactcgttattcggtccggaattggccgctctggattcacgtatgaaacaaattgatctactaattcatgattacgatatttcactgctgcaacttgaataattttatcattataagggttaaatcctgttgtttcaaaatcaattacaacataatctaacggtaaggatacattccccacttcatacactcctttatctctaaacggttatatttcttacatcatatcatgaagtgattactacttgaaaaagaaaaggcagaaatgggaactctccatctctaccttttcaccattattttaatttagcaactcttttctccatctctttttgtgtcatcggcccaataaacttatcttgaatgacaccttttgtatctataaaatacgaagttggaatcgtaattactttataagctgttgtcacatcaatgttcttgtccaataaaataggaaaagtaattcctttttctttagcaaaattgcttaccttctcttcccccccacctttttctgaaggcgtataattgaccgctaaaatttctacgttctctttatgttctttatagaaagcctccatatcaggcatttcttgctgacatggtccacaccacgtagcccaaaagtttaaaattactttctttccttttaaatccgataactttacatttgtcccatctaacttcgttaatgtaaagtccggtgcactcttccctatctcaataccattccttgcgataatctctttcatcgcagcttcacttttttcttgcttcacttttaccgcctgctctttataaccaaactgttcataagctgcatatcccgctaaacaaagtaacactacaataatcgtaagcttccgccacattttatatcaccctaacgtattatcttcttttaacacattcatcaaaatactatataccttattttagcttatacggacaagcttggaaatattcacattctaaataatcagaatttttataactaagatgaaatatttaccttttaatcatataattagaaatacatagaacattttacaatgaaaggagctctcatgaatttatttaaaaaaatacttctatatattcttagttttatattttccccaatcggaattatcacatggattatctcactatttagtaaagatcctgaaaaaaaacagttggacatatttgtctctatatcgcattaatctcatttatccttttggcaggcctcggcattattacttttttcacgatgactaccattactactatagaatagctatagaaaggatgattgttttgggagaacaccctatcaccaaagagctacgctatatacgaatatgcttagttattttagtaatcgttcttttatttttcaacagtgaaaaagtcgttgaaatttctacaaatcatgattccatagaaaatgttcccaccagtaatatgacacaaatcgcggaaaatacattcgctattcaagaatataatccattactaagtagcgaacatacaattaagattttcaaatataatccagatacaaatcaacttactctcgtcaaagaagttaattctagtgattcgaattcttatacttatcaacttaatgagaccgaataaagtgaaactttaatcagccctcaccaatcgggctgcccggcaaatagcggaataaagataagagcattacatatctcttatctttttgtttgcaactctttgtacaatgagttgcaatttaataattctctaggattcccacattccacaatagtcccattctttatgacaacaacacaatctgctatcatcgctctctctacatcatgtgttgccacaattctcgttacatctcttcctatcccttcaatcatattccaaaccagttcttgattgcccggatctaacccagccgtcggttcatctaaaataataagagttggatttgatacaatcgcgcgcaataatgcaagacgttttctttcgcctcccgaaaactcttcaccgcttttatgtagcacagtttgactcccttcaggtaaccctctaataatcggcgttgcatttataagttcactatttttttctaactgattttctaaaccctcttccccgaaatacatattctctgttaccgtcgttcggaaaaaacgtggttcttgccacactgtagtcatacgagcttcattaccataataagcaatgctaccgttagatggtttatacaagcccgttattaactttaaaagcgttgtttttcctgcaccgctttctcccacaatcataacgagttcaccaggacgaatttgcaaatcaatattatgaattctgcatttctcttcgtcattctcctgaaatgaaacatttgttatcctgatccccatcgctctttctacattgctatctgctgctcgtttatttaaaaagcaaaaagctctatttgccgaagcgactgcaacttgtgtcattattaataaatcgcccacataacggacagggaaaaagagcatctcaattgtcgctaacactgcaatgagtgaaccaacttctatttctcccctcattattttttgtgcacctataatgagaacaacaatatatgctcctgtttcaatcaccgttccaactactccaatgcaatgttgcatcatcgtcttctttacttctgatttatacgattgtgccgttacttctttaaataagcgaattgcccatttttctttttgtaaactccgcaaatcttgtatcccctttacaaactgtgacaccatctctacaacacttgagtgatttttttgagaaacgcttgcaatatctcttaccttttctcccatcagtattggaacaattgtacttaaaaataaaaacggagttacccacaatataaactgtatatctatatgttgtagtgctatgaaagctccaataaattgggcaatagcgtgtatatattctattaatatagagccatataatctgacccagttcggaatatcagacacgaccaaagtttctaactctccttgcttaatcttctcactctcttcaaacggtaatgagaaatagtgacgcaataattctatacgtttcgtttgtaatatacgttgactcgcttttgaacttatataatcaaataaaagattgttcgcccacattaaaaagtgactacccgcaaacaaagctatatatacatacgcaccttttagctccctttgaataagattgtctacaattaatcccatgaaaattgggcgggataaatttaaaatggcagcaattatcccactacatacagctgctattactaatattttttctttctgtaacggtaacaaaattcttttatattctttcatgacgtttcctccatttttcgtagtaaaaaagaaagggatgaaaccatatggtttcatccctttccataaaataaggaagctaactattgttagcttccttattattcatttcaattatttagttcgacactttagactcttcaattttctcacgaagaaccatttgcagaataccaccgtgacggtagtagtcaatttctacttcactatcgaaacgagctactacttcaaattgtttttcattgccatctgcatcagttgcaactactttcacaagatcgcgtggtctaactgttttgtcgatttgaatttcaaatgactcgttaccaacaagacctaacgtttcagcactttcgccatctttaaattgaagtggtagtacacccattaacactaagttactgcggtgaatacgctcaaagctttctgcaattactgctttaatacctagtaagtttgttcctttcgcagcccagtcacgagaacttcccataccgtaatctttaccagcaacaactagaagacctgtgccatcttctttatatttcatagcagcatcatagatagatgttacttcaccagttggccaatatgttgtatatccgtcttctgttcctggtgcgacttggtttttaatacggatgtttgcgaatgtaccacgcattataacttcatggt

SEQ ID NO: 1256 - DNA, 8987 bp, Bacillus thuringiensis
  unsure (1)...(8987): unsure at all n locations
ggtagttagcaatatttgcaattatgtggttaattattatgagtacccatagaaataccatttcagatcacgcaataagtaaaacattaactggcgttgagactggcgaaataaaaccatttcaaattgttttgactccatctattatgggtactctttcacttgttttagtcagttttataataacagctattactatctaccctatttcctataaaaaaagcactcgtgaattatcacgagtgcttttttactatgcacgagaaacgtatttaccttcaccagtgttgatgataagcatttcgccttcgttaatgaagattggtacttgtacaacaagaccagtttctaatgtagctggttttgttacgttagaagcagtatcacctttaataccaggctctgtttctgtaacttgtaattcaactgtgtttggaagttcaacaccaagtacttcgccttggtaagtcatgattgctacttccatgttttcttttaggaatttaagctcgcgctcgatttgtttttcaccaagttcgatttgctcataagttccgttatccataaatacgtgagcctcaccgcttgcgtataagtattgcatacgacggttttcgatgtgtgctttttctactttctcacctgcacggaatgttttctcttgaacagaacctgtgcgaagattacgtagtttagaacgaacgaatgcagcacctttacctggctttacgtgttggaaatcaagtacttgccaaagggcattgtccactgaaattgttaaacctgtacgaaaatcgtttactgaaatcatgtaaaaaaatcctcctgtgtattacaaaataataagttcttttggtgatttcgtaattacttcattaccttcacttgtcacaatgatatcatcttcaatacgtacgccgccaatacctggaatatatatacctggttctactgttacagccatacctggttcaagtactgtatgagaacggaacgctaaacctggtgcttcatggatttcaagacctattccatgaccagtagagtgtccaaagtattcaccatatcctttttccgttatgtagtcacgcgttagcgcatcagcctcgcgacctgttaaaccagctttaataccgttcacaccacgtagttgtgcttctaaaacgatattataaatttcttttaatttatcagatggttcaccgactgcaatcgtacgagtaatatcagagcaatatcctttgtaataagcgccgaagtctaatgtaacgaaatctcctgtttctatcactttttcagatgccacgccgtgcggtaatgccgaacgaagacctgaagcaacgataatatcaaacgaagaagatgttgctccttgttttctcatgaaaaattcaagttcatttgacacttcaatttcagatactcccgggcgaatgaatgatagaatatgctcaaaggcagcatctgcaatctgtgcagcttcctttaatatcttaatctctgaatcagtctttatcaagcgtaacttttctacaagtccagaagtcgggataaattcagcatcaatcgcttccttatgcactgaataagaactatatgtaagagtatcttgctcaaaaccaagcttttgaattccaagctctttcacttgctttgccacttcatcaatgatcaatcctgcgtgctgtacaacctcatatccaaccgcttgtttacttgcctgctcgacgtaacggaaatctgtaataaattgagcacgatcttttgaaataagaacaacgcctgctgttcctgtgaagttagccatatatctacgactatgttcatttgttaacaaaataccgtcaataccagcctcatcaaatgcacttcgtaatctttcaattttctccattactttatgcctccctcaatttctccattaatgcaaataacgctaacttatagccataaaaaccaaatcctacaatttgacctgcacaaacagctgccgtcacagattcatgacggaacgattcacgctgatgaatgttagaaatatgtacttcaataacaggaatcgaaatgctcgcaatggcatcacgaatcgcatagctataatgcgtaaatgctcccggatttaaaatgatcccttcatatatatcttccgcttcatgaataatgtcgataatggcaccttcatgattcgattggaaacattctaactccactcccattgtttctgcttcttgcttcatatctgcttcaagtgtcgttagcgtgccctttccatatacatttacctcacgaacaccgaggcgatttaggttaggaccgtttacgaggagtaactttttcatattcttaaaactccttaatattaaatatctatacaatattttaacataggagttacttatttgaatagttcgtcttctcttacccttcttgttctgctttattgctatttactgcgtaagaaacagaatatgctataaacacaccatacaatataaaaatacatattgtcgtcacaattgtctcttttggtaaatggagcgcacttttaataacaggagccattaaacccatccccaaaaacagtagtgcccaccaaaatagcccataaataattcccgctataatcccttcaaactttgcaaaaaatgctttatacaaaaaggcaatcaaaattgaaagaagtcccatacacactattccgaacacattgccccatacaccctctttccaacttccaaacgcaaatggtaaaaggaaataattcgggcccgcctccgtgaatgaaaatatatgaaggaaataccataccccgccccaaaagattccaccaaacaaaccaatctgcacaaaattccttgttcctaattgttcttgactcacatcgacacctccgctcaatagtatgcccgaaactattttgaagcatgtttaaatcctgcgaaatttgtctataaaaagaataagaaatgtccgactctcataacattttcccttgtcatctacttgtatttgccgataaaataaaggaaactcggtgattgtcttatttcaaaacgacagaacccagtatgacaattgcctctttttctacataagagagaaacaaatacaggttggtgttaacatggcagaagagtcaaaacaaatatatggcgggcaagcggtcatagaaggagttatgtttggcggtagagaatatactgttacagcggttcgtcgtaaagataaatcgattgaattttatcgattaccacgcgttcgtaataaagtactatctaccctaaaaaaaattccatttttacgagggattgccgctattgtggatgcaagtgcgaatggagcaaagcatttaaacttcgcttcagaacgatttgacgtccacccagaagatgatgaacaaattgcaaataaaaaagaagaacaatcaaaattaacgatggtattaggagttgcagctgttggcgttttatcttttatattcggtaaagtcattttcacagcagttcctgcactattagctgaattaacaagaccgattttcccgtctcatactgggcaaatcattgtcgaaagtgtcattaagctcatgctattattgagctatatatactttatttctttaaccccacttattaagcgggtatttcagtatcacggtgcagagcataaggtaatcaatgcttacgagaataaccttcctctgactgtagaaaacgttcaaaagcaaactcgtctccattatagatgtggcagtagctttattatatttacagtcattattggaatgttcgtttatttcctagtccctacagatcctctttgggcacgagttataaaccgaattttattaattccagttgtacttggtatttcttttgaagtactacaattcacaaatcgattacgagatattcccgtattacgcgtacttggatatcctggattatggctacaactattaacaacgaaagaaccaacagatgatcaagtggaagtagcaattgcatcgtttgaagaattattacgtttagagaacaaacaataattatttaaaaatggtgttcaactcctttcctcatcgttaatatactaattttaatatacgtttttaggaggtgtcccttatgaacggtcgttcgtttactttcgctatatttgtgcttattatcggattggcaatattcggccttgtttcatctgttattacaaatcccatgggtgtattaagaaatatcgggtacatgttacttgttgttggtatcttttacttgctatacaagatgtttacaaattccagtggttctgcaaattcacaaagctcatataagcgtgcggcaaaacaatcgaaccgcaaacatgggaaacaaaatgtagcacccctaggcaattctttctttaagtcaaatacttctaatgacaaaagtaaaaaagggaattcttccactttgaaacgaaaaagaaaacagtctcatttaactgtcattgaaggcaaaaaaagcaaaaagaaagaccgtgcttccttttaggaaatacggtctttttttatactttgaagcacttcttttaaacttttctctctcatactttcaattcgaagatgatgattttcaaatggtaaattccgtgtcacatcattaggtacaacaacgcacgttaatcccgctgcaactgctgctctcaatccatttaatgaatcttcaaatacaacagcttcagacggcttaattcctaattcttctattgcaactcgataaagagctggatctggttttaccttctcaacatcttctctcgttttaatcacttcaaaatattctcgaatctgtagctcttctaaaaaatgaataacccattctctagacgaactagaagccagtgcgattttcaatcccatttctttcgcttcttctaaatattcttttaccccgtcacgagcttctggtattctcattttctctttatgtaaagttgccactttttcttttaatgcatttttgttaaacttctcttttaattgatcatttaaatatgtataaagtacctcatctgttgttccaatacatttcgcaaattcctctaaaggtagttccccgccgtattcacgaacagcatctctgaaagagtgaaaccatatcgtttctgtgtccacaattaatccatcaaaatcaaaaataattgctttcataattctcccatccttttcgaattgaaataaaaaaggaaacgccatacgttccccttaattacttttctcttcatttgctctttgaacaccacgaagtgtttccactcggactgcatcttgttcaaagtattccactaaatcaccaatgcgatcaattgcttcccaacttaaatgatgttcaattccttctacatcattgtaaattttactttcatccacaccgataatacgcataaattgctctagcaagtcatgacgatatacgagacgttctccgatttttttaccttttgttgttaatacaagccctctatatttttcataaattagatattcatctttgtctaatttttgcaccatttttgttacagaggatggatgtacactaagcgattcagcaatatcagatacgcgggcgtaacccttttcatcaatcaacaaataaatttgttcaatataatcttccatactaggggtaggcatcggtttcctccatccaagttcattttgcttattccgtacgaagcaatcaataaaatgatacaccagaaagaataacgtgacaagttgaaaacgagcctaaatatataaaacaaaaaagaatctgtatttgcatacagaccgcccttaagtaaaatattgtatttctgcattaggaaaaaactcatttatataacctcttatcgtttcttccaatactgctgcatcatcctttttatatacatattttccgatggttttggaaaacgatgctgaatcaattcaaacgttaaatttggtattgtcatatctttgtcgctcaaatagtttacggttccttcttcccattcttcatgcatttaaattggcgcaactataaaatcaagtggatattcaagtgcctttcgttcaaagtaaacgagctttggcataaatggtctcatatgcttttcgccctctcgttagtatgggggacattaaagttttccccccagtaacttgcgttgcaagttactgggggttataatttggataacagctaccttgcaacgcaagttacctgagtaaaaggtggtgaaatcatgcacagccaaatgttaaaaggtgtactagaaggttgcatcctatacatcatttcacaagaagaagtgtacggatatgaactgagcacaaaattaaataaacatggctttacattcgtaagcgaaggaagcatctatccgttattattacgtatgcaaaaagaaaaattgatcgaaggcacattaaaagcttcctcactcggtccgaagcgaaaatattatcacgtaaccgataaaggattagaacagcttgaagaatttaaacaaagctgggggatggtttcaacgaccgtaaacaatttattacaaggagagtgatggggatgaaggcgaaagatttaatcgaattaaataaccaaaagcgtaaattattaactacagaaaatgaaatcgcctatagtgacatgttaatatacatccgcttagctaaagtgccagaataccacgcagaagaactgctaattgaaattctagatcaccttattgaagcccagcaagaagaaaaaaatgcttatgatatttttggagacgacttacaggcgtactgtgacgagttaattgccgccctaccgaagcaaagtttatgggaacaattatcaattcctttatttataacttgttacctgctagcaatatactttgctatttcgtccgtaattgcatttgtattacccttatttgcagataaagcacgttttaaatttgtacacattgatttcatttatctgcttgtatttacattatccgtacatcttatgatacgttttgtcttcgattttattaacactgatttatttaaaaataaaacaactatttggaggcatataggaagctttttaatacgtcatagcctatggatgctattaatcggtatttcctttttatttataaaaaatccctatactacattacaagtttcaccttggaccggtactttgcttgccatctctggctatgtactatataaacttttcttcaaaaaagaatacttggactttaaaaaggagtgacgaggtcatgactgaaaaagaaatggttcagttaaacaataaaaaaagaaagttattaacacctgaaaacgaagctgcttatggtgatatgcttatttatttacgccttactagcgttccacaaaaacaaatggaagaattacttttagaaatattggatcatcttttagaagcgcaagaagacggtaaaactgcgcatgatattttcggagaggatttaaaagcttactgcgatgaataaattaactcttcggaacatcaaaattcttttcaacaagctgccgttattgggtttgcagttagtttattattagctgttcaaattggatacgatacattcactactcttatgcaaaaactattttcaaatacaaacacttcaggaattccatttagtattcccggaacaatattatctgctattgttttaacaattggtgctttcataactttttctttatttagacgtttctcttttacaatattagtttcctggaaacaaaaagcacttctcttattatcggtatttataccttttgtcttatcagtttttgcaaacgtatttttcaaaacaaaaccatacttattttataacttgtctattttgcaaggtgctcttattacactttctttttatattttgtacaaatttttatataaaacatctaaattttaacagcccttcaaaaggctgttttttcttctgtctaattttacaaattgaaaaatttcataaagaaaataagaaaaatgcaaaataattaaagttaattgttgacgtgatgcttttattatcggtatcataaatcttcgtgagcaattatttttcgttatacgatttttttattattactgaatttttgagaggagaaattagatgtcagttaaaaagaaaacgcaaantcgcacccgcaaaatggtacgtgaactaatgttagcagacgaaaatgtaaatgcttcgctaattatggtatatagtgaaaacggtgtaaacgcagaaattaaaatcgagggcttaacgccgaaatgtaacgaagaattatttttgagcggaaacgtggattggaacaagagtgttatttataaaattgttgatttcactggaaacgctgaagttggtaaagttacattaacagcgatgaacaaaaacaatgtttctctagaaattgaacgcgttatgtggagtaaagaaaataaagaagctgccgagcaagaagaaacacaggtagaagcagcaccgaaaaaagaagtagttgtagaagctccaaaagcaattacgcctgctcctaagcctgttacgcgtgtggaaacacctgctatggcacctaagcctactccggtaccgacaccgaagccagtaagcgtagaagcagctgtagaactagttactccagcgcctgtaaaaaaagcagtccctactccagttacaaagcaagagacagcaccggttgctcctgcaaaaccgaagcagcctgctttgactgaaacaaattcaaaactacaagaaaattatgttaaactcgtgaaaaagacaattgaagtttgtcaagattacgagcttggcatcgacatagatgattctattgaaagcttaaaagaagaactacaaagccaaggtattagcgttacatttgacaaagaaattatggacgttgtaagtcgccttcgttctttacaagataaaggaatcaaagtagaaaaagtacttaatttactataaaaaaataagag

SEQ ID NO: 1257 - DNA, 9134 bp, Bacillus thuringiensis
tatattgtatttttatctcctaattgtttattaggagattttattataaaaaaatgatttcctcttagagttcactatcattgacagtacaatcgattatcttataaaatgagtgacagtcattcaatatgcgtgtgaaagggtttagatgatgaataaaaaagagaaaattgtctatgcagctattgaagtgtttcaggaaaagggcgtcgaaaaaacgaagatttctgatatcgtgaaattagctggcattgcgcaaggaactttctatttatattttccttctaagttatctgttatgcctgcaatagcagaagtgatggttgaaaagatgatacttgcagtgaaagaaaaagtgcaaaacgatgcgcctttctcaagtaaagtaacgcaagtaatagatgcggtgtttcactttatagctgaatatcgtgaaatacaggctttaatgtatgctggtcttgcatctacagaacatataaaagaatgggaagctgtgtatgagcccctttatatgtggctaagtgaatttttaaatgaggcaaaagaagctggtgaaattcgtgattcagttcacgcagagcgaacagcgaagttatttatcgctctagttgaatcagcagcggaacaagtgtatttatatgatcataaagatgatgagcaagtcgatttgcaaaaggcagaagtactagattttttaacacatgcactacatataaagaaatagtgagatgaacctgtctgaaaaggtaggttcatttttgaggaaaactgaatgatagtcattcatctaatgcgtatgtatgtgtggaaggatagtgtgaaattctaacgagtaggggggcatctctactcatgaatagcccacaaatagaaggataaagaaaaagcttcttgggcattattttttgagaggaacttacgggaagaggtgttaaaaagtgaagaaaccgataaaagaacaaaagatggtattggtcattcttttgagtaatatatttatcgcttttttagggattggattaatcattccggttatgccgtcctttatgaatgatatgcatttaccagggaagacgatgggatatctcgttgcagtgtttgcaatggcacagctcattacttcacctattacaggccggtgggttgatctttacggtagaaagaaaatgataatcattggattatttatttttggtgtttcagagcttctttttggattaggaaaagatgtatggatgctttatgtagcaagggtattaggcggaattagtgctgcgtttattatgcctggtgttacggcatatgttgcggatattacatctattcaggaacgtccaaaggcgatgggatacttatctgcggctattagtactggattcattatagggcctggaatcggcggatttattgcagaatacggtatacgtgtgccgtttttcgttgcagcagtaattgcttttatagcatgtgtgatttcgatctttattttaaaagaaccgttaacgaaagaagaacttgcagagatttcttctaatacgaaggaatcaagttttattggtgatttaaagaaatcattacatccaatgtatgcaattgcatttattatcgtatttgtactcgcattcggattatcagcgtatgaaacagtgtttagcttgttctctgatcataaatttggcttctcgccgaaagatatcgcagcaattattacaattagttcaatctttggggtagttgtgcaagtatttatgtttggcaaattggtagaaatgttcggtgagaaagtgttaattcaaatatgtttaattgtaggtgcagtattagcattcgtctcaactgtagtctttaattattggattgtacttctcgttacttgcttcattttcttagcatttgatttacttcgtccagctttaacgacatttttatcaaaagcagccggaaaagagcaaggattcgtcgctggtatgaactcgacttatacgagtttaggaaatatcgcaggaccagcgatgggcggaatattatttgatatgaatattcattatccatatgcattttcaggcgttgttttaatagttggtctcggcattacatttatgtggagagagaaacagttggctgaaagttttgcgaagtaataaaaccccttacgacggtaaggggtttttgttttattctgattaaagtttcattttataaacttaacccaaaccgttttaattcaataaaaatcccctctaattgctttcctttatccgttaatgtgtactctacacgaggcggaacttctggatatacttttctcgttataatgccttgagactctaattcttttagtcgaagcgataatgtttttggactaataccatccattgatttttgtaaatcactaaagcgtaatgttccttcgataagaagatcacgaatgattaaaaacgtccattttgtactaattacatcaagcgttttagcgataggacaaggtatgcccggtaaacctttcgttaattcaactggatttatatcgttcatggaactagcctccataaaatttttttggatgaatttgctttatagtatcacaaaactatacttttggtaactatatgaaaaaaatatcactacttccataaaggaagttagtgcatatacaatagcaatacgaaacaaaaaggatttatataaggaggtggtgatttccatggggataaaaaagttatttggatttcttagtttgtttgttatttgtattgtgcttgtagcatgtggtgtggaacaaaaaactgaagttcagttattaaaagaaatgccaaagccaaaagcaatgacaattgatccctcactaagtaaaaaagaagcgaccgaaatggttcatgcggcgcagcgtttttatgcattttgggatacaggtaaggaggaacttattccgcagactgttactaaagatttcttcgataatacattgccgaaagggcgaacacaaggcattgaaggattaaagtttgcagcgcaaaattttcgtaaagttgtgcctgatatacattgtgagattgaagacttattagttgttggtgataaagtaacagcccgtctttcttttacaggaacgcataatggtaagaaaattaatttttttgcaattgatattttacatgtgaaagacggaaagataacagaagattggcatttagaagataatcttacactacagcagcaactcggcttaatagctgaagagtagatcatataggggagagaaaaacgatgaaaaatatatttattataaatggacatgaaaaatacggtacaaaggaaggacgattaaataaaacgttagtagattatatggttactgtattagacgagaatcatcatgtgaaaacaacaacgattcaagatggttacaatattaaagaagaacaagataagtttttatgggctgatgttgtgatttatcaaacaccaatttactggtttagtgttccaggcttatttaaaacgtatatggatgaagtatatgaatacggtttgttctttaaaggtgcagatgaatatggaacaggtggtttattaaaagagaaagagtatatgttctctacaacttggaatgcacctgaaaaagcatttggagataagacaaagttctttgaaggagaaagtttagaatcagcgcttagtcatttacatcgcgtgcaaaagtttctcggtatgagtccgttaaagagttttgcttgttatgatgtggtgaagaatccggatatagagaagtttttagtgaacttgaaagatcacttagatggagtaattaaataatagtatgtgaagaaggtactgttaaggatgtagtaccttctccttttataatgactcacattttaagacatggatggctgtatccataacttcgcaaaatttgcccaaccgaatgaatcaattgttacgttttttaaagaagaggggtatgtttttctttttagaacgtgatagttaaataaaatgatgtgttctgcttgtaaaaactcttcaatctcatacatgagttcatagcgcttttctttattttcttctagtaaaaatgtatctagtaaacagttaatttgtttttcgtagtgcgggtccatgaaccgatttacgaagcaacttttatttttaaatacatttaagaatgcaatttcatgattggcagcaaatacttctcccatgaaaataatatcagcatgtttatcaatagagcgattcatataatctgaaacgggaaatgggtgaagctctacttgtatacctaaactttcacatcgttcttttaagaaatatgcgtcatttgcactatctttaaatgcgaagaagtaaatatgtatcgtttctccattatatgtactctttttcaaatactcttttgccttttctaaagagtaggatcttcttgttgcaaggcggcttctatcagggaaaaagcttgatgcagcaattgtccgtctaccctctatgttacgaagtatcatttcaacatcatatagttctctccaagcttttcgaaagtaaatgtcgtgatgaggaccaggttttttaaagttgaagctagcataaatacaacctatttcttctatttgtatatcatgcctttcattttcctcttcgtttggtagttcataatcagcatctatttgcacatggtcaggaataccccaaaattcaatacggtctaataacgcgcgctctttaaaataatgggtgaacgcttcgagtatgatattatcttcagagtaatgagcaagtttgaaaggtccagtacctatataatgatgattttgaatactcgtatcacgcggtaaaattgcgagctgcattgaacttacatagtgtaagaaaaataaatttggtttcgctaaatggaatcgaatttgtagtggtgatggcgtttcaatttgaacgatttcttctgttaaccattcgaaaggagagtaaacttcttttagtctttcaaatgaaaattgtacatctttagaagttaaaactgtttcgttatgaaaatatacatcctttcgtaaataaaaagtccacgtaagcccgtcttcacttaattcccacgtatgcgcaatgtgaggctccattttttcagtaacatcgttatagacgactaatgtatcaaaaatttgactcgtaagatggctctctgtagttacagccacaaaagccggatctaatgggaatatctttctcgatataggaatctttaatacgtcgtacatatcatttgaaggttcgtatccaaaatgatgatgtagtttattttctatctttttttgaagtgcgagggggaggggttcttttaaaagaagaaagatatcttttaatttttcttgcgctaacagttcatctgtataggactcaatcgcttctacgaaattatgtataaatagaatttccgtttttttccccggcctcgccctggagtccagctaattaattgctcctcgctcattttctttaataaaatctttacgtttttcgtactgcaatataaaacatccgctaattcttgtaagctatttcgcatatgttgttgatcttgtgcatgtagtcttagtctaatgtaatagtccataattttcatatatacacttccttctatcataaaaggggaaactctttagaatattctaacctttttcttcctttttttcaaagtaaaataagtaagcataaggaggggaaacaatgggattttggagtatgcatcgaaatataaaaattagaattataacatcgtttttaacacgtactgtgtccacgatgatttttccatttatggcgatttatttttccataaagttaggtagtgcgattgctggtgcgttactacttattaatgtcatagcttcattagtaattggtttatacggtggatatgttggagaccggcttgggcgtaaaaaggttatgattatcggtcaaagtatacaagtcatttccattgcttgtatgggagttgcgaattcggattacgttgactcaccgtggttaacatttatctttatgctagtgaatagtttagggtctggacttatgaatcctgcgacagaggcgatgttaattgatgtgagtacacctgaaaatcgaaaagtgatgtacagcattaattactgggctattaacttatccattgcaattggagcgatatttggtggattactatttgaaaactatagattacaattgtttatcgtattaactcttgttgcgattattactctatatgtaatggcagtatatatggaagaggtgtatgtggctagaaaaacagtagagaagaaaaatgtattaaaagatatggcggatagttataaagttgtaatgaaagatagagcttttttaattttttgtgcagcaagtatatgtacattgtctttagagtttcaaattaataattatttaggtgttcgcttgcagaaggaatttgaaacggtgcactttttattcgggaatggttttacgtttgatttaacagggattcgcatgttgagctggatttctgcagagaatacaattttagttgtgttatgttcagcacttcttattaaaatgctgaaaagcttcaacgatttgaaaatcttatatgtaggcttatttatttacacgattggatttgcaatactcggaacgagcaatagcttatggattttattaattgcagggcttttccaaacggtaggcgagatgatgtatgtgccagtgcgtcaatctattatggcagatatggtgccaaatgaggcgagaggttcatatatggcgattaacggaatggtctttcaagttgcaaaaatgaacggggcattaggtgttatgctaggttcatttattgcatcttggggcatgagtgctctgtactttatcgttggtatgagcagtattttactatttatgaaggcgatagggagagagaagtatgagggggaggtttctcagattggataaaacgatatgaaaagcgatgctagaaatcgcttttcatatggcttttaaaacggatcaacttcagctaaatcaggattgctatttgggtttgttaataagactttcagctcacctacttcagagagcgcaacgaggatataaccactaataaggacgacgagtccgatgacccttaatgtttgcagtgtaatatcacggctattgttttcggagttgtcttggggcgttgaaggtggattgttattcataaatagggctcccatcttttgtatttatatatgtgcgaaatcattatttaacttatggataggaattatatagtcattttcactatatgagaaatgcctatgaaaagtgataaggaatttttgggcgagaaaaggggggaatccaaaagattattaaaactgaacttttggattcccctctttttatttatcttgctatttgtggtggtcggatttcctgtaaacgaccagttgatgagggctaatgaatcagtgggggatgaataaaaccccactgattcattattttcatgtaaatacaaggttagttaaccaaattagttatcctaatatacgcaacgattcttcaataaacgctgggatgtcctctggctgtctacttgttactagctgattttgacatacgacaacctctttgtcatgaaagttcccgccggcatttttcaaatcgacttcaatagatttatatccagttacatcgcgtccttcaagtgtttgtgcagtaatgagtagctgaggtccgtgacaaatagcaaaaacaggtttttccgcatccataaatgctttactaaagcgaacaaaacgttcatcggcacgaagtatatctggagaaaatccacccggtatgaagagggcatcaaagttctctggagaaacatcatcaatacttttatcaatcacgacttcactttttccttgcttaccgtgtaccgttttccctttttccatttcaatagttgtgaattcatatcccttttgtttaaaagcttctactggctctgtgtattctgtatcctcgaaataatccgttattaaaatagcaatttttttactcattctaatccgctccttatattatattatcggctccagaatcttccttgggcaatgccttctataaatgattcaattgaagtatttgttaagttgtaaactcctgctccatccagtttaatcttactatggtccaaagcatgaggattactaaggacatgagctatcggtttaaaatgtttaaaagtagtttctgcaaattctaaaacagggggttgaatgacagactcactactaaacactaatactgcatcaaaaagggaggagtctgttgttgtataagtgtcagttactttaatggaatcattgaactgataaattttattatctatgatactatagttaatttggtgttgtacaaaagcttgaatccattcggacagaagtgagacgcttgggtcaccatttaatagaattgcaacatttttggaatcagatttaaaaatagtattggacatacttagtgcaggtgattttgcatctgaatttacttcgtgattttccttaggtaaaggagctccaataatgttagcgacttcttgtgctaattgacgatcgacgtggtttaagagagcaattacatttgccttcaccatgtctgatttacacttcccaacttcaaagcaaaaagcttcttttatgtgctgcttttcaatagggctcatactattgtagaaaagtttagcctgagaataaaagttaagaaagcttttactgcgacctctaattttatgcccatcaatcttttcttgataatgttcatatcctccttgttcggcttggacggttgcaggttgattgttatttaatccattaggatgatagcttgtttgaccgcgatgaatctgcatttgatgcataccatcacgttgattattatgaaaaggacatacaggctgattaatagggatttgatggaaattagggccccctaaacgagataattgtgtatctgtataggagaataatcttccttgcagaagagggtcatttgaaaaatcaatacctggtacgacatgaccagggtgaaaagctacctgctctgtttcagcaaaaaagttatcaacattt

SEQ ID NO: 1258 - DNA, 9821 bp, Bacillus thuringiensis
acgatatgacccagaattccgcgattccaactgtaatacctcggttattctctttcgtgtcgcttgttattggatgtcctttatatgtatgttcctgattatatctttctattatgtcagcaataataaacggatctggacgaagcataacaaaaagaactagacccgccagtataaatgctgctgccgatagtatgaacggacctgcaagtttaggaactccaattgaatgcgcaaaactacccattactcctactaaatttggtcctgcaactgcaccgaaagtcgtcattaccatcgtaatactaacagccgttgctctctgcttcttatctgctaaatctgtacctgcataacgagcttgtagattcgtggctgtaccggcaccatatatgagtaaagaaataagtaaaagaataatgctattcgttaaagctgccattacaacaccaattgctccaaatccacctactataaaccctgttgcaagacctatccggcgtccatatcgttgcgaaagcttccctactatgaaagctgctaatgctgatcccaatgtaaacatagcagttggtaatcctgcaaatgcatctgttccaagcatttgctgcgcaagaagtgctcccactgtaataccagcagctagtcctgcaccgccaaacatttgtgaaatgctgacgattattaacgttcgtttgtatagtttttgttgctcttcttctgtgtacacatgattatctattaaagcccctgccttatctagcaattccccatcctccttttaaaattaatccctcttgttaatgtactatgtataacgttacatattcaatggcattttccattcatccctttcattctaaaaaactttctaatcatactcgacttatcccatgctatattaaaaatactactattcacaatatgcaaggagaaaacaatgaaaaaacaggctaatagcagcctgtttccctttacacttcttctactatccttccccttctctttttactcaaagctcttccttcccaaaacaacaaacttacgaaagcacaaattaaaataattggcacacttgctttatataaatctgtaaaactcattgccatctgattcttggcataatgattcacatcattcgaaaatgtgagtacctctttctttatactttcctcttgtttttcaacttcttttgttacttgcctcataacttcttctctttttacatccctatattctactggaacttttcttaatatttcatccgtcttgtcgcgaatcaattcttcctttttctctttacttaatcccattgtcattgcattttgtttcttatttatattcgactctaaactttgattctctattttttctttagtcatttgtaaaatttcagtttgctcagtactattcacatgaatattccgcaccttttcttctgcataatgatatactttttctttatttatagttaaattatgagttaagttagagacaaatattgcgaccgccaatacaattccaacctgtcgtaacattgatacaacactttgagaagcagttaataattctccttcaaacgaagacgcacttaaaactgtaattggccccactactaagccatatccgacacctaatatcatacatggaataataatttctatatttgttgaatgaacatcaatcatttgcaaccaatagtaggaaagccccataacaagaaatcctgacaaaataatagttacttttccgagttttttaattaaagttgctgcaactggtgagacaaaaaatatcatcgctgaaataggtgtcactaaaaaagccgcttcaatttccgttcgaccttgtagtttcgtcaagaacgttggaagcaatacagtaactccaattaaaaataaattactcaatataacaacgattgacgctccgacaaacattcgatcttgaaataactttaaattcaccattgggttatgaatctttcgttctactaaaataaatagaataagagaaatagtgctaattgcataacaagacaaagcaatattactttgccatccccatgtattaccttttactaatatgagagtaaatgaaaaaattgctgtgctacttaatagtagtcctatccaatctatttttgagataatacgttcttcattttttatttgtagcatgatgcaacataacacgattcctattatacaaaccggaacattaacgaagaacacccatctccatcctaaattttgcgtaataattccacctattactggccccatagcagctgacaatccttgtgttactcctaaaattgcaagtgcaacatgccttttagctaacggcatagctgatacaccaattaccatacttgttggaaataaaattgctgccccaatactttgtataaaacgagaaaaaataagaaaatcacctgtattagcaaaagcgcaaagtaccgatccacccccaaaaatcaccagaccaagaatatacatctttgcttttccaaagatatcagctatccgccctaacggaatggcaagtactgcaatcgtcattgtataaacatttaatacccaagacatcttttctaatgaagtatttacactcgattgtattgccggtaaagctatattcataattgtcgtatcaatcatacaaagaaagatacctagacacattaaaaagacaatcttaataccctttgattgctccatctttatatacccctttatttattgtgaatgcgtttttcactcttctgttttattgttttctttcgcctctaactcttctaattttttcttcaaagtctccacttgtgcactatacgatgcaatacctacatctagtgaaatttcttcgacgaaagtaatacctattctccacttttcatatttcaatcgaagatctgcaatgtacgcttcttttctttcaatttcatctttaatccatttttttattgttacatcatcactatagttgccaaaatacattctcattaaaaaatccgaacgtaaaacatccttctctataggcgtctgcatgtattgataaaattcttcacgcccctcatctgtaataaagtacattttcttattcggttttccctcttgcatgacaacctctttttttattttcccttcattctccaattgccgtaatgttggataaatcattccaaaacttccatcaaaaaaatgagtaaatacgtcttcaaacacaattttaatatcgtaaccagacaattccttttccattaataaacctaaaacaacatctcttcccttcaaagtaaaacccccacatagtatataatcaataatcatattaacattgttaatatgattattgattatataccttattctgttaattgtaaaatgtttctaaataaaaaagccccataatttggtttcaccaattcacagggccattttcttatttactctttaacacctacaccttgcaaaacttcaatatcctctttcatttcataataataagaaggcaattctataccatgttctaagaaataatcctcaatgaatgaaataataatttttaacgttttcacacgagcatacaatttatcgttactttcaataatatgccactttgcatttggcttacttgttttttcaaacatgtcttccattgcttcaacatactcatcccatttttcacgattacgccaatcttcgtctgtaattttccatcttttcaaaggatttttctctctatctttaaatctctttaactgttcctctttacttatatggtagaagaacttccctattatgtaatggtcatctgttagtagtttttcaaaatcattaatctcatcatatgctctcatccactcttcctttgtagcaaatccttcaacacgctcaactaacacacgaccgtaccatgagcgatcaaaaatggtgatttgcccgtactgtggaattttgcgccagaaacgttgcaaataatggtaacgtttctcatgaggtgcaggcgctccaattggatttacttggaacccacgcgggtcaagatgttccgtcacccgcttaattgccccacctttaccagccgcatcccatccttccataacaagcataaccgcgattttttcttctttcaaaatttgctgtaatgctaataagcgcctttgatatttttctaatttcttattgtacttagattttgattcaatttttttcgttaagtctactttagcaagatgtccattttccataaaacaaatcccccttgttgtatgacaatgttattttaacatatttttggtaattttttcatatcctaaaaaaactgtgtagaaacatctctacacagcttgcttctctaatttcacatatataagcacatttaactacattaaaataaataatttatactgaactcttagtatattctttttattaaaacgtaaaaatagtccttttaaaaagggcagcaatctaagtatagaaaaacaaatttattcttttttactacatacgtaattatgccggctataagagtattgaataagatattgattcactactcttatagccactttacattatatggtatatttactcgtaaaaagaagataataacaagtaaatccattaaagaatgggagctctaaaaaaatgaaacgaaaaatattaactctctttacacttttatgcttagcactaccaatacaagctagtgcttacacatttcagtcactaccgattgcgtcaaagtctaaacaatggtatgtcgaaattgataaatctcataactcaaacaagcaagcaatccagccaaagcaaggtgtatttgatacgtatagtttactcgtaaaaaacatcggtcatgatgtatcaaacgtatctgtggaaatacttgataacaaccctacctctaaagctacctttaaacctactacacctaatgaaaatatttctaaaagtcatacaagctttgactacatggtattcccattagactttaatagtcataattttaaagttgtaatcacttgggaagaaaagaatttctcttacaatggccatccggtaaatgaaggtaaaaaaatgaaacaaacatttgtatttaatgaagactaagtcctaatttctttagggcttagtcttcttttttgaaacctgcttgtatcgcttccgtcacttcttttgtgatttctaattttgttgtgccaaatatgtacggacagtttttcattacaaaggtgttttattaatactagttgattatatgctaagttattttctatataggtctagccctcttttcccatataatcaattaaatcgacgaatactctgtacagacaatgctattccaattgttaaaattactaaactagctagtgttataatagttatttcgccacctatgacagtagctaaccagcctacaactacataccctaatggcaataaagcaaaagaacccaacatatcaaggcttgccactcttccgaatgcttcttctggtacaaactcctgtaaactcgtttcccaaatgagtccaaatatcatcatgccaaatccttcaattgccattaagaatattaaagcgggtgcccaagaaatgaatggcataattaataaagcaatgccactcattaaaacacctccataagccagtaatcctctcttatgccaccgctctttcccaccaaatattactgcggcaattatagccccaccaccagaaaaggccatgccaagcccatacacgtaagcttcaaaatgatgatgaacattaaataaccatggaattaatacgacgataatgccggcataacaaatatttataaaagaaaaaactaaaattgtaatccacagccacggatgactttttaaaactaaaacaccttccataaactcttgtttgtaagtaagcttactcttttcaatgggttttacttttttaaacttaatttcttttaaaaataataaacataaaaatgataataagtacgttgctgcatctagtccgaaacctatccctgcagatgcaaccgatacgattaacccaccaagtgctggcccaatcaatcgtataccttgattactcatttgagtgagtgcgttagctgcattacgaatttcaggaacgaatactttcgcccttacagcagaatatgctggttggaatatcccttccataagtccgtatatggcaacgagaatatataaaatcgtaattgttaataaatccataaatataagcgatgcaagtaatagcattaatatacagcggattatatccgtaaataacattaatttaacccgatcaattcggtctacaactaaacctgcaaacggtaaagcaagaatattaggtagcatgtacattgccatcgtcatccccattacaactgttgagccagttaatgaatacacaacaactggaagtatgaccatagttatcgaactacctaaggccgagagtaattgtccaatccataaaaacttaaagtgcgttgatactttaactggtaataataattttccaatataacttaaacttttctccttttgtatttccccttgcatgtctctctcctcttttcaaatgactatagaatacataatatacgactgaaaattcataatattatatttccaattatataagaaaccattatgttatggtaaaattatcaaaaaaatataaaggagaatgcatcattatgcctccaaattcacataacatcgaacaccaaatctatacaatgtgtatgatccagcgcaacaatgaagttttactcgtaaaacgacccaatcatcgaggtttccctggctacatagctcctggcggcaaagtagattttcccgaaagtatcgttcaagccgctataagggaagtaaaagaagaaaccggattacttgtttcggatttaaattttaagggattagatgaatatgtaaatccgaaagggaatgttcggtacatggtatttaactactggacagactcatttgaaggtgaacttcttttaaacccacctgagggcaaattattatggataccaatcgatacagcactaaagcttcctatgcaagattggtttaaagaaagattcccattattttttgaaaaaggcacctttgaaattcaacgtgtttgggataatgagctagataaacaagttgctataacaattacacatacgtaaaaaagcttggaatctctccaagcttttcttacttctcctgtactttcttaatcttataatcaatttctaaaaacttaactccaaatatccacattctatgattagcttctagtatgtgatccgtgcgctcttttataataaaagtctctgctaacggtaaacggattgtcaagaaccgagtatgtaaataaatcccctcatctccctgaccattttctcttaacttactagtaataattaaatcatgactatcattatatagtttcaaaataccagtcatattcgaataaggtaaaggtaaggcgatattcatatatgtctcactcttatttgtatgctttgaataaagagctacaaaaatagatttacctgcttcattttttcttagccaagcccttacattctctcttccatctttctcatctatgacactaatgatagagccatgcatcgtttcccaattgccgcccattcctaaatgtatttgttctacacgcttactcattttctcatagcaaagtgcgaacggacggaaccaacgagcccatttaatattcgattgcaattcatactctactgtattttcataaaaatgaataatacttaaaggaaccttcgtcacatcaaatgcctcactatgaaagtcatttactttatcaactaaaccgttgtattccttactgtctactaaattgctgctatataaataagcctcaccaattgccacatttcctcttaacttactcattggtttcccatagtatttataattcggaacactcttttcaatcacccagccgataaatgccggtaacgctactccaattccgttgacaacaccatgaatccaaaccatttgagcaattgtaatcgtcaagacatgcttcaaattcccgtatgaatatataagtgagaacataattgtaaccatgagtgtactagacgaaacgattagaagaatctttgcactgatagcattaaattttgctctccaaacgtaaaatccatacccataaattgcacataaatataggaacactgcaaaaaattcaaatattcttgagtatgtaattcctattgcaactgtcataggtgaaatcatgatgataaacataatagcatcatacactttacttctcttttctctttttctccctattaaaccagctgataatggcaatagaaacgccgaataatgaaaatgtgcagctgtgagtaaaacaatgtcagagctaaaatgcataattgaaagttttgctactgaagcagaaaaccaaaaaccacctaaaaacaaataaataaacgcactatctatggcgatctcttctaacggcttccatcctctttctagcaatctacttacaccaaataacgcaacaattcctgtatatacaaaccaaactagcgcaaataaatagtgatttgtgacgaaagctaacattgcacaaattgctgcgattggatataaaaatgatacggatttataaaataataattgcgatccatctctttttcttttatcaataatacaaaatgacattggtataaataataaaacagataataatataattgcttcaacaggatttatattcgaccactcacttattagaaaaacaacatagcaagcaagcccaaatattatatttttcatatcgtctattccctttccacaaatgttcccttatatgaaaaaagcgaaccaattaacgggtttcgtacttgtacatgaattcgaaaacattgtagtgtttcatcataactttcaacaatttttgcctcaccatacaaaaattttggtaacggcatttttcttccaaacatataaaaccattgtttctttgaagaaatatgcattgcccctaactcatcgatatgaaaatgcagtgtagaaacgagtaaatgtggttcaccaaaataatctacaatttcattttcgttttcatcaaactgcataactgcattaaaatatcttttcttatttcacctattgattccccttctccaactatttcaagcccaaatccaatctttgttttatacaaaaacttctgtggttccccttcttttttctctaaatacgaaatttcagtaaagcgagcatcccactctgtatgtatatctggttcttgcgtatattcccataatttttccatcgtcgtgttcatttttgtcgcaacataaataggctgtttccttttcattctccccacctcctatgcactataactttaatgtacatgcaatgaatttattttgctacatttttcacaaacttcctcagaaaaaagaaagaatttttaaaatatatataaaacacttgattccacgaaaaatttaaattattataaaacaaatgttaccaacaacttcataaatcaaacactctcgcctaaaacgtgagatagaggttgcgatacttatgagtattctaatggagacacagagatgtctatgaacttagatgaaaggaagtattgccgaaattgataaatttctctgcatttatcaattggggctgttttcgaatagaaacagaactgtcatatgtacagacgtgtacgtatgaagagctatctacaaaaaagagatatcatttttttatgatattcctttt

SEQ ID NO: 1259 - DNA, 8191 bp, Bacillus thuringiensis
ggaatagaaaacggataaaataacttgcagttccccaaaattctcgcaacgcactatttggtaagaggaagggatataaaagaataagatgaagatacacccgaataataaaccataaataggtaatgaactcctttttttgttaagtaattgattgattccatctgaagcagtaaaaatataaggaatgcaagaatcaaaaataataaagagataaaatgacaaaaagataatttcaaatcgctcaagaaatgagaagtgaaatggtgtaacgagagaaagggtaggccataaaaacttagttataccatctgggctaaaataaaggaaagaaacgaacgtcacttgcaggtaaacgaataaagtaatcaaattcgcaagaacaatccctttttttgcagatgatttattactgaggtaaggataaaggacgaatgcaaactcaaatccgagaaaggcaataatagttgattttactgtgttgaaaactggtatccatccctctttaaggagaggaagaagatagatccaatgcccatctttaagtgggataaataatagtaatggcatccagagtgtaaataagacagtaaaaacagcatagcggctaataataagaacacctttatatgcgagcattaccattggaatagataatagcatcatgattaaaaacattggagatctaggcaaaatccaaatgtgaataacgtataagagggaaaaaattaaagaaaccgctgcaagaacagcatataaaatccaaaaaatcattcctactcttcctaaccattttccaagataacgagttagcacatcaagtaaatggtaaccaggatgcttctccatgatttttacaatacatagactgaccctataataatagacatccagccatctgtattcgccccttgggccacttcacgtggcagtgtaagtacaccgaatcctacttgaacaccactaatcgttaaaatgtattgaaataaactaatctccctctttacacgctttgtcacttatcttcctccttttcttctatatccggttgtcgattttcttgttttaagttaagggatagtggtcgtttcttcattagtttccatggcaaacgcacaagaacgtcttttaaatccgtagcaaatgatggagaaaaaggactaccgtaaggaacaccaagtgagtccatagaaagaatatggatgatgataactgacattccaaccataattccaatgactccgaataaagaagcgattatcatcattggaaagcgaagaatccgaactcctgctgacatttccagattgggaatgataaaagaagcgactgcggtaatagatacgacgataaccataacattacttacgattcctgcttgaactgcagcttgtccaataacaatccctcctacgacgccaattgtttgtccgacgggaccgggaagtcgaactgcagcttcgcgtagcatttcaagtactaattccatcaaaagtgcttctaatataggcggaaaaggaattttggctcgagattctccaattgttaacaataatttaagtggaattacttcataatgaaaggaaatcatagcaatataaagagcaggagcaaatattgcaataaatagtccagtgaaacgaaggagtcgtataaaagatggaatcataggtctgaagctgtaatcatctatcgtctgaaaaaaggatgaaaaggtcataggtcctattaatacgcctggtgagcgatctacaataacggcaattcgcccatctagaatatgatgtgttgttgtgtcaggacgttcagttattgataattgcggaaagagagtaaaggaattatcttcaacaaatccctctaattcaccagtagtaagaatcgcatcaacttttactgactcgatacgggatgccatttcttttacgacattttcgttcgcaacatctgctagataaagcaaaaaaacctttgaagtagctcgttcaccaacagtgaattccttcactttcaattcgcgatttggaatatatcgacgaataagtgcaaggctgtcgctcgctacttcattaaatccttcgtgtgagctttttatggagctctctgttgtaggttcttcaatgctcctttttggtgccgcttgcgtatcaagctctaaagcggatagttgcccgtttataaataaaatacttttgccgtgtaaaagagattgttcaatgtctgtccactgttgaacttttttaatatttccgatagaaacagaggcttcccaaaaatcgtcttcattccactctttaaataagagaggacgaagaatgtttacgttaataacagttttgtctacaagtccttccatatatataagtgcagcttcctgtccgttttttaatggaaaagtgcgtgttattaattctggaataccgctaaacagtttggacaagtgctttaaattaagggaaagggaagaagagatagatttatttaatgtgtgattagcttgctcttgggtagaaaaagatttttcaccacgaatccatttattaaaagaccccatttgttcgcttactccttgttatgttttatatggattattatggatagttacaagctgacatatgcgtagtttaaattttatattggatatttttaactttaacgctataattatagtgttaaagatggaatcgtgatatgacctgttatgaatctatcgttttatttatgaataaatggattggtattttagcaagatgtgctaataaactactccaccatgatgatagcgtgccaaaaatgtggtgcgtatattttcgtggtggagtttttttattctcaaaaagggggaaagaccatgaatgacaacatggttcatattacaattgacggaaaaaagtatacagcggagcctggttcgacgatattgggtgttattaatgagaacgggattgaacatccgcaaatttgttacgtgccagaagtagatcctattcaaacatgtgacacttgtattgtagaagttgacggaaagttaatgcgttcttgttcgacgatagcaacggaaggtatgaacattgaacgtgcttctgttcgcgcaaaagaagcacaaacagaggcgatggatcggttactagaaaatcatttattatactgtacagtatgtgacaacaacaatgggaactgtaaactgcataatacagcagaattaatggaaatcgaacatcaaaaatatccgtatgaaccgaaagtagatgtaagtgaagttgatatgacgcatccgttttatcgctatgatcctaatcaatgtattgcatgcggtcaatgcgttgaggtgtgtcaaaacttacaagtaaatgaaacgttatcgatagactgggaagcggaacgcccacgagttatttgggataaaggagtaaatattaatgattcttcatgcgttagctgtggtcaatgtgtaacgatttgtccttgtaacgctttaatggagaaaacgatgctcggtgaagctggatttatgacgggattaaaaccagatattcttgaaccgatggtagatttaattaaagaagttgagcctgggtatagcggtatttttgcggtatcagaagtggaagcggccatgcgtgatactcgtacgaagaaaacgaaaacagtatgtacattttgtggtgtaggttgttcgtttgaagtgtggacgaaggggcgtaaaatccttaaagtacagccatcttcagatgcaccagttaatgcaatttccacttgtgtaaaagggaaatttggttgggatttcgtaaattctaaagaacgaataacaaaacctttaattcgtaaaaatggaacgtttgttgaatctacatgggaagaagcactgaatgtagttgcaaataaattaggcgctattaaagaagagtacggtaaaggttctattggatttatttcttcctctaaaattacaaatgaagacaattatgtaattcaaaaattagctcgacaagtatttggaacgaataatattgataactgctcacgttattgccaatcaccagcaacggatggtttgttccgtacaattggtatcggcggtgatgccggaacgattaaagatattgcgcaatctggtcttgttattattgtgggatgtaatccgacagaaggtcatcctgttctagctacacgtattaaacgtgcacataaattacacggacaaaagttaattgtagctgatcttcgtaaaaccgaaatggcagagcgatcagatgtctttattagtccaaaacaaggaacagatcaagtatggttaatggctgttacgaaatatatgatcgatcaaggttggcatgatcaggaatttattaatgagaatgtaaacttctttgaagatttcaaagagagcctagaagaatatacacttgaatatgcagaagaagtaacaggtatttcaaaagaaacacttattcaaatggctgaaatgattcgtgatgcagatggtacatgtatcctttggggtatgggggtaacgcaaaatacaggtggttctgatacttccgctgcaatttcaaacttacttcttgcaacagggaactatcgtcgtccaggagcaggtgcatacccacttcgaggtcacaataacgtacaaggtgcttgtgatatgggtactttaccaggatggcttccaggatatcagcacgttactaacgaaatggaacgtgcgaaatttgaaactgcttacggagtgaaaattgatagtgaaccaggtcttaataatattgaaatgcttcacgcaattgacgaaggaaaaatgaaagcaatgtatcttgtcggagaagatatggctcttgtagattctaatgcaaatcatgtacatgaagtgttatctagccttgatttcttcgttgtgcaagatgttttcctttctaaaactgctcaatatgcagatgttgtattaccagcagcgccatctcttgagaaagaaggtactttcacaaatacagagcgccgtgtccaaagattatatcaagttcttcctacgctaggagacgcgaaaccagactggtggatcgtccaggaagttgcgaataaactaggtgcaaactggaattatagccacccaagtgaaatctttgctgaaatggcaagtttatcaccattgttctcgcaagcgaactatgaagtgcttgaaggatggaacagtttccattggggaagttttgatggaacaaatacaccacttctgttccaagatggatttaacttcccagataaaaaagctcgttttgcgattgctgactgggtacgtccagctgaatttccagctgagttcgaccttcacattaacaacggtcgtatgcttgagcatttccatgaagggaatatgacaaataaatcaacaggtattcaaacgaaagtacctggtgttttcgttgaaatctctccagaccttgcaaaagaacgtggcgtaaaaacaggttcgttagttcgtcttgtctctccttttggagcattaaaattacgtgcactcgttacagatcgtgtaaaagcgaatgagttatatttaccgatgaactctacagataacgaaacggcaattaatttcttaacaggtcctgctgtggatgtacgtacgaatacacctgcgtataaacaaacgaaagtgcgtatggaagtgttagaagttgatggctaaaatccgatgccaaaagcgaacccacgcaataaaaaacgtcaccctcaagctggcattgaggtacatcgtaagtgggcacgtccaggggtatgtgcatttaacggataagtaggaggagaaaactatggctgcacctataaaaatgattcaaaaacaagaattaactgaggaagaaataaaacagcaaaaattagatgatttaaaggagcttttaactaataatgaagaagctctaaatcagatgtttaatatagtaggggaattaaatgacattggaatgctagaagctgcaaattctatgctgaaagcgaaagaaccaattgcaaagatcgttctaggtcaagtaactcgtgagcctgttacaaatttaattaataatatgatgggtgctgcaggggcgttaactgaacttgacccagaacttacgaaaaagcttataggtagtttattagtcgggctagaagaaggtaatgaacatctagaaagtaataaaaaagtaggggtattcgatcttatgaaagtattgaaagacccagatattaaccgtgctatcgggtttgggcttcatttcttaaaaggtatggggaaagggttaaaagacgaataaacttcatgaagtgaacctttccgcctaaatatttgtacgaaatagtttgggcggaaggctcattttggtaaaatatataataaagtaaaatgaggcttttgggaggtatgattgtatgtcaaaaaaagtacatgaatttaatgatatgatacgaaaacttcgaaaagaacttttcggaaaaggaccagaacgaattcatactgtttttgcagaaaatatggctatagcgactctttatggaaacttaacacctactgaaaaatttatttcaagtacgatggacggtgcggaaatggttcatatggctagaacgaaaatgattcaagaggtgtatgctgtgaattcacgtgaacatttggaggaacttgttggagcgaaattagtgaatttgttttcagatatgaaagtagaagaagatattgcagtttctgtatttgtttttgataaaaatataacgtgagagaaggatactgatcgtgaaaccgatacaggtagaaagagaaatctttcgttatgaacaaggagcatttaaacatatagaggacagcattgtaacagagtttcctgtcaccattaaaatgaacggacaggagtttgttacaatggttagtactccagaatatatagaagatatggtaataggcttcttagcgtctgaaggaatcattcggaagtatgaagatattgatagtgtatgggtgcaggagaaagaaggatttgtgcatgtaacaacgacaaaagtaaatccgtattatgaacaaatgcaaaataaacgctatattacgtcttgttgtggtatgagtaggcaagggtttgtttttgcaaatgatgcactaagtgcaaaaaaaatgaagggtgtccatgtacaggttgctgcagaggattgttttcggttaatgaaagaaatgcagcaatctgcggatacgtttcatcatactggtggggttcataatgcagctttatgtgatgtgaatggtattattttaagtcgaatggatattggtaggcataatgcattagacaaaatttacggttattgtttaagaaacgatatttctataaaagataaaatcattgtttttagtggtcgtatttcttcggaaatattattgaaagttgcaaaaatcggttgtgaaattatactatcaaaatcagctccaactgagttagctttgcaactagcggaagatttaggtattacgacaataggatttattcgtaatcactccttaaatgtatatacccatccagaacgtgttttaaatataaaataaaagtgaggcaatgaagatgaaatcagttacattagacaagttgcaacgtccgttaaaggatttacgcatttcagttactgatcgctgtaattttcgctgtcgatattgtatgccagaagaaatatttggtcctgattactcgtttttgtctaatgataaaattttatcttttgatgaaattgaaaggataacacgtattttcgtttctttaggtgtgagaaaattacggattacgggcggagaaccgttacttcgaagagggcttccaaagcttattgagcgccttaataaaattgatggtgtagaagatatcggtttaacaaccaatggatcgttacttaaaaagtttgctcctgatttatataaggcgggactatcacgtgtaacagttagcttagattccttagaagaagagcggtttttctatttaaatggtaataggagcaaagtgcaaagggttctggaaggaatacaggctgcagctgaagttggaatgaaaattaaagtagccatggtcgttcaaaagggaaaaaacgaacaggacattttgcagatggcgcaatattttaaggaaaataagcatattcttcgttttattgagcatatggatgttggaaattataatggttg

SEQ ID NO: 1260 - DNA, 6364 bp, Bacillus thuringiensis
atgaatacatttgtcgctattgggcaaatttttatgagcaatgaacaaattcaagaaatgattaaagaagctgaaaaaatgcaaggctttatcggaggattttttgtatgagaaactcaccattgttcatggctgcactatacttccttcttggatgtatctttacacgcttcgccattacgaacgtgacagatacaatctggaatatgtggacaatactatttgcagttatggcaacaattgattttaatttggcacttcgccttatattaattaaattcacaaagaagaaacaataataaaacgcagaggtcgcttcctctgcgttttattgtggatagtttttcaaaaagtaaactaatgtttgtaactctacagctaagtcaatatgatgaattctaatattctctgatacgtttaatcgcgctggtgtgaaattcaaaataccatgcacgctcgtttcagctaatctatctgctacagcttgtgctactgtagccggtactgttaatattgccacttgtatatcatttgataatctctcttctaattcatctaaatgatatacaggaatgcccccgatttctgttccaactttctcttcactaacatcaaatgccatttcaatttttgtattattgtttttcgtgaaattataatgtaagaaagcggtccctaaattacctactccaataagtgctacacgtgttatatcatcttgatcaagtgtttcgcggaaaaatgataatagataatttacgttatatccatatccctttttccctaacgctccaaaatacgaaaaatctcttcgtattgttgcggaatctacttttactgcctcactcaattcggccgatgaaacacgctgcttaccagaaagagataagttttggataaatcgatagtatagaggcaatcttttagcagtggcttgtggaatcttttgctgatccatatgacctctcctctcttcctatctttattcatatactttaatcaaatacagaagtttagcactcattaaattccttgtataataaagagaagaagtattctctctttattttaaactatacactatttttagtatgattgagaaatataaacatggcaaagttaagaaattatttgaggtgaaaacattgattttattacaagtaaacgcgctttcgaaattatacggtgcagaaacgattcttgcaaacataaaattggaagtacaaacaaaagatcgtatcgcattagttggaaggaatggagcaggcaaatctacattattaaaaattatcgctggtgaattatctcatgatggtggcgaaattataaaaccgaaagatgtctcaatcggatatttagctcagaatactggactagaaacgtctttaacaatttgggatgaaatgctaaccgtctttacccacttacagcaaatggagacaaaacttcgaaggcttgagcaagaaatgggaaaagaagaaaacttttcaaacgaagctacatatgaaagattgttagctgattatgaccaattgcaactcaattataaagatcaaggtggatatcaatatgaagcggatattcgctccattttaagcggccttggcttcccagttgaaacgcaccagacgacgatctctactttaagcggcgggcaaaaaacaagattagctctcgggaaattattattaacaaaaccagacttacttattttggatgagcctacaaaccatttagacatcgaaacattaacgtggcttgagcaatatttacaaggttatcctggcgcaatattaatcgtttcacatgaccgttatttcttagacaaactcgttacacaagtatatgaaatttcgaataaagaaagcagacgatttgttggtaactacagtaaatatttagacttaaaatcagcattatatgagcaagaaatgaaacgttacgaaaaacaacaagatgaaatcgcaaaacttgaggacttcgttcaaaagaatatagctcgcgcttctacaacgaaacgtgctcaaagtcgtcgtaaacaactagacagaatggaattattaacgagaccattaggggattctaagtcagcatcattccacttcgatattgaaaagcaaagtggaaatgatgttttacaagtaattgatgcaaccatcggctatgatgagaaccctataattgaacatgtaactatgcgcttaactcgcggagatagtgttgctttagttggtccaaacggaattgggaaatccacattgttaaagtctattgtgaataagttaccactattaaatggtgatgtttctttcggatcaaatgtatctgttggttattatgatcaagaacaagcaaacttaacatcttctaaacgggttttaaatgaactatgggatgaatatccactgcaacctgaaaaagaaatccgtactatactcgggaattttttattcacaggagatgatgtactgaaaccagtatcttcccttagtggtggacaaaaagctcgattagctcttgcaaaacttatgatgcaaaaatcaaatttattaattctagatgaacctacgaaccaccttgatttaaacagtaaagaaattttggagaatgctttaattgattatccagggactcttctattcgtctcacatgaccgctactttattaaccgtgtaacaacgactgtggttgagttatcaacagaaggtgcacaggaatatttaggggattacgattactacgttgaaaagaaaaatgaaatgattgaacgtgcagaacttgaacagcaagaaagtgacattcctgttcaaaaggtggttgcacaagagaaattaaattatttagaagaaaaagagcgtaaaaaactagagcgtcaacgcactagaaaaattgaagagctagaacaaagtatattagaattagaagaagaaattgctacgttagaagatcaactttgcttaccagaaatatatgcagattatgaaaaagctagtgaaattacaactaaaaagcaaacgctacaagaacaacttgaaacttgtatggcagaatgggaagagctgcatgtataagcatatttaaataagaaagatgtctcataagtcaggatttttgactatgcgacatctttttttcttttaatacagaaacaattttttgagtatatcaatcgtaacttagaatataccaacgatttttcaaatatatctattgtaaccctatatatattaacagttcgacacgaaatatcgatttaacgacaaagattgacaatattagcatcttctataatagggggatgtttcaaaatgtttttcggggatatcttcttactttttatttcccgaaaaagaacaaacacaaaggtctgacatcatcctatttatccacaagtttatacacatatccacctttataaaataaaccttaaaataacttttccacattatccacaattaataaaaaagttatcaacattttatatacacaataaaacccacattatcaacagacaatatgggttttatccacaacctgtggttaattatgtgtataactatgcttcaatatctaatcctggatttgcatttaaggctaatgttgcacgcttaccttgttcataagcaattgtccctgccgctgcaatcatcgctgcattatctgtgcataaagatagcggcggaataattaattcaatgttttctttttgtgcaaattcctcttctaatcgcgcacgaagtcctttattagcagctactccaccagcaagaagtaattgctttacattataagcttctgctgcacgagctgctttcgttacaagtacatctattacactttcttggaaacttgccgctaaatcttctggcgcaatttctataccgcgttgttttgcgttatgcacagtgttgataactgctgatttcaatccactaaagctaaaatcatatgaatccggttctagccatgcacgaggcaaatcaattgtcggttctccttcatgtgcaaggcgatcaatatgaggaccacctggatatggcatagataacgtacgagctactttatcatatgcttctccagctgcatcgtctcgtgtttcaccaattacttcgaatgaaccatgttctttcatataaacaagttccgtatgcccaccagatacaacaagtgataataacgggaattgaacttcttttactaaacggttcgcataaatatgaccagcaatatgatgaacaccgactaacggaatatcatgtgcaaacgctactgccttcgctgcatttactccaattagaagtgctcctactaaaccaggaccttctgttacagcaattgcatcaatatcatcaaatgtgatgtttgcttcctttaaagcttcttctaacacaactgtaatttcttctacatgatgacgggatgcaatctctggtacaacgccgccaaaacgtttatgactttcaatttgtgatgcaacgacattcgcaataatttccgttccatttttaacaactgctactgctgtttcatcacaacttgtttcaataccaagtataatcgtatttttttccattatatattcacccacattacgagaccatcttcctgattgtctgcatagtatcgtttacgaatcccaccattttgaaatccgtattttctgtataactgctttgctacttcatttgatacacgtacttcaagtgtcattgtttttacccctagttctttcgcttcagaaataactgctttcaatagggcatctcctaacttttgacctcggtattctggcaaaatagctatatttgttatatgtgattcatcaataattatccacaatccacaatacccgactacacgaccatctttttctaacacaatataatgtgcatgttcattcatcgttaattcacggtgaaaggcatctgcagtccaaggagttgaaaaagacgcttcttcaatagctacaatttgagcaatatcatcaagctccatctttctaaatatcatatccatcttctgcaagctcctacttgttttgactttctaaccactttgtttcagcttcagctaaacgaagatagcttggaacaaacgtatgcacatcttgttcttctttttgtaatcctaagaatgctagctcacttggtcttgggttatttttagtaaatggagcgaatacagcttgatcacctaaatgttctataattgtttctttatgcaatttaacatcgttaccgataaataaaacaggctgtcctttatcttttaacatttgcaaccagtccacaataagaataattcggtcttcttctattgaagttaactgctctccttcatatgtatataacccagtataaatttgcccacgtcttccatcaaataaaggacaaattaacccgctaaagttagcaccgtttgcagctactacctctaaacttgatacacctacaattggtatttgaagtgaccaagctaatgttttcgccgctgtcacgcctatgcgaacacctgtataggatccaggtccagcagctacaacgattttagttaattccttcggttttacgccacactcttttaacagtttctctacagctggcataagacgtacagaatggttttttgttaaatttgtaatgatttccccaattacgtttccttcctcaataagggatacacccattacgtaatttgaagtatcaattgctagtactttcatcttgtaatagctcctcacataatctaatatagcgatctccaattggctcgagtataatttttcttgtgtcatctccagcatggaataaactaatttgtaacttttcatttggtaaatatgcctctattaaatgagcccattctactaccgtaattcctttaccgtagaaatattcatcaaagcctaagtcctcttcactttctgctaagcgatacacgtccatatgatatagcggtaatcttcctttatattctttaatgatattaaaggtaggactatttacaactcttttcactccaagaccttttgctagtccctttgtaaaagtcgtcttaccagctccaagatctccttctaaaataattacgtcttgtgcctctacgagcttacctagtttttctgataacctttgtgtttcctcagaagattttgttgttacttcatatttactcacagacttcacctactttactcacaatgttctctgctctttattatacaggttttgaatatataaaaaagtccttaggagttgtcctaaggatagtttgactgtctttattagttttttgttaaaacaaataaaaaaatacgaaacaacttggttcgttcttttctttatatgaaatggcggtcccgacc

SEQ ID NO: 1261 - DNA, 6204 bp, Bacillus thuringiensis
taaatgactgattacaaatatatactagtatagccataccatctccacccattactcctaaaccaacttcgactaggcgtgcaccaataaaaatacacagtaacatggtaagaaattgtagccaaaacatgataaactacctccgaaattcattagttaagatatattcgaatagtttaatttgaatgaaaattaaataaatacccgaagaaatccttgttatttatacattttttattatataacataaaaaaagtaacattcacgtactttttgaaattattttgaaaaagcaattcattaaaaatttgtatttatatctctaaataagtagacattttgatttatatgttgtaatctttgaaagagaataaattaattctcatagaactcccatatcgttcaactcgttcagcgagaaaggcaaactgatggaaacatgaggacgcaaaactacaggagctaaggtcgaaaggctacgctagccagttaccggacggatagggttggtcttggccaatgcttttacattggcttttttttattctcgaacatattgagaaacattttcaaacaaaatattcatatattttgttttttttgtttatgttgattaaggaaggtggatattaatgaaaaaatattggcataagttatcgttccttcaaaagaacgtcttattaaccgtattagttattttgacacttgttggaagtatgggtgcattaagttttaacatgtttcaaaatagtatgatgtctttatttgaaaggcagtctattgaaacaggagaaatagtattgaaaaaactggatgtagaattagttagagacatggcgaaagatcctacagccgaaaaagtgaaaaaagaaaagttaacagagaaattagatgaagtatcaaaagaattgaaaagcgttggacaaacgtatgttacaggagcaaagccgaatgaaaagcgagaattacaactcgttggtttgactacagagttaacaaatgcgtttcctataaagccgggagattattatgaacaacccgctcattggatgaaggcatacgataaagtgattgatacgaaaaaggctcaaatgacagaagtatatgaagatgaaataggttcgtgggtgacaatattagaaccaattacagatggagaaaacaatattgttgcaattattgcggctgacttagatgcttccattgttcctattacaaaagagaagtttatgatacagggcttactcttcatcattatttcattagcaattgcgactattactcaattctttatcgtgcgtcactcgctagctccattaaaagatttacgagaagggttacgtaaaattggtgaaggtgacttaagtattaaattaaaagaaagaccagatgatattggaattattaatgtttatttcaataacacaattgaaaaatttaaagggattatagataaagtaaggcaaactgctgagcaagtttcttcttcttcacaagaattgtcggcgagtacagaggaaaacagcatggcagttcaagagattgcaagttctattgaaggtttaagagtaggggcacagtctcaaaaaacttcagtacaacaatgtttaggaattgtacatggaatggaagataaggtagaagaaataactggggctgcaaaacaagttgcggttgcttctgaaggtatggaacaacattcaattgaaggtaatgaagtgattggacaaattattaatcaaatgagtttaatccaaaatgcagtacaagatttatcttccatcatttattcgttagaaacaaggtcaaaagaaattagtgatatcgtaactgtaattacaggtatttcaaatcaaacaaatctattagctttaaatgcttctattgaggcttcacgtgctggagcagctggaagagggtttgcagttgttgctgatgaagtacgaaaattagcagaacaaacggaagcgtctgcaaaagatatagcgaaattaattggtgaaacacaagctgagacagaagatgctgtagtttccatgcaaaaaggttcaaaagaagtagaaactggaatttcgcttgttcaaagtagtggagatttctttgaaaaaatctcaaaatcagcgcaatctgttacagatcaagtaaaagctgtttccggtaattcgagtgacattttacaaaatagccagaatattgttcaagtcgtaaatgaattatcacatattgcaaatacttatgccaacagcagtagtaatgttgaagaaagcatgaaagagcaagaaatatcagtacaagatattgcagaattagcgacttctttaagttggctttctcaggaattgcaagagcttattggtgagtttaaaagcgaataaggagaaagttcaattctaatcaaggggggtatctccgctactgattatgaattgaacgaatctgccctttaataagggatgaaaaaggtgtgaattttcacacctttattatatttaagagaggaatttacataaatatgaaattagtgatttcttataatgagatgataaaagaatttttaggaaaagtagaaggaagtattaaaatacctaaagatgtgcacggaacagaacttaggataaaaaggaaaacggaactgttttcaaatttgactcacattgtagatttaataggagcgactgcaacgtggttatatcatatttctaaagaaaaacatattgtcatgctttatcatgtaagaggaaatttatttccaattactattgaagtttctaattttctctcctatgaaagtttaaatttacaaattgaagagcaactggagcaaattaaagaaatgaatgaggaagaaatagaagagtttcaaaacggtaatacattatatgaaatgtcacctattattattggtgaaacatattatgagctacaagacacgaatacattacaatttgtatttagtaaaaatatgcaaagtgtagaaataatatttaatagtgttaattggaaagagacaacgattactcgttatgcacaacaaatacaaggtgttttagttgatatatcacaaaatactaataagtatataaaacattttaatattattacagaggccgagatggcactttatagtcaagtgaatgatacgacagcagtatatcctgagaaaagtatcgtcgatatgttctataatactgttactcaatttccaaatcgtatagctttatcttcaagggaaggtactttaacttatgaggagctaaataaaaaaagtaatcaaatagctcatatgttaattaaaaacggcgtccaattaggagactatgttggaatatttatgaaacgtagcatagacacagtagtaagtatggtagctatattaaaagctggtgcagcgtatgttccgattgatccagattatccggaaagtagaatacagtacattattcaagatagccaagcgaaagttatattgatgaaagagacgcctataacatgtgatggggttcaaacagtttcattgtatgatagtgaaacttatgaagatatagatgtaaagttgtctattcattgtgatgatgtagcttatatgatttatacatcgggttcaacagggaatccaaagggaacgatgttagcacatagaggcgttgttaatctgtacacttggatgaaaaagcaatatgaattgacagaagaggatgtatttgctcaatttccttcctttagtttcgatgcttctgtatgggagtcatttgcttctttattctgcggaggaaacttgtatgtactattagaggaagagcgattgtctgtagaggcatttgcaaatgcaatctataaagtgaaagcaacttcaatcttggcattagcaacaatttttgttcgacaagtagcaacttatttagcagaagaagatatatataagctagcttccctaaaaagaattgcgattggtggtgaaatgttgcctgtagaggttattaaattgtggagagaaagaataggtacaaatgttgaaatttataatgtatacggaccgacagaatgtactgtagtgacgacaacctataaaatacctagtcagttaaatgaggatgttgcgagtattcccattggtaaaccatgtgctaattatcaagttatgattttggatgagaatatgaatctttgtccaattggtgtacctggtgaattatatatagattcagtgggattagcaaaagggtattttaataagcctaataaaacaattgaagcttttattccgaacccttttaatcctatagttaatatatataaaacaggtgatatcgttaagttgctagaggatggaaatatagagtttttacatcggaaagatgatcaagtaaaaattagaggacatcgtattgaactaggagaaatccaaagtaaaatttctcaaaatcataatataaaagaaaatgctgtttttgctaagaagagtaaggaaggtagccaatatttaatcgcgttctatacaactttaaataaaaaagaaataccagaattagtttatcagttacaagagcaattaccagattatatggtgccatctaaactaatttatattaatgaattaccacttacacctaataaaaagattgatgttaagaagttagctcagttagaagaaaagtatgaaccggttcggctacaagaatatgttgcaccttctaataaagcagaaaaacaaatcgcgaacgcctgggcggaagtattaggaatttcaaaagttggagtgcatgatgatttctttacaattggtggacattcattaaaagtattacgagtcttaacattgttaaaagaagatttctcacatttaacaattcaagatttctttaaagaaagaacgatatatggattagctcgaattgagcgagaagtaaaagtagagaaagaagaagtatttcgtgaatataaagtgattcacgagccagatactatcacgtatgcaaacgttttggaagaaatccagatttcaaatgtctttttaacaggagctactggttatttaggatcacacatattatatgaattgttgagagatacatctgctactatttattgtttagtaagaccaaccaaagatgtgcagcaaagaattatagatacattaacaggctactttaatgatatatgtgaagaatggttacagcgtatacaggccgtagctggtgatctgggagaagagtatcttgggatgagcgaagaagaatttatgttcatcagttctaagatggatacgataattcattgcggtgcagatgtaagacattttggagatgtaaaacaatttgaaaatataaatgtccaaggaactagccgtatgctagcattagcggagaaaggtgctacattccattttatttctacaattggtatcccgttagaattagcggtagatcaatgggatacatacatgaaaactggtgattttaattacagtgtagacttagagaatgtatattcaaatagtaaactacaagcggaaaacattgttcgtgaagcaatgaaaaatggtttgcgcggaaatatttatcgtgcaggtaatttagcatgtcattcagaaacaggttcgttccaacaaaatattgaaggaaacgcattttatcgtcttattaaaacaatgctattaattgggaaagcaccaaatgtgaagtggaaagttgatttcacaccaattgattttgctagtaaatcaattgtatcgtatttacaagatgcgcaaattgtaggagagacgttacatatttgtcatccacatcaaattgagtttgaacaatttatacagctaattggagagtgtggatacaatcttgaaatggttccactttcagaatatgtaaataccggacttgcattagcgaagggaaatgaagtaatagcagagttaattgcttctcaagttgcaggagatggagcacagcaatctgaaattgtaatgggtacgcgtagaacgaatgaatggattaagaaaaaagaattgatagtaccagcaattaataaagaatttatacagcagttattagctcatggtgaaaaagttggttattttccaaaaataatgaaatgattatgcatgcttttgtttgttcaataaaataaatcatgctacaatgaaaacgaattaaggaccggggagccaattggctgagaggatgtaagtaaacatcgaccgtcaac

SEQ ID NO: 1262 - DNA, 9454 bp, Bacillus thuringiensis
tacttcccattatggcagtagggtttattgcaatggctgaaggggatacacctgcaccacaaagacctgatttagcatatggtgaggggcatattagtggtataagtaaattagaagcacacggggatcatggcggtgcacccgcttacgaccacggaagaccgcctgcaccagcgtatgaatatgtgaaataacaaaaaagccaactttatttatataatagggttggcttttttggtgctatgatgtttagaatttacttttagataatgcctttaatatcggatttataattctacttattaaacgaaatcccttgaatatagagctaacaactttcataatgttagaatctctttttattttaaacacctactttcgcaattccgcttgtagaataaagttttcttttatactacctttatatgtataccttattttattcttttgataaacctttgtatgatctttgctaaatactgtttcgtcactaagaccaagttcttgtttaactaaattacgttctccaaaactcaatgaatcatctaccgttcctattaataataagaaagcgaatttgaaatctttttgctcagtaaagaaagcatttggtgtcatagctagcgaagcctttttaatatgtttattcttatcggtgtctaagaagataaaaatattatttgataaaccgattgaggttctgccatcttctaatacttcagttgaattaattttcaactttgttttttctcccatttcttttaatgctttttctattctttgtttgtattcatctactgttaatttagtttctttattttctgcaatcgcaggtttagtgctatcctttttattgccactaacaccagcagcaacaaaaattattaatagtgcagtaataatccaaacccaccattttttataaaacggttttttcatataatttccctccatagatttatacctaaatcataccaatttcatgcaacaactgtaaatggttaagtttctggtttgttgacaaaacagaacgattgttctattatttttatacaaacaaacgttcttgtggaggtcatcttatgaatcatttacttaaatgctctttcaatcaaaaaataccaattgaattaatatatttaaacggttcaggagatttctctcaaaggactgtgattgttagaaaagtatatgaagatcgtatattggtgtattgcatgaaaaaacaacaagttagaacactgaaattagctaatatactatctgttgataaagtaagaaataactatcaatacgcttaaaacacttaatgaggtgattatcatatggcaaacggagtaccaaaaccaccaaagaagaaaagtgcttcaaaaaaggaacctagaccatacatggatgaattcgaacagcaagaagctgctgaattaattcaatatgcaaagcaggatgatacagaattagtctttactgtgtatagaaaatataaagaaccagatatcattcaaggaaaaatcgttaaacttgaacaacaaatgggtagaattgtagtgagtaatggcccgaatataatacataaaattcaattcatggatattttgaaaatcgaaacgcctagttaatttagctaggtgtttttatatggccataaattctttatcaaagtagaacttgtccattaagttgtttacaattccgttgaaataagcgaatttacccttgttcatttttgttcccgctttaattttcataacaaactctttgatagcttgtaagccaatagtaagttcctggtctttagtaaatgctttatcacctgttatatggttaacgattttattacactgtcttacgaccttccacagttcttgaattgttttagattcactgtaaaaagagccaactaaagaaataaaacgctctggtacccaatgagcaacaaagtcagcttgttccatattctcttctggagtattgctattctcattactattacgtttatttatatcttttatattttgttttaaggaaatagattttgttttattggtgtgacactttttttcatttttaacaggtgcttgtgtgacaacctgttcctccacaatgattggttgaataacaatagcgttacatgtttgtctcatatcgattttacgcttcatttctagctgtttaataatacctaaagactctaggtgtaggcatactctaataaccgttctacggctaatattaaggtcttcagcgatgtgttttttcgttctgaaagatacgccaaagaacttagaagaatagttgtgtaatttatttaatacagttaattgagttttgtttaactgatcggcgaatttctctttgtacgcccgaacagttttatttaattcatcaatagttttgaatgttgctagatttttatatgtttcattacctgcaataattgtaattccttgtttcttttccatagtggtttgtctcctttttggaaacaaaaaagcaacgtcaccaatttggtaaacgttgcttaatagaccctgcatgatgtaaaatagctcatgagagtatagcaagtgtttacctggcctaatcaggtggacggtatatagagtgttcgtagcactttacatacacgctgtgctcttttgttttgtgtagattttgcacgctgaaataattttgcatgaattttgcacgattacttctggaaatctaaaggagccttgatataaaagggatgttttactattagttcgaatccctctgggcgcgtcaaaaagtcctaacttacgttttgtaggttaggactttttttatttacctcttgttatatctagtaataagatttactattagtacttgataataatttttaattttattattttctttcaatattattcaaatttcggttgtaagttgtaaatctcattaatacatataaattaataatattttggaatgggtgtctgcgtgaggattctccttttaccaaacttattgtacaatagaaacaagggggagattagtttgaaggcaagtcttttacaagaacaaagcttacgtttggcaatgacacaagagttaaggcaagcgattacaatgctccagtataatgtacaagaattatcggagtttttgtatgagcaatcgttagagaatccccttattgagttaggtggttttgagagggagaagaaaaagagctctaacaacagtaaaagtaccagcaaacaagtcgagaatcagatggagatctacagtgtggattctacaacgattcagcaacatttattaaatcaaatacagtattataaaatagatgaagaagagcgaaaagtagcttctttcattattatgaacatggatggaaatggatatttacaagaaacgaatgaagagttagcagagctcctttctgcacatattcatgtagtcgaccgttctgtagagcttgtccaatcactggagccagcaggggtaggggcgcgtaatattcaggaatgtttaaccttacaattgaagcgcttacaaagacgtaatggattagcagaagaggttgtagaagatcatttcgcttattttgtgaagaaagattggcgaaagctcgttcaagtgttgaaatgtagtaatgaggaattgcagagtgcggtaaattgtataacgtcattacaaccaaaaccaggtcttgcgttttcttcagataaaccactttacattgtacctgatatggcggtgaaaaaagatggcgatcgcctcgttttacaaatgaatgagagaaatatgccgagaattgaaattcattctgaatatagtgcgcttcttaataatagtgaaagtgaagtagcatcttacgtatcagaaaagtatcagcatgtgcagtggattatgcgcagtttgaagcagagaaaacagacattgctgcaagtaatgactattattatggaaaaacaacgtgatttcttctggaaaggtccagagtatttaagacctctcgctttaaaagaggtagcggaagagttaagtgtgcatgaatcgacaattagtcgtgcgacgcgaaataaatatgtgcaaacaccacacggtttatttgagatgaaatcgttctttagcaatgccgtttcgacgactgaagatgaagcagtttctacaaaacgtgtaaaacaatttattcaaacgctaattggggcagaggataagaaaaagccactttcagatcaaaagatttcaaaattattagaagaagagcatgaaattgttatttctcgaagaacagtggcgaagtatagagaacaaatgcatatcccagcttcgtcattacgaaaaacgatcggataggtgaagaagatgaaagttgtactgtatactaaaaaagattgtggcctttgcgtgaaggcgaaacaagttttacaggaagtacaatgtgaatattcttttcaaatcgaggaaatagatatatatgaagataatgaccttttagaaaaatatcacttaatgattccggttgtagaaatggacggaaaacaagtagaatatggtaacattcacaaaggtgtcataataaactatataaagaatgcagttaagagttgaataagtttctatctcctgttacaataatacacgtagcagggattatttttttaacctatgtgggacacaaaatgtcactacgggacgtaaagtgaccacgagggaaaatgaaccgatgtagtgaggagaaaagatatgcgctcatggattcagaatacaaaaaaattattacctgatctgctacctgttatgcaaacgagaatgcaaattcttcaatacattaggctcatgcagccgattggaagaagaaacttatcagcaagtctcggtatgacagaacgagtattgcgaagtgaagttcaagttttgaaagaacaaaacttagttcacgtcgcttcttctggaatgactttgacagaagaaggaacagctttagttcttgctttggaagactttatgaaagaaatttccgggttaaaggttttagaaaagcaacttaaggaaacattagacttggatgaagttttcgttgtccctggtgatagtgatgaatcaccttgggtcaaactggagatgggccgtgcttgtgtgacttgtataaaagaccgtctgacagcgaataatatcgttgctgtggctggaggaactacgctagctgctgctgcggacatgatgcaacttgattgcaaagatttacatatgctatttgtcccagcacgtggtggaattggagaaggtgttgaattagaagccaataccatttgtgccaagatggcgcaaaatacgatgagtaattatcgcttattgtatgttccagaccatgttagtagcgaagcatatgcgtctattgtgacagagccttccgtgaaagaagttcttgagttgattcgatcttccaatatcgtcattcatggaataggtgatgcgttaacaatggcacgtcgcagaagtacttcagaagcagattggttaaagattcaggcaagcgaagcagttggcgaagctttcggttactactttaatgaagaaggaaatgttgttcataaagtaagaacggttggtatgcaactagaggacttacaaaatgtatctcacgttgttgcagtcgctggaggttcttcaaaggcaaaagcaatacaggctgtaattaaacaagggcacacttcaattctaattacagatgaaggtgcagcaaaacagttaacaaagggttttaccctttaatataatcccccaaggaggaaattcaaatgactaaaattggtattaatggatttggacgtatcggacgtaacgtattccgcgcagctcttaacaactctgaggtagaagtagtagcaatcaacgacttaacagatgctaaaacattagctcaccttttaaaatatgacacagttcacggaactttaaatgcagaagtatctgctaacgaaaacagcatcgttgttaacggtaaagaaattaaagttatcgctgagcgtgacccagctcaattaccatggagcgactacggagtagaagtagtagtagaatctactggccgtttcactaaaaaatcagacgctgagaaacacttaggtggatcagttaagaaagttatcatctcagctccagcttctgacgaagatatcactgtagttatgggtgttaaccacgaacaatacgatgcagctaaccacaacgtagtatctaacgcttcttgtactacaaactgtctagctccattcgctaaagtattaaacgaaaaattcggcgtaaaacgcggaatgatgacaacaattcactcttacactaacgaccaacaaatcttagacttaccacacaaagatttacgtcgtgctcgtgcagcagctgaaaacatgatcccaacatctactggtgcagctaaagctgtagcattagtattaccagaacttaaaggtaaattaaacggtggcgctgtacgtgttccaactgctaacgtttctctagttgacttagttgttgaacttgacaaagaagtaacagttgaagaagtaaatgcagcattcaaagcagcagctgaaggcgaattaaaaggtatccttggatacagcgaagagccattagtatctatcgactataacggatgtacagcttcttctacaatcgatgcattatctacaatggtaatggaaggtaacatggttaaagtactttcttggtacgataacgaaactggttactctaaccgcgtagtagacctagcagcttacatgacttcaaaaggtctttaattcttaattatataagttatcaatgacaaaacgagggagagggtttgttccctctctctcttctttcgttttaaaagcaaatgtgttaagcttttgagtgggttttgtcaatcctaactagtagtcggagggaaatccaatgaacaaaaaatcaattcgtgacgtagatttaaaaggtaagcgtgtattttgccgcgttgatttcaacgtacctatgaaagaaggcaaaattacagatgaaactcgtatccgtgcagctcttcctacaattcaatatttagtagagcaaggtgcgaaagttattttagcaagtcacttaggccgtccaaaaggtcaagtagtagaagaaatgcgtttaactccagtagcagcacgtttaggcgagcttcttggtaaagacgttaaaaaagcggacgaagcattcggaccagttgcacaagaaatggttgcagcaatgaacgaaggcgacgtattagttcttgaaaacgtacgtttctatgcgggcgaagaaaagaatgatgcagaacttgcgaaagaatttgcagcacttgctgacatcttcgtaaacgatgcattcggtgcagctcaccgtgctcacgcttctacagcaggtatcgcagactacctaccagcagtatctggtctattaatggaaaaagagttagatgtacttggtaaagcactttctaacccagaacgtccatttacagctatcatcggtggtgcgaaagtaaaagataaaatcggtgtaattcgtcatctattagacaaagtagataacttaatcatcggtggtggacttgcttacacattcgttaaagctttaggtcatgaaattggtctatctctatgtgaagacgacaagatcgaactagctaaagaatttatgcaacttgcaaaagaaaaaggcgtaaacttctacatgccagttgatgttgtaatcactgaggaattctctgaaactgcaacaactaaaatcgttggtatcgactctatcccttctaactgggaaggcgtggacatcggtcctaaaacacgtgaaatttatgcagatgtaattaaaaattctaagcttgttgtatggaatggaccaatgggtgtattcgaaatgactccattcgcagaaggtacaaaagcagtaggacaagcattagcagatgcagaagatacatactctgttatcggcggtggtgactctgcagcagctgttgaaaaattcggtatggctgataaaatgagccacatttctactggcggcggtgcgtcattagaattcatggaaggtaaagagcttccaggtgtagtttgtcttaacgacaaataagtagcagccaaagaaaaaggacggtgcaaagcatgcgtaaaccaattatcgcaggtaactggaaaatgaataaaactctatctgaagcagttagcttcgtagaggaagttaaaggtcaaatcccagcagcttcagctgttgatgcagtagtttgctctccagctctattcttagagcgccttgtagcagcaactgaaggaactgacttacaagtaggtgcacaaaacatgcacttcgaaaaaaatggtgcattcactggcgaaattagcccagtagcacttagcgacttaaaagttggctatgtagtacttggccactctgagcgtcgtgaaatgtttgctgaaacagatgagtcagtaaacaaaaagactatcgcagcatttgaacatggtttaacaccaatcgtatgttgtggtgagactttagaagagcgcgaaagcggaaaaacatttgatctagtagcaggtcaagtgacaaaagcacttgcaggtttaacagaagagcaagttaaagcaactgttatcgcttatgagccaatctgggctatcggtacaggtaaatcttcttcttctgcagatgcaaacgaagtatgtgcgcacatccgtaaagttgttgcagaagctgtttctccagaagctgcagaagctgttcgtatccaatacggcggtagcgtaaaaccagaaaacattaaagagtatatggcacaatctgacatcgacggcgctttagttggcggtgctagcttagagcctgcttcgttcttaggtcttctgggggcggtaaaatgagaaagccaacagctttaatcattcttgacggtttcggacttcgtgaagaaacttacgggaatgctgtagcacaagctaagaaacctaattttgatggttactggaacaaattccctcacacaacgcttacagcttgtggcgaggcagtaggtcttccagaaggtcaaatgggtaactctgaggttggtcacttaaatatcggtgctggccgcgtagtatatcaaagcttaacacgcgttaacgttgcaattcgtgaaggcgagttcgataagaacgaaacttttcaaaatgcaattaaaagtgtaaaagaaaaaggtactgcacttcatttattcggtttactttctgacggtggtgtgcacagtcacatgaaccatatgtttgctcttcttcgcttagcagcaaaagaaggcgtggagaaagtttatatccatgcattcttagacggccgcgatgttggaccacaaacagcaaaaggttatatcgatgcaacgaatgaagtaattaaagaaacaggagtaggacaattcgcgactatcttttggtcgttattaccttat

SEQ ID NO: 1263 - DNA, 3826 bp, Bacillus thuringiensis
tgagtcactcatcatgaagattgggttgcgtttattcaaggatttcatcagttttccttggataacatcttttgcattactccaaatagagataacgcgatcgtaacgttcttcttccgtgattaaaccgcgacggaattgtttaattacattatctacttttgcttgtgcttcgtggagaatttcatctttttcgcctaatacaagaatgtcagataccccaactgtaataccagcttttgtagagtacttgaatcctaagtttttcatacggtcaagcatgcgagacgtttctgtaatttggaaacgtttgaatacttccgcaatgatgttaccaaggattttcttgctaaatggcgccacttcttcgcgactagcaataatttctttaatgttcgcacctttttcaacaaaatatttcgctggtgtttctttttcaaggtttgaatttgttggttcattaatataagggaacgactctggtaagatttcgttaaatattaatttaccaactgttgttaatagaagcatactcttttgctcttcagtaaatgttgcgttgtttactgcacttgcagctactgcaacacgtgtatgaagatgaacatatccattttgatatgcaagcaatgcttcgtttgcatctttgaagaccataccttcaccgattgcaccttcacgctcaagtgttaagtaatagttacctaataccatatcctgagatggagtaacaactggtttaccgtctttcgggttcaagatgttttgtgccgctaacataagaagacgagcttcagcttgagcttctgatgataaaggtacgtgaacggccatttggtcaccgtcaaagtccgcgttgtatgcagtacatacaagtgggtgaagacggattgcgcgaccttctactaatgtaggttcaaacgcctggataccaagacggtgaagtgttggtgcgcggtttagaagtactggatgttctttaatcacagactctaaaacgtcccaaacttcaggttgtacacgctcgattttacgtttcgcactcttaatgttatgtgctaatcctttttcaactaactctttcattacgaaaggtttgaacagttcaagcgccatttcttttggtaatccacattgatacatctttaagttcggtcctacaacgattacagaacgaccagagtagtcaacacgtttacctaataagttttgacggaaacgtccttgtttacctttaagcatgtgagatagtgattttaatggacggttacctggtccagtaactggacggccacgacgaccattatcgattaatgcgtctacagcttcttgtaacatacgtttttcgttttgaacgatgatgcttggtgcacctaagtccaatagacgttttaaacgattgttacggttaattacacgacggtataagtcgtttaagtcagaagtagcaaaacgtccaccgtctaactgtaccattgggcgtagttctggcggaattactggtagaacatctaagatcatccaagacggttcatttccagagttacggaatgcttctaatacttctagacgtttaatagcacgagtacggcgttgtccttgtgctgtttttaattcttcttttaagaagtctacttctttatctaaatcgatgtcttgtagtagctttttaattgcttctgcacccatagcagcttggaatgtgctaccatatcgatcacgatatgcacggtattctttttcagaaagtaattgcttcttatcaagtggtgtatctccactttctgttacaacataagaagcgaaataaattacttcttcaagcgcgcgaggggacatgtctaagacaagtcccatgcggctcgggatacctttgaaataccaaatatgagatacaggagcagctaattcgatatgacccatacgttcacgacgtacttttgcacgcgttacttcaacgccacatcgatcacaaactacacctttataacgtacacgtttgtattttccgcaatgacattcccagtccttttgtggtccgaaaatacgctcacagaacaagccatctttttcaggctttaacgtacgatagttaatagtttctggtttcttaacttcaccgtatgaccaagaacgaatcttgtcaggtgaagcaagtccaatcttcatatattcaaagttatttacatctatcaaggggcctacctcccttttagtctacaggttatcccaattattccttagttgtctcaacttcgacattcaatttatctgctgattgatgatcatcgtcatcttctgtatcacgcatttcaatttctgtatcgtcgctagacatcattttaacgtccatacctaaactttgcagctctttaatcaatactttgaatgattcaggaacgcctggttctggaacattttcgcctttaacaattgcttcataagtcttaacacgtccaacaacatcatcagacttcactgttaagatttcttgaagagtataagcagcaccgtaagcttcaagtgcccaaacctccatctcaccgaaacgctgtccaccgaactgagctttacctccaagaggttgctgcgttacaagtgagtatggtccagtagaacgagcatgaagtttatcgtcaaccatgtgcgcaagtttaatcatatacatgacaccaacagatacgcggttatcgaatggttcaccagtacgtccgtcatacaggattgttttcgcgtcatttgccataccagcttcttcaattgtgccccaaacatcttcctcacgagcaccatcgaatactggtgttgcaatgtgaatgccaaggtatcttgctgccataccaagatgaagctctaatacctgaccgatattcatacgagatggtacccctaatgggtttaacatgatatcgattggcgtaccgtctggtaagtaaggcatatcttcttctggtaaaatacgagaaataacacctttgttaccgtgacgtccggccatcttgtcaccttcagaaattttacgtttttgaacgatatatgcacgtacaagttgattcacgcctggtggcaattcatcgccatcttcacggttgaatacttttacgtctaagataataccgccaccaccgtgtggtacacgtagtgatgtatcacgtacttcacgcgctttttctccaaagatagcatgtaatagacgttcttcagctgttaattctgttacacctttaggtgttactttaccaacaagtaaatctccatcttttacttcagcaccaacgcgaatgataccgcgctcgtcaaggttacgtaatgcgtcttccccaacgtttggaatgtcacgtgtaatttcttctggtccaagtttcgtatcacgagcttctgattcatattcttcaatatgaatagaagtgtacacatcatcttttacaaggcgctcactcatgatgatcgcatcctcgtagttataaccgtcccaagtcatgaagccaacaagcacgttacgtccaagtgctagttcacctaattccatagaaggaccatccgcaaggatttcaccttttacaacttcatttccaacacttacgattggacgttggttgtaacaagttccttggttagaacgaatgaatttttgcattttgtagcgatctaagtcgccttttactgtttgaccgtcaacttctacatagcgacgtacccaaacttcacgtgcttctacgcgctcaacaacaccaggatgtttacagattactgcagcacctgagtcttttgctgatacgtactccatacctgtacctacaatcggagattccggattcattaacgg

SEQ ID NO: 1264 - DNA, 7814 bp, Bacillus thuringiensis
caatttctttttgtcgttttctgcgtttccgcatcagcgacggttattaatttaacatatacaaactattaacgtcaacactttttaataaaaaattctttttcttacataacgaatacattcttctgtgttagctactctccggaataaacagaaaatgattttatatctttcttccatggctttttttacaacttcatgaatacgctcatcttcaaaatcaaataaaagttcctctaattctctcttcaatatgtattccatttcttttctctcttcttttgtcaacatcagcccaagcaaacaatcacctcaataattccttacgcaacaataaacgttccgctcattttcaattatcacaatcctatcatccattatatccactacttacgatattaatcctttgttctcttttttatatttacagcatatatgtaactgaaaaggattggacaaaggggcgtaatattatgtttttcttttttattacgagtaagagaaattttaaacacattagcttaatagtgatactgtccttatttacagcatggctactctttttaaaaacatattcacatgaatctgctttttcaactgctacaggccctaaagtaatttacaaaggagacaccgctaaaaagcaagttgcatttacgtttgatattagttggggagacaaaaaagcaattccaatcctagatactcttaaagaaagagaaattaagaatgcaacattcttcctttctgctgcatgggccgaaagacaccccgatattgtagagcgaatcatgaaagacggacacgaaatcggtagtatggggtacaattacacatcctacacttctctagagacaaatgaaataagacgagaccttttacgagcacaagatgtttttacgaaacttggtgtaaaacaagtcaagctgttacgtccacctagtggcgaatttaacaaagcaacccttaaaatcgcagaatcacttggatacaccgtcgtgcattggagtaataattcaaacgattggaaaaacccaggtgtaaataacatcgtttccactgtctctaataatttgaaaggtggagatatcgtcttattacacgcatccgattctgcccttcaaacaaatagagctttaccgctgctcctgcaaaaaataaaaagtgatggatatgagcaaatatccgtatcacaacttatttccaacacaagtacgaaaagtgaagatgtgaagtagcttcttccctaccactcttcacgcataaaaagctctactacctttcaagaaggtggtagagctttttgaatcataccatttccagcattataactgctggtgtataaaatctctctattaagctgatttacttgtttttccgattaaacgatgtaatacaagtaattgatatgcgttacataacaatagcggtataaccattaaatataaccaatctgtatcattaatccgaagcgctggtacccattcaaggatcgttacaacaaccataaagaacagagctggcacaaatgcttttttatttgtttctttgctttttacataagcaacaattgctccaaacacaaataatattccagcaacaagtatgttattccctaacgagacttccccatttgcaataagtacagatcttaaatacacaaaatcaaataatacgaatgcaataaagaagagctggactgcattccataaagaagatgagcggaacatccctagtccaaaacggtggattgttaaatatgcaaagaatcccatttgacttataacactaaaaataaatcctacacccatcagccagaaagatactgctaaaatctccttaccgtcgaaattttgaaaaaattcattgtacttgtcccactccaaaacaaaaccaataataactgtgctaattccaccaagaaacaacgtcgttaaaaatagtcgtacccacttgcggctattcacaacacatcccccattatccttatatttctaattaaattgtatcaatgacaatttcaaaaagctagccatgttcatgtataaattccttaaagatatttatattaaaaagagagaactgtgctgaaaggagttccaacttatgaaacggatgctattcattttcgtttcttcttttctacttatcgcacttgcagcatgcgcacaaggaaaagaaacgaaatccgaactagattacgatcaaacaaagaaaatgattgttgatattttaaaaacagatcaaggtaagaaagctattcaagatgtattaactgatgaaaaaatgaaacaagcactcatactagatgaaacagtagtaaagaaaacgattgaagatgccatggtatccgataaagggcaacaattctgggaaaagctctttaaagatcctgagttctcatcgaagttcgctaaaagtatggggaaagaacaaacccaattaatgaaaaccttattaaaagaccctgaataccaagcaggcgttatagaaattatgaaaaatcctgaagtagaaaaaatgatgttacaaacaatgaagagtaaagaataccgtcaatatctacaacaagtactaacagaaactgctgaaagtccactcttccaagccaagatgattgatatcattagtaaaggtgtgcaaaaagctgaaaaaggcggatctggtaagaaagaagcaggcggtgacggtggttctcaaggcgggaagaaggaagaatagtaaaaaataataactataataacgagtggacaatttatacattgttcactcgttattactttatcttgctattaacagacgaaatggcaccctctagttaagcgaaaggtttactagcaacaaaagccttattgttgtcagtaacaggtgaaccccactgattaaagtttcactttatttttgtgtaacagctgttctatcaattactgtttcagctattttactataaataatgcccgttgtatgtgtatcttcatatactgaaggagcaaagtcttctttattccaatcgggttgttgtagcggaatgcgaccaagaacattcgtttgtaattcggtagctaacttatctcccccgccttttccaaatacatattctttctcaccagttaccttactttcaaaatatgccatattctcaacaacaccaagaatactatgttcagtgcgcaatgccatcgctccagcacgcgctgctacaaacgcagctgttggatgaggcgtcgttacaataatctctttgcaagatggcaacattgagtgcacatctaacgcaacatcacctgtgcctggtggcaaatctagtactaaataatctaaatcgccccattctacttctgtgaagaagtggtttaacattttcccaagcataggtcctctccaaataactggtgcattatcctctacaaagaagcccattgagattacctttacacctaaacgttccaccggaattatcttgtcacctcttacgataggacgtttttctatccccatcatgtctggcacactaaaaccgtaaatgtccgcatcaataataccaactttttttcctaaacgagctaaagcaactgcaaggttaacggaaacagttgattttcccacgccaccttttccactcgctactgctaagaatgttgtttttgaattaggtgacaataaagattcactttgctcttcttcttgttccggtgcaaactgagctaattcctcttctgtaaattctgcaaaacgaagtccaactgttgctgccccaagttcttttactaactttacaattccagactgcaactgcatttgttccgctgtaccggtttttacgattgcaattttgacactcacatgttccttctctggcttgactgttacctctttaattgcacttgtttcttttaatgttttatgtaaaaacggatctacaatcccttctaacgcttcaaccacttgctctttcgttatcataattagcccagccccctgtatgaaaaataacgtaatgttaattgaatttatctctgcttatccttgaaataaatgcgtttacatttccagtataacatattttccgaaaacttcgttaacgagagaagctcaaaaaaatcctccttattctggaggatttcctttttccgtgaaataacgtaatataccacggtatattgcagctgctaccttttgctgatatttctccgaatttaacatatacctttcgttcacattcgataaaaagccagcttcaattaaagcacctggtgttttagaatactttaataaatatacatgcgaaattgtcttagcagaacgattcgtgttttctaaacttgttctcaattcagcctgtataaattttgcagcacgttcattttcaatcgaagagcggtaatagaacgtttgtgcgcctttcgatccactactagttaaagcatttaaatgaatacttgcaaaaaagtctacatcaggtttattgatgatttctacacgtttttttaaatcctctgctttacgtctactatatgactttgtatctttgttagctaaatcataatctccctcacgcgttaaaataactagtgcaccttgttcttgtaaatagtcttgtaccttttttgtaatttcaagcgtaatatccttttctataatatcctttccaccaacagcccctccatctggtccaccatgcccagcatctaatacaattactttccctgataagggtaaattccaagctcgccacgattttgtaatttgaaattcttgtttaactaaaaaaaacaatacaaccgcagcgagtgcaaaagagataattcgaattctcttcatacctttcctcctccagctagtccctctaattacttatatgggacaagaggaaagtttatgcttgtcttaatgaagctttaatcgatatcttctttcacctttttcatacccttcttgccaccacaatcctataaactgctgacaagattcaaaaagtaattcctcatctttcaactttatttctcgcatagtcatactcgttaaaaattgaaatagcgtttcagttaattgttgttcttcttctaaagctctatatttcacatcaaaaaacgattcaccataataaccaaatttactgtatctcgctcctaataaataagattctatccctaattcaatacagtaatcttcatactgacgatgaagctcttgcatttgaaaggcatcacgaatatttgaacgcaatgtttttaatgataattcccgcaacatcttccgctcgtattttaactgcttttcattctgtttttcttgtaagctgacaatgacattcatagtacttataaacctccctaatacgtattagtctaaacttctaaagaagaagcatacgcgtggcggtagcactaaaatattccaagctataaaaattgcaaaagaggaatgaaacataaaaaaaccccaaccaaaatggttggggtttgtagttcgcaaaaattaacgttttgagaactgaggtgcacgacgtgcgcctttaagaccgtattttttacgctctttcatacgtgcgtcacgagttaatagacctgcacgttttagtgttagacggtattctggatcagcttttaataaagcgcgagaaataccgtgacgaatagcaccagcttgaccagtgtatccaccaccatttacgtttacaagtacatcgtagttacctaaagtttctgttgcaactagaggttgtttcactacttcacgtaatgcagcaaatgggatatagttttcaaaatcacgaccgttaatgataacgcgtccttcgcctggaactaggcgtacgcgcgctactgaactcttacgacgtccagtgccatagtattgaacctgtgccaaagtaagccctcctttaattaattatccgcgaagttcgtaaacttctggtttttgtgcttggtgtggatgctctgctccagcatacacgttaagtttcttagaaacttgacggcctaagcgtccttttggaagcatgcctttaattgcaagctctaacatttgtacagggtagtttgtacgcatttcaagagctgttctttgcttaagtccacctgggtggttagtgtgacggtagtaaattttatcgtttaatttattacctgttaaatgaattttctcagcgttaataataattacatgatcacccgtgtcaacgtgtggtgtaaatgtaggtttgtttttaccacgtaaaatggatgctacttcactagcaaggcgacctaaagtttgaccttcagcatcaaccacataccatttacgctcaacttcgttagcttttgccataaaagtcgtacgcatgtgtttccctcctcgttatcttttccatagaaaaaatctattgtttatcttaaacacgatttccttccggggctaatcgtggttttagaaacaataccatatgttatgatatacttttgagtttctaatgtcaagcaaatgttacaccaggattagttgttatagtttacctcccataagtaaagcccatgacctggagccatctttccagcaaactgacgattttgtttcgctaaaatctctggaatgctatcaggatcaagctttccttgccctacgctaagtaacgtaccaacaataattctgaccatattatataaaaatccattacctacaaaacgaaaaattatttcatcattttgttcaattaactcgatttcataaattgttcgcactttatcttttttgtcagtttttgccgaacaaaaagaagtgaaatcatgtgttccaataaaataaggaattgcttttcttatagagttgatttcgagcgggtatggatattgatatacgtaatttctacggaatacatccgcagtctttgataataatacacgataacgatattcttttttctcaacaccgtaacgtgcatgaaattcttctgtttttttctctacttgcctaataacaatatcatctggcaacattgtgtttaaagcattaatccattgccactcttcaagagacaaaggagtatcaaagtgtattacttgtccttttgcatgaactgtagaatctgttctaccagatgcctgaacacgaacaagttctcccttatgcaatttctgcaatgctttttctatctcctgttgaacagtacgatggttcggctgaatttgataaccacaaaaatgcatgccatcatatgcaaccgtacattttattctatccatttctctattctccattacgatcgcacccatgccaaaatacaagctaaacaaaataagctgacaatcgttactgtatcgctttttttccagcgtagttgcctaaatttagtacgtccttcaccactttgatatccacgagcttccatcgcaatggctaagtcctctgcacgcttaaaagcactgataaacagaggaacgagcagtgaaataatagctttcattctatcttttatcggtcccccggcaaaatcaataccacgtgacgcttgtgctttcattattttactcgtttcatccattaatgtcgggataaaacgaagagaaattgacatcattaatgcgatttcatgaacaggaacctttatacgcttcaacggctttaataacgtctccaaaccatctgtaatttcaataggtgtcgtcgttaacgttaataatgtcgtcattaaaataataacgaagaatcgtacagaaatgtatatcccttgctctaatcctttttcatatatcgaaaaccaaccaagctggaatagtacatccccctccttatttgtaaaaatatgcaggaaaaatgtaaaaagaaaaatc

SEQ ID NO: 1265 - DNA, 7623 bp, Bacillus thuringiensis
tacccatcagtaaacatgcatttcaccaatggatatataaattaaatctattactctacatctaaaccaaagttattacatagagacgctaacccaccttggaatccacttccgattgcattgaacttccaatcacctgcatggcggtataattcacctactactaccgctgtttcaatagagaaatcttctcctaaatcgtaacgaattaactctgcattcttttcttcatcgagaatacgtacgaatgagttagaaacttgaccaaagttttggctgcggccttctccatcataaattgtaattgtgaaacaaatacgttcgatgtgagcaggaacattttttaaatcgattttaatcgcttcatcatcgccttcgccttcaccagttcggttatctcctaaatgctctacagcaccattcgcacctttgggattattatagaaaacgaaatcttctgctcctgaaactttaccgttcgcacctactaaaaagatactaacatctaaatcgaaatcagcttgtccatcataacgatttgtatcccagccaagccctacaagtacctttgataaacctggatttgtttttgttaaatctaccttttgtcccttttttaaagaaatagatgccatttaaaaattcctccttagtttatcctattgataacgtgatacaatctcacttaagtttttatcttgcgtgccttctccaactgctgaaaacttccactcattttcgtagcgatacatttctcctgcaattaaagttgttttactagcatagttttctgataaattataacgtgctaattcctcacctgtatgaggattttgaatacgaatataagcgttacgaatcataccaaagtcttgacgtctgtttacacagtcataaatatttacaacgaatactaaacggttaatacgacttgggactttatgtaattctacaaagattgtttcatcgtcaccttcgccttcacctgttaaattatctcctgaatgaataatactaccacaagtagaaagtttgtttccgaagtaaactaaatcatttttgtttaaaaaacgatctccttctaacataacaacagatgcatcacaatctatatttggtttacttccaaataatgaagacagaaatccacctgattgcccaattggatcccagcctaagccaacctgtagttttgctacttttggttgtcctttcgttaaatcgatcttttgacctttttctaaaataataggcatgaagtttctccctttctacaaagcattttccatatcggaaaatattgtattcttctcttatattgtagcattatttacctattgataaaaaggataaattctcagttatatgaaaacattcatataatttacttatgatgatgtaataagtggtaaatagcaccaatcattcctgcacaattaccgttttgtgcaagttcaatctcacaattattataaatctcttgatttaagtatttactgacctcttcttttacttcttttaaaaactcatttcctctatcggtaattcctcccccaataataattgtttctggattaaaaatataagcaagattactaattccgattgccaaatgtttaaagaaaatcccaactgcttgagcaacttctctatctcctttatcatacaactcaaaaattgttctcccattccactcgcctttgcctttatattttcttacaagccgaattaatcctgaaatcgaagcaacctcttcaaacgtttttccttctattagcatattcccccattcaccagcactaaatgaatgtcctcggtacaattctccatctataaaaattgctcccccaactcctgttccaatggtgagcataataaagttctctttctctcttacactaccattccacttttctccaaacgctgcacaattcacatcattgtcaatcgatactggaacttttaatatctcttgcaatctatcaataataggaatagtactatatcccggaatatgatccgcgcctcccgtcacaattcccgcagtgctaataccaattccggcaatagtatgttcattcattaatttttttgataaaagaatgagtttttgaataatttgttctccgcctaagtgaatttctgttgcaactgttttacgctttaatactctccctgcttctgaaataatgccatacttaatttgcgtaccgccaatatcaaacgctatatactttttcatctactgccacttcctctaccgttatgaatgtaaattctccacctctattatttgtaggaaatctacattaactcttttctgctttgacaaatataccacctttttctatatatagttttttttgcataaaactctttttcctaagaaatattacaaagggatgtattttagatggaacattcatttcttaggaggaaaaccatgacgaaaatcttcattttagcatcaacactctctctatctttttttagcggtttaaatatcggtaatgctgcaactgaaaacttccaaccattaacaaacgctattgtacaaaatagcgatcattttgcagaaggaaactcaaaggataataataaacctccaggaaataacggttctcaggacgatagtggttccggtggcagcggctctggtgaaaacggttctggtgaaaacggttctggtggctttggcggcaacagttccggcggtaacggttctgatggcagtggccctggcggcaatggttccgacgataacggttctggtggcaacggttctagcggcagtgattctggcggttctggcggcaacggttccggcggtaatggttccggtggcagtggccctggcggcaatgactctggtggcgatggctctggtggcaacggttctagcggcagtggttctggtgaaaacggttccggtggcagtggttccggtggcagtggttctggcggtaacggttctggtagcaacggctctggtggcagcggctctggcggcaacggttccggcggtaatggttccggtggcagtggccctggcggcaatggttccggcgataacggttctggtggtaaccgttctggtagcaacggctctggtggcagcggttctggcggtaacggttctggtggtaaccgttctggtggcgatggttctggtggcagtggctcacacggcggtaatggctctcaaggtggcaatcgtgttaaaggcgatagcaattctcaggagggcaacggttctcaagggggtaatgtaaaagataatacgaaaaaacaaggtgataaattaccgaataccgcaacgcattaccctatatctattttaatgggtctttcaatattcctaattggtatgttactgtttattcgtcgtaaaaacgtaaaataagagcaacatacttccatctaaagaatacatgaaatactttataaaactaaaaaggactttggattgcattttattatgcagcccaaagtcctttttatcacctatcagaaaaagtattaatacgcttttccccaatacaccatttgtttagcttctttaccacaacaaatgcattcttcagctaaatgctcttgctcaaaaggcatacaacgtgaagatactccaacttcttcttttagtttttcttcacaagctaattccccgcaccacattgccttaataaagccttgcttttcgtcagctatttttttcatctcttcgaaatttgtcgcaacatacgtattctcatcgcgaaatgcttttgctttatcaaataaagcaatatgaatttcttcaagtaatgctggaatacgttcttctaattgatccattggtacaaactctttttccttcgtgtctcttcttacaagtacaacttgattcttttcaatatctttagggccaacttctaatcgaattggaatccccttcatttcatactcattaaatttccagcctggtgttttattactagcatctatttttactcgtgcaaccttttgaatatgttcttgtaactctattgcttttgctaaaactccttctttatgctgagcaatcggtacaataacaacttgcactggagcgacttttggtggcattacaagtccattattatcactatgaaccattattagcccgcctatcattcttgttgatacaccccaagatgtttggtgcacatattgccacttaccgttacgatctaaaaacttaatatcaaatgcttctgagaaattcgtgccaaagttatgagaggttcctgtttgaagtgcttttccatcatgcattaaactttcaattgtataagttgcctttgctccagcaaacttctctttttctgttttttgtcctttaataactggtattgctaaataatcctcacagaaagaagcatataagtttaaaatatttaatgtttcagcctgcgattcttctgccgtttcatggattgtatgaccctcttgccataaaaattcagtcgtacgaaggaacggcctagttgtcttctcccaacgaactactgaacaccactgattatataactttggcaaatcattataggattgcacaatttttgaaaagtgctcacagaataaagtttcagatgtaggacgtacacaaagtctttccgctaacttttcatctccaccatgcgtaacccatgctacttcaggagcaaatccttcaacatgatccttctctttttgcaataaactctctgggataaacattggcatatatacattttcatggccagttccttttaacttctcatccatcaccttctgcatattctcccataaggcatagccatacggacgtaaaatcatgcacccttttacacttgaataatcaacaagttcggctttttttacaatatcggtataccactgcgcaaagtcctcttccatcttcgtaatggcttgcacttgttcttttgccatagtcagtcttcctccttctagaaaatacaaaaaagcccgcgtccctaaatagggaccgagctttgccggcgttaccaccctgattcatgcacaaaaattgcgcatgctctctttttgataacgggaaattcccgctgcatatgcagaactcaaaggcaggttccatattgcctttttaagaatctttcagcctgacggattctctctctgctaaaaaggttgaacatgtactagtcctttttcatcgttataacgaaataaatttgttgattatcataatacaaattcttttttaaaacaatagctaattttcttatttttatatatccttttcattttttgtagttttatacgtagcttttccgcgtaattttcacaagttgatgtgcaatcataccgataagtgtaccaattaggacgaagaaaccaataaatccatatcccattccttcccacccaccaataaccatcattgtaacgggaaaggacgctaagcaaagaagtattaaactaagtgcaaatataatatcaaactgtttgtctggaaaccgtttctttagtaaatatgaaatagtaaatacaaggataatcgtgattccgccaatgatgtaaaaaataccaaatccatctaaccaatccatagtgttccctccctccatagattcccttatacttaattatatgtttaatttttctgaaaataaataataaactttcacctaaatatatgtatttattactaggtgttaatagtaatatataataataggttttatataatcaggagggaactttatggataaagcattatcaaaccacgtcatcattttatcattcgactgtttatcagctttagattttcctatactacaaaaactacctcatttccaatctctaataaaaaagggcacggttgtcgaaaaagtagaaccaatttatccttctgtaacatatccaagccactcaacaatcgtaactggtaattaccctaacaagcacggtgttgttagcaatacgttacttcaaccagggcgtgaatcacctgattggcattggtaccgaaaatcaataaaaggaacaacattgtatgatgaagcgcgcaaagcaaatttaacgacagctgcccttctatggcctgttactggaagagcgaacatcgattacaatttaccagaaattttccccaatagaccttggcaaaatcaagtgttagtttccttatttagcggtagcccactataccaattagatttaaatcgtcgtttcggccatataagaaatggtttatcacaaccagagctggatgatttcgtcctcgcctctgctgtgcatacaatccagacgaaaaagcctaatgtcatgttcgtacatttcaccgatctagacacacaaagacactatcacggctttgaatctaacgaaacaacagctgctatccagagacacgacgaacgtctagggaaaattattcaagcactaaaagaaagtgacctatacgaagaaagtacaattattgcccttggtgatcatagcgctttaagtgaaaacaaatccatccaattaaatgtgctattccatgaaagaggacttatatctcttaataaaaaaggaaaattagtagactggaaagcctattgccaaagttgcgacggctctgcctatgtatatgtaagggacaaaaatgatacggatacaatccgggaggtacaactactccttgaagaactacttcaaaataaacaaaacggaattgaatttatacttcatgatgaagctgccaaagactgcggtgcagacgttaattgtttattcatgttagaagcacaagaagggtattatttctctgaaaactatacaggagattttataaaagaaattactgaaaaagatgttacgcctagtaaaaaatatacatttggtacgcatggatactctccaacaaaacctaactatgaaacaatttttatcgctgctgggaaaggaataaaaagtggctttaccgtcccgtatatgagacttattgatgaaggtccaactatcgctagactactcggtttacacttaggtgaaacagacggagcaattgtagaggatttactccaattgtaaagaactgtgtatatatgtaaaagttatgtaaaattcatcactgtttctctttttataatttttatttttgtacactgttagtaaaacaaatttaagggggaacattatatgaaaaaaatgtccagacaagaaaaaagctggatattatacgattgggcgaactctgtatactcgctcgtcattacaactgcattatttccaatttactttaaagcagctgcaaaagaagctggactatctggggcaacttcaacagcatattggggatatgcaaactcattcgcaacacttttaatttctatacttgctcctattcttggcacagttgctgattataaaggatttaaaaaacgttttttcacattcttctttggactcggtatcgtatttacaagtatgttagcagtcgttccaacctctcagtggtacttattgctagggtgctatatgctcgccttaatcggctttgctggagcaaacattttctatgatgcatttttagtagacgtcacttctgaagatagaatggaccgaatttctacaagaggatttgcattaggttat

SEQ ID NO: 1266 - DNA, 7236 bp, Bacillus thuringiensis
cgctaagataaacatataaaagtgtcttgttctacccatgataaactcctctcttctcacttcaccattcaacagtttattttatcgaataattcgatatgactcaaggttaactttctgttatgtaatcaagttccacctttacaatgtcctcacatgctattgaaatgattgttccttgtttatcaatcgccgtcacttctctattatccattacacgatttgctactctttctaacacttttccttggtctcgatagcaaaattcttttacatctttaattgtttctccattttctaaatggtataccattctataacatcgatatcccacactttcacccccgtcttgttcgttttttcacatatacataaaaatgagtaatctttgcctcatcacatcttcttaatttcaataaaattctaacaaaaataaatacttttatcaaaccgactttttcaacaaaactacctataaaactacacctttacaccattaggaaacaaaaaacatatttttttaacattttcttcactatttctgcataaagtgaaactttaatcagtggggatttttgttcatccccactgattattagttgaaccaatcgggcatttacggacagtttatctcccacctgtcttctttgcagcagctaagttttaagttgagagtttactgtccgttaatgcgggacaaattatccatacaaaaaaagaacccgcctcagcgagttcttcttttgttattttaatcaaacttgtacaggagctggcttcgcataacgtaaaactggtttacgtgcagccatcgtttcgtctaaacgtttaatgactgtcgtatgcggtgcttcttgtacaacttctggattttcttctacttctttagcgatttgaatcatcttatcaatgaaaccatctaatgtttcttttgattctgtttctgtcggctcaatcataatacattcttccacatttaatgggaagtaaattgttggtggatgataaccgaaatcaagcagacgttttgcaatatctaatgtacgtacaccaagtttcttttgacgacgacctgataatacaaattcatgtttacaatgtctatcgaatggaagatcgtagaatggcgctaatcttctcatcatatagttcgcatttaatacagcatactcagttactgcacgcaatccatctggacccatagagcgaatatacgtgtatgcacgaacgttaattccgaagttaccatagaatggtttcacacgaccaattgcttctggacggtcgtagttgaagtgataaccattttcggttttctctaaaatcggttttggtaagtacggaattaaatcagctttcacacctactggaccagaacctgggccaccaccgccgtgaggacctgtaaatgttttatgaaggtttaaatgcacaacgtcaaatcccatatctcctgggcgtgcttggcttaataccgcatttaagtttgcaccatcatagtataatttaccgcctgcattatggacgatttctgccatttctaaaatattttcttcgaatagacctaatgtattaggatttgttaacataagtgctgctgtttcttcgtttacaacacgttttaagtcttctaagtcaacaaggccattttcatttgattttactgtaattgtttcaaaaccagctacagttgcagatgctgggttcgttccgtgagcagagtcaggcacaattactttcgtacggttaaagtcaccattcgcttcatggtatgcacgaattaacattaaacctgtccattctccgtgtgcaccagctgctggttgtaaagtaacagtatccatacctgtaatttcaattaaatgctcttgtaagtcgtacattaattccattgcaccttgtactgtcttttcatcttgcaacggatgaatatttgcaaatcctgcgaaacgagctacactctcattaattttcggattatatttcatcgtacaagatccaagtggatagaatccagaatccacaccgtggttacggtttgaaagtgctgtatagtggcgcataatatcaagttcagatacttctggtagctctgcatcttctactcgaatataatcgctctcaaacacatcttctagtttcacttcttctacatctaatttgggtaagctatatcctatgcgtccttctttactcacttcaaagataagtgcttggtcttggttcttcattggatagcccccatttcgtttacaagtgtgtcaatttcctcttttgtacgaagctcagttactgctacaagcatatggttttcatgctctttataatcacggcctagatcgtaaccaccgataatattcttttgtaataatgcatcgtttacttctttcactggacgtttgcaatctacaacaaactcattgaagaatggtccagcaaatgttactgtgaagcctttcgcttcaaattgacgttttgcatattgtgctttagaaatgttttgacgtgccatttctttcacaccttgtttgccaagtgccgtcattgcaacagaagctgctagtgcatttaacgcttggtttgaacaaatgttagatgtcgctttatcacgacgaatatgctgttcacgtgcttgtaacgttaatacaaatccacgtttaccatctgaatctacagtttgtccaacaagacgtcctggaattttacgcataaatgctttcgttgttgcaaagtaaccacagtgcggtccaccaaactgcgttggaataccgaatggttgtgcatcaccgattacaatatcagcaccaaatttccctggtggtgttaatgcgcctaatgataatggatttgaagaaacgataaataatgatttttgttgatgaacgattttttcaatatcagctaatttttcaacttgtccgaagaagtttggatattgaacgattacacaagcaactgtatcatctacttcactttgtaatacgtctaaatctgttacaccatctttatgattaatttcaacaacttcaagattttgaccttttgcatacgtttcaagtactgctcttgattctggatgaaccgcgctagatacaagaattttctttttgcgagtatggccagctgctaacattgccgcttcagctaaagctgtccccccgtcatacatagaagagtttgctacatccattcctgttaattcacaaatcattgtttggaattcaaagattgcttgtaattccccttgtgaaatttccggttggtatggtgtgtaagctgtataaaattctgagcgagaaataacatgatctacaattactggagcataatgatcgtatacgcctgctcctaagaaagaagcgtattcttttaagttagcatttttactagccatttgagatagctcttttaaaagctctggctctgattttgcttctttaatttttaaatcccctttaaaacgaacactctctggaatatcagagaataattcatcgatcgtttgaacgccgatcgtttgtaacatttcttttttgtcttcttctgtcattggaagataacgatgcaacatgaaatctacccctctccccgttactttgaacgtttgtaaaatggtgttggaacaactactgctttgacgcgtttattacgaatttcaatttctacttctgtatcaactgctgcgtattttacatcaattagtgctaaaccaatgcttttctttaacgttggagattgtgtaccactcgttacttccccaattttttcttcaccaataaatacagggtaatgcgtacgaggaattccacgttcgattacttcgatgccgactaatttacgaggcgcaccgttttctttttgctcttttaacgttgcttttccaaagaagtctgcttctttatttgtttttaccgcaaagccaattccagcctcaatcggtgtaatatcttttgataattcttgtccataaagtggtaatgttgcttcgaatcgaagtgtatcacgagcacctaaaccacatgcttttaagccctcttctgctccaacttcaagaagtttctcccaaagttttgcagcatcttcactcttacagtaaatttcgaatccatcttcacctgtgtaacctgtacgagatacaagtgctggaattccatctacaagaatatcgtttttaaatttaaagaacttaatttctttcaaatcttctgacacaactttttgtaaaatgccttctgcttttggtccttgaattgcaagctgtgcaacttcactagaaacattgactactgtcgcatcgccaattacatgacttgctaaccattcgtaatctttctcgatatttgatgcattgattactaataaatagtcttcttcaccacgtttgtagattaataaatcatctactgtaccaccattttcgtagcacatagctgtatattgtgcgccccctacctttaaggtagatacgtcatttgtaacaacacgttgtaaaaatgctaaactatctacaccttttacttcaacttctcccatatgagacacatcgaacaaacctgcagctgtacgtacagcttcgtgttcttctttaatgcttgaaaattgaactggtaattcccaaccaccgaagtcgattgtttttccaccatacttcgcgtatacatcaaataacggtgtacgttgtaatgtaatcatgctctctcccccttatgctttgacaaatcaataaaagttgcttcccttttctaaacattttcattctgaaaagataggatatacggaatctcattatatttttttatgaaagcgtaaataaaaaatcactttcttggataaaatacgaaagattccacacatttcacaccattatcctaacatcattcgctatatttcatcaatattctagcataaaaaataatttagaattttttatgttaaaacacaataaatacagcttttgagatttaatactttattattgtctatcatatagcctttaataacgataattatgccttcttttaaggcaaatcatcatacattaaaaaataattactttagtttataaaaggtgggagagttgtaatgaatgtcgatatttccgtagatcggacatggcaaaacaattttttaaatagaattgacgaagatggtccttggacaaactgggatttatatcacttagcttatgaaacagaaaaatcgttacttgttcctacttttgatggactacaagcaccgaaacatttatcccatttcacaccgcttccgcatcaattagaagtcgctcaaaatgtgattgaacaaatgaacggtaaagcgattctagcagatgaagtaggccttggaaaaacaatcgaagctggacttattttgaaagaatacatggtccgcgggcttgtgaaaaaggtacttatacttgtcccagcttctctcgtatcacaatgggcatacgaactgaatacaaagtttttcattcccgctgtagcacaaaagaaaagctactcatgggaacaagctgacgtaatcgtatcatcaattgatactgcgaaacgttcaccacatcgcgatatcgtgttgaacttggaatatgaccttattattatcgatgaagcacataaactgaaaaataataaaacaaaaaactatgaatttgcacaacgattaaaaaagaagttttgtttattactaaccgctactcctgttcaaaataagattgatgaaatttttaaccctgtttctttattaaaaccaggacatttaggcaatcaatccaactttgaagaatattacgcttccaaaaatcgctcagccgaatcagatgaagacttaaaagctctcattaataaagtaatggtgcgaaatagacgacataataccggtatcgattggccgaagagacatgtacgtacaatttttgttgagtttaatgaacaagaacaagctctatataatgatatcgaaaattggcgaggacaagacgccttcacatctgctttctcatcgttaactttaaaacgggaagcgtgtagtagtcgtgaggctgtttactattcattgaaaaagcatgtagaaaaaaaacagaaagaaaacgaacattatataaaagatccacatatcgatgtgctaatggacaaaattaatcatattcctttcaactcaaaagcaaataaagctcttgagcttataaaagaaattgacgataaagtcgttatcttcacagaatatcgagcgtcacaaatgtacttacaatggtttttacaacaacacggtatttcttccgttccattccgcggcgggtttaaacgcgggaagaaagattggatgaaggagcttttccaaaaccacgcacaagtattaattgcaactgaagctggtggtgaagggattaacttacagttttgtagccatatgatcaattatgatttgccatggaatccaatgcgtcttgagcaaagaatcggacgtattcaccgtctcggtcaaaaaaatgatgttcatatttataacttagctacaaagcatactgttgaagaacatattctgaaactgttatatgaaaaaatcaacttattcgagcgtgttattggtgaactcgatgaaattttaacgagaattaatatgaaaaacatcgacgcgcacattcaagaaattttcgcgcaatcaaagagcgaaggtgaaattagaattaagatggaaaacttaacatctattatcgactttgcgaaacgaaatgaagctgaggtgcaaggctatgcagcaacatgaaattcataattacttatacaatttctttgaggcgaataactgtgaaattttagaacgttctcctcatttattagatgtacagttaacaattgagatggataaattattaatgaatcgccctttttattggcactatcttgagaaaacaggaggcgtaccgaatccgatgcgccttactcttattacaaatccagaaaatgaagaaaatgatggtgagcttattcactacggttcaccacgtctacatcaaattttccaaacgacaaaagaattaggctcatacatacgtttatatgaggatgtaagacataatgggtcaacacatacaccgttccacccttggctcggtattaatataaaagcttcctatcaatgtgatcgaaaaaaagacatccttcactcgattggtattcatctcatttctggaacaatgatggcatactttcatgaaacattaacaaacattaaact

SEQ ID NO: 1267 - DNA, 10041 bp, Bacillus thuringiensis
  unsure (1)...(10041): unsure at all n locations
cgatatatggaataatagggaagatcgttattcagatgaacgcttaaatcatacaaataagaaaacaatacctaaaattgaaatgtcacatatcggtggttaatatataaagctagcttcatagtgaaaaatggaaaatttacaagagttgtggattttctattttatagtaaaagtgatgattgatatctctgtaaaagatgtgcagagaaattaagcagcattcaaaaacctttattttgaggaggttttttgaagctgcttttttatttggagaaaatggaggaatgggtaatggcatttcataagccggaacaaattgctgagcttgtcattgaggccggtgttcaaaaagtaagacagacattgccagcgatgcttattctcggttttttaggaggagcgtttattgcgataggttttttacttaacattcgagttttagggaatttacctgagcgctggggaagtctagtgaatgttttaggaggagcagtatttcctgttggactcatgctcgtagtattagcaggaggagaattaattacgggaaatatgatgtcactgtctatggcgctttatgcaaagaaaattacattgataagcgtactgaataactgggtttggattactctcatgaattttattggggcaattttcgttgcgtattgctttgggcatcttggcggattaacagagggagagtatttaaataaaacggtagcgatagcggaagggaagttacatgaatcatttgggagaactttaattttagcaattggttgtaattggctcgtttgtcttgctctttggctcgcttacgggacgagtgattttgtcggaaaaatcatcggaatttggattccaattatggcatttgtagtgattggatttcagcaagtagtagcaaatatgtttgtcatttccgctgttatttttgctggtcatctaacgtggatggatttggctaaaaattttgttcctgtttttatcggaaatgtaattggaggagctgggtttgttggttttgcttactttgcttgttatcagaaacaacattctaatatgaaatagagttcttgagaggaagggtatgtaatggctgatcggtattcacgacaacagttgttcaaaccaattgggagtaaaggacaagaaaaaattcgaaataaacatgtgttaattgtaggggcaggcgcattaggangtgcaagtgccgaaagtttcgtacgtgcaggtgtgggcaagttgacgattattgatcgtgactacgttgaatggagtaatttacaaaggcaacaattgtactctgaacaaaatgcgagagagaaaatgccgaaagcaattgctgcaaaaaatcggctagaacaaattaattcggaagtacaaatacatgctttcgtaatggatgcaacttcagaaaatatggaaggtctattaaaaaatgtagatgtaatcattgatgcaacagataattttgatattcgatttgtaataaatgatttatcacaaaaacataatattccgtgggtatatggttcttgcgttggatcgtatggtatgagttatacaattattccacaagagacaccgtgtttacattgtatgcttaaaaatattcctgttacaggtgtgacatgtgataccgctggaattattagccctactgttcaaatcgtcgcagcatatcaagtggcagaagcactcaaaattttagtggaagatttctcagcaattagaaaaacatttttcatgtttgatatatggagtaatcaaaatcattttataaaattagggaaaataaaaacagacgcttgtctctcatgcggttcaaatcgaacttatccttatttattatacgaaaatcaaacgaaagcagctgttttatgcggaagaaatacagttcaaattagaacagtagacaataggaaatacaattttgatgatatagaaaaagtattacaaaaactggggaaagtagatcggaatccgtatttactatcttgccaattcgatgattaccgcgtggttgtttttcgagatggtcgtgtttttattcatggtacaaatgatatttcgaaagcgaaacaactatattatcgcgtattcggttaatagagagggtgtcaacaatggaaagaagagtgccaattacggttgaagaagctgttcgtaaagtgatgggatttgctgataaaggcttaaaggagctattaccaattgaattagcttatggacgtatattagcagaggatttagtagctgaccatgatgtaccgtcatttaatcgttcgccatatgacggatttgctattcgagcagaagatactaatttagcaagttatgaaacgccaattgtatttgaagtagtgggtgaaattggtgcaggatcgctattccatgagaaagtagctccgtttcaagcagttcgaattatgacgggagcacaaattccgaatgggtgtgatgcggttgttatgttagagctgactcgtcaatatgagaagaatggcaacaattatatggaagtgaagcgatcattcaaaaagggcgacaatatttcttttcaaggtgaagatgctcgtaaaggaacggttcttgcaaagaaaggatcgtacattaatccaggtatttcagctcttcttgctacattcggttatagtgaagtaccagttgcgagaaagcctgtaattggactgttagcgactgggagtgaattactggatgtcaatgattcattacagccagggaaaatccgaaacagtaatacgtacatgatattgtctcaaattcgaagagcgggcggaagagtaaaatattttgggaagtttagtgatgattttaatacgtgttttacagctgtgaaagaagcgcttggccaagtagatatgttaattacaacgggcggtgtatcagtaggagattatgattatttaccagctatttacgaaaagttaggtgcatctgttctttttaataaagttgcaatgcgaccaggaagtgttacgactgtagcacaattaaatggcaagttattatttggtttatcaggaaatccatcagcttgttacgtagggtttgaattattcgtaagaccgtgtattcggacgtatatgtttagtgaaaaagtacatttaaaaagagaaaaagcgttattaggagaagattttctaaaaccgaatccatttacaagatttgtacgagcaaaattgcaatatgatgaggggaaattaatcgcttatccatcagggtttgataaatctagctcagtttcttcattggcaaaatccaacgcgtttatcgtattgccgggcgggacaagaggatataaaaaagatatgtttgtcgatgttcttttattagaagataacgaaggtagtgaatggccttggacatttcataaagtgagaggtggttttaatggaacaagtgctatttgagattgtagataatccgattttagttgaagaagtaacgaataaagtcgcaagaagagaagcaggtgcgattacaacatttattggtacggtgagagaattaacaaaaggaaaacgaacgctacatttagagtatgaagcatataaaccgatggcagtaaaacaacttatgagaattggagaagaaatttgtgaaagatggccggatacaaaagtagcaattacgcaccgtgtagggcggctagaaataatggatattgcggtagtcattgcagtttcatcaccgcatcgtaaagtagcttatgaagcgaatgagtacgcgattgaacgtataaaacgaattgttccaatttggaaaaaagaattttgggaagatggaacgatgtggattggagatcaacttgaaaatacaccatatccagaaggaaaaccaaagaaggaagaatgagaaaatgattataattttattgtttgcaaatttgcgtgaggaagttggatcggatcgattagtgatttcagaaaagcaagaaatgacagtgcaacaattaaaagaatggcttaaagccagctattgtttacaatcgttggataaagtgatggtcgctgttaacgaagagtttgtaatgaatgaagagatgataaaagctggagatatagtcgcattaatcccgcctgttagcggtggatgataagttttttcaccagatgaagcgccaagaaaatgttgtatataaattagaataagagaagggatgagttctatgcttactcaagaacaaataatgaatgcattaaaacatgtagaggatccagagttacacaaaagtgttgtagaattaaatatggttagaaatatacaaatgaacggaacaaaggttaaacttgaagtagtactaacaatccaaggttgtccgttaaaagcaaaaattcagcaagatattgaagaatcacttcacgcaattggtgcctctaaagtggaggtaacatttggttctatgacacaagaagaacgtacagctttaacagagaaattaaagaaaaatactagaacagaaactggtatgccgagcatgcttcgcccggattcaggagtacgttttattactgtaacgagtggaaaaggcggagttggaaaatcaacggtgacaattaatcttgcaactgcactagcgcgtatgggcaaaaaagtggggatactagatgcagatatatatggttttagtattccagctatgatggaaacgaataagaaaccaacgatgattgatcaaacggcaattccagtcattagtcacggtgttaaaatcatgtcgatgggattttttacagaaggaaataacccagttatgtggcgcggaccgatgctaaataaatggattcaaaattttcttgcgaatacgcactggggagaattagattatttattacttgatttaccaccaggtacaggagatgttgcgatcgatgttgcagcgatgattccgcaagcgaaagaaataattgttacaactccgcacaatgtagcttcattcgttgcttcaagagtcggtgtaatggcaaaacatacgaagcatgagattttaggtattgtggaaaatatggcttattatgaagaacaagatggatcgaaaaattatctcttcggaaaaggcggcggcgaaatgcttgcagaacaattgcaaacagaagtaattgctcaaataccttttgcgaaacgtgaagaaaataatggttcatctgtatatgatgaagattctcttgttggagaagtgtttacatcgttagctgaggatattatttatagaggatagagggggaagtttagtatggcatgtaacattgatcattctattgaagatgtgatgaataagcttgaaagtcaaaagagttttttatcagaagagatttttaaagggttaaaaaattttttacaaggtaatcactcacaagaaatattaaatgatgtatttcatcttttaaaaaagtatgacttagtaagtgaagaagaaagagagacgagaaataatcaattattgttgattataaaataagtatactttggcttttgttttgtaacaggaggggtaaatggaatggatatgaaaaagatgattgaaatgatagaagcaacaaaagtgactaaagaagaattatcaatttctactttacatcaagagcttgtgaagttatatagtcaaaaaaatgttgctcattataccgagttattaaagtatattttatcattatccgtgcagctcaacctacatcttgtattgaaatattttggcgtgcgaccggttgttgcgacagatgagcgtatgcaatttcaagagatatttaaatgcttagctaagaaagatgagaatggggaatggtttctaaattttgtttctttatatgtagggctaattgtagttcttcgttttgatgagaaagtgattgagagcaatttttttgatgatatggtagtggatgaatgtaatgaaatataggattctgctcataacatttttctatattaaatgctttaactgcgattttagttggttatgtaaatatgaaggtaactaattaagaaaaaggaatgaaactagttggataaaaagagttcttcagttgtttccgtcgttttttcgtgttaccattaagcgaatttttcataaggagagaaagcgatgaaatggatttattttcttattattaacattatagcttttagccttatggggcttgataaacgaaaagcgaagaagaaacagtggagaacgccagaaagtacgttgtttttatcagcggcagttgggggagcagttggaacttggattggcatgtatatgtttcatcataaaactcataaaaagaaatttgttttcggcataccgttacttgttgtaataacggtatgtttattattcgttgtatgagaaatgtcgaaagaaatgcagattgattattggtaaagtgagcatgtgagaccgtataatggagaaaaaatgagaagaggagaaaaaggaagatggggagtcaatcagcagagcaaaaaaaagggatactatatgcggctggtgcttacacgatgtggggaatcctaccgatttattggaaatgggttgaggaagttccagcagatgaaatattagcacaccgcatcgtttgggcgtttgtttttatgttactcgtattaggtgttacgaagaggtttcgccagtttattggggaatttgtgaatctttttaaacgacctaaattattaatgtcattaacaatagcttcagtcttgattagtggaaactggtttgtttacatatgggccgttaatcataatcatgttattgaagcgagtcttggctattatattaatccgcttattagtattttacttggtacagtcgttttaaaggaaaagttaaacttctggcaatatgttgcagttggtttagctggagtgggggttatcattttaacagtacgtttcggggctatcccgtgggtttctttatcacttgccctttcatttggattatacggattaacgaaaaaattgttaaactatgatgcgacaattggacttacgatggaaacgatgttagtaacgccgtttgcgattatttatctagtaatgacaggagtacatggtttcggctcatttggctctatctcaatgttatcgacattactattaataggagcgggtattgttacagctctaccacttttttattttgcaaaaggagcccaacttattccgctttatatggtaggttttttacaatatactgcaccagcaattagcttaattttaggtgtattcgtatttggtgaacatttcacatctactcatatgattgcatttttctgtatatgggttgcattatttgtattctcggtagcgaagactaagtttttagtgcagaaacaaccgaaatttataaaaaataaatcagcaaaagtatcataatgcgtagtattttctacgcatttttctttatactgatactatataggatttccattatagctagtaaggagctgagaacatggaaacaattttacataatgatccgcttatggcagctgtaatttcatggtttttagcacaattaacgaaagtagtctttaaattagttaaaacaggtgaatttgattttgcaaagttttttgcttcaggtgggatgccaagttctcatgcttcaacagttacagcgcttgctacaggagttggagtagtggaaggtgtggaaagctcgatgtttgcggttgctactatttttgccattattgttatgtatgatgcttcaggagtaaggcttgcagtaagtaaacaagcaaaaatattgaatgacttttttcacggtagagaaacagaatataagaagttaaatgaacttgttgggcatacaccgtatgaagtagtagtcggtgctttattaggaattattgtcggagtagggtattgtttatgagcagaacattttatatgttctgcttttctttgtttttatacatattcagctacctttttgaatatcgttatacggatttcgaaagggtgggtgagtaacttgttattatatgaaaaagtgtatgaagaaatagcgagaagaacaactgcacttcaaacaatgcaacggcaagatggtacgtggcggttttgttttgagggagcgccattaacagattgtcatatgatttttttattaaaattattaggtagagataaagagatagaaccgtttgtaaaaagattagcatcactccaaacaaatgaaggaacatggaaattgtatgaagatgaggtgggtggtaatttatctgctacaattcaatcttatgctgccttacttgcatcggaaaaatatacaaaagaagatgcgaatatgaagcgagcggaaatgtttataaatgagcgcggtggggtagcgcgtgctcattttatgacgaagtttttattagcgattcatggagaatatgaatatccttctctctttcatttgccaacaccaattatgtttctgcagaatgattcccctctcagtatatttgaactgagtagctcagcacgtattcatttaattccgatgatgttgtgtttaaataaaagatttcgagtagggaaaaagttattgccaaatttaaatcacattgcaggcgggggcggagaatggtttcgggaggatcggtctccagtttttcaaacgttagtaagtgacgtgaagaaaattataacgtatccactttctttgcatcataaaggatatgaggaagtagaacgttttatgaaagggcgtattgatgaaaatggaacattatatagctacgcaactgcctcgttttatatgatttatgctttacttgcattaggacattctattcaatcaccaattattgagaaggctataatgggaattacatcttatatatggaagatggagagagggagccatttgcaaaactctccgtcaactatatgggatacagctttactcagttatgctttgcaagaagctcaagttccgaaagtaagtaaagtgattcaaaatgcatcagcgtatttactaagaaaacagcaaacgaagaaagtagattggagtgtacatgcaccggatctcttcccaggtggttggggcttttcggatgtgaatacgacgattccagatattgatgatacaactgctgtgttaagagcgttggcgcgaagtagagggaacgaaaatgtagataatgcttggaagcgagcggttaattgggttaaaggattgcaaaataatgatggtggttggggagcttttgaaaaaggggtaacgagccgtatattagcaaatttaccaatcgagaatgcaagtgatatgattacagatccttctacaccagatattacaggaagagtgctagaattttttgggacgtatacgcaaaatgaattgcccgagaaacaaaaacaaagtgcgataaattggttaatgaatgtacaggaagaaaatggatcgtggtatgggaaatggggaatttgttatatatatggtacgtgggcagtgttgactggtttacggtcactaggaataccatctagcgattcatcattgaaacgagccgttttatggcttgaacatatacagcatgaagatggtggctggggagaatcttgccaaagtagtgtggaaaaaagatttgttactttgccatttagtacaccatcccaaacagcatgggcgttagatgccctcatttcttactatgataaagaaacgccagttattcgaaaaggtatttcatatttgctctccaacccttatataaatgaaaaatatcctactggaacaggtttaccaggtgggttttatattcgttatcatagttatgctcatatatatccgttgcttactttggctcattatgcaaaaaaatatagaaaataaaccgagagatgtctctcggtttattttgttgggtagtaggtcccttttgaaaagaataaggttgtaatgtgccttatttatcggttgattggcgcttttgacgtgcatcagcggcatttgcacgtgcgtttgcttctaagtcattgtaatagcgagttcgcgaaagaactcaacatcaatgtcatcac

SEQ ID NO: 1268 - DNA, 10465 bp, Bacillus thuringiensis
caatcgcgggaccagcatgtttccctccccccaataccagttaataggaaaatacctgtaccaataattgctccaatacctaaaagagttaaatcaatcgctcctaaagtttgattcaatacttttttcttttcttcatccattgctttctttatgaaaagactcattctttgaaacctctttttcaagtttatctcttacttgttacattctttattactgttctattttaaaaataaaaatatacatagttcacttcccctatagacttagtaacccgtctcaataaaaacagaaaaatcaatctctttataccgtattgaattttcaaaatattaaccataccaaaaaaccattaagaatgctgattgaatttatcatacaattaattatattgtcaataataaatcactcaaaaataatcggctgattatgtatcaaatgttatttttatacataattattttctcaaaaacattgttgttttccaccttaatattcatatgcattttattacattgattttcatacaattttcattacatacaatgtaatgaaaatcataataacctcaaatgaattattattcaaaaataataattcatttgaggttatgtcaccattttaatactaacaaaaaagtgcagattttcatctgcacttttttttattcttccacttcagcttctgcactactattttcaagatgctccttctgagcttcctcttgcaactctgctgaaatcatcccataataaagttccggatataacccaaatatttgatatacacttcctaaaaacggcatcagaatccctcttttctaaagttgtattgccacttttaaggattcccttttcattcattatacattcgtttttggcgtttcttcttcatcttgaacacttaataaattttgccattttttatacggagcgctatttggatctacatatccttttgcatgcgagcgatcccacaattgtttaataaacatttctttctctttctttgccaccatatcggcacctgtaccgtaatagttctggaaatacaactcgatttcatcgaggaatagtcttaataattcatctgatgtttcttctaatgtcggatcatacttcgcttcacggtcatacattaaaatcatatctaaaagattgtggacatgttcttttctaagccatcttacatcttgggctcctaatacgaacggatgtgtatataaatgtccaccttgtatcatcgccttttcttgctcttcttcaaatcgtgacaagatgttttcataaataaacggattatgaagcaatgctctgtgtaatttataactttcgcttgaaatatttttccccatcgactgaattaaaaagctacgtcctacaccgttatattgatacacaaattgtccatcaacagcaactaaactaatccagcgatacatatatgcgtatagtaatgcacgattacatttatcataatctaattttgtttgagtcgcgtttaaatctggcataaaggctggtaagtgccaatacttatctaaatgcggcgttaaactagattttttactatttaatttatttacacggcgataatacgattggaaatagtcacctttatcattcataaatccgtttgaaatatgtcctgatgataatttaggaaaatcttgcagcgataagccgtaatgcgctcgataacagattacttcaaatggcgaaaaggcttcatgtactgtatctttttctttaaacatttcttgaattaattcctcttgcagctctttctttaaagaaggatgtataccccaatattgtaattccctatgatgagcaactttcggaacgaatggactcgctaaatggaacaggtcttcaattttttcacgaacgtattcatcgcgatcacgtttcttataatctgcttcttttcgcaacgcttcaatgatattcagttctaatttatcacgatagcgtacttgcagttcgtcataacaatagctcagtatatgttctcggtagaaatcctctacctttttcgactgaatctcttctgttttcgcatcacgacaatattccccgtacaaactcatataaatttccgctgatatatctttcggtagtacacctaaatttaaatgttgctgcatatcttgccatatcttttcttgcagctgttcttcagctaatacatatacattcgtcgggtttgttttcccttcaaattccttactgcgcttttggatttcaaacagtaaattttcacgtgtttcatgtaaattatcaaaaaatctttcccaatattgaatcattttattaactgcttgatatagcgattgatatacaagttctaatagcatttcttttcgatattcatttaatttgtgtacatattgcgttataatgtcttcaaattctcttttgaataaacgttgctgattattaatcatttttccaaaccagccttgttgttgagcaatttctactcggcgtacagccgttaccgttccatcgatattacccacattaaattttttatcgtagttttgaattacatttcgcttttgttcattattttcatgtagtcgattcattttttccactaactgctttcgaatttcatataacataaaacgtgctgctactgggtgaactggatctgttttctttaaaaaccatgtatttaattgataggactgcccttcagaaccacttggtgaaaagcggtctgattcaatcatgtcatataaaagtgtcgttacatgttcatgtacacggctcggaatcgcatacgcatataaacgaaccgcatgatccactcttgccacttcacctttcatttgttccatcattttcagtttcgcagctgaaattttacactcatgttgcagacgatttaattcctcatctttttgcaccgttcgttgtacataactttctacagcttctaaaaacagttttgatttcgcaactccgagcttaccaccctctgctccttcacgtgtttcattgtacatttgtctatagaaaatatgagcttgctctggacgggtagcaagatgttccaagtcctctaaataacttttacctctctccggcttttcacgctgcatcccacgttttacatcttggtcatatctttgcttcttctcttgaaacagttgatctaaatgaagccacgattcatctaaaccttgcacagcccattttaaagcacaatattttaacacatgctcatacggataaatgagttttgccgttcctgccccgcaatatcgtccttttccgcttgattctgctaattgctgaatttgattgtcttcttgtgcaaaatgacttgtggacatcgggctaaataactgtaaataaattgtatttgccatctgttccatataatctgataaattgtgtaaatggtgtccatgtaggttttcataatcgtataagaaacaataattgtacggtaaatgatgttgtttaattgtatgattcgttcttccgtcttcatctacttgatcagggcgatactctaattcaattgttacaccgccgcgttttgataattctccagtagaaccgagcgtaatagcatgtaattcttttaacgatgcatagccatttgcttgcaccgtttcaaattctttcgcgctaactgttctcgtctttactaaaacatccggcattaaaaacgcaccgcgtattaaaatgttatgatgctgcaatttcttccgaagcatttcacgtaaatataatgcaatttgcagaaacatccctgaacctgttccgcctgctagtgatgttactataatgacacgcacaccatattccgtttgatcacttgtaaccggaaaaattttctcgatttcttgccaaaaagacgtcaatttatcttctttcatcgcagcacgtaacgctaaacgtgaaataacgcgtaactgtcctgctccttctgttaatggcttatcaagtatagtcggatccatcggaaaccactctgggatcgttggatctcctgcaatatactccctaggcgttttactagaacttgtttgtgtcttaaactttcgaatatgatcaaatttacttaatgtattcacatctgtatcaaatacgtgcattgctaccttttttcggcgctcttcaggcagtttttcatatatttgatgcgtcacagtactaccgattccacctaaaccaattaatattgttggaacttgtaatgtcatgtgaaccaccttcctattcttgcttgtttgaaaaaagggaaagagaatgaatactccatccccttcttatccctacctactattcacattcgtacttgtaaatctccttaccatatcctctatcaattagtaaaagttcatttggatatagtgtcttatgttccattcctacttcatcctctgttataaacattccatcaataatcattccaactacttgtgattctttcgctacaaagacagatttcgaacctttcttcgctataaatgtaacggattgcacagtttttctttctgctctaaatgggatcccaaaataatggttccaccatttatttcgaagtaattctggttcagattgatatagccaatctttcgctacctcttgatcccattcataatacagtagtgctttccggtgaaatcttggccgaacaatccatcctaaaacaatgattcctactactaacagtaataaagtgataggaatgacaaacttaaaaataagcgcatatttttcataaaacggagcatcttgaatatggaatgttatgtttttctttacttcttgtaactttgaatcctgcattacgatggtagcttctacggtgccggtatctgtaaaattaaatgtgtcggagtaatagggacgaggataaacatagatttgatttccatgttgctttatttcatagttgattgattgtttagatgtgacaccagtagattttaatagtttctttacagcctcttctgtcatcggcttaccatctaactgtggttgtataataaacggtttactattctctaaatttgtcactttttcttcataatcttttgtaacagtttgaagtgataatttcggtttctcagctgtttcaattttaaattctttcgtctgtctataaaacccctttatattcatatgaactttcccgcgtactaaccctttaccaagcttcgtttcgtaataaaacacatgccttttatcgttccacttcattgcatattgttttccgtctatttctacttctgcctgaaagtaagaagactgaactggcaactccgtaggccttgcttcaataacagctgtcacaccttcatacatttcctcaacattttttctatccttatcctctttatcataagtagaaacagtataattaagtgccggttcgactagtacttgtaacccttctttctcaatatctcggtccacttctatcgtataagttcctggtttaataacttcctcattttccgtacttatatgaactatatttccgaacaactttgcttctcctggtgcatgtatggaaaaagaagattgtaattgtaatggtttagaaatttgtgtgacctgataatcgggcagagaaggcgattgtcgtacaagcgtcatacgctttaacggaaacggtgttgtaatttctactcttttccccactactttcgtttttacaatcgattcaacagaggagaatggatcacgatttgcaactaatgctgccacttgatttacactttttacaatgccatcttctccgcttgacggcatcgtaacaccatttatctctttcttccatatttccttgaacgtatttagttgttctttttcttgttgtcctaaatcttcttccatcgtaattaagactggatgtaacgatatcttttttgcatccatttctttcttaaactgggctaatttctgcaaaatttgttcttttccgccaaccttatctttctctaaatcattaaatgccccgtcagttaatacaataagccaaaattcacgttttccatctatatctgcttccttttttatagattgcatcgccgtttctaccgcgctaaatggagtatttaaatacgttttccatgctccaattccctcaatttctgtttgccttttatccttcgttaacgaaatgtttaatggctcattcggcttactcattggaacgtaagaaaatttatctttttcatccaatagcgcaactaaactttgcaaagcataattggcatatttccagcgatcgttatttctcatgctgcccgaatcgtcatatacaagtgaaacgaccctttcctttgcctcctctccttttgcaaaagctgataaaggtaaacatataaatagaaacaacatgaacgtggcacaaattcggattttcatgatgaggcttcgccacctttgtagacaaattcctatgtttaaatttatgagaggaaacaagatatatgacttgtattttaggacaacgaacccagcataattttattatgtaaacagttataagaactgaatattattccttctagcgttttctatccgatactataagtaaaaaagcctgtttaagctccacacttaaaacagacttttcctactttttattttaaaaacacataacaaaaagtttgatttttgacttaacacatcacttctattgtaaatccaccaggtgcttcaacgtaaaacgtatacgcatggacatgcttaggaggctcgaccaaaaatccatcttccttcaatctttcatttatcttatctacttgttcttcactttcttgtggaaatcctacgtgaaatgttcttggatactgaacttcttttcctttcattaaagttagtataaatccatcattatcacgcataactgcaaaggcattccctcttgttccactacaagttagaccaaaatacttctctaaaaactctctagctgctgttacatctgtaactgttaaattaagatgtttaattcccaatccttcaccttctttctcaattttctaacattttatcatacaaataaaaaacacgccttccacagcgtgtttcattgctttacatacacttcaacaatcggattctctttattatccgcatgcaagcgtatattctcttcacttgtattataaatactagctaataacattatcgttaacacattaggtgtcttcgcatcacttccgtattttctctcaagcgcttccttatattcaaaatctaaatccccctgcacatatgtatacacttcaaaaccatcttctaaattgcaaactactgtatcaataatatctgtccctacttgcttcttcatttcctctcgtaacgcttcaataaaatcttcccatggtacttcgtatgtctgaaactgatctgtagatttcatgccttttcctccttatatatcctcttcttatatttcccctttcctataacaattatgatagatagggcattcgtacaagccgcacttgtcccccttacatatcgtattactgtaatgcggaaggaggaaagaatatgcatagacaaaaatgttatgatacatgccaacgttatttcggaaaagttgttcggattgaagaccgtgatggccgtatacatttaggtaaaataatcgatgtgacacaaaactctgtatggatcgaaccggtgcaacagcgctcatcttttgattcagggttcggatactacgacgcttatgcaaacggtggttgtgacctttgtggaggccttagcaggtgtgatagttgtggattcggatgcggtggtggattcagcagctgcggatgtggtggtcgtggttgtagtagttgtggttgcggcggctggggaggcggcggttgtggctggggtgttgaactcggatttggtttcatcttcggaattacattagctgcattatttttcatttaacatagtaaagagttggctacctttagccaactctttttctttatttttcacatataaaaatacgatgccctaaaatgtgttggtacataagccgtacattttcatgctgtgcccacgcctcatataactcattcggaatatgtgaggatacattccattctggctcttctacatagccagagattgtttctgcaatcgtgccaccacccgcaattgtaattcttttaaaatttgctttctgaaataattgtacccactcattctcagttaacagttctttcatgccatataattgggcgattttttcttcctcacccttatcaatgtgcctatcaataatcatttcaatgacaacaagcttaccgtcctgctgtaatacacgataacactccgagataaccctttctttgtctgtaaaagcgatgattgattctccaagtacgaactcaaatgagttattcaaacacggtaaatgctctacatttccttcaattaattgtatatctaacccttcaaacaaccatctatcttttgccttttgaatcataatttcattcttttcaaccgttgttactttatagccaaattcccttgtcatatacgccgctgttttccccgtaccacaacctatctcaaggacattcgctccatatttaaaaggcagttgtgctaacaattgttttgttaacgtaaagccaccaggatgagcacttcctattccgtaataagctaggaaatcgatgtatgtgtttcgtttcatgggattctcccttttttattttatatattcgagcacggaagaaaagtgcatagaaaaaagggcgtattgtacgcccctcatcttacttatcctctgtaatatatgcccatttatagctgtagtctccaccaaccggatggtgaacaataccttttactttctgtctttgaacgatagcatcaccacgttgatataatggtgcaattacagcatcatcaagtaatattttctcagcttttagtaagctatcccaacgttctttcgttttcgttaatagctcgcctttacctttttctacaatttcatcatattttggatttgaatatccagtttggttatgaggaccatttgtaacgaacatatcaatgaatgtcattggatctaagtagtcagggccccaaccagcgtaagataaatcataatctaaatctgattctaattttaatttttgtttaaacggttgatttttcaagttcactgttaaccctggtaagtttttctcaagttctccttttaagaattctcctactttcttcgcattatcgctatcgtagtttaatagctcaatcgttacttgctcttttccaagttcttttttcgctttttcccaatgctcttttgcttttttcacatctgtttttaaaatatctccattttctttacggaagtcttttccatctggactcttagcaaattcttttggtactaagtaatctgctggtgtagatccgtcatttaaaataacgttcgttaagccttttttatcatatgcctttgcaatcgctaaacgtaaatctttgttctttaatactgtatcttgcccaccacgtttttggtttaaacgtaagaagaacgttgatggtgttttttgtgtataaaagtctggatttgatttatatttgtcaaccatttcagatgtaagtcccgcacgatcgatttgtccgctttcatataagtttacacgtgtaccgctatcttttactacgttaaagttgatttcatctaacttaactgttttattatcccaatattgtgcatttttctttaatttccatccttcttcatgtttccagtctgttaatgtaaatggtccgttgtataacgttgtatctgcttctaaaccaaatttttcacctttttcttttacgaatttttcatttaacggatagaatgttccgaatgaagttaattctacaaagtaaggaactggattttctaattctacctctaatgtgtaatcatctacagcttttacacctaacgtatcaagtggtgctttcccatcattaattgcttttgcgttctttaaatcaaacataatgtatgcatattccgctgctgtatttttatctaccgcacgtttccaagcaaacacgaaatccttcgctgttacagggtctccatttgaccattttgcatttttatttaatgtaaatgtatactttttaccatcatcactctttttatatgattcagcaactcctggtgttgctttattatctttatcaagtcgatataaaccttccattacgttgtttaaagctagaaacgatacttggtctgtcgctttagcagagtccatagatggaatctcttgagactctgttaaattaagcacttgcttcgccgctagctttccgccttctttttcaccgctttttggtgttgtgcttgccttctctttatctcctgatccagagcaagctgttaatgccatactcattactaaaaaaggtgctacgaccgctgtcaattttttcatcttttt

SEQ ID NO: 1269 - DNA, 13200 bp, Bacillus thuringiensis
tttttgctatccaataacacttacttcttttgctttcacaccaggaaccgctgcactaatcatttgcggtatacctgcaacttgatcagctgttaacaattgtccacgcttcactccaaccgtaatcgccgctgttccttttgctttttcttcatcaaaaattgtctctttttcaggcaatgtaatttgaacatttgccgtttcaactgtcgcaaagtttcttacaatatcttgctccaattgcttcttcgtaccgacaatttgcttcatttttttatcttgctcacttgaaccgagcgagctttctaataaaatttcttcaccgcttttcgaattaaacggtaagcccatcccattcatttcttttcgaacccatggagcatcattcttttgcacacgaatcgaaccatcggccgctaattgataatcgacacctaacttcgataattctgctgtaatctcttgtttatctgcatcatttaaattttgatatacaacaacatatttatctggcaaggtgaagtataaaagtgctcctgttacaatcgctaaaagcgcagcaccgattactaacttatgccatgtttttaacgattggataacatttttcatcttttccatttaaacacacccgtccactttcctaaatttgcatattaattagtgacttataattttcaataagattatcacgtacgagagcagccgttttcatttgagattcagctttcttttgctgaattaaaacgtcatgtgtttctcctacccctttagttagtaaatcatatactgctgtttgcgcattgttttgcgtttgattcatatcttccaataaatcaataaactttttcccctcaactacaggtgtttgagaagtcttcggtgcaccaattgactgaattgctccaaatggttgtgtatgtaacattggttggattttcatattattatcttcccccttatcctcggccgatttctaaatctttatcaagcatttttttatttgcatttaatacactcgtattcgcttcatacattttttgagcaaccattacattcgtcatttcagcagttacatcaatattgggataacgtacatatccttcttcatttgcgtgcggatgcgtcggatcatacactaaattttccgttttgtctgcttcaatactttttatttttactccattagtaggagccccatctaacatacttgcaaaactattgtttgattctagcaccacactacgacgctcatataaatctgcccccggagccgccgtcgtattcgcatttacaatattgttagaagtaacttccatccactttctcgctgacgttagccctgagccacttgcattaattgcctgaaacatccgttgtctctccttctacttttaacgtccgcgtgccgcttggttaattgcatattgtgtattaattgcgttaattgaaataccgtataactgatttgctttcattaaatctagcatttctgtcgttacatccacactatttccgtctttattcgtttgcattgattttgtttgaatctttgcatatgtatttttcgtatttactgtcggtaagtgcatttcattcgtttgatataaatctggattgctctttaaatcagccgcattatttttatataacgcactacttttattcatctgctcagcaaatgttacatcttgtgctttatagccaggtgtattcgcatttgcaatattactagaaacagtatttcgtttcgtcactaaataattcatataatggcttacatcactcactaaatctggcatattccacacccttccttttctaacgtaatgatccactgatagaagtttcacttcattatttattttcttatatgcgtttattaaaatatttactattatgtacccttacatattttattccattttttcattgttgtctttagaaaaatacaaaaatatagaaaaagaatgcaaaaaactgtatacacatagtaatctatagaacatttcaatatataaactacaaactaaagtccatttttctattatttagattacaattattatttcatcacagtcataaaatgaaacctcaatcagcggagttctttatgtaaacgaaggaatagacccccttttaaaaggggaatctgtttccagacgttattattaatatttaccgtaaaatgaattagccttcattcgcccatcattttccataatcatttcttccaaaatcttttgcttatcacgaatatgctgcgctgccttaataatgaatgggcttacttctgctgcaacttgtgcacgtctttcttcatctagtgtcatcatccaacgatttaacatctcactcttctcagcaaactcttcatctgacacttgtaattcaccgatttcattaaaacagctgacaaacgttcgataaatatcattgttcattttcaagtgctccacggtaaccgtctattaaatcttgtaacacttgtacaatcgcatcaatgtcttttgcttcacgcgttactttcatcgtttgaatttgaatgctaatccaatcgtataaaccaaatagaccgtcatataaatcttttgaaatatcaggatttaattgaagcttcaactcttcaaatatacgttctaacttttcaagaaggtcgtctccttcttgaagtttaaatgtatttaaaagttcttctaatttacgaaactctacgatacatctttcataaataaatattgtatttttaatcggattactcgtcataatatcattttgcatataacgttgccatgcttgcatataatcacttcctcaactttcattaatcatcacttttggtttttgtcattgctttgattgtctgcagctgactatcaagcaatgctagctggctttccaactttgcatatttatcaataattgattcttgttttttcttattaattgtatcaatatcttgaatttttctctctaaatcagtcacttgcttttcaatacttttagagcgttttccgataatcccttcatctccaaagattccctcaagctttttatctatatcatgaccaataccattaaagccaaagaaaaattgttttgtagattctggattctctttaaaagctattttcaatttttcttcatcaagagtcatatttcctgttttatcaatttgaattccaaaagaaaataaatacttatcatcttgtgaaaatttaaaaatgcttgtcattgcattactgatagcaaatgaaacattattcccttgcattactccattttcaccagaaaataaatctaaacttttaacagcgttattatactcatctttcatttttttgattaaatctatcgaattttttatatctgaatcttcgatagttaatttaattggctctgtagttaccttttctaagttaatagttaatcctggaattgtatcaatcttatttgttttactagttcctttaattccgtttattgtatactcagcatttatcgctcctgtcacttgatgtgcaacaacattcgttccatccggatttttcgcagaagtaactaaccctatattttgtaaaaaaccattggcgccatccgttaatttcagctctccagtttctcctgcagtagtcgatgtgaaaaatagttgatcccctaatgtgtatactgatgcaccataattcccattatttatcttattgacaagatctttatacgtcatatcttttgagattttaacttcttttccatttatctgaaatacatcatctactccaagttttaaatctaaactaaacttttgctccgtaccttcaggagtttttgggggagtaagtggagctgtagttatttgatgcctttctgctactcgctctactgtaattgtatatgttccaggaattgcagcagcatccgcctgtgctgtcataaaaccatctttggataaagttgttttcttttcatcacctttaaatgtgtttaaatctttgaatacttgcacaaaatttgcaaactcttttttcatgctcgcataaactttgttttcatttgttaacgtttgtttttgtgtagtgtatggtgattttttcatttccaatgcttgtaactctaaatctactaacttctttgtatctattatgttatttcctaaattccatatttgctgtctgtcaccataattagatattgtccctgccatatttttcactccttatcatttacatgtaatctaaaatactcgttttactcatcgtactaacagctttaatgttgcttcgtatgttgcgtttatataagctaaatcagaaattgcgacagctaaatcaacatcctcaatttctttacggttttcttgaagtgctacattttgctcgtttaaaattgttttaaacgtctccattgtgttcattgtcgaaccaacttcagttgtacggttaatgatgccatctaagttttgcttatttccttccaataacggttttaatgctttttggtcaccgtttttcatcgcttcactcatctgttttaacgtttttataaccggggataataatgcttctccgttacggaacgctttgaattcataaccgtcatttaattgccagttcacatcattttttccaccttggtacgtaccatcttctgtaaatggcggattttttgcactatcaccaccgaaaatataacgaccttgttcttttgtattcgctaaatagacgacctgttttaaaatttgatcaatctctacaccaatagcctgcaattctttttcactatttgtcccatttaatgcttgtactgttaattggtctgctcttgttaaagatttcaaaacaccttgtaaagtattttcagtttgtgttaatacattttttgaatccgctatatctttctgcatttgctccatatttgccaatgaatgttgaatcgcaaatgatttacttgctgcaagtggatcttcactcataagaaggtttttcttccctgaggttacttgatttcggtggtattgctgttgcacatttaaatccatcaactgattctttgcccagtttgcattttgaaatgtagatactctcatttctatctcctccttaaatatttccaattaccaactatacatgactactccttatctaataatcgaaaacaaactatcaaacacttcattcatagtagttatagctttagaattcgccacgaagtacttctggaaggccattaaattaaccatttcttcttccatatttacgccctcgatgctcatcttttcttgctggataccttctaataaatccttatgaatattttgatatgcatttactgaacttttatcagaggctacaccaactaaaaattgatctaaggcttgcttatatgtaagtccatccttatagcctttatctgtaatagccgcaaggttgttggcagtttcagccgaaattttcatttttgaaatatcttttataaaatcaggattcaattcaagcttcttcgcatcttctcctacaaaaaactctttcttcatagtattattcacttgtttttttaacgaatttacaaactcattcagattatctttataatttgtaatctttgctttcgtatcaattgccgataaaattgttccaccacttaatgggatatctgttccagatatttgtacagacattggctttttatccttctgtaattgaagtgggtatgtatcttgaccatttacagttaaaacaccattcatcctaacacttgcaatattaggatttgtagcttcatacgatacttctatatctgcatacttagacatttctgtcataatacgatcacgttcatctaatagttgatttggtacttgtgtacctgcttgcccaattttatgattcgcttctgctaaactagcagcaagtcgattaaattcattaacatgcgcttcaatatcttctgtcgtctgtgcttccactgtatctaagtttttcgcaagacgacttacttgacttgtgaacttccccgtttcagcaattaatgtatcgtagtaatttgattgctccggattttttgcaacttcacgaaaagcattgaaaaacccatccattaaactagataatgaatttttacctgtcgttcctaccatagactctactcgcgacaaagtagaattcatatatgcatagtaagagaactgtgacatttgatcattatattgctttgtcttcacttcatctgtaatacgatcaacacctaacgtttgtacaccataccctattctttgttctggtgcataccctttacttcctccagcagatccgtaattcaccatttgacgaacataacccggtgtatgaatgttagacaagttttgtttcgttgtttgtaaccccatttgagccgctaacatacccgatagcggtgtattataatcagataatctcataaagcttcacttctcctttacaatagttcattcataaagatttgcgaattattgtttcgctctaagttatattcagaaacagaatccacaatactttctgtagtttttaatagtacgtttaagtaatattgatttttcaaaagaatcatttttacattctcttctaattcagttacgtttttttgtaattcttccattttttcaatttcttcttgagaaaaatacgaaaataacgcacttacacgaaacgattcaaccccttgttctttgcagaactgaacaaccatttcttcaaatgagcttgataacccttttaaaccatcaatgtactgcaattgctctacttgcaacttttgaactgcatttacatttttattttttaaattctcatatatttgctctccaagcgcttgaatattttcatacgctttttgaataataacgagtttttcatataattgtatgtacatatagcttccttccttttacaagactaaattcacaattaaaccatggatttctccaatttgatttaacatttctaaatgtcctgttttcgtattaattaaattcataacatcttctaattcattcaatcccatttctgcctgtttcacaatcgtcattttctgtgaatatccgtaacgcgggtgacgagacatgacatctttatactgcaatacattatccacgtaaaaattcaaaaatgattttactgtatttttgtattccattacattatcaagcgttaattccatttcaattttctctttaatttctccaatattatcgacaaacgcttccatttgttctagtaatttatcttttttcggatctgcatgcaaattatccgaaaatgcaagtcctgtcctgacatttgcttctttcggcatttgagtagcaggcggtatatgcgataaaattggattatgcgagatagaacgtagcatatatatcacctatttattttttttatttcttcctaaacttaatcgtaaaatccagttatttataattatactctgaacagtaatattttgcagttattttttataaaagatatgttacaatttagcatgaggtggcacaattctatgaatattttcctttgtggttcaaatcaattaacagcattagatcaagaagaaattaaaaaatttttaactgactatgctcacaaacataaaatttacatattatgttataaatctattgaaaatgaggttcttcgttttttcgttgagaatgaaagactcgctcaaaatttatgcctttacacgctgcaaccattgcaagcaataacagatgaatttcaagaagtcgttgattacttaaaaaaacacggagccgaatatgttgcttttgatcatccttctgactccatttaccgatcagattatatgttttttgttaaacaaattattgaagacactgatttagttctctgtttttataatggtgacaaacatacatctgtcatccctgtcgatgttgcaaaagaagcaggtattgatgctgtcatttatgatttaccaggattacatgaaaagcaaacgaaaaaaagctttgaacaaaaaattcgtatgatgtaaagggggaggcacaatatcattattgtgcccattgtaaatatgataattgaacaagattacgatcattttatagcgagttttaaacaacaattcaatatggacatcgcttcatataaacaagatagaatgcgccgtagaatcgatgctttcatttcgagaaaaggcttcgaaaactacactaattttttaaacaaattacgcgctgatcaaaatttatttttaaattttattgactatattacaattaacgtttcagagttttttagaaataaagaacgatggcaaactttagagtcgaaagcactaccaaaattactcgaacaaaatagcggaaaattaaaggtatggagtgccgcttgcgctgctggtgaagaaccatatacactctctttaattttatcaaaacatctagctccatttcgttttgaaattcaagcaacagatcttgattttcatattttagaaaccgcaaaacgcgctcaatatacagaacgttcgttaaaggaattacctactgatttgaaagaacgtcatttcacaaaagagaatgatctatattcattgcatcaaaacattaaacaaaacgtctcgtttaaacaacacgaccttttaatgcagtcattcgatacaaattatgatttgattatttgtcgtaatgtaatgatatatttcacagaagaagcaagaataaaactttacgaaaaatttagtcgttctttacgaaaaggcggtgtactatttgttggtagtacggaacaaattttaacacccgaacgttacaatcttcagcgatttgatacattcttctacgaaaaaatataaaagaggtcgtcacaatggagtgacgacctcttttacataactcgaattaaaataataccgacaatccatatgaagagaaaaagaaacgtcatagaccatttatgttcttgcatcgtttgtttcaatgcctgtgataattgtgtcatgttcatttccgcaagcgctctccatacacttacatcccgatctttagcaatgcggtctgtaacgctaattaaaatcgtttcgttagacaatttcgttatataagcagtaataaccgttaccatcaaatttatatttccttctgaggaatcactttccactctagagatgagtgcacttacatctagtaaaggaatatgtacttttctaccaaatgatagttgtacttcagcgaaatcatatgttccatctaacaaaggaagttcttttatgtgcgcctgcttaataagtccttgtaggcttctaattacttgttcaaacactttttctgattgctttccttcttgagataatgtatgtaactttttaaaaagttgtaacaccgtatccatctctttagaaagtatttccttcataatctttccatcacttaaacttgcaagtaaaatacctatttcattatttttcgaaataattttagactgtccagtaaacactaaattgctacgctttcgttctttctggatttcatgttccgaaatagctgcaggctgttttaatggttgtagcgtcttatcttcaattgtcgtacgtttaatctccatttaagcgcctccactactatgaaataattagccccattctttattactctttaaaactaaaaacagtacgaataaacctgacatgatagtaaatacatccgaagcttgtactccctgttcacctttttcttcttccttgtctttcgtttcttctttttgttctttctttttagagacaacttgtttgttatttttctctttttggtccttcgccttatgtacttccttgttgtcttcgaacggctcttttataacgtaagtaaattcctctttctctttcaacggttcttttataaacttatttactttctcatcttgcttcggaatttgaacaactggcaatttttcttctggaagcgggtttttgattttcaaatcttcttgcttctcattttctttcttatcttctaattcattttctagtttattatctaatttatcttctttctcttctatctttttatcatcttcgttttttggcgccaaaacagaaatggtatattcactttcttcaacaagtttattacctgctgcatctattatctctacaagtaattcgtatgatccagccggcaatgcttctgttatttcaaatactttttgccaatccatatcatgcttgttgtagtctaataaaaacgaaagctctttattttctttcccttttaatgtaacgcgcacttcttttacaaccgattctatatctgacgcttttactcgtatatgtatagaatctccctgttttcgttcaactaagttctcttttacttcatcaatagtaactttctgtaactttggcaattctttatctatagttggcgtttcatttttaatacgaatgagcgggactttcacttcattttttatgagctcttctttctcattctctttgtaactttgaacgagctgaagattccaatcaccttgcaaatcaaaatcccctgctttatagttagcaacccagatcttcgtttcttcatcatactcaaaagatagtattctttcttgcgcatattgctcgccatttttttgtaactgcaatatacctttcatgctttgaatgtttttcacatttggttctacagcaattcgcacttcttcgccaactttaagctccggcttatttactgtaataattccttgttctgtttctatctttctttcattcaattgtttatttactacttcttgttgctctgcttctttttgtttctcttcatcttgcttcgtttccacttgttctgacgattcttgagattccttattttcttcttgtacattcacttcatttattttttgatctgactcaatttgttcctcagcctgactttgcaaggggaagaacaagcacacatgtatgcatagccaactcattagaaaaaactttacgtttttcatctactagttcaaactcctatttcaatgccttatagtgatttcgtcacttttactccaaaaaatccatctacatttacaagttcaccatacgccactaatacatcatttacataaatacgaatcggttcatcaatatcctcatctagtacaactgcttcattttcttgtaaacttaatatatcttgaatcgttttcactgtacttccaaatacaaatttcacgttcatttctacattttgtagaatggacgtgtccatatatactggttccatttgttttacttctttaaattcaataggttgcacaactggttctacaattttttcttcttcaatttcttctgtggcaatctcttcttcttccaccatcggatacagaagtcgccttaccatttctttcgcttcggaaattggcaaaatttgatacatcttcgattgaagcaaatcgccaatttcaagattgaacgtaatttgaacgagttcgtccacttccattgactctcccaaatattccatttcttcttttaacgttacaaatttaacatttggcggcgtcatgtccattttttcttgaaacatttctgacatcgccgtagcagcatgacccatcatttggttcataatttctttaataccgctcagttctaattcagtaagctctttttctgggtcaacttcccctgttcccatcatcattaaatctaccattgttaaggcaacatctttcgtaaatacaaatacattctcattctttagcccttcaacaaagtcgacatttaaaataacaaatggtactggtactccatcataatgacgaacattgattgcttctacatttggtgtactaattgaaactggctgatttaaaagtgttgacaatactgttgaagcggaaccaattgaaatatttgcaatttcaccaagaacatctttctcttcttgtgttaaatgctctttttcaattttttcttctacaatctcagtttccactacttctgctggttcgtctgtttcttctactccaccagataattgcattaatttatttaccatttgtttcgcatgctcaactgaaacaatttgtacaagtttagagtttacaagattatctatctttaaatcaaacgatactttaacaatcgtatgattcccatcgatttcagagattttctccatttcttctgataactttacaactttaatcgtcggcggagacatatctactgtatcttggaagaattcggacatagatgtagctgcgaatcccatcatttgattcatcgcttcttgtacagcacttagctctaattcaccaagttcttttccgtcctcgacttcacctgttcccatcatcattaaatcagcaatggacaatgcaacatcttgcttaagaacaagaaggttttccatatctaatccttttgtaaaatgaatgtttaatacaacatgtggaacttcgacatctcttgaatcatataaatctaccaactctatacgaggagcagtaatgcttacttgcctatttaaaattgttgataatacagtcgaagctgaaccaaatgatatatttgcaatttcgccaagaatatcgcattcttggggcgttaaatgctcattttctttttctagcacaatcgtgctcgtatccccttttgtgtgttgctcaggcattttccctgcctcctcatttctgtttttctatcaaataatataaactcttattttattttagcaaactcattagtataaaacgttactatgtatcccattattagattcgtaacgattagccaaaaagctccccaattgtatacaagtggggagctttccctcattcctattataaaccttctgggtttaaaatgaggaccactcgtccatcaccgagaatcgtcgcaccagagaaatagttagaactctctgcaaagaagtcacctaatgactttaagactatttctctttgaccgataattgtgtttacaataagtccatagctgcgatgtgtgttacgaacaattaacacaggaaccatttgaccatcatatgacgcaaacgcctcatctactgttttttcaccaaatacagtacttaaatgtttcacttcaataatttgattacgataatttaatacatcttttccttgtaaggatcgcatgtcttctctcttaattcgaattgcttcatcgatatttccaagaggtaaaata

SEQ ID NO: 1270 - DNA, 8116 bp, Bacillus thuringiensis
  unsure (1)...(8116): unsure at all n locations
cgcggtgtatttcgcaacaatgatggaagcaatcaacattgaagaaaagaaagagtttcttttcttaacattgacaactccgaatattaaagctgatacggtaaaaagcgagattgatagatttaataaagcttttaataaattatttaagagacgtaatattcaacgttctattaagggttatattagaaagctagaaatgacgtatgataaagaacgattcatcactgaagaaatgtataacaacaaaaagagaaaagcatattatgattctcgtggattgaaagtagacgatcataacccgaattatgatacatataatcctcatttccatgtattactttgtgttgaaaaaaattattttaaacgtaaagagctttatattaagcaggaagaatggttggaaatgtggcgagaagtaacagatatgccagagattacgcaagtacatattcaaaaagtagagttaattcgagaaggaaatgcagttgcagaggttgcgaagtattcagcaaaagattatgaaatgtcagtgagtcaagatgtgttcgacgtgttttatttagctttaaaaggtcgacaattaattgtgtacggtggattgctaaaagattatgctaaaaaatacgaagatggcgaattggacaagtataagagtacagataaaaatgagtattattatagattaattgcaatgtggaataaggatttaatgaaatttgaacaagaatatcaagagttaacggaaagtgagaaacaagaatataacggtcatttgattgatgaaatggaggttgaatagttttgtataaaaaaggtgatattgttaaacatacctgttgggaatgttataacgaagaaatgaaaatttatcggatttcaaaaagtaaggtcaaagatggtgaagatgtatattactcatataagtgctaggttaaatgtgaaaaatgtggtgcggttgatgatatttgaatgacaaagagagaaccagtcttaatattaagtttggttctctcttttttgtattgaaagaaaaccttctgagtgcagcaagtagcattcaaaaggtttttatgatctaacagagaattaacaaaaaagagttttttcttaaatttaaatttgtgaatttgtgaatttatttttaaagtttatttcgagatatattttgttctgatgatttcgttttactactgtacgagttaaaaacctatagtgtgcgcatgaatttttttagatatatctatatcgataaaataccgcacgttttttgatgttttttgaaaatagaaattctacatttttggggttgattttggatttttggtgtgggattttatttaaaaatttttaaatttgaaatcttgatttttcgatttttgaaatttttgttttccgttttctctgtaattctgtattccgaaattagggagtttatatagtacctctatgacgaactgaaaacgaaaaaactttgctcgcatatttaattcatagatatttcatatcgttaaaaagttgcaccgttttaaacaagttgtgtgataaaaaaagatgtttagattatgtttgaatttgttgtttctgtgaattttttatttcgtgattcctgtatatttttaatcctttttactcttaaaatctttttgcttttgtgcgcaaatgaaaaattcaaaaagccacgcgtaacctttattaaatatataaatatattattaaaatacctaacccttttatgatgaaaaaatataaatagttaaagaaaaaagactgatgaaaatatcagtcttttttctttagttttatttataaagagtatctctttatggtgttttctactttttctctccagttctctatatcgtcaattgatattccgatctttattaattcgtttggaatgaaactgttatctaaaatccataaagtgagcctttctaatgtgattctttcgtttccaatcgaataaatacgttcactttgtttgcaggtatatggttttttaccaacatatttttctacataaaagtatctttttccgtttgctttgtaatttgttagaaatgccatagtaatgctcctttcaggtgtttttatggttagttaaagagtagttctgtaatgttttttcaactttttcataccaatatttcacatcgtttatggatactccgatttctagtagttcttttggtatacggttgttatctaatagccacattgcgattctttctaaagctattttttgattgccgattgcgtaaatgcatttatatttgtattgctttgagtaatatggttgtgttccaacgtattgggctacataaaagtaaatgtttccttttactttttttgatattatatatgccaaagaaatgacctccaatcattaaaaatctatattactttgattaatattaactttatcaggttaatttttcaacaaataaagtatgaaataatgcatattttgaacgttttaatttaaataggttttaaattagtttaaataaataaaataaataaccttatatgtatataaattaactttaatttaaatgaagtatgaaatagtgcataatatgattttttattccatacaggtttaaaaatgttttataaagtgctaaagttgtgtttaaaaggttaaaaaacaactattctttgcacaaaagtgcccttataagaaaaaagcatgtatatttcatgagaaaaaggagtataaaaaatgaaagtagtaaataacttccgtgtgattatggcggtaaagaatatagataatgttgcagagttggttaggatgacaggggtaagtcgtaactctatcaataagttgtggcgtaacgacaatgtgtcatctttacgaatagatacattgctaccgatctgtgaaaagttaaatgttaaactatcggatttaattgaatatattccagacgatagtgagacaaaataatttaggggctattctatctttagatagcttgtgtatgatgaaatcggtattaatatttgctagtggaaaacaggttatattcgcatatggtttttggtagggttatatgcttattttaaatttcggcaaacttttatgactgtctttttctttctttttctgtttgttatcacatgaatatggtaaatgaaattataggcttgctaggtgcgtcaacatcttggaagatgagaggtaggcagatatttcgtgattttgtttaactttatgtgtgattatcgtaatgcagtaaaatgaaatggtggaattgatgagtaatgaaaaaagagttcctatttgtggggctctttttttatttgtcatggtgtatgcaaagcacatgcagaatacatactaaacgtttttaaacgtatagaggacgcatactttagggaaaatcgcttccctgaagtagagcatgagaaacccaataggcacagtctatttcaccactttttgtacaaagtgggattcggtttccttatgctcttttttatttgaatgggtctaggaatgaatatacgaatatctgtagttttaccctatggctattcttatagtgattctaatagaaaatgtgattgtattaatgtttttggggtgtttgaaagaatagaaaaagctgaagctcttcctgtaaaacaaaaaaatatgtttgtagaggaagtagttatttcactacaagaaaattcccatagatcggtggggcggtgaatataaaaagagactttttaatatatggatgtcagattttaaaagggggaggagtatttatggtacctgtcaacggtaagcggacggaatgaagcgatagcgaaatgatggagcattaaggagttgataggtaacttcgaccaagaccctcttgttcttcccaaaaccatgttttggggatgcctaccggcgagggagtccctcaaggattgaggggttggggagttcgattgaaaggggtcaaggggaagagtttcccttgtgggtttgggcaaagcccataattcttttgccatgcctgtcatggctcggcggtcgccgaaatgtcccgtagggcacacgtgtttacgcagtaaactgtagtgtgctacagtttacatggaactacgaccgaagaaggagcgatgcccatgtcaaaattcatggtttgtcatatgcaaaaattcaagatgacagatgtgaaaggattacaaatacataatcagcgtgaaaaagaaagtcattcaaattcagacattattcaagaacgaacggaacagaattatgatcttattcatgataaaagaaaagtggattataagaaattcattcaaaatcgaattgataatggtgttgtatctaatcgtgcgattcggaaagatgctgttgtttgttgttcgtttatgatttcggctagtcctgattatatgaattctttatctcaagcggaacagagacgattctttgaagagtctgtttgttttttaaaggcgagatatggagaagagaactttgtatatgcttcagtacatgttgatgaaaaaacacctcatatgcatgtgggcatggttccggttaatgaaaaacaaaaactatcagcgtattcattttttaaaaacaaatcagagcttcatgatctacaagataaaatctatgaacatgtgaaggaaaagggatttgatatagagcgtggtgtttctagcgacaggaaacatttatcgacgcagcggtttaaagcggtgagtttgcaacaagaaatagagaagttagagcaggaaaagaaagaaatagatagtcgtctttatgatttagcatcgtctttagatcaagcgaaaagtgtagatgagattccagtcaaagaaaaaggcgggttcatacgctctaaaatggtcgagattgcttcagaagacttcgatagtataaaatcattagctaagtcttctgagtctcttagaaacgaaaatagacgccttaaaaatgaaaagattaagattgaacgtgaaaaagatgatttatataaggggcaacgttttttagaaaggcaagtaacagacttgaaaagagagaatcgagggttgaaggaagcaaatgattttcttaagaaaacgttggagcgagtgaaagagatgtataaggagaagcttcctgaactcgcaggggtgattggttatgttaaggggagtatactggacaagatgaatcgcaagtttttaaaacgacattttgctggtgatgatgaagtaaagggtgctcaaaagttcttgaatcacaaacaagagcatgaagaacaacaaaagagattaaaacaagtacgaagaagccaacagaaaaattgggaccagggattggagagatagtgtgggaacattatttaatcaacaaccaaggatggaatattttcatagttatggagttaagtttataggtactgtaaaggaattggctaagaaaaataatttaacgattgaagagacatgtaggattttggaattgacgatgaaaattgatgattatgatcgtaaggatgaacaattagctggaattggagaacttatcaaggaaatgaatgatcaaattatgggacttagtggaggtctgagagctataagtgaacgtttgcgtgatatgaatgaaaatgttgtattagtatctttggaagataaagaataatggcatgttaggaggctctgtgtgagtctcttttttctttagatgtgtagcgttagcggaacttgttttgcataatatagcgaggattgtagagccttgtataacatccttgaagatagtttgtttaataaaaaagacgtggttaaatcccacgtctttttctaatttaaaggtaattttgatgagttttcttttataatttttaagatttcttcaaaagataatctctgttctactacattaacagtgaaatctgaagattcttgttcggacatttttaattcgtactcattgtataacagaaacatttctaggcaagctaatgccgttcttttgtttgcattatagaatgcgtggtttttagccaatgattcaaataatgcagtggctttgtggaagatagtcggatatgcatcctcttgtgctactgtttgttgtggacggtatattgctgattgtaataaccctgtatctttaacacctctttgttcattaggtgaatacatgtcgataagtgtttcattgataaaaatagcttgagtttctgttatataaattgtcatttcggttttcctactttcctccacgcctgaaggataattatctgtttaccaaatctttaaatgcaccgtcaaatttattgatggttctgtttaacgattccaagaacttaggattgagatcctctggcatagaaatttttttggatttttttataacgatttgttcgttttcttcgttaatttctaaacttacaacgtcaccttgtttgatatttagagtagtgtaaaattcttgcggtaatgttaaacctaaagaattgccgattttagtaactttacgttcgattttttgtgtttccatgtggcgagtgtttgctgtcatttggacttcctccttggaatttgccacactattttttgtcgtagtctaattgccactttgtgtttgtattgagtttttcgaattatatagtgtgattttatgtttgttttgtttgtttgcttttggttttttcggtcttcttagttttctcttttgtttgttgtgtttagtctttctgtattattatgacgtttagttagaatgttataacagttataacgtattaaccgtcaatacaattatactcatttttagaaatatgtaaacaaatttatatttcattgcaaaagatagggaagattgtagagccttgcttgaatttgttttatttagacaaagaaagtgtaaagggagttacctgttattctaattagcaggtaaagttcgagaatttctcgattttttcatggcaacacttcgaacgtgttctgaaatatatgtttttgaggtataggggattgatgtgtaattcttaaagagaaaatattataagttgtttgaaaaacgcttagaagtgaaaatgaagaggctgagagataggaataatttttgtttttaaaagaaaaaatgcccttgtccacgaagtggattgaagggcatttttttatggtttttcggacacgaaaaatacggttttcttctttctttaatacataggtaactatttccgcacggaaattgatgcctatgtattcttttatcccttgatacacaagggatttcgaaaaaaaagacttgctatttccggcgggtagatttatcatttttagtgtcgaattaaaaacaataactaccaaggaaggagcaagtccgaaaaagggattcgtgtacccttttttaagcaattcatataggactaatatatcaaacatgacaaagaaaaatcaagatgaaatcactggtaaattacaacctaaaaagaaacagaatataagaatttatgaatttatagagaagaaaatgagtgagagcgggagagaattgtttaaatcgtgcagtacttttaatgagtttgtggctacgaacgatgaaccgaacaagacacgagtagagggtaatgatagctaaaatcgatcatggccgattcgggcttggagaaaagcagggaaggacgcggtgaaaatcgcaacaatgatggaagcaatcaagattgaagaaaagaaagagtttcttttcttaacattgacaactccgaatattaaagctgatacggtaaaaagcgagattgatagatttaataaagcttttaataaattatttaagagacgtaatattcaacgttctattaagggttatattagaaagctagaaatgacgtatgataaagaacgattcatcactgaagaaatgtataacaacaaaaagagaaaagcatattatgattctcgtggattgaaagtagacgatcataacccttccggtccttgaattccttgtacaccttgaggtccagtgggtcccggtggtccgggaattcccattccggtccctgaaccagtaggtcccggtggtcccggaggcccttgaatcccttgtacgccttgaaagtcttgaggcnccggtggtccttccggcccctgaatccctggcacg

SEQ ID NO: 1271 - DNA, 6176 bp, Bacillus thuringiensis
ttttttggcatggagtttggttgtttggcttggtgcctctccaaactttggcggtgttaaggttcattttgtagcagaattgtgcatcacctcaatgaatcagttagatggaattttttgcttatagggcaaatttacacctatctgttttttaaagtcaacacatttgttagaaaatagaaagataataaaatatagacttgaagttttattcagaatattagaaaatagtgaataggttgaattgtttcaaaaacgaaaaaaggagtgtaggtaaagtgattgatcaaaaattcgatccactacaagcatggaaaaatgcttatgaacaaaccgaaacattttggggaaaagcgctcaatgaaacaattaaaacagaagaatattctgcttggatgggcagcgttctagatttgaatttgttttatcaaaaagcattaaatgatacgacaaaaagctatttagaacaagtaaatgtgccgacgaaagaggatatcgcaagagtggctacgcttgttattaacttagaaaataaagtagataacattgaggagtttctagaggagaaagtacattctttaggacaagctcctacattaaagcgtgatgtgacgaaagtaaaacaagatattcgtacgcttgaaacaaaagtagatcaaattttagaattgctagaaaagcaaaatgcagaactagctaaactacaagtacctgtaaaagaagaggtaaagcctgcgaataaaccagaaaataaaaaatgataaaagcgcttgtttataacatgtaaaagagagagggagaatctcttttcgtgtataaacagcgaaacataattatatatggactctatagtatgagtaccaaaatgattcataacaatcgttcacaaattcatttaagggggaaaagaaatggttcaattaaatggaaaagtagcaatcgtaacaggtggagcaaaaggaattggaaaagcaattacagtagcattagcacaagagggagcgaaagtagttattaactataatagcagtaaagaagcagctgaaaatttagtaaatgaattaggaaaagacggacatgacgtttatgcagtgcaagcggatgtttctaaagtagaagatgcaaaccgacttgtagaagaagctgtgaatcattttggtaaagttgatattcttgttaataatgctggtattacaagagatcgtacattcaaaaagttaaatcgtgaagattgggagcgcgtaattgacgtgaatttaagtagcgtatttaatacgacaagcgcggttcttccatacataacggaagcagaagaaggaagaattattagcatttcttctattattggtcaagcaggtggatttggccaaacaaactactcagcagcaaaagcgggtatgttaggatttacaaaatcattagcgttagaacttgcaaaaacaaatgtcactgtaaacgctatttgcccaggatttattgatactgaaatggtagcagaagtaccagaagaagtacgtcaaaaaatcgttgcaaaaatcccgaaaaaacgttttggtcaagctgatgaaattgcaaaaggtgtagtatacctatgccgtgacggtgcgtatatcacaggtcaacaattaaacattaacggcggattatatatgtaatgaagtaagaaaaaagtgcatatccatagcaggaatgcacttctttttttagaaggaaatcgaccaaaaagaccaactatgagaagtcaagaggaattttataaataggaaattaaaaaaagggtgcaccaaataaccctaagagatgttaaaaaaataaaagtatcaaacttcttttgaatattgagggatttcatacggtttattgttttttaggatggcatagataatgtaacacaactttctagctacagctcctatacaaacatagtagtgctttccttgttttcgtttcttctcataaaaagctttcaagacagggtcatgtttatgggctgtaatagcggcttggaataaggctctacgtaaatgagaagagccacgcttagatatagacatacctgatgattcaaattgtccagattgggacacagaggcatcaatgcctgcataagcgacaagtttagatggtttgtcaaagcggtgtatatccccaatttcacttagtatagtggcacctaaaattggtccaacgccaggtactgtcatgataggagtatctaaatcaattaaaagttgtgacatttcgtcttcacattctttgatttgatcttcgataaaactaatttgctccatcaacatttttagttggaaggaaaaagcgtttttacaaaaggtaacaccaaacgaattagaggctaattccattagcttgttagctgttttctttcctagtcggttacgactggtttgctcaattatttgtgttaaatcatcaatagatatctgttcatagtcactaggagaggcatattcaagtaagatttgtgaagaagttttaccaaaaacatccgaaaagatgctttggtactctgggaaagtctgatctaatacgacaagagcttttcgttttaaatcactcatattgcttacaagcgcattacgaaagcggctcatttgttttagagcgaacattttttcgtccacaagtggggtttcaacaaaacggccaaatcgaatgatatcggcaatcatagtggcatcaatggcgtctgtttttcgctttctaatttctgttccttttcgccaggcattggtttgaatggggtttaatacaatgactgaaaatccatgatccagtagaaaagaataaacagctaaccaataatgtccggtggcttccattccaatcagtatttctgtaggagactcaatgtattggtagatctgatttaaaagggtttgtccaccttctttgtgattctgaaaaggaaatggcttagtaataggttttcccgtttgatcgataatggacgcataatgtttatgtttagcgatatcaatacctaaatagaacatagcttacacccctatattaattagtgttagatagtgctttcctcccctgaactaataagcgctactacctcgtaagagatacgaagaatgaccaatggtcatcaacatccaactcattcgtaaactacttattagacagaggtaccgctcttttttacgaatacaaagattcagggagatggtcggcaacactctatctacaaatattagtatctcataaaaatagatacccttggatttataggtacatcccgtccctaaaaacctaacttaatcatacgaggagatgataaacatggagactgcactactagcagccactgaaaaaaatgaaacgaatactgttatatctttactaaaacaaggcgcaaatataaatgcgacggatagtcaaggacgcactccgcttatgattgctacatacaaaaatgatgtaaaaaccgcaaaggcacttatcgaagctggtgctgacgtaaatatccaagatgacatgaaaaataatccctttctatacgccggtgcggaaggttacttagacattttaaaattaacaattgatgctggtgcagatcctacgattacaaatcgttacggcggaacagctcttatcccagcctcagaacatggctatattgacgttataaaagaactcctcactcgaacaaatattgatgtaaatcatgtaaataacctgggatggacagctttaatggaagccatagtactaagtaacggaaacgaaacacagcaacaagtcattcgccttcttattgagcacggtgcagatgtaaatattccagacaatgatggtgttaccccgctagagcatgctcgcactcatcactttgaggagatagagaagattttgttagaggggaataagtaaaaaatgtactaaaaaatccgaagcgctcatcacttcggattttttaacaaccttatttatccataacaacaggaagctggaatgaaacaatcgttccttttccaagttcactttttatttctaatccagttccgtataactgttttaatcgtgcatccgtattcaataaacctattccctgtttttgattcggttttttcactaatatttcttttattttttcatctgacatgcctatcccatcatccgcaatcgaaatgtttataaatccactcacactctctatttttatatgaatgcttccaccctttgctttttttaatataccatgacgcacagcattctctactaatgtttgaatagaaaacggtggtactacacattctattccatcttcgacttccagcacgctctgtattctctttccaaatcgctctctttcaatataaaggtatgattgaagtaaatctaattcatgctgtataggtacggtttccgctaacacttcttcaccaaaactggctcttaaatacgttccaaactcaacaattaatttctccatcctaacaatatcaatttcacctaatgcagcaatcgtatttagtgtattaaacagaaaatgcggctgaatttgcgcctgaagccaagcaccttccattcttattcgctcatgaattgattgctttaactctgttaatgcattaattctcacttttaattccagtgcatctataggctttacaatgtaatcattcgccccagcaagaaatcctgtataaatatcttctggctgcgacctagcggttaacagtacaataggcaactctgcaatagagtattgggtacgaatcatttttgttaattcataacctgacattttcggcatcatcacatctactaatatcatatcccactccatatttaaccgctccaaaacctctcttccggttgttaccgtttcaagttcatattcatcttgtggtaatatactctttaatacttttaaatttataggatcatcatcaacagcaagaattctccttctattaccgactcgattatccttcatttcaacttgttttaattccactactttttcaattgtttcttttgacacaattagcatctcttctctttcagcaagtggtaatgtgaatgtaaaagtagagcctttgtgtaaaacggatgtaacagtaagtgttcccccgtgcatttccactaattgtttacaaatacttagcccaagtccaaatcctccactttcaccatatgaatcactaccttgttcatatggaaggaagattcgcttttgcgcttctttatcaattccaataccagtatctgtaacctgaatagccgcgtaattttttcgtttttcaacatcaattgtaatagccccttcatccgtaaatttaactgcattatgaagtaggttaaataaaatttgaataagacgattttggtcagctaatacaaatggaaaccgttcagggatattcgcgataatttgtaatttcttttcttctccaataaacttttgcatatcaatcaccattgtaataattggttgcaaatcaaccggtctcttatgaatcggtatccctttctgctccattcttgtaacatctattaaatcgttcaacaaatacgacatacgccttcctattgtcattaatagttttagatgttgtttactttcaccatttatcgctttctcttcatccattacactttgtgcaatattcatcatcccatgtaacggatttctaagttcgtgcgctgtatttgctaaaaattgatctttcttatgatgctcttcttttaattttccaaccagttcactattctcatcactcgtgcgaaagaatcggataaaccaaaaagtcgaaaatgataccattgctaaaaaaatatcaaatggataaaaatccgcatcaaatatcctcgcaaaccctatgctatacatgaacgcaaactctttaaaactcgcacacaatactccagaagtagcactaatcactgtaaaaagtaaaaagattaaagtcatactttccactttccaccactcgtacaacaataattgctgttaaaatgaatggaataatacttgtagaaaataatatatatccataatcatgccctagtgtaggtgaagacagcaatcctctgaagacatagatcccacataaaacgatggtacataaaataaattgactgtccccataacctcgtatcaaccttttcatagtcagtaaaataaataaagcgcaaccgac

SEQ ID NO: 1272 - DNA, 9802 bp, Bacillus thuringiensis
  unsure (1)...(9802): unsure at all n locations
tgccgaatagttatatagattcctctcttatcttccaaaacgaaaactcgttttgcaggaattagcaccttagcttatacgtcataagctcggttgccgggcatcatcgggccagtccctccgccactcttgataagagtatgtgtatgtagttttgaatatggtactaatagtaaatcgtacaaaaagaattgtcaatgatattttcggaatatattttattttaagataatcgaaacattcccctttttatgtcctttttctacatatatatgagcttcagcaatttcttctaatcggtaagttctatcaataacaggttttagcttttctgtttcagctagttgttttagcaggttcatatcttctttactgacctttgccatcattccgttcacagatacatattttccattaggcattaatgcatctgtacaaagagactttttatattttccaactgcatcaaatataatatcgtagtgctcgccccgcttagtaaaatcttctttcatataatcaattacgttgtctgcccctaaagttgttactaaatcgaaattcgaactactacaaatggctgtgacagtcgccccgaagtatttagcaagttgtatggcagctgtccctactgacccagaggcgccgtatataagtactcgttgccctttttttatctgtccttttctaaggaagtgcaatgctgaagttccgccaaaaggaataacggcagcttcttcatatgtcacattggtaggttttaatgctattaatccactttcatgcacgcatgtgtattccgcataaccaccaaggtttagttctgttaatgcaaaaacttgatctccttttttaaattgtgttacatctgttccaatgtcttcgatttcaccggataactctacgccaagtataggttttctcggttttctgaaacctaatatgatccgcataggaatccaaaataagagggggctattaaagccacgtattctacaatctccagtcgatacacttgttgcgtgaattttaactaacacttcattttttttaggtttaggcttttctacattttgaagctggagaacattaggtggtccgtactttgtacaaataatcgctttcataatgacctcctgaaatgagttgttattatttacatcatatttaaactttttctcaaacatgttgttatataggaaataaatttaaagataaatattacgaattatatagatttcataggaaaagagatgatattatttttgggaaggaggggacgttatgaaaaaacttattttaatttcaagtttagtacttgcagtcggtctaggagtagggtgtagtaatgagaaaacaaaaaagactgacgaaccgaaaaaagaagctgtgcagaaagaaaaggaattaacagcgaaggatgtttttaataaagcgaatgaagcttttaaaaacgaagaaaatgtaacgatgacatatgatgtgggaataaaggctgaaggaacagagatgaatgtaataaaggctaaaatgcaactagagccgaagaaaaaaaattctcgttctgaaatgaatgtttctggtacagaggttgttgtttatgatgtgggtggcaaaattgctggtcagttgaaaaatcctaatacgggtgaaattatgtctgtaccagaggaacaattgaatgctaacggaatgaacgcgactcaaggaatggtagataatttagagattccatcggaaattttaaataaagtgaagatggagaaaagtggagataattataagctgaagtttgcattaaaagggcaagagacagagagtatgctagctagtatggatgaaaagcagaaaaaaatgctacaaggccaaaatgcaaagatagaagaaatagatggggaatatattattacaaaagattttaaatatgaatcagcaaagatagatatggttatgagtagcaatggtgaggataaagcgcacattattacggatgcaaagtttacatcgtatgataaatttgatccaatacaattgccagcagcaaagtaatcactgtcaagagaggtacctgaaagaaagggtatctctttttgttgctaataaggagagtgtcctttgaaaaaaagaaagatagcagtggtcattgtcgcatatacggttttgcttgcaacgtctgtacatacgtataaaaaacaaattgatcatcctattatgagtgatgtaggtaaattgcttccgacaaaaataaaacgtgttgaaagtgctacggaagagcactcgttaataaaattagtgcgagatgcaaaagtttcaggagagaaaatttccatcgcaggcatgcaacatagccaaggaggacagacatattatccgaatggcacgatgctcgatatgaaaggatataataaaatattagaatttgatccagagaagaagcggattacagttcaaagtggtgtcacctggaatgatattcagaagaaaataaatccttatggccttgcggtacaggtcatgcagtctcaaaatatttttactgttggcggttcattaagtgtaaatgtacacgggcgtgatattcgtcatgaggcactgattgatacagtagattcatttagattgttaatggcagatggcacggtacgtaatgtaagtagagaagaaaatgcagagttatttccatatgtcattgggggttacggtttatttggagttattttagatgtgacgctgaagttaacagatgatgaattatatgaaatgcacacgagaatgatagattataaagaatacgcatcttatttcaaagagaaagtgaaaagagatgagaatgttcgtatgcacttagcgcgtatttctgttgctccaaattcatttttaaaagagatgtatgtgacagattatactttggcacaaaatcaaaatatgagagaagagtacagtgaattaaaggaagaaaatattatagctgcaccgaaatttttgcttgggttatcacgttatagtgattggggaaagaatacattttgggatatacaaagaggttattttgaacgtacagatggaaagtatgagacgcgtaataatgttatgagatcagatagtgcttttatggaatatgaaaatccaaataggaccgaagtgttacaagaatactttgtacctatagatgctttcacagagtatatagatgatttacgtaacgtattaaatgaagatgagtttaatttactcaacattacgattcgttacgtggaaaagaatgaaaatgcagttttgtcctatgcgaaagatgatatgtttgcgctggttcttttgattaaccagggacgctcagagagtgagataaagaaaacagaggatgtcattcgaaagatgattgatgttactttaaagcataatggtagttactatttgccgtattattcttatccaacgaaagagcagttaaagagggcatatcctcgcattgaagaatttctcaagaaaaagaaggaaatagattcagaagagagatttgtgaatttattttatagggagtatacgaaatgacatatagaagatttgtggcttcgcaaagtatcatcatgatggcaggaagtatggtatttcctttttatatattattgcttcgaaacgttggaaatagcttctcgcaatttggctgggcgtatggcttatttgctttaacatcagcacttgtatatccactagtgggaaaggtatctgatcaagtaggggataaaaaattattaatcatatacgcttggtccatggcaatcttaatgctttgctttccaattgccacggaagtttggcatgtgtatattcttcaaattgtaatgggcgttttaggtgctgtgcagcgtaatactgagaagacttcgttagcacgaaaggttgcgcaggaaaaggctggttatgagattggaaaataccatgtgtggacatccattggcggagcagtagcggttattgccacgggatatttagtagatttctttacgattggtacaattttttatattgcatctattctatatgtagtgagcgggattgtattaagtagtaaaaaaatataactattcctattttcaccttaataacctttatttgttatactaaaagggaatacaaaagaaaaggggacagtgcctttgatgaaatttgtagttttagctattcttactttgtttttgattccatggacaagaagtagtagtaagcttcgagcagtggataagaagggagataagaaggttgtaaagggtaagaaatcatctattttagttattcctgttttattttggataggtattgcaatctatgaatacttttggctaattgatgatcgagtagattcgattcttactcattattctgttgcagtagcaattttaattgggcttgttttattttcacaagatcaaatagggaaattagaaggtacattaaaaggacttctaatgtttattttactcgcaagttacggctactttggttatttgcacgatatagtaatctcgcaaaagaaatatgattctgttgttaaggtagagaaagatatttcagagccatttactgaaaatgaccagccgtttacagtgccgccaaagacagcggagaataagatgaaaaaagtatttggtgatattccaaaagtagcttattttgagctaggagaattaacgccacaaatggtaaacggcgaggctttatatgtagcgccgattgaagtttcaggattttttaaagcgcgtaaagctgagacaattccagggtacgtaacgatgtcaggtacgaatcctgatgcggaagcgaaactgcacctcggttataaaatgaaatatgtgccaagcatgttttttggtaataatttagagcgtgtggtaaggcaagcagaaccaaatttaatctttaaaggaaaacctaaatttgaggttgatgataaaggaaaaccatattatacaatgacgtatggtgaatttatttcaggaagatctggatttgaggtagaaggtgttgtcgtagtagatgcacaaacaggtgaagtgaaaagatatgataaaggaaaggcacctaaatttgttgatggtgtattaaatcatgagactgcatctacgttaaatacgtactttggcaaatatattcacggattttggaatacgaaattctcgcaaacagatatgaaaattccgactgagtggggaacgaaagaaggcgtgaccccgatctttggtaaagatggaacactgtattattttacagactttacttctccaaaagaaggagtagattcagctctaggctattcattagtagatgcacgcacaggcaagctatattactataatggaaaagaagtaaaggggattatggatggttcagcagctacagaagtagtagataattcctttaagagagagaaatggcatgggacaatgcctgtcatttataacgtatacggtaaaccagcttggattattccggttgttgatgacggaggcctagtacgtgcgcatacagttgtatatgctgctaatgcaaaaatatttgcgacaggttcttcgcagaaagaagcgcttgagaattataaaaacgtaatgagcggtaatggtgatacatttagaccaacctcaacaggaaaagaagcgcaaaaagaaggtattgtacaacgtgtatataaagaaaaatcaggtgaaaatacaatcgtgtacgtacttttagaaaatgaacaaaaggtatttatgataccggtgaagaaattcccatatgctatgtttacagaagtaggagatccaattcaaattacatatttagatacgggagagacgatggcctcggtatctaaatttacgaatagcaatgtgaaaaaataaagcggtagaatttctatcgctttttttacattatgaaagaggaaaatgcactgtacttgacgtatgtttatgatgtaactataattgttacgattcagtgtgtataggaaagggtgaattgaaaaagtgaatgaagttaatcacgaaatatataaacctgtaaaggcaaacaggttgtggatgattcttgtattagggacacttacggcgattgggccattatctattgatatgtatttgccttcattaccgaagttaacggatgacttgcaaacaggtgcatccctagcgcagcttacattaacagcttgtttgcttgggttgtcagtagggcaattatttgttggctcaattagtgatatttacggaagacgcaaaccacttattattgctcttattatttatgttgcttcttctttactttgtgctgttgcgccatctatttggacattagtattattgcgcttcctacaaggagcttcaggatcagccgggattgttatatcacgtgcgatggtaagagatatgtactcaggttctgaaatgacgaagtttttctcactgcttatgttagtaaacggagcagcacctattttggcaccgattattggggggcaattgttacagtttacaacgtggcgcggtgttttcatcgttcttggagcaattagcgtattcatgttaatctcagctacttttgtattacgtgaaacattacctcctgaagaaagagaaacaggtggtttgtcagggactttggcgacgtacggaaaattgttaaaggaccgtctatttatgggatatgcattgtcacaaggattagtaacagcggcaatgtttgcatacatttcgggctcaccatttgtgttgcagaacatatacggagcatcaccacagcaatttagtttattctttgcgattaatggcctcggtattattattgctagtcaggtaacgggtcgtttagcggggaaagtgaatgagaagacattatttgttgcgggtattattatcgcagctgttggtggcctatctttactactgacaatcgtactaggaataggtttaattggtgttttatgttcgttattccttgtcgtatcaagtgtcggggttgtatcaacaactgggttctcattagcgatgagaaatcagaaacaagctgcaggaacagcatcagctttattaggtttattacagtttatttcaggagctcttgttgctccgctagtaggtatcggtggaagtaatacagcattaccgatgggtattgttattgcgctttgtgaagtaggagcagtgttatgttatctatttatggccagaagaagtgagaaacagtttgaactgcagcaaaaacaaaatctagaggcttaacaaaaaagaactgattcaaagggaatgtttgaatcagttcttttttcatttctttgaaatacctcatacagttttgtaaggtgatgtagtaaagcattgcaaaagttatttgtataaagtgacgatactgtgacaaacatgttggtatatatatattacggtgtcgtcttaagtgtaaaaagtaggatgttctcggtataataacaagtggagataaaagaaactataatgagtaatagttgtagataaaaggagaagaagagatgaagaaggttttgggtattgccgtaatgggaggaatgctccttctagcagggtgtaatggaaataaagatacgaaagaaccgaaagaaaaggtagagcaatctacagaacaaacagaagagatgaaagaataccgtgcagtacatgaaaaatacgatatgaaaatgaataaagaaattaataaagcactgcagttatttgaagtagcaaaagaaaagggcggtaaggaaataacgactgctacatataaagaagatgtgcaaaaggtaacaacgagcatgttagaagatattgatcatatacgtaaagaaattcgtgttccgaagtcgaaagagcaagaacatgaagtatatgttggtttcttgaatgaatcggaacaagcgatgaaaaaattacagaagttagctaaagaagaagattcatcgttgattcgtgatatagaaattaattttgcaacagcatcgacatactataaacgttttcaagcagaaacgaaaaaataaccttgcctgtgcaaggttattttttcttcttactaccgcctacttctttattttatttctcttttgtattcttttttcgttccatcagagaagacaacttctaaatcaaatttttgatagtctttatcaagtttgaacacgttcactacttgatcgattacttcttggtcagcagtatttttatcaaattttaattcttgtaagagtgggcttaattttgtgatagcctcgtctcctgttaattttacatctgctttatgatcttcaatttttgcttccattttcttatcagctgctacatttttatagtctgcttcgtagtctttctttgtatcttggtagtctgcctttaaatcgaattcattgaagtttagttttaaatctgcaggagcctcattttttgcttcttcagtcgtctttttattagaagttgtgtcttcttttgcaggagctttacatcctgttaatgcaggtactagcataagagctaataaaactgatagtagaattctcattataaattcctccttatgtaaattcgttctatacaagtttttcccaaaaacatgtaattatgtatgtgttgaaaataaattattattctgtagttgcaagggctaatccgcaatttaaatcaaaaaagatttgtatgtatatggtaaattgaagttgtgaggaggggctaaaatgcatgaagaatataaagagataataaaaaaatcaattgaatatatagagaatcacttacatgaggagcttacaacagaaagagtggcatctcacagtgcagtatcgatgtaccattttcatcgcatctttcaaagatatgttgggatgagtgtaacagattatattcgaaagagaaggttaactcatgctgcgcaagttttagtgtcaacggagagagctgttattgatattgcagtgcaatacggtttttcctcacaagaggcatttacgagagcttttaaaagaatgtttcaattgccaccaaagaaatatcgaaagtactttcagtcattttatatagaaagagagggtgtttcaatgcaaaaaggtataccgaaaggatggatcttaagtggaagtcatcctgctgaatatgagatgggtttagattatgaagttgtccatcaggggaaagtatctgcatacataaaagcaaaagagaatgttacgcacggaggattttcaacattaatgcaaatgttccgagcggataaatatgtaggaaagagattacgttttacagcatttattaagagtgaaaatgtaagagattgggcaggattgtggatgcgagtagatggaaaagatacagaatcgctcgctatggataatatgcaaaatcgccccattaaaaatacgaataactggcaatcgtactcggttgtattagatataaaagaagaagcacttggtattgcatttggtgttttattatcaggagaaggttgtgtgtggctagatagtattcgatttgatgaagtagatgaaaaaattccttcaacagatttggcagagaacttttatgaaacacttttagaagagccggtgaatctacaatttgaagaagtagaaaaataaagaataaggagaaaagatatgctcaaatatgtaaaactaataagtatttgtttagtaatatcgtcttgtattatgggagttaattatttagttaggtatctttggtcagggcatataccttctttgacatgcagcanatatttgatgtttgtgtttatatgtatataagttttgtcatgcaaaaacaggaaa

SEQ ID NO: 1273 - DNA, 8210 bp, Bacillus thuringiensis
aattttaggtgccactatactaagtgaaattggggatatacaccgctttgacaaaccatctaaacttgtcgcttatgcaggcattgatgcctctgtgtcccaatctggacaatttgaatcatcaggtatgtctatatctaagcgtggctcttctcatttacgtagagccttattccaagccgctattacagcccataaacatgaccctgtcttgaaagctttttatgagaagaaacgaaaacaaggaaagcactactatgtttgtataggagctgtagctagaaagttgtgttacattatctatgccatcctaaaaaacaataaaccgtatgaaatccctcaatattcaaaagaagtttgatacttttatttttttaacatctcttagggttatttggtgcaccctttttttaatttcctatttataaaattcctcttgacttctcatagttggtcttttcaaaataaagaggacacctattcctaaaacagctttaattactgctttaatgaattggtgtcctctagttttctagccggactatattctgtttgctttactttaaaaggattattttattaagttttgattgtcatatacatttcctattacttcgaatgacactgcactcattctcaaatcttcatcctcatctccatctggatctttgtagtaaaacatagcgtccttttcgtgccaatcaactctgtagactaaatcgttatgacatttgacaatatcaccttcgtaaattgccttgccgttcttatcttctacgcctgtatattgaccaactgtttcagcttcaactcgaacatcaccctctaattggctttggactataaatggaactgactcccaaagacctagcatgccatcaaacatataaccatcaacataataaccataatgccacttccctctttcatctcttccacgacatttaatttttctcattttcttgttcctcccctgaataaaactcaatattccgtcaatactgtagacaacccattaagttactttctccttgttcccccttggagatgagcagttagcttttgctagctgctcttttatgttagtgacgaatcaattagtaatgttgtattcttacgctcattaaattcttttgttatttcttcaatcgttaaatatcctgctactgaaattgacgattcaatatatctgtttaatgcttgctctcttgttatttctgtaggttctccctcttcttctatttccttaatgctttctccagcaacttcttctacataaacctcgatagctttatcttcatcctctgctgcaaccattgcccaatatccatgtttatcaaactcaaagtatttcatatcaattccccctctttaataggcttcatgctcttgattatttcttttacatgttgcactaactcttcacgatccatttttgtgtaaccttttattttgttatgtctacaaactgatttaagttgttttaacggccacttttctactggtggaatactaacgattacagtttggtcattcatacctatatccatatccattctccttttctacaaaatgaaatttttgttcagttttctttaacttcaatttcctctgctacatcttctagtacgctagctagataataagcatcatctacataatctgtatggatcgtaaatgtattagcttttgtaacaatcgttactttaccttttctcattctttcttcattaaatcccgtttcattaaccgtaatttccatctttcattctccttttctactaaaatgaagtttttattcgatttctgcacttataccatcttcgcttagaaactcacataatatttctaagtctccactcgctacaaccatttcccatgcttcaccttcaaatccatactcctctgaaagaacatttacagcatgttcaaaattcgtaaaactaagttctccgtaatttataaccaaacttcgaacgttatccggttcttccgtttgttccagttttagctcatcgatagttatgtctttttcaactagcacctcttcttcgacatatccatcacgaacgcgatcagctgcttgttctaatgtttccgcttctacaattccctcatacaccttagtttccgtatacgttacagtaaatgttttcatcattcattctccttttctaataaaatagcgtttttgttcagtttttatctttttccaactgttctttcgctctattaactacccacttcaactcctgttcatttagattcttacaatgaacattatctctatagttatctgttatttccccgctttgcatatcaaaagacaaccaaattgcagcaatttctaatcccatttcatagtagcctatgattattcacctctaaccaaattacgattttatgaaaaagcttgcttaattctggcatcaataaaattccgatcattaccccagcaataagcttcatagcatttaatttcttctaataaacactctaattcctcaacacgaccaattaccttatcaagcaattgcatcatatctaattcatttgttaactcttcttgaagtgctttccatttactcctttggcgaaaatgaatattccatgcttgctgcggagtaaatcccatacccattaattcctttactatatctggtagctcggattcaaaactgaaacttgttttttgcgggatttctacactatgcttgctttcgaacttaaaattaaactcaacaccctttacttccgccactttcatcggcttaccatctttttcgatgaaaaaaatagcatctttaatatctgtaagtgtatgatccatattgttttatcctttcaaataacgaatttatttggtctcttcacatttacaatcgtgtaaccactcatcacacttcctgcattcacactcacagttttctaatttctcatcacatctagagcaataatctatgacttcataaatcacttgtttccctccttactaagttccttaatagtccgaatcatccaagcaaaactgttcgcttcaactactatgctcttcccttgtactaaactagcgtcacatatcaggtgtagtttttcgattgttgtcatttccttttgctcaattactttctcccagcccattttgtctccccctatcaaataaagattttgttatatttcaccttcgtgcttttttataatgtttagaacttcctctgcatacggctcgtcttgattaaccacataatatttaggttgtgggttacgcccttgtttctccctttcgcactctatctttcgtgaaatcccctctaaaatatccctttcgttcgcggatgtcatttttaaaatatcatcgaattttaaaactaaaaatttcacttattgccacctccttttcgattaattaagaaattttgtttaaactaatgttccatcaattaacaacggaaggttttcgcattgatcaaacattttaatccattctgaaatatcatccctacccattacatctaaatactttgatagtgcctgttcacgcgtgatctctactggtaaaccttcttcctctacttccttgatgctttccccagctacaatttcaacatatagctcgattgctttttcttccccaccatctttaactgccatcaaagcgtaataatcatgtttatcaaactcaaaatatctcattattattttcccctctcgtttaaaataagaattttgttataaattaacgattaactacttcgatattaactatctggccaaatgtaggatattccttaatttcttttagccattcgctgatttttgaatctaactttttctgaagtaggtctatttcatcttggctaggtttagataaccagctttctgaaacttctccacatgcctcatacgcatttacagtaacttgatcaataacatcttctgcactaacatatggcacataatcacttatctgtccgattgaaaagttatctccataaggaactccatcatatttttcaagttcattcatttcttccttcgctgcctcaatcgcctcttctttagtagcaaagcgatcacttgtccaaatttcattgccagtaaggttgtacatccattccatctctcattctccctttcgtgttaaaataactattttgtactaattgactcccaatcaaatgtttctaatatattcaacaatcgttccacttttggcgcccgccatgccgtcatagcgtatgtgtggaccttgcttgtgtaatgatgtttgtttaactctatgtgcttcttagcttccgctttagttaagaacatcgtattttcaacaatgaatgcttcttccttttcgtatactaaatggcaatcttcatcgatgttttctttaatccactcaactaggtcgtattcagaagcgtattcttgcaattcttttaagtcttcaatctgttcttcagtaagttcatgttcaatttcatcgttaataatttcttttacgtattcatcgacaattacagcttcacaatcgttaacaaagtataatgatgttctttcgtggtacccttctgcagttacaacccatttataatccattaaagtccaaaagcgtggtgatgcttggcaatcgatttcctgtgtttttaattcctgctgcaattcctttaaaaattgaatgtccttattcatttcccgattcccccagtttttttattccatcgtttacacttttcaattgctcttcgaacatttttatcatcgatcttctcatgcgttcggtattagtaggatataaaacgtgatcttctatatcctcgattttatcttccaatctctttttctctttatttaacgtgtatagagcgtgattgtatgccatatctatccaccttttcgattaaaataatgctttggttaaagctttataggattgtttcttttgataggtttagtcgaatatgtaatctcaacttctcttgaatactcaatttcagaaccgcacatactacaatcaattttgtcattgtcttgcgaacgctcccaggcatctacatccttctcgccacaataagggcatgttaaatgttcttcatattcgacatcttctggtttagactgtaattgtatttctctaacaccgatcaaattattttttgggtattttgcgcaaacgtgataaactttaccatctatcataatgttagtgcttatcgccaaatcacaatctactacttttataacttccgcttctttattctcatcgaaccatagttccatatcgtatttaacgattgtgtatgccatctctaattccccttttcgattaaaataacgcttttgtttgattctcatccgcccatattaggattgatgcattcccacatataattatcaaattcaatctctacgttcttaataatctcgcctttatgaatctcaacatcttggttgaattccatccctttctcaaacgcataaatttttatatccacgttgtactctttagacaaggttgctaatggtgctgcatctatgccccaagccgccttataatcttccagtacgcatatttctaatttatcttcatcatcttcaaaataatgttgaatgttactctctataaaattccgacgtgttcctttaatatgaaaagcattttctgacttgatgaagatttcatactcatcttcctctacgatcttttccacaggcgtttgttcaaagaatccgtttggaataggagttagtgcttccaataaaaactttctaacatcctcttttgctcctctaactttaaaagtaccttcacaccaatttggcatatctctcattctccttttctaataaaattcaaattttgtcttaatatccgttatcctggcgctggtggttcacttcattctttttgtaataaccttgttcaatttcttcaaatgtgaatcctaatttcttacctaaccctaaaaacgagtacaataattcttcataaagctcaatatcttgagttgcacgaaattccgatataccttcatatacattgttaaattgattgactaacgtacttgccgtatagacgtttgcattatgttctaataatttcaggctatattcattaggattaaatccgatgccattccctagtgaagctataaaatgaaatccatctacatactccattaaaataacttctttttcactaggtcctttattgctccaatgcttaaagcatcttgtttcatttgcaagttctccaatttccacctgtaaagcaaggatcatattgtaaaataaattttgtccttccaatccatgctccttaatgattcttgtatctaataccttttgcattccgaatattttagttaagttcattttgatttccccttcctatttagcaaattcctaatcctatcggacgatttgttattaattcctgatcagcttggtctatcacaaggagcgcaacctccgcttggtgcctccttaacgcttttgccatctttggcaagctcataccttgtttccacatttcacgaaaacgaattacatctctttcatcccaaataaagttagcttcctctaaagcgatgtaaatttttaatcttgattccttcatcgcttcatgattacttgctacgctcataagcgaacctactttctaaaaatgattattttatcttttcagtaaacttagtatccactcgatccactttaccgttaacccatactgcgacttgctcaccaaatccactgattggcgggttaactgccgtaacattcccgtccttgactatataaagtttgttgctgctaacatcaatttctatttttttcatatgtccctctcccttttactaccgcatgtactcgacaacatcaggtttgaatccacttcctaagtaaatccttaccggaattatttcttttttatcccttgctgccttacacaattcttcagccgtatcccaattgaaaaacttatctacagccctttgaaatctccaaattgccattacatattgttcaaagatgtcataacgatcatcttgtttagttgtgcgtggtaattcatccgtaccctttgcatttcttggaacttggacgcgtacatcagcgtatgtattgcgtccagttcctttcttaacattggccttcattacatcgaactgacaaatttccggttctacatcgaaaatatttaattgtttaggcatttacaatcccactcttctcaatagcgcccagcaactcacttgcaccttccttacttaaaaacatccgaccctctagcaactctatgtttgattcagaaacttcacccgttacaaagcatgacttatcctgtttttttaaaacgatgttttccccttcaacatgaaatcctaatgctgtaccttcaacaattcctaaatttctgcgtaactctactggaattaccacacgccctagctcgtccacttttcttgaaacacctgtgtttttcataactttctccccctttttagctaactttttgttgttgattccgtttcaactcttgtttcattgattcaaatttgattaaccatgcttgccaacgcttatcgttttcttcttgctgctgctttgctacctcacagttacacccttccgttagagctacacctggataaatttctttacgaataattcctttatcacgacataatacacacatgcttattcctcctttttgaagtttcgcaaactgtaattttcaccgttcattttcaacacttgagtatcttccataatccgactaaactcacgctctccgtacattcctgctaactccataactccaaagtttgttgtaaataagtttgttctgcctagcctacgctctagaatgtccttggttttcgttttcttccaagtaactccctcagcatctttttccgtaaactcggctccaaaatcatctaatacaagtacatccacatttgcgagaatagacattagcttgtcctctgttaactcgctatttttattccaggtagatgttatttttgtgaagagagcgttcatttctataaacattgcgctatagccttttctcataatttcttttgtagccgctacacataaatgactctttccaactctatagtcacccgtaattacaatgctttctgacttgttaggttcaaagtttctagcaaaatccatcattacttctttagcatttgctaattcct

(The sequence listing continues in the following parts.)

What is claimed is:

1. An isolated nucleic acid molecule having a nucleic acid sequence that is the same as nucleotide position 2466 to nucleotide position 3581 as set forth in SEQ ID NO:1164.

2. A transformed cell comprising the isolated nucleic acid molecule of claim 1.

3. The transformed cell according to claim 2, wherein said cell is selected from the group consisting of a bacterial cell, a plant cell, an algal cell, a mammalian cell, an insect cell and a fungal cell.

4. The transformed cell of claim 2, wherein said cell is a plant cell.

5. An isolated nucleic acid molecule obtained from *Bacillus thuringiensis* having a nucleic acid sequence that is fully complementary to nucleotide position 2466 to nucleotide position 3581 of SEQ ID NO:1164 and encodes a 4-hydroxyphenylpyruvate dioxygenase (4HPPD) enzyme.

6. An isolated nucleic acid molecule having a nucleic acid sequence that hybridizes to nucleotide position 2466 to nucleotide position 3581 of SEQ ID NO:1164 under stringent conditions and encodes a 4HPPD enzyme, wherein said stringent conditions include hybridization in 50% formamide, 1M NaCl, 1% SDS at 37° C., and a wash in 0.1×SSC at 60 to 65° C.

7. A transformed cell comprising the isolated nucleic acid molecule of claim 5.

8. The transformed cell of claim 7, wherein said cell is selected from the group consisting of a bacterial cell, a plant cell, an algal cell, a mammalian cell, an insect cell and a fungal cell.

9. The transformed cell of claim 8, wherein said cell is a plant cell.

10. A transformed cell comprising the isolated nucleic acid molecule of claim 6.

11. The transformed cell of claim 10, wherein said cell is selected from the group consisting of a bacterial cell, a plant cell, an algal cell, a mammalian cell, an insect cell and a fungal cell.

12. The transformed cell of claim 11, wherein said cell is a plant cell.

13. A transformed plant comprising a nucleic acid sequence encoding a 4HPPD enzyme, wherein said nucleic acid sequence is at least 90% identical to the full-length complement of nucleotide position 2466 to nucleotide position 3581 of SEQ ID NO:1164.

14. Progeny of the transformed plant of claim 13, wherein said progeny comprises said nucleic acid sequence.

15. Seed of the transformed plant of claim 13, wherein said seed comprises said nucleic acid sequence.

16. The transformed plant of claim 13, wherein said nucleic acid sequence is at least 95% identical to the full-length complement of nucleotide position 2466 to nucleotide position 3581 of SEQ ID NO:1164.

17. The transformed plant of claim 16, wherein said nucleic acid sequence is 100% identical to the full-length complement of nucleotide position 2466 to nucleotide position 3581 of SEQ ID NO:1164.

18. An isolated nucleic acid molecule having a sequence at least 90% identical to the full-length complement of nucleotide position 2466 to nucleotide position 3581 of SEQ ID NO:1164 and encoding a 4HPPD enzyme.

19. The nucleic acid molecule of claim 18, wherein said sequence is at least 95% identical to the full-length complement of nucleotide position 2466 to nucleotide position 3581 of SEQ ID NO:1164.

\* \* \* \* \*